United States Patent 9,061,059 (MODIFIED POLYNUCLEOTIDES FOR TREATING PROTEIN DEFICIENCY) - sequence listing, part 83

SEQ ID NO: 161345 - DNA, 966 bp, Artificial Sequence
  Description of Artificial Sequence: Synthetic coding sequence
atgtctgagcagagcaaggacctgagtgaccccaactttgctgctgaggcccccaacagcgaggtgcacagcagccctggggtgtctgaaggagtgcccccatctgccaccctggccgagccccagagcccccccctgggccccacagctgccccccaggccgcccccccaccccaggccccaaatgatgaaggagaccccaaggccctgcagcaggccgctgaggagggccgggcccaccaggcccccagcgctgcccagcccggccctgcccccccagccccagcccagctggtgcagaaggcccacgagctgatgtggtacgtgctggtgaaggaccagaagaagatgatcatctggttcccagacatggtgaaggatgtgattggcagctacaagaagtggtgccgcagcatcctgcggaggaccagcctcatcctggcccgggtgtttggcctgcacctgcggctgaccagcctgcacaccatggagtttgccctggtgaaggccctggagcctgaggagctggacagagtggccctgagcaacaggatgcccatgacaggcctgctgctgatgatcctgagcctcatctacgtgaagggccgcggggcccgggagagcgctgtgtggaatgtgctgcgcatcctgggcctgcggccctggaagaagcacagcacctttggagatgtgaggaagctgatcacagaggagtttgtgcagatgaactacctgaagtaccagagggtgccctacgtggagcccccagaatatgagttcttctggggcagccgggccagccgggagatcaccaagatgcagatcatggagttcctggcccgggtcttcaagaaggacccccaggcctggcccagccgctaccgggaggccctggaggaggcccgggccctgcgggaggccaaccccacagcccactaccccaggagctctgtgtctgaggactag

SEQ ID NO: 161346 - DNA, 915 bp, Artificial Sequence
  Description of Artificial Sequence: Synthetic coding sequence
atgctgcagaagcccaggaacagaggccgcagcggcggccaggccgagcgggaccgggactggagccacagcggcaaccctggggccagccgggccggggaggatgcccgggtgctgagagatggctttgctgaggaggcccccagcaccagccggggccctgggggcagccagggcagccagggccccagcccccagggcgcccggcgggcccaggccgccccagctgtgggccccaggagccagaagcagctggagctgaaggtgtctgagctggtgcagttcctgctgatcaaggaccagaagaagatccccatcaagagagctgacatcctgaagcacgtgattggagactacaaggacatcttcccagacctcttcaagagagctgctgagcggctgcagtatgtgtttggctacaagctggtggagctggagcccaagagcaacacctacatcctgatcaacaccctggagcctgtggaggaggatgctgagatgagaggagaccagggcacccccaccaccggcctgctgatgattgtgctgggcctcatcttcatgaagggcaacaccatcaaggagacagaggcctgggacttcctgcggcggctgggcgtgtaccccaccaagaagcacctgatctttggagaccccaagaagctgatcacagaagattttgtgcggcagcgctacctggagtaccgccgcatcccccacacagatcctgtggactatgagttccagtggggccccaggaccaacctggagaccagcaagatgaaggtgctgaagtttgtggccaaggtgcacaaccaggaccccaaggactggccagcccagtactgtgaggccctggctgatgaggagaacagagcccggccccagcccagcggccctgcccccagcagctag

SEQ ID NO: 161347 - DNA, 666 bp, Artificial Sequence
  Description of Artificial Sequence: Synthetic coding sequence
atggccctggccctggccgccctggccgctgtggagcccgcctgtggcagccgctaccagcagctgcagaatgaggaggagagcggggagcctgagcaggccgctggagatgcccccccaccctacagcagcatctctgctgagagcgctgcctactttgactacaaggatgaaagtggcttccccaagccacccagctacaacgtggccaccaccctgcccagctatgatgaagctgagaggaccaaggccgaggccaccatccccctggtgcccggcagagatgaggactttgtgggcagagatgactttgatgatgctgaccagctgagaattggaaatgatggcatcttcatgctgaccttcttcatggccttcctgttcaactggattggcttcttcctgtccttctgcctgaccaccagcgctgctggccgctatggagccatcagcggcttcggcctgagcctcatcaagtggatcctgattgtgcgcttcagcacctacttccctggctactttgatggccagtactggctgtggtgggtgttcctggtgctgggcttcctgctcttcctgcggggcttcatcaactatgccaaggtgaggaagatgcctgagaccttcagcaacctgcccaggaccagggtgctcttcatctactag

SEQ ID NO: 161348 - DNA, 462 bp, Artificial Sequence
  Description of Artificial Sequence: Synthetic coding sequence
atggccctggccctggccgccctggccgctgtggagcccgcctgtggcagccgctaccagcagctgcagaatgaggaggagagcggggagcctgagcaggccgctggagatgcccccccaccctacagcagcatctctgctgagagcgctgcctactttgactacaaggatgaaagtggcttccccaagccacccagctacaacgtggccaccaccctgcccagctgcttctatgacatcagccacctgatcttcttcatcttctacctgaggaacatgaagaagaagtacaccaagatggtgaagctgctgcacaagagcgccccagcccagagcgacagctgcaagtgccccttcatctgctgcgtgtgcatcagccgcatcagcatcggcagccgcagcggctaccagtacatcatgcacaggtctgtgggctgcctgaaggccaagcaggagaactag

SEQ ID NO: 161349 - DNA, 3138 bp, Artificial Sequence
  Description of Artificial Sequence: Synthetic coding sequence
atgcaccagaagaccccagagatctacagcgtggagctgagcggcaccaaggacatcgtgaagacagacaagggagatggcaaggagaagtaccggggcctgaagaacaactgcctggagctgaagaagaagaaccacaaggaggagttccagaaggagctgcacctggatgaccacaagctgagcaaccgggagctggaggagaagtatggaacagacatcatcatgggcctgagcagcaccagggctgctgagctgctggccagagatggccccaacagcctgaccccacccaagcagaccccagagatcgtgaagttcctgaagcagatggtgggcggcttcagcatcctgctgtgggtgggcgccttcctgtgctggatcgcctacggcatccagtacagcagtgacaagagcgccagcctgaacaacgtgtacctgggctgtgtgctgggcctggtggtgatcctgaccggcatctttgcctactaccaggaggccaagagcaccaacatcatgagcagcttcaacaagatgatcccccagcaggccctggtgatccgggacagcgagaagaagaccatccccagcgagcagctggtggtgggggacatcgtggaggtgaagggcggggaccagatcccagctgacatccgggtgctgagcagccagggctgccgggtggacaacagcagcctgaccggggagagcgagccccagcccaggagcagcgagttcacccatgagaaccccctggagaccaagaacatctgcttctacagcaccacctgcctggaggccagcaccagccctgtgggcaccgtgacaggcatggtgatcaacacaggagacaggaccatcatcggccacatcgccagcctggccagcggcgtgggcaatgagaagacccccatcgccattgaaattgagcactttgtgcacatcgtggccggcgtggccgtgtccatcggcatcctcttcttcatcatcgctgtgtccctgaagtaccaggtgctggacagcatcatcttcctgattggcatcatcgtggccaacgtgcctgagggcctgctggccaccgtgacagtgaccctgagcctgacagccaagaggatggccaagaagaactgcctggtgaagaacctggaggccgtggagaccctgggcagcaccagcatcatctgcagcgacaagacaggcaccctgacccagaacaggatgacagtggcccacctgtggtttgacaaccagatctttgtggccgacaccagcgaggaccacagcaaccaggtgtttgaccagagcagcaggacctgggccagcctgagcaagatcatcaccctgtgcaacagagctgagttcaagccaggccaggagaatgtgcccatcatgaagaaggctgtgattggagatgccagcgagacagccctgctgaagttcagcgaggtgatcctgggagatgtgatggagatcaggaagaggaacaggaaggtggccgagatccccttcaacagcaccaacaagttccagctgagcatccacgagatggatgacccccacggcaagcgcttcctgatggtgatgaagggggcccctgagcgcatcctggagaagtgcagcaccatcatgatcaatggagaggagcaccccctggacaagagcacagccaagaccttccacacagcctacatggagctgggcggcctgggggagcgggtgctgggcttctgccacctgtacctgcctgcagatgagttccctgagacctacagctttgatattgatgccatgaacttccccaccagcaacctgtgctttgtgggcctgctgtccatgattgatcctcccaggagcacagtgcctgatgctgtgaccaagtgccgctctgctggcatcaaggtgatcatggtgactggagaccaccccatcacagccaaggccatcgccaagtctgtgggcatcatcagcgccaacagcgagaccgtggaggacatcgcccaccggctgaacattgctgtggagcaggtgaacaagagagatgccaaggctgctgtggtgacaggcatggagctgaaggacatgagcagcgagcagctggatgagatcctggccaactaccaggagatcgtgtttgcccggaccagcccccagcagaagctgatcatcgtggagggctgccagaggcaggatgctgtggtggccgtgactggagatggagtgaatgacagccctgccctgaagaaggctgacattggaattgccatgggcattgctggcagtgatgctgccaagaatgctgctgacatggtgctgctggatgacaactttgccagcatcgtgactggagtggaggagggccgcctcatctttgacaacctgaagaagaccatcgcctacagcctgaccaagaacattgctgagctgtgccccttcctgatctacatcatcgtgggcctgcccctgcccatcggcaccatcaccatcctcttcatcgacctgggcacagacatcatccccagcatcgccctggcctatgagaaggccgagagtgacatcatgaacaggaagcccaggcacaagaacaaggaccggctggtgaaccagcccctggccgtgtacagctacctgcacatcggcctgatgcaggccctgggcgccttcctggtgtacttcaccgtgtatgcccaggagggcttcctgcccaggaccctcatcaacctgcgggtggagtgggagaaggactatgtgaatgacctgaaggacagctatggccaggagtggacccgctaccagcgggagtacctggagtggacaggctacacagccttctttgtgggcatcctggtgcagcagattgctgacctgatcatcaggaagaccaggaggaacagcatcttccagcagggcctcttcaggaacaaggtgatctgggtgggcatcaccagccagatcatcatcggcctcatcctgtcctatggcctgggctctgtgacagccctgtccttcaccatgctgcgggcccagtactggtttgtggccgtgccccacgccatcctgatctgggtgtatgatgaggtgaggaagctgttcatccggctgtacccaggctcctggtgggacaagaacatgtactactag

SEQ ID NO: 161350 - DNA, 1605 bp, Artificial Sequence
  Description of Artificial Sequence: Synthetic coding sequence
atggcccagctgggcaagctgctgaaggagcagaagtatgaccggcagctgcggctgtggggagaccacggccaggaggccctggagagcgcccacgtgtgcctgatcaatgccacagccactggaacagagatcctgaagaacctggtgctgcccggcatcggcagcttcaccatcattgatggcaaccaggtgtctggagaagatgctggcaacaacttcttcctgcagaggagcagcatcggcaagaacagagctgaggccgccatggagttcctgcaggagctgaacagtgatgtgtctggcagctttgtggaggagagccctgagaacctgctggacaatgaccccagcttcttctgccgcttcaccgtggtggtggccacccagctgcctgagagcaccagcctgcggctggctgatgtgctgtggaacagccagatccccctgctgatctgcaggacctacggcctggtgggctacatgaggatcatcatcaaggagcaccctgtgattgagagccacccagacaatgccctggaggacctgcggctggacaagcccttccctgagctgcgggagcacttccagagctatgacctggaccacatggagaagaaggaccacagccacaccccctggatcgtcatcatcgccaagtacctggcccagtggtacagcgagaccaacggccgcatccccaagacctacaaggagaaggaggacttccgggacctgatccggcagggcatcctgaagaatgaaaatggagccccagaagatgaagaaaattttgaggaggccatcaagaatgtgaacacagccctgaacaccacccagatccccagcagcattgaggacatcttcaatgatgaccgctgcatcaacatcaccaagcagacccccagcttctggatcctggcccgggccctgaaggagtttgtggccaaggagggccagggcaacctgcctgtgcggggcaccatcccagacatgattgctgacagcggcaagtacatcaagctgcagaatgtgtaccgggagaaggccaagaaggatgctgctgctgtgggcaaccacgtggccaagctgctgcagagcatcggccaggcccctgagagcatcagcgagaaggagctgaagctgctgtgcagcaacagcgccttcctgcgggtggtgcgctgccgcagcctggccgaggagtatggcctggacaccatcaacaaggatgagatcatcagctccatggacaacccagacaatgaaattgtgctgtacctgatgctgcgggctgtggaccgcttccacaagcagcagggccgctacccaggagtgagcaactaccaggtggaggaggacatcggcaagctgaagagctgcctgaccggcttcctgcaggagtatggcctgtctgtgatggtgaaggatgattatgtgcatgagttctgccgctatggagctgctgagccccacaccatcgccgccttcctgggcggcgctgctgcccaggaggtgatcaagatcatcaccaagcagtttgtgatcttcaacaacacctacatctacagcggcatgagccagaccagcgccaccttccagctgtag

SEQ ID NO: 161351 - DNA, 1587 bp, Artificial Sequence
  Description of Artificial Sequence: Synthetic coding sequence
atggatgcccagcagaccaagaccaatgaggcccggctgtggggagaccacggccaggaggccctggagagcgcccacgtgtgcctgatcaatgccacagccactggaacagagatcctgaagaacctggtgctgcccggcatcggcagcttcaccatcattgatggcaaccaggtgtctggagaagatgctggcaacaacttcttcctgcagaggagcagcatcggcaagaacagagctgaggccgccatggagttcctgcaggagctgaacagtgatgtgtctggcagctttgtggaggagagccctgagaacctgctggacaatgaccccagcttcttctgccgcttcaccgtggtggtggccacccagctgcctgagagcaccagcctgcggctggctgatgtgctgtggaacagccagatccccctgctgatctgcaggacctacggcctggtgggctacatgaggatcatcatcaaggagcaccctgtgattgagagccacccagacaatgccctggaggacctgcggctggacaagcccttccctgagctgcgggagcacttccagagctatgacctggaccacatggagaagaaggaccacagccacaccccctggatcgtcatcatcgccaagtacctggcccagtggtacagcgagaccaacggccgcatccccaagacctacaaggagaaggaggacttccgggacctgatccggcagggcatcctgaagaatgaaaatggagccccagaagatgaagaaaattttgaggaggccatcaagaatgtgaacacagccctgaacaccacccagatccccagcagcattgaggacatcttcaatgatgaccgctgcatcaacatcaccaagcagacccccagcttctggatcctggcccgggccctgaaggagtttgtggccaaggagggccagggcaacctgcctgtgcggggcaccatcccagacatgattgctgacagcggcaagtacatcaagctgcagaatgtgtaccgggagaaggccaagaaggatgctgctgctgtgggcaaccacgtggccaagctgctgcagagcatcggccaggcccctgagagcatcagcgagaaggagctgaagctgctgtgcagcaacagcgccttcctgcgggtggtgcgctgccgcagcctggccgaggagtatggcctggacaccatcaacaaggatgagatcatcagctccatggacaacccagacaatgaaattgtgctgtacctgatgctgcgggctgtggaccgcttccacaagcagcagggccgctacccaggagtgagcaactaccaggtggaggaggacatcggcaagctgaagagctgcctgaccggcttcctgcaggagtatggcctgtctgtgatggtgaaggatgattatgtgcatgagttctgccgctatggagctgctgagccccacaccatcgccgccttcctgggcggcgctgctgcccaggaggtgatcaagatcatcaccaagcagtttgtgatcttcaacaacacctacatctacagcggcatgagccagaccagcgccaccttccagctgtag

SEQ ID NO: 161352 - DNA, 1338 bp, Artificial Sequence
  Description of Artificial Sequence: Synthetic coding sequence
atggagttcctgcaggagctgaacagtgatgtgtctggcagctttgtggaggagagccctgagaacctgctggacaatgaccccagcttcttctgccgcttcaccgtggtggtggccacccagctgcctgagagcaccagcctgcggctggctgatgtgctgtggaacagccagatccccctgctgatctgcaggacctacggcctggtgggctacatgaggatcatcatcaaggagcaccctgtgattgagagccacccagacaatgccctggaggacctgcggctggacaagcccttccctgagctgcgggagcacttccagagctatgacctggaccacatggagaagaaggaccacagccacaccccctggatcgtcatcatcgccaagtacctggcccagtggtacagcgagaccaacggccgcatccccaagacctacaaggagaaggaggacttccgggacctgatccggcagggcatcctgaagaatgaaaatggagccccagaagatgaggagaactttgaggaggccatcaagaatgtgaacacagccctgaacaccacccagatccccagcagcattgaggacatcttcaatgatgaccgctgcatcaacatcaccaagcagacccccagcttctggatcctggcccgggccctgaaggagtttgtggccaaggagggccagggcaacctgcctgtgcggggcaccatcccagacatgattgctgacagcggcaagtacatcaagctgcagaatgtgtaccgggagaaggccaagaaggatgctgctgctgtgggcaaccacgtggccaagctgctgcagagcatcggccaggcccctgagagcatcagcgagaaggagctgaagctgctgtgcagcaacagcgccttcctgcgggtggtgcgctgccgcagcctggccgaggagtatggcctggacaccatcaacaaggatgagatcatcagctccatggacaacccagacaatgagatcgtgctgtacctgatgctgcgggctgtggaccgcttccacaagcagcagggccgctacccaggagtgagcaactaccaggtggaggaggacatcggcaagctgaagagctgcctgaccggcttcctgcaggagtatggcctgtctgtgatggtgaaggatgattatgtgcatgagttctgccgctacggggctgctgagccccacaccatcgccgccttcctgggcggggccgccgcccaggaggtgatcaagatcatcaccaagcagtttgtgatcttcaacaacacctacatctacagcggcatgagccagaccagcgccaccttccagctgtag

SEQ ID NO: 161353 - DNA, 2901 bp, Artificial Sequence
  Description of Artificial Sequence: Synthetic coding sequence
atggagccccaggtgaccctgaatgtgaccttcaagaatgagatccagagcttcctggtgtctgaccctgagaacaccacctgggccgacatcgaggccatggtgaaggtgtcctttgacctgaacaccatccagatcaagtacctggatgaggagaatgaggaggtgtccatcaacagccagggcgagtatgaggaggccctgaagatggctgtgaagcagggcaaccagctgcagatgcaggtgcatgagggccaccacgtggtggatgaggcccctcctcctgtggtgggcgccaagaggctggccgcccgggccggcaagaagcccctggcccactacagcagcctggtgcgggtgctgggcagtgacatgaagaccccagaagatcctgctgtgcagagcttccccctggtgccctgtgacacagaccagccccaggacaagcccccagactggttcaccagctacctggagaccttccgggagcaggtggtgaatgaaacagtggagaagctggagcagaagctgcacgagaagctggtgctgcagaaccccagcctgggcagctgccccagcgaggtgtccatgcccaccagcgaggagaccctcttcctgcctgagaaccagttctcctggcacatcgcctgcaacaactgccagaggcgcatcgtgggcgtgcgctaccagtgcagcctgtgccccagctacaacatctgtgaggactgtgaggccggcccctacggccatgacaccaaccacgtgctgctgaagctgcggcggcctgtggtgggcagcagcgagcccttctgccacagcaagtacagcaccccccggctgcctgctgccctggagcaggtgcggctgcagaagcaggtggacaagaacttcctgaaggccgagaagcagaggctgcgggcagagaagaagcagaggaaggccgaggtgaaggagctgaagaagcagctgaagctgcacaggaagatccacctgtggaacagcatccacggcctgcagagccccaagagccccctgggccggcctgagagcctgctgcagagcaacaccctgatgctgcccctgcagccctgcacctctgtgatgcccatgctgtctgctgcctttgtggatgagaacctgcctgatggcacccacctgcagcccggcaccaagttcatcaagcactggaggatgaagaacacaggaaatgtgaagtggagcgctgacaccaagctgaagttcatgtggggcaacctgaccctggccagcacagagaagaaggatgtgctggtgccctgcctgaaggccggccacgtgggcgtggtgtctgtggagttcatcgccccagccctggagggcacctacaccagccactggaggctgagccacaagggccagcagtttggcccccgggtgtggtgcagcatcatcgtggaccccttccccagcgaggagagcccagacaacatcgagaagggcatgatcagcagcagcaagacagatgacctgacctgccagcaggaggagaccttcctgctggccaaggaggagcggcagctgggggaggtgacagagcagacagagggcacagctgcctgcatcccccagaaggccaagaatgtggccagcgagcgggagctgtacatccccagcgtggacctgctgacagcccaggacctgctgagctttgagctgctggacatcaacatcgtgcaggagctggagcgggtgccccacaacacccctgtggatgtgaccccctgcatgagccccctgccccatgacagccccctgattgagaagccaggcctgggccagatcgaggaggagaatgaaggagctggcttcaaggccctgcctgacagcatggtgtctgtgaagaggaaggcagaaaatattgcctctgtggaggaggccgaggaggacctgagcggcacccagtttgtgtgtgagaccgtcatccgcagcctgaccctggatgctgccccagaccacaaccccccctgccggcagaagagcctgcagatgacctttgccctgcctgagggccccctgggcaatgagaaggaggagatcatccacatcgccgaggaggaggccgtgatggaggaggaggaggatgaagaagatgaggaggaggaggatgagctgaaggatgaggtgcagagccagagcagcgccagcagcgaggactacatcatcatcctgcctgagtgctttgacaccagccggcccctgggggacagcatgtacagcagcgccctgagccagcccggcctggagagaggagctgagggcaagccaggagtggaggccggccaggagcctgctgaggccggggagcggctgcctggaggagagaaccagccccaggagcacagcatcagtgacatcctgaccaccagccagaccctggagaccgtgcccctcatccctgaggtggtggagctgccccccagcctgcccaggagcagcccctgtgtgcaccaccacggcagccctggggtggacctgcctgtgaccatccctgaggtgtcctctgtgcctgaccagatccggggggagccccggggcagcagcggcctggtgaacagccggcagaagagctatgaccacagccgccaccaccacggcagcagcattgctgggggcctggtgaagggggccctgtctgtggccgccagcgcctacaaggccctgtttgctggcccccctgtgacagcccagcccatcatcagcgaggaccagacagctgccctgatggcccacctgtttgagatgggcttctgtgaccggcagctgaacctgcggctgctgaagaagcacaactacaacatcctgcaggtggtgacagagctgctgcagctgaacaacaatgactggtacagccagcgctactag

SEQ ID NO: 161354 - DNA, 2814 bp, Artificial Sequence
  Description of Artificial Sequence: Synthetic coding sequence
atggagccccaggtgaccctgaatgtgaccttcaagaatgagatccagagcttcctggtgtctgaccctgagaacaccacctgggccgacatcgaggccatggtgaaggtgtcctttgacctgaacaccatccagatcaagtacctggatgaggagaatgaggaggtgaagatcgtgctgctgggggagtatgaggaggccctgaagatggctgtgaagcagggcaaccagctgcagatgcaggtgcatgagggccaccacgtggtggatgaggcccctcctcctgtggtgggcgccaagaggctggccgcccgggccggcaagaagcccctggcccactacagcagcctggtgcgggtgctgggcagtgacatgaagaccccagaagatcctgctgtgcagagcttccccctggtgccctgtgacacagaccagccccaggacaagcccccagactggttcaccagctacctggagaccttccgggagcaggtggtgaatgaaacagtggagaagctggagcagaagctgcacgagaagctggtgctgcagaaccccagcctgggcagctgccccagcgaggtgtccatgcccaccagcgaggagaccctcttcctgcctgagaaccagttctcctggcacatcgcctgcaacaactgccagaggcgcatcgtgggcgtgcgctaccagtgcagcctgtgccccagctacaacatctgtgaggactgtgaggccggcccctacggccatgacaccaaccacgtgctgctgaagctgcggcggcctgtggtgggcagcagcgagcccttctgccacagcaagtacagcaccccccggctgcctgctgccctggagcaggtgcggctgcagaagcaggtggacaagaacttcctgaaggccgagaagcagaggctgcgggcagagaagaagcagaggaaggccgaggtgaaggagctgaagaagcagctgaagctgcacaggaagatccacctgtggaacagcatccacggcctgcagagccccaagagccccctgggccggcctgagagcctgctgcagagcaacaccctgatgctgcccctgcagccctgcacctctgtgatgcccatgctgtctgctgcctttgtggatgagaacctgcctgatggcacccacctgcagcccggcaccaagttcatcaagcactggaggatgaagaacacaggaaatgtgaagtggagcgctgacaccaagctgaagttcatgtggggcaacctgaccctggccagcacagagaagaaggatgtgctggtgccctgcctgaaggccggccacgtgggcgtggtgtctgtggagttcatcgccccagccctggagggcacctacaccagccactggaggctgagccacaagggccagcagtttggcccccgggtgtggtgcagcatcatcgtggaccccttccccagcgaggagagcccagacaacatcgagaagggcatgatcagcagcagcaagacagatgacctgacctgccagcaggaggagaccttcctgctggccaaggaggagcggcagctgggggaggtgacagagcagacagagggcacagctgcctgcatcccccagaaggccaagaatgtggccagcgagcgggagctgtacatccccagcgtggacctgctgacagcccaggacctgctgagctttgagctgctggacatcaacatcgtgcaggagctggagcgggtgccccacaacacccctgtggatgtgaccccctgcatgagccccctgccccatgacagccccctgattgagaagccaggcctgggccagatcgaggaggagaatgaaggagctggcttcaaggccctgcctgacagcatggtgtctgtgaagaggaaggcagaaaatattgcctctgtggaggaggccgaggaggacctgagcggcacccagtttgtgtgtgagaccgtcatccgcagcctgaccctggatgctgccccagaccacaaccccccctgccggcagaagagcctgcagatgacctttgccctgcctgagggccccctgggcaatgagaaggaggagatcatccacatcgccgaggaggaggccgtgatggaggaggaggaggatgaagaagatgaggaggaggaggatgagctgaaggatgaggtgcagagccagagcagcgccagcagcgaggactacatcatcatcctgcctgagtgctttgacaccagccggcccctgggggacagcatgtacagcagcgccctgagccagcccggcctggagagaggagctgagggcaagccaggagtggaggccggccaggagcctgctgaggccggggagcggctgcctggaggagagaaccagccccaggagcacagcatcagtgacatcctgaccaccagccagaccctggagaccgtgcccctcatccctgaggtggtggagctgccccccagcctgcccaggagcagcccctgtgtgcaccaccacggcagccctggggtggacctgcctgtgaccatccctgaggtgtcctctgtgcctgaccagatccggggggagccccggggcagcagcggcctggtgaacagccggcagaagagctatgaccacagccgccaccaccacggcagcagcattgctgggggcctggtgaagggggccctgtctgtggccgccagcgcctacaaggccctgtttgctggcccccctgtgacagcccagggcctgtggggcctgctgtccttcctgcacctggccaagaagtgcttcttcctgaaggcccccagcgaggccttctcctggttctag

SEQ ID NO: 161355 - DNA, 2901 bp, Artificial Sequence
  Description of Artificial Sequence: Synthetic coding sequence
atggagccccaggtgaccctgaatgtgaccttcaagaatgagatccagagcttcctggtgtctgaccctgagaacaccacctgggccgacatcgaggccatggtgaaggtgtcctttgacctgaacaccatccagatcaagtacctggatgaggagaatgaggaggtgaagatcgtgctgctgggggagtatgaggaggccctgaagatggctgtgaagcagggcaaccagctgcagatgcaggtgcatgagggccaccacgtggtggatgaggcccctcctcctgtggtgggcgccaagaggctggccgcccgggccggcaagaagcccctggcccactacagcagcctggtgcgggtgctgggcagtgacatgaagaccccagaagatcctgctgtgcagagcttccccctggtgccctgtgacacagaccagccccaggacaagcccccagactggttcaccagctacctggagaccttccgggagcaggtggtgaatgaaacagtggagaagctggagcagaagctgcacgagaagctggtgctgcagaaccccagcctgggcagctgccccagcgaggtgtccatgcccaccagcgaggagaccctcttcctgcctgagaaccagttctcctggcacatcgcctgcaacaactgccagaggcgcatcgtgggcgtgcgctaccagtgcagcctgtgccccagctacaacatctgtgaggactgtgaggccggcccctacggccatgacaccaaccacgtgctgctgaagctgcggcggcctgtggtgggcagcagcgagcccttctgccacagcaagtacagcaccccccggctgcctgctgccctggagcaggtgcggctgcagaagcaggtggacaagaacttcctgaaggccgagaagcagaggctgcgggcagagaagaagcagaggaaggccgaggtgaaggagctgaagaagcagctgaagctgcacaggaagatccacctgtggaacagcatccacggcctgcagagccccaagagccccctgggccggcctgagagcctgctgcagagcaacaccctgatgctgcccctgcagccctgcacctctgtgatgcccatgctgtctgctgcctttgtggatgagaacctgcctgatggcacccacctgcagcccggcaccaagttcatcaagcactggaggatgaagaacacaggaaatgtgaagtggagcgctgacaccaagctgaagttcatgtggggcaacctgaccctggccagcacagagaagaaggatgtgctggtgccctgcctgaaggccggccacgtgggcgtggtgtctgtggagttcatcgccccagccctggagggcacctacaccagccactggaggctgagccacaagggccagcagtttggcccccgggtgtggtgcagcatcatcgtggaccccttccccagcgaggagagcccagacaacatcgagaagggcatgatcagcagcagcaagacagatgacctgacctgccagcaggaggagaccttcctgctggccaaggaggagcggcagctgggggaggtgacagagcagacagagggcacagctgcctgcatcccccagaaggccaagaatgtggccagcgagcgggagctgtacatccccagcgtggacctgctgacagcccaggacctgctgagctttgagctgctggacatcaacatcgtgcaggagctggagcgggtgccccacaacacccctgtggatgtgaccccctgcatgagccccctgccccatgacagccccctgattgagaagccaggcctgggccagatcgaggaggagaatgaaggagctggcttcaaggccctgcctgacagcatggtgtctgtgaagaggaaggcagaaaatattgcctctgtggaggaggccgaggaggacctgagcggcacccagtttgtgtgtgagaccgtcatccgcagcctgaccctggatgctgccccagaccacaaccccccctgccggcagaagagcctgcagatgacctttgccctgcctgagggccccctgggcaatgagaaggaggagatcatccacatcgccgaggaggaggccgtgatggaggaggaggaggatgaagaagatgaggaggaggaggatgagctgaaggatgaggtgcagagccagagcagcgccagcagcgaggactacatcatcatcctgcctgagtgctttgacaccagccggcccctgggggacagcatgtacagcagcgccctgagccagcccggcctggagagaggagctgagggcaagccaggagtggaggccggccaggagcctgctgaggccggggagcggctgcctggaggagagaaccagccccaggagcacagcatcagtgacatcctgaccaccagccagaccctggagaccgtgcccctcatccctgaggtggtggagctgccccccagcctgcccaggagcagcccctgtgtgcaccaccacggcagccctggggtggacctgcctgtgaccatccctgaggtgtcctctgtgcctgaccagatccggggggagccccggggcagcagcggcctggtgaacagccggcagaagagctatgaccacagccgccaccaccacggcagcagcattgctgggggcctggtgaagggggccctgtctgtggccgccagcgcctacaaggccctgtttgctggcccccctgtgacagcccagcccatcatcagcgaggaccagacagctgccctgatggcccacctgtttgagatgggcttctgtgaccggcagctgaacctgcggctgctgaagaagcacaactacaacatcctgcaggtggtgacagagctgctgcagctgaacaacaatgactggtacagccagcgctactag

SEQ ID NO: 161356 - DNA, 2901 bp, Artificial Sequence; identical to SEQ ID NO: 161353
  Description of Artificial Sequence: Synthetic coding sequence

SEQ ID NO: 161357 - DNA, 654 bp, Artificial Sequence
  Description of Artificial Sequence: Synthetic coding sequence
atgtacagcagcgccctgagccagcccggcctggagagaggagctgagggcaagccaggagtggaggccggccaggagcctgctgaggccggggagcggctgcctggaggagagaaccagccccaggagcacagcatcagtgacatcctgaccaccagccagaccctggagaccgtgcccctcatccctgaggtggtggagctgccccccagcctgcccaggagcagcccctgtgtgcaccaccacggcagccctggggtggacctgcctgtgaccatccctgaggtgtcctctgtgcctgaccagatccggggggagccccggggcagcagcggcctggtgaacagccggcagaagagctatgaccacagccgccaccaccacggcagcagcattgctgggggcctggtgaagggggccctgtctgtggccgccagcgcctacaaggccctgtttgctggcccccctgtgacagcccagcccatcatcagcgaggaccagacagctgccctgatggcccacctgtttgagatgggcttctgtgaccggcagctgaacctgcggctgctgaagaagcacaactacaacatcctgcaggtggtgacagagctgctgcagctgaacaacaatgactggtacagccagcgctactag

SEQ ID NO: 161358 - DNA, 2514 bp, Artificial Sequence
  Description of Artificial Sequence: Synthetic coding sequence
atggagccccaggtgaccctgaatgtgaccttcaagaatgagatccagagcttcctggtgtctgaccctgagaacaccacctgggccgacatcgaggccatggtgtccatcaacagccagggcgagtatgaggaggccctgaagatggctgtgaagcagggcaaccagctgcagatgcaggtgcatgagggccaccacgtggtggatgaggcccctcctcctgtggtgggcgccaagaggctggccgcccgggccggcaagaagcccctggcccactacagcagcctggtgcgggtgctgggcagtgacatgaagaccccagaggaccctgctgtgcagagcttccccctggtgccctgtgacacagaccagccccaggacaagcccccagactggttcaccagctacctggagaccttccgggagcaggtggtgaatgagaccgtggagaagctggagcagaagctgcacgagaagctggtgctgcagaaccccagcctgggcagctgccccagcgaggtgtccatgcccaccagcgaggagaccctcttcctgcctgagaaccagttctcctggcacatcgcctgcaacaactgccagaggagaattgtgggcgtgcgctaccagtgcagcctgtgccccagctacaacatctgtgaggactgtgaggccggcccctacggccatgacaccaaccacgtgctgctgaagctgcggcggcctgtggtgggcagcagcgagcccttctgccacagcaagtacagcaccccccggctgcctgctgccctggagcaggtgcggctgcagaagcaggtggacaagaacttcctgaaggccgagaagcagaggctgcgggcagagaagaagcagaggaaggccgaggtgaaggagctgaagaagcagctgaagctgcacaggaagatccacctgtggaacagcatccacggcctgcagagccccaagagccccctgggccggcctgagagcctgctgcagagcaacaccctgatgctgcccctgcagccctgcacctctgtgatgcccatgctgtctgctgcctttgtggatgagaacctgcctgatggcacccacctgcagcccggcaccaagttcatcaagcactggaggatgaagaacacaggaaatgtgaagtggagcgctgacaccaagctgaagttcatgtggggcaacctgaccctggccagcacagagaagaaggatgtgctggtgccctgcctgaaggccggccacgtgggcgtggtgtctgtggagttcatcgccccagccctggagggcacctacaccagccactggaggctgagccacaagggccagcagtttggcccccgggtgtggtgcagcatcatcgtggaccccttccccagcgaggagagcccagacaacatcgagaagggcatgatcagcagcagcaagacagatgacctgacctgccagcaggaggagaccttcctgctggccaaggaggagcggcagctgggggaggtgacagagcagacagagggcacagctgcctgcatcccccagaaggccaagaatgtggccagcgagcgggagctgtacatccccagcgtggacctgctgacagcccaggacctgctgagctttgagctgctggacatcaacatcgtgcaggagctggagcgggtgccccacaacacccctgtggatgtgaccccctgcatgagccccctgccccatgacagccccctcatcgagaagccaggcctgggccagatcgaggaggagaatgaaggagctggcttcaaggccctgcctgacagcatggtgtctgtgaagaggaaggccgagaacatcgcctctgtggaggaggccgaggaggacctgagcggcacccagtttgtgtgtgaaacagtcatccgcagcctgaccctggatgctgccccagaccacaaccccccctgccggcagaagagcctgcagatgacctttgccctgcctgagggccccctgggcaatgagaaggaggagatcatccacatcgccgaggaggaggccgtgatggaggaggaggaggatgaggaggatgaggaggaggaggatgagctgaaggatgaggtgcagagccagagcagcgccagcagcgaggactacatcatcatcctgcctgaatgttttgacaccagccggcccctgggggacagcatgtacagcagcgccctgagccagcccggcctggagagaggagctgagggcaagccaggagtggaggccggccaggagcctgctgaggccggggagcggctgcctggaggagagaaccagccccaggagcacagcatcagtgacatcctgaccaccagccagaccctggagaccgtgcccctcatccctgaggtggtggagctgccccccagcctgcccaggagcagcccctgtgtgcaccaccacggcagccctggggtggacctgcctgtgaccatccctgaggtgtcctctgtgcctgaccagatccggggggccaacaacttctag

SEQ ID NO: 161359 - DNA, 2262 bp, Artificial Sequence
  Description of Artificial Sequence: Synthetic coding sequence
atgcccatggacctgatcctggtggtgtggttctgtgtgtgcacagccaggacagtggtgggcttcggcatggaccctgacctgcagatggacatcgtgacagagctggacctggtgaacaccaccctgggcgtggcccaggtgtctggcatgcacaatgccagcaaggccttcctgttccaggacatcgagcgggagatccatgctgccccccacgtgtctgagaagctgatccagctgttcaggaacaagtctgagttcaccatcctggccaccgtgcagcagaagcccagcaccagcggggtcatcctgagcatccgggagctggagcaccgcatctatgaaagagtcatcgaccccccagacaccaacctgcccccaggcatcaacctgtggctgggccagaggaaccagaagcacggcctcttcaagggcatcatccaggacggcaagatcatcttcatgcccaacggctacatcacccagtgccccaacctgaaccacacctgccccacctgcagcgacttcctgagcctggtgcagggcatcatggacctgcaggagctgctggccaagatgacagccaagctgaactatgcagagacccggctgagccagctggagaactgccactgtgagaagacctgccaggtgtctggcctgctgtacagagaccaggacagctgggtggatggagaccactgcaggaactgcacctgcaagagcggggctgtggagtgcaggaggatgagctgcccccccctgaactgcagcccagacagcctgcctgtgcacatcgccggccagtgctgcaaggtgtgccggcccaagtgcatctacggcggcaaggtgctggccgagggccagaggatcctgaccaagagctgccgggagtgccggggcggcgtgctggtgaagatcacagagatgtgcccccccctgaactgcagcgagaaggaccacatcctgcctgagaaccagtgctgccgggtgtgccggggccacaacttctgtgccgagggccccaagtgtggggagaacagcgagtgcaagaactggaacaccaaggccacctgtgagtgcaagagcggctacatctctgtgcagggcgacagcgcctactgtgaggacattgatgaatgtgccgccaagatgcactactgccacgccaacacagtgtgtgtgaacctgcccggcctgtaccgctgtgactgtgtgcccggctacatccgggtggatgacttcagctgcacagaacatgatgaatgtggcagcggccagcacaactgtgatgaaaatgccatctgcaccaacacagtgcagggccacagctgcacctgcaagccaggctacgtgggcaatggcaccatctgccgggccttctgtgaggagggctgccgctatggaggcacctgtgtggcccccaacaagtgtgtgtgccccagcggcttcaccggcagccactgtgagaaggacattgatgaatgttctgagggcatcatcgagtgccacaaccacagccgctgtgtgaacctgcccggctggtaccactgtgaatgtcgcagcggcttccatgatgatggcacctacagcctgtctggagagagctgcatcgacattgatgaatgtgccctgcggacccacacctgctggaatgacagcgcctgcatcaacctggccggcggctttgactgcctgtgccccagcggccccagctgcagcggggactgcccccatgaaggaggcctgaagcacaacggccaggtgtggaccctgaaggaggaccgctgcagcgtgtgcagctgcaaggatggcaagatcttctgcagaagaacagcctgtgactgccagaaccccagcgctgacctcttctgctgcccagaatgtgacaccagggtgaccagccagtgcctggaccagaatggccacaagctgtaccgcagcggggacaactggacccacagctgccagcagtgccgctgcctggagggggaggtggactgctggcccctgacctgccccaacctgagctgtgagtacacagccatcctggagggggagtgctgcccccgctgtgtgtctgacccctgcctggccgacaacatcacctatgacatcaggaagacctgcctggacagctatggagtgtcccggctgagcggctctgtgtggaccatggccggcagcccctgcaccacctgcaagtgcaagaatggccgggtgtgctgcagcgtggactttgagtgcctgcagaacaactag

SEQ ID NO: 161360 - DNA, 2433 bp, Artificial Sequence
  Description of Artificial Sequence: Synthetic coding sequence
atgcccatggacctgatcctggtggtgtggttctgtgtgtgcacagccaggacagtggtgggcttcggcatggaccctgacctgcagatggacatcgtgacagagctggacctggtgaacaccaccctgggcgtggcccaggtgtctggcatgcacaatgccagcaaggccttcctgttccaggacatcgagcgggagatccatgctgccccccacgtgtctgagaagctgatccagctgttcaggaacaagtctgagttcaccatcctggccaccgtgcagcagaagcccagcaccagcggggtcatcctgagcatccgggagctggagcacagctactttgagctggagagcagcggcctgagagatgagatccgctaccactacatccacaacgggaagcccaggacagaggccctgccctacaggatggctgatggccagtggcacaaggtggccctgtctgtgtctgccagccacctgctgctgcacgtggactgcaaccgcatctatgagcgggtgattgatcctccagacaccaacctgcccccaggcatcaacctgtggctgggccagaggaaccagaagcacggcctcttcaagggcatcatccaggacggcaagatcatcttcatgcccaacggctacatcacccagtgccccaacctgaaccacacctgccccacctgcagcgacttcctgagcctggtgcagggcatcatggacctgcaggagctgctggccaagatgacagccaagctgaactatgcagagacccggctgagccagctggagaactgccactgtgagaagacctgccaggtgtctggcctgctgtacagagaccaggacagctgggtggatggagaccactgcaggaactgcacctgcaagtctggagctgtggagtgcaggaggatgagctgcccccccctgaactgcagcccagacagcctgcctgtgcacatcgccggccagtgctgcaaggtgtgccggcccaagtgcatctatggaggcaaggtgctggccgagggccagaggatcctgaccaagagctgcagagaatgtcggggcggcgtgctggtgaagatcacagagatgtgcccccccctgaactgcagcgagaaggaccacatcctgcctgagaaccagtgctgccgggtgtgccggggccacaacttctgtgccgagggccccaagtgtggagaaaattctgagtgcaagaactggaacaccaaggccacctgtgagtgcaagagcggctacatctctgtgcagggcgacagcgcctactgtgaagatattgatgaatgtgccgccaagatgcactactgccacgccaacacagtgtgtgtgaacctgcccggcctgtaccgctgtgactgtgtgcccggctacatccgggtggatgacttcagctgcacagaacatgatgaatgtggcagcggccagcacaactgtgatgaaaatgccatctgcaccaacacagtgcagggccacagctgcacctgcaagccaggctacgtgggcaatggcaccatctgccgggccttctgtgaggagggctgccgctatggaggcacctgtgtggcccccaacaagtgtgtgtgccccagcggcttcaccggcagccactgtgagaaggacattgatgagtgcagcgagggcatcatcgagtgccacaaccacagccgctgtgtgaacctgcccggctggtaccactgtgagtgccgcagcggcttccatgatgatggcacctacagcctgagcggggagagctgcattgatattgatgaatgtgccctgcggacccacacctgctggaatgattctgcctgcatcaacctggccggcggctttgactgcctgtgccccagcggccccagctgcagcggggactgcccccatgagggcggcctgaagcacaacggccaggtgtggaccctgaaggaggaccgctgcagcgtgtgcagctgcaaggatggcaagatcttctgcagaagaacagcctgtgactgccagaaccccagcgctgacctcttctgctgcccagaatgtgacaccagggtgaccagccagtgcctggaccagaatggccacaagctgtacagaagtggggacaactggacccacagctgccagcagtgccgctgcctggagggggaggtggactgctggcccctgacctgccccaacctgagctgtgagtacacagccatcctggagggggagtgctgcccccgctgtgtgtctgacccctgcctggccgacaacatcacctatgacatcaggaagacctgcctggacagctatggagtgtcccggctgagcggctctgtgtggaccatggccggcagcccctgcaccacctgcaagtgcaagaatggccgggtgtgctgcagcgtggactttgaatgtctgcagaacaactag

SEQ ID NO: 161361 - DNA, 2292 bp, Artificial Sequence
  Description of Artificial Sequence: Synthetic coding sequence
atgcccatggacctgatcctggtggtgtggttctgtgtgtgcacagccaggacagtggtgggcttcggcatggaccctgacctgcagatggacatcgtgacagagctggacctggtgaacaccaccctgggcgtggcccaggtgtctggcatgcacaatgccagcaaggccttcctgttccaggacatcgagcgggagatccatgctgccccccacgtgtctgagaagctgatccagctgttcaggaacaagtctgagttcaccatcctggccaccgtgcagcagaagcccagcaccagcggggtcatcctgagcatccgggagctggagcacagctactttgagctggagagcagcggcctgagagatgagatccgctaccactacatccacaacgggaagcccaggacagaggccctgccctacaggatggctgatggccagtggcacaaggtggccctgtctgtgtctgccagccacctgctgctgcacgtggactgcaaccgcatctatgagcgggtgattgatcctccagacaccaacctgcccccaggcatcaacctgtggctgggccagaggaaccagaagcacggcctcttcaagggcatcatccaggacggcaagatcatcttcatgcccaacggctacatcacccagtgccccaacctgaaccacacctgccccacctgcagcgacttcctgagcctggtgcagggcatcatggacctgcaggagctgctggccaagatgacagccaagctgaactatgcagagacccggctgagccagctggagaactgccactgtgagaagacctgccaggtgtctggcctgctgtacagagaccaggacagctgggtggatggagaccactgcaggaactgcacctgcaagtctggagctgtggagtgcaggaggatgagctgcccccccctgaactgcagcccagacagcctgcctgtgcacatcgccggccagtgctgcaaggtgtgccggcccaagtgcatctatggaggcaaggtgctggccgagggccagaggatcctgaccaagagctgcagagaatgtcggggcggcgtgctggtgaagatcacagagatgtgcccccccctgaactgcagcgagaaggaccacatcctgcctgagaaccagtgctgccgggtgtgccggggccacaacttctgtgccgagggccccaagtgtggagaaaattctgagtgcaagaactggaacaccaaggccacctgtgagtgcaagagcggctacatctctgtgcagggcgacagcgcctactgtgaagatattgatgaatgtgccgccaagatgcactactgccacgccaacacagtgtgtgtgaacctgcccggcctgtaccgctgtgactgtgtgcccggctacatccgggtggatgacttcagctgcacagaacatgatgaatgtggcagcggccagcacaactgtgatgaaaatgccatctgcaccaacacagtgcagggccacagctgcacctgcaagccaggctacgtgggcaatggcaccatctgccgggccttctgtgaggagggctgccgctatggaggcacctgtgtggcccccaacaagtgtgtgtgccccagcggcttcaccggcagccactgtgagaaggacattgatgaatgtgccctgcggacccacacctgctggaatgacagcgcctgcatcaacctggccggcggctttgactgcctgtgccccagcggccccagctgcagcggggactgcccccatgaaggaggcctgaagcacaacggccaggtgtggaccctgaaggaggaccgctgcagcgtgtgcagctgcaaggatggcaagatcttctgcagaagaacagcctgtgactgccagaaccccagcgctgacctcttctgctgcccagaatgtgacaccagggtgaccagccagtgcctggaccagaatggccacaagctgtaccgcagcggggacaactggacccacagctgccagcagtgccgctgcctggagggggaggtggactgctggcccctgacctgccccaacctgagctgtgagtacacagccatcctggagggggagtgctgcccccgctgtgtgtctgacccctgcctggccgacaacatcacctatgacatcaggaagacctgcctggacagctatggagtgtcccggctgagcggctctgtgtggaccatggccggcagcccctgcaccacctgcaagtgcaagaatggccgggtgtgctgcagcgtggactttgagtgcctgcagaacaactag

SEQ ID NO: 161362 - DNA, 2520 bp, Artificial Sequence
  Description of Artificial Sequence: Synthetic coding sequence
atgagcatccggcggctgctgatcctgatcctgaagattggaagacgctggacagagctgatccgcaccatggagagccgggtgctgctgcggaccttctgcctgatcttcggcctgggcgctgtgtggggcctgggcgtggaccccagcctgcagattgatgtgctgacagagctggagctgggggagagcaccaccggggtgcggcaggtgcccggcctgcacaacggcaccaaggccttcctgttccaggacacccccaggagcatcaaggccagcacagccacagctgagcagttcttccagaagctgaggaacaagcatgagttcaccatcctggtgaccctgaagcagacccacctgaacagcggggtcatcctgagcatccaccacctggaccaccgctacctggagctggagagcagcggccacagaaatgaggtgcggctgcactaccgcagcggcagccaccggccccacacagaggtgttcccctacatcctggctgatgacaagtggcacaagctgagcctggccatcagcgccagccacctgatcctgcacatcgactgcaacaagatctatgagcgggtggtggagaagcccagcacagacctgcccctgggcaccaccttctggctgggccagagaaataatgcccacggctacttcaagggcatcatgcaggatgtgcagctgctggtgatgccccagggcttcatcgcccagtgcccagacctgaacagaacctgccccacctgcaatgacttccacggcctggtgcagaagatcatggagctgcaggacatcctggccaagaccagcgccaagctgagcagagctgagcagaggatgaaccggctggaccagtgctactgtgagaggacctgcaccatgaagggcaccacctaccgggagtttgagagctggattgatggctgcaagaactgcacctgcctgaatggcaccatccagtgtgagaccctcatctgccccaacccagactgccccctgaagagcgccctggcctacgtggatggcaagtgctgcaaggagtgcaagagcatctgccagttccagggccgcacctactttgaaggagagaggaacacagtgtacagcagcagcggcgtgtgtgtgctgtatgagtgcaaggaccagaccatgaagctggtggagagcagcggctgcccagccctggactgcccagagagccaccagatcaccctgagccacagctgctgcaaggtgtgcaagggctatgacttctgcagcgagcggcacaactgcatggagaacagcatctgcaggaacctgaatgacagagctgtgtgcagctgcagagatggcttccgggccctgcgggaggacaatgcctactgtgaggacattgatgaatgtgccgagggccgccactactgccgggagaacaccatgtgtgtgaacaccccaggcagcttcatgtgcatctgcaagacaggctacatcagaattgatgactacagctgcacagaacatgatgagtgcatcaccaaccagcacaactgtgatgaaaatgccctgtgcttcaacacagtgggcggccacaactgtgtgtgcaagccaggctacacaggaaatggcaccacctgcaaggccttctgcaaggatggctgcagaaatggaggagcctgcatcgccgccaacgtgtgtgcctgcccccagggcttcaccggccccagctgtgaaacagacattgatgaatgttctgatggctttgtgcagtgtgacagccgggccaactgcatcaacctgcccggctggtaccactgtgaatgtagagatggctaccatgacaatggcatgttcagccccagcggggagagctgtgaggacattgatgaatgtggcaccggccgccacagctgtgccaatgacaccatctgcttcaacctggatggcggctatgactgccgctgcccccacggcaagaactgcaccggggactgcatccatgatggcaaggtgaagcacaacggccagatctgggtgctggagaatgaccgctgcagcgtgtgcagctgccagaatggatttgtgatgtgcaggaggatggtgtgtgactgtgagaaccccaccgtggacctcttctgctgcccagaatgtgacccccggctgagcagccagtgcctgcaccagaatggagagaccctgtacaacagcggggacacctgggtgcagaactgccagcagtgccgctgcctgcagggcgaggtggactgctggcccctgccctgcccagatgtggagtgtgagttcagcatcctgcctgaaaatgaatgctgcccccgctgtgtgacagacccctgccaggccgacaccatcagaaatgacatcaccaagacctgcctggatgagatgaatgtggtgcgcttcaccggcagctcctggatcaagcatggaacagagtgcaccctgtgccagtgcaagaatggccacatctgctgcagcgtggacccccagtgcctgcaggagctgtag

SEQ ID NO: 161363 - DNA, 2448 bp, Artificial Sequence
  Description of Artificial Sequence: Synthetic coding sequence
atggagaccggcctgggcgcccccctcttcaaggcctggctgctgatctctgtgtggggcctgggcgtggaccccagcctgcagattgatgtgctgacagagctggagctgggggagagcaccaccggggtgcggcaggtgcccggcctgcacaacggcaccaaggccttcctgttccaggacacccccaggagcatcaaggccagcacagccacagctgagcagttcttccagaagctgaggaacaagcatgagttcaccatcctggtgaccctgaagcagacccacctgaacagcggggtcatcctgagcatccaccacctggaccaccgctacctggagctggagagcagcggccacagaaatgaggtgcggctgcactaccgcagcggcagccaccggccccacacagaggtgttcccctacatcctggctgatgacaagtggcacaagctgagcctggccatcagcgccagccacctgatcctgcacatcgactgcaacaagatctatgagcgggtggtggagaagcccagcacagacctgcccctgggcaccaccttctggctgggccagagaaataatgcccacggctacttcaagggcatcatgcaggatgtgcagctgctggtgatgccccagggcttcatcgcccagtgcccagacctgaacagaacctgccccacctgcaatgacttccacggcctggtgcagaagatcatggagctgcaggacatcctggccaagaccagcgccaagctgagcagagctgagcagaggatgaaccggctggaccagtgctactgtgagaggacctgcaccatgaagggcaccacctaccgggagtttgagagctggattgatggctgcaagaactgcacctgcctgaatggcaccatccagtgtgagaccctcatctgccccaacccagactgccccctgaagagcgccctggcctacgtggatggcaagtgctgcaaggagtgcaagagcatctgccagttccagggccgcacctactttgaaggagagaggaacacagtgtacagcagcagcggcgtgtgtgtgctgtatgagtgcaaggaccagaccatgaagctggtggagagcagcggctgcccagccctggactgcccagagagccaccagatcaccctgagccacagctgctgcaaggtgtgcaagggctatgacttctgcagcgagcggcacaactgcatggagaacagcatctgcaggaacctgaatgacagagctgtgtgcagctgcagagatggcttccgggccctgcgggaggacaatgcctactgtgaggacattgatgaatgtgccgagggccgccactactgccgggagaacaccatgtgtgtgaacaccccaggcagcttcatgtgcatctgcaagacaggctacatcagaattgatgactacagctgcacagaacatgatgagtgcatcaccaaccagcacaactgtgatgaaaatgccctgtgcttcaacacagtgggcggccacaactgtgtgtgcaagccaggctacacaggaaatggcaccacctgcaaggccttctgcaaggatggctgcagaaatggaggagcctgcatcgccgccaacgtgtgtgcctgcccccagggcttcaccggccccagctgtgaaacagacattgatgaatgttctgatggctttgtgcagtgtgacagccgggccaactgcatcaacctgcccggctggtaccactgtgaatgtagagatggctaccatgacaatggcatgttcagccccagcggggagagctgtgaggacattgatgaatgtggcaccggccgccacagctgtgccaatgacaccatctgcttcaacctggatggcggctatgactgccgctgcccccacggcaagaactgcaccggggactgcatccatgatggcaaggtgaagcacaacggccagatctgggtgctggagaatgaccgctgcagcgtgtgcagctgccagaatggatttgtgatgtgcaggaggatggtgtgtgactgtgagaaccccaccgtggacctcttctgctgcccagaatgtgacccccggctgagcagccagtgcctgcaccagaatggagagaccctgtacaacagcggggacacctgggtgcagaactgccagcagtgccgctgcctgcagggcgaggtggactgctggcccctgccctgcccagatgtggagtgtgagttcagcatcctgcctgaaaatgaatgctgcccccgctgtgtgacagacccctgccaggccgacaccatcagaaatgacatcaccaagacctgcctggatgagatgaatgtggtgcgcttcaccggcagctcctggatcaagcatggaacagagtgcaccctgtgccagtgcaagaatggccacatctgctgcagcgtggacccccagtgcctgcaggagctgtag

SEQ ID NO: 161364 - DNA, 2451 bp, Artificial Sequence
  Description of Artificial Sequence: Synthetic coding sequence
atggagagccgggtgctgctgcggaccttctgcctgatcttcggcctgggcgctgtgtggggcctgggcgtggaccccagcctgcagattgatgtgctgacagagctggagctgggggagagcaccactggagtgcggcaggtgcccggcctgcacaacggcaccaaggccttcctgttccaggacacccccaggagcatcaaggccagcacagccacagctgagcagttcttccagaagctgaggaacaagcatgagttcaccatcctggtgaccctgaagcagacccacctgaacagcggggtcatcctgagcatccaccacctggaccaccgctacctggagctggagagcagcggccacagaaatgaggtgcggctgcactacagaagtggcagccaccggccccacacagaggtgttcccctacatcctggctgatgacaagtggcacaagctgagcctggccatcagcgccagccacctgatcctgcacatcgactgcaacaagatctatgaaagagtggtggagaagcccagcacagacctgcccctgggcaccaccttctggctgggccagaggaacaatgcccacggctacttcaagggcatcatgcaggatgtgcagctgctggtgatgccccagggcttcatcgcccagtgcccagacctgaacagaacctgccccacctgcaatgacttccacggcctggtgcagaagatcatggagctgcaggacatcctggccaagaccagcgccaagctgagcagagctgagcagaggatgaaccggctggaccagtgctactgtgagaggacctgcaccatgaagggcaccacctaccgggagtttgagagctggattgatggctgcaagaactgcacctgcctgaatggcaccatccagtgtgagaccctcatctgccccaacccagactgccccctgaagagcgccctggcctacgtggatggcaagtgctgcaaggagtgcaagagcatctgccagttccagggccgcacctactttgaaggagagaggaacacagtgtacagcagcagtggagtgtgtgtgctgtatgagtgcaaggaccagaccatgaagctggtggagagcagcggctgcccagccctggactgcccagagagccaccagatcaccctgagccacagctgctgcaaggtgtgcaagggctatgacttctgcagcgagcggcacaactgcatggagaacagcatctgcaggaacctgaatgacagagctgtgtgcagctgcagagatggcttccgggccctgagagaagataatgcctactgtgaagatattgatgaatgtgccgagggccgccactactgccgggagaacaccatgtgtgtgaacaccccaggcagcttcatgtgcatctgcaagacaggctacatcagaattgatgactacagctgcacagaacatgatgagtgcatcaccaaccagcacaactgtgatgaaaatgccctgtgcttcaacacagtgggcggccacaactgtgtgtgcaagccaggctacacaggaaatggcaccacctgcaaggccttctgcaaggatggctgcagaaatggaggagcctgcatcgccgccaacgtgtgtgcctgcccccagggcttcaccggccccagctgtgaaacagacattgatgagtgcagtgatggctttgtgcagtgtgacagccgggccaactgcatcaacctgcccggctggtaccactgtgagtgcagagatggctaccatgacaatggcatgttcagccccagcggggagagctgtgaagatattgatgaatgtggcaccggccgccacagctgtgccaatgacaccatctgcttcaacctggatggcggctatgactgccgctgcccccacggcaagaactgcacaggagactgcatccatgatggcaaggtgaagcacaacggccagatctgggtgctggagaatgaccgctgcagcgtgtgcagctgccagaatggatttgtgatgtgcaggaggatggtgtgtgactgtgagaaccccaccgtggacctcttctgctgcccagaatgtgacccccggctgagcagccagtgcctgcaccagaatggagagaccctgtacaacagcggggacacctgggtgcagaactgccagcagtgccgctgcctgcagggcgaggtggactgctggcccctgccctgcccagatgtggagtgtgagttcagcatcctgcctgaaaatgaatgctgcccccgctgtgtgacagacccctgccaggccgacaccatcagaaatgacatcaccaagacctgcctggatgagatgaatgtggtgcgcttcaccggcagctcctggatcaagcacggcacagaatgtaccctgtgccagtgcaagaatggccacatctgctgcagcgtggacccccagtgcctgcaggagctgtag

SEQ ID NO: 161365 - DNA, 2601 bp, Artificial Sequence
  Description of Artificial Sequence: Synthetic coding sequence
atgggcttcccccccctgctgaagggccaggccagcgccaccaggagcagcctggccagctgctcctgggtggtgttcttcctgagctgcctgagcagacatgcccctgagattgagggcggccgccgctggacagagctgatccgcaccatggagagccgggtgctgctgcggaccttctgcctgatcttcggcctgggcgctgtgtggggcctgggcgtggaccccagcctgcagattgatgtgctgacagagctggagctgggggagagcaccactggagtgcggcaggtgcccggcctgcacaacggcaccaaggccttcctgttccaggacacccccaggagcatcaaggccagcacagccacagctgagcagttcttccagaagctgaggaacaagcatgagttcaccatcctggtgaccctgaagcagacccacctgaacagcggggtcatcctgagcatccaccacctggaccaccgctacctggagctggagagcagcggccacagaaatgaggtgcggctgcactacagaagtggcagccaccggccccacacagaggtgttcccctacatcctggctgatgacaagtggcacaagctgagcctggccatcagcgccagccacctgatcctgcacatcgactgcaacaagatctatgaaagagtggtggagaagcccagcacagacctgcccctgggcaccaccttctggctgggccagaggaacaatgcccacggctacttcaagggcatcatgcaggatgtgcagctgctggtgatgccccagggcttcatcgcccagtgcccagacctgaacagaacctgccccacctgcaatgacttccacggcctggtgcagaagatcatggagctgcaggacatcctggccaagaccagcgccaagctgagcagagctgagcagaggatgaaccggctggaccagtgctactgtgagaggacctgcaccatgaagggcaccacctaccgggagtttgagagctggattgatggctgcaagaactgcacctgcctgaatggcaccatccagtgtgagaccctcatctgccccaacccagactgccccctgaagagcgccctggcctacgtggatggcaagtgctgcaaggagtgcaagagcatctgccagttccagggccgcacctactttgaaggagagaggaacacagtgtacagcagcagtggagtgtgtgtgctgtatgagtgcaaggaccagaccatgaagctggtggagagcagcggctgcccagccctggactgcccagagagccaccagatcaccctgagccacagctgctgcaaggtgtgcaagggctatgacttctgcagcgagcggcacaactgcatggagaacagcatctgcaggaacctgaatgacagagctgtgtgcagctgcagagatggcttccgggccctgagagaagataatgcctactgtgaagatattgatgaatgtgccgagggccgccactactgccgggagaacaccatgtgtgtgaacaccccaggcagcttcatgtgcatctgcaagacaggctacatcagaattgatgactacagctgcacagaacatgatgagtgcatcaccaaccagcacaactgtgatgaaaatgccctgtgcttcaacacagtgggcggccacaactgtgtgtgcaagccaggctacacaggaaatggcaccacctgcaaggccttctgcaaggatggctgcagaaatggaggagcctgcatcgccgccaacgtgtgtgcctgcccccagggcttcaccggccccagctgtgaaacagacattgatgagtgcagtgatggctttgtgcagtgtgacagccgggccaactgcatcaacctgcccggctggtaccactgtgagtgcagagatggctaccatgacaatggcatgttcagccccagcggggagagctgtgaagatattgatgaatgtggcaccggccgccacagctgtgccaatgacaccatctgcttcaacctggatggcggctatgactgccgctgcccccacggcaagaactgcacaggagactgcatccatgatggcaaggtgaagcacaacggccagatctgggtgctggagaatgaccgctgcagcgtgtgcagctgccagaatggatttgtgatgtgcaggaggatggtgtgtgactgtgagaaccccaccgtggacctcttctgctgcccagaatgtgacccccggctgagcagccagtgcctgcaccagaatggagagaccctgtacaacagcggggacacctgggtgcagaactgccagcagtgccgctgcctgcagggcgaggtggactgctggcccctgccctgcccagatgtggagtgtgagttcagcatcctgcctgaaaatgaatgctgcccccgctgtgtgacagacccctgccaggccgacaccatcagaaatgacatcaccaagacctgcctggatgagatgaatgtggtgcgcttcaccggcagctcctggatcaagcacggcacagaatgtaccctgtgccagtgcaagaatggccacatctgctgcagcgtggacccccagtgcctgcaggagctgtag

SEQ ID NO: 161366 - DNA, 2451 bp, Artificial Sequence; identical to SEQ ID NO: 161364
  Description of Artificial Sequence: Synthetic coding sequence

SEQ ID NO: 161367 - DNA, 1734 bp, Artificial Sequence
  Description of Artificial Sequence: Synthetic coding sequence
atggagaccggcctgggcgcccccctcttcaaggcctggctgctgatctctgtgtggggcctgggcgtggaccccagcctgcagattgatgtgctgacagagctggagctgggggagagcaccaccggggtgcggcaggtgcccggcctgcacaacggcaccaaggccttcctgttccaggacacccccaggagcatcaaggccagcacagccacagctgagcagttcttccagaagctgaggaacaagcatgagttcaccatcctggtgaccctgaagcagacccacctgaacagcggggtcatcctgagcatccaccacctggaccaccgctacctggagctggagagcagcggccacagaaatgaggtgcggctgcactaccgcagcggcagccaccggccccacacagaggtgttcccctacatcctggctgatgacaagtggcacaagctgagcctggccatcagcgccagccacctgatcctgcacatcgactgcaacaagatctatgagcgggtggtggagaagcccagcacagacctgcccctgggcaccaccttctggctgggccagagaaataatgcccacggctacttcaagggcatcatgcaggatgtgcagctgctggtgatgccccagggcttcatcgcccagtgcccagacctgaacagaacctgccccacctgcaatgacttccacggcctggtgcagaagatcatggagctgcaggacatcctggccaagaccagcgccaagctgagcagagctgagcagaggatgaaccggctggaccagtgctactgtgagaggacctgcaccatgaagggcaccacctaccgggagtttgagagctggattgatggctgcaagaactgcacctgcctgaatggcaccatccagtgtgagaccctcatctgccccaacccagactgccccctgaagagcgccctggcctacgtggatggcaagtgctgcaaggagtgcaagagcatctgccagttccagggccgcacctactttgaaggagagaggaacacagtgtacagcagcagcggcgtgtgtgtgctgtatgagtgcaaggaccagaccatgaagctggtggagagcagcggctgcccagccctggactgcccagagagccaccagatcaccctgagccacagctgctgcaaggtgtgcaagggctatgacttctgcagcgagcggcacaactgcatggagaacagcatctgcaggaacctgaatgacagagctgtgtgcagctgcagagatggcttccgggccctgcgggaggacaatgcctactgtgaggacattgatgaatgtgccgagggccgccactactgccgggagaacaccatgtgtgtgaacaccccaggcagcttcatgtgcatctgcaagacaggctacatcagaattgatgactacagctgcacagaacatgatgagtgcatcaccaaccagcacaactgtgatgaaaatgccctgtgcttcaacacagtgggcggccacaactgtgtgtgcaagccaggctacacaggaaatggcaccacctgcaaggccttctgcaaggatggctgcagaaatggaggagcctgcatcgccgccaacgtgtgtgcctgcccccagggcttcaccggccccagctgtgaaacagacattgatgaatgttctgatggctttgtgcagtgtgacagccgggccaactgcatctgcctggtgcccctgtag

SEQ ID NO: 161368 - DNA, 333 bp, Artificial Sequence
  Description of Artificial Sequence: Synthetic coding sequence
atggagaccggcctgggcgcccccctcttcaaggcctggctgctgatctctgtgtggggcctgggcgtggaccccagcctgcagattgatgtgctgacagagctggagctgggggagagcaccaccggggtgcggcaggtgcccggcctgcacaacggcaccaaggccttcctgttccaggacacccccaggagcatcaaggccagcacagccacagctgagcagttcttccagaagctgaggaacaagcatgagttcaccatcctggtgaccctgaagcagacccacctgaacagcggggtcatcctgagcatccaccacctggaccactag

SEQ ID NO: 161369 - DNA, 2448 bp, Artificial Sequence; identical to SEQ ID NO: 161363
  Description of Artificial Sequence: Synthetic coding sequence

SEQ ID NO: 161370 - DNA, 69 bp, Artificial Sequence
  Description of Artificial Sequence: Synthetic coding sequence
atggagagccgggtgctgctgcggaccttctgcctgatcttcggcctgggcgctgtgtggggcctgtag

SEQ ID NO: 161371 - DNA, 966 bp, Artificial Sequence
  Description of Artificial Sequence: Synthetic coding sequence
atggagagccgggtgctgctgcggaccttctgcctgatcttcggcctgggcgctgtgtggggcctgggcgtggaccccagcctgcagattgatgtgctgacagagctggagctgggggagagcaccactggagtgcggcaggtgcccggcctgcacaacggcaccaaggccttcctgttccaggacacccccaggagcatcaaggccagcacagccacagctgagcagttcttccagaagctgaggaacaagcatgagttcaccatcctggtgaccctgaagcagacccacctgaacagcggggtcatcctgagcatccaccacctggaccaccgctacctggagctggagagcagcggccacagaaatgaggtgcggctgcactacagaagtggcagccaccggccccacacagaggtgttcccctacatcctggctgatgacaagtggcacaagctgagcctggccatcagcgccagccacctgatcctgcacatcgactgcaacaagatctatgaaagagtggtggagaagcccagcacagacctgcccctgggcaccaccttctggctgggccagaggaacaatgcccacggctacttcaagggcatcatgcaggatgtgcagctgctggtgatgccccagggcttcatcgcccagtgcccagacctgaacagaacctgccccacctgcaatgacttccacggcctggtgcagaagatcatggagctgcaggacatcctggccaagaccagcgccaagctgagcagagctgagcagaggatgaaccggctggaccagtgctactgtgagaggacctgcaccatgaagggcaccacctaccgggagtttgagagctggattgatggctgcaagaactgcacctgcctgaatggcaccatccagtgtgagaccctcatctgccccaacccagactgccccctgaagagcgccctggcctactag

SEQ ID NO: 161372 - DNA, 4386 bp, Artificial Sequence
  Description of Artificial Sequence: Synthetic coding sequence
atggctgctgagcggggggcccggcggctgctgagcacccccagcttctggctgtactgcctgctgctgctgggccggcgggcccctggagctgctgctgcccggagcggcagcgccccccagagccctggggccagcatccgcaccttcacccccttctacttcctggtggagcctgtggacaccctgtctgtgcggggcagcagcgtcatcctgaactgcagcgcctacagcgagcccagccccaagattgagtggaagaaggatggcaccttcctgaacctggtgtctgatgaccggcggcagctgctgcctgatggcagcctcttcatcagcaatgtggtgcacagcaagcacaacaagccagatgagggctactaccagtgtgtggccaccgtggagagcctgggcaccatcatcagcaggacagccaagctgattgtggccggcctgccccgcttcaccagccagcctgagcccagctctgtgtatgccggcaacaatgccatcctgaactgtgaggtgaatgctgacctggtgccctttgtgcgctgggagcagaaccggcagcccctgctgctggatgacagagtcatcaagctgcccagcggcatgctggtgatcagcaatgccacagaaggagatggcggcctgtaccgctgtgtggtggagagcggcggcccccccaagtacagtgatgaggtggagctgaaggtgctgcctgaccctgaggtgatcagtgacctggtgttcctgaagcagcccagccccctggtgcgggtcatcggccaggatgtggtgctgccctgtgtggccagcggcctgcccacccccaccatcaagtggatgaagaatgaggaggccctggacacagagagcagcgagcggctggtgctgctggccggcggcagcctggagatcagtgatgtgacagaagatgatgctggcacctacttctgcatcgctgacaatggaaatgagaccatcgaggcccaggccgagctgactgtgcaggcccagcctgagttcctgaagcagcccaccaacatctatgcccacgagagcatggacatcgtgtttgaatgtgaggtgacaggcaagcccacccccaccgtgaagtgggtgaagaatggagacatggtgatccccagcgactacttcaagatcgtgaaggagcacaacctgcaggtgctgggcctggtgaagagtgatgagggcttctaccagtgcatcgcagaaaatgatgtgggcaatgcccaggccggggcccagctgatcatcctggagcacgccccagccaccaccggccccctgcccagcgcccccagagatgtggtggccagcctggtgtccacccgcttcatcaagctgacctggaggaccccagccagtgacccccatggagacaacctgacctacagcgtcttctacaccaaggagggcatcgcccgggagcgggtggagaacaccagccaccctggagagatgcaggtgaccatccagaacctgatgcctgccaccgtgtacatcttccgggtgatggcccagaacaagcacggcagcggggagagcagcgcccccctgcgggtggagacccagcctgaggtgcagctgcccggccctgcccccaacctgcgggcctatgctgccagccccaccagcatcaccgtgacctgggagacccctgtgtctggaaatggagagatccagaactacaagctgtactacatggagaagggcacagacaaggagcaggatgtggatgtgagcagccacagctacaccatcaatggcctgaagaagtacacagagtacagcttccgggtggtggcctacaacaagcacggccctggggtgtccaccccagatgtggccgtgaggaccctgagtgatgtgcccagcgctgccccccagaacctgagcctggaggtgaggaacagcaagagcatcatgatccactggcagcccccagccccagccacccagaatggccagatcaccggctacaagatccgctacaggaaggccagcaggaagagtgatgtgacagagaccctggtgtctggcacccagctgagccagctgattgagggcctggaccggggcacagagtacaacttccgggtggccgccctgaccatcaatggaactggacctgccacagactggctgtctgctgagacctttgaaagtgacctggatgagaccagggtgcctgaggtgcccagcagcctgcacgtgcggcccctggtgaccagcatcgtggtgtcctggaccccacctgagaaccagaacatcgtggtgcggggctacgccatcggctatggaattggcagcccccacgcccagaccatcaaggtggactacaagcagcgctactacaccatcgagaacctggaccccagcagccactacgtgatcaccctgaaggccttcaacaacgtgggggagggcatccccctgtatgagagcgctgtgacccggccccacacagacaccagcgaggtggacctgtttgtgatcaatgccccctacacccctgtgcctgaccccacccccatgatgcctcctgtgggcgtgcaggccagcatcctgagccatgacaccatccgcatcacctgggccgacaacagcctgcccaagcaccagaagatcacagacagccgctactacacagtgcgctggaagaccaacatcccagccaacaccaagtacaagaatgccaatgccaccaccctgagctacctggtgacaggcctgaagcccaacaccctgtatgagttctctgtgatggtgaccaagggccgccgcagcagcacctggagcatgacagcccacggcaccacctttgagctggtgcccaccagcccccccaaggatgtgacagtggtgtccaaggagggcaagcccaagaccatcatcgtgaactggcagcccccatctgaggccaacgggaagatcaccggctacatcatctactacagcacagatgtgaatgctgagatccatgactgggtgattgagcctgtggtgggcaaccggctgacccaccagatccaggagctgaccctggacaccccctactacttcaagatccaggccaggaacagcaagggcatgggccccatgtctgaggccgtgcagttccgcacccccaaggctgacagcagtgacaagatgcccaatgaccaggccagcggcagcggcggcaagggcagccggctgcctgacctgggcagtgactacaagccacccatgagcggcagcaacagcccccacggcagccccaccagccccctggacagcaacatgctgctggtgatcatcgtgtctgtgggcgtcatcaccatcgtggtggtggtgatcatcgctgtgttctgcaccaggaggaccaccagccaccagaagaagaagagagctgcctgcaagtctgtgaatggcagccacaagtacaagggcaacagcaaggatgtgaagcccccagacctgtggatccaccacgagcggctggagctgaagcccatcgacaagagcccagaccccaaccccatcatgacagacacccccatccccaggaacagccaggacatcacccctgtggacaacagcatggacagcaacatccaccagaggaggaacagctaccggggccacgagagtgaagattccatgagcaccctggccggccggcggggcatgaggcccaagatgatgatgccctttgacagccagcccccccagcccgtcatcagcgcccaccccatccacagcctggacaacccccaccaccacttccacagcagcagcctggccagccctgcccggagccacctgtaccaccctggcagcccctggcccatcggcacctccatgagcctgagtgaccgggccaacagcacagagagcgtgaggaacacccccagcacagacaccatgcctgccagcagcagccagacctgctgcacagaccaccaggaccctgagggcgccaccagcagcagctacctggccagcagccaggaggaggacagcggccagagcctgcccacagcccacgtgcggcccagccaccccctgaagagctttgctgtgcctgccatccccccacctggcccccccacctatgaccctgccctgcccagcacccccctgctgagccagcaggccctgaaccaccacatccacagcgtgaagacagccagcatcggcaccctgggccgcagccggccccccatgcctgtggtggtgcccagcgcccctgaggtgcaggagaccaccaggatgctggaggacagcgagagcagctatgagccagatgagctgaccaaggagatggcccacctggagggcctgatgaaggacctgaatgccatcaccacagcctag

SEQ ID NO: 161373 - DNA, 4386 bp, Artificial Sequence; identical to SEQ ID NO: 161372
  Description of Artificial Sequence: Synthetic coding sequence

SEQ ID NO: 161374 - DNA, 3519 bp, Artificial Sequence
  Description of Artificial Sequence: Synthetic coding sequence
atgaagaatgaggaggccctggacacagagagcagcgagcggctggtgctgctggccggcggcagcctggagatcagtgatgtgacagaagatgatgctggcacctacttctgcatcgctgacaatggaaatgagaccatcgaggcccaggccgagctgactgtgcaggcccagcctgagttcctgaagcagcccaccaacatctatgcccacgagagcatggacatcgtgtttgaatgtgaggtgacaggcaagcccacccccaccgtgaagtgggtgaagaatggagacatggtgatccccagcgactacttcaagatcgtgaaggagcacaacctgcaggtgctgggcctggtgaagagtgatgagggcttctaccagtgcatcgcagaaaatgatgtgggcaatgcccaggccggggcccagctgatcatcctggagcatgatgtggccatccccaccctgccccccaccagcctgaccagcgccaccacagaccacctggccccagccaccaccggccccctgcccagcgcccccagagatgtggtggccagcctggtgtccacccgcttcatcaagctgacctggaggaccccagccagtgacccccatggagacaacctgacctacagcgtcttctacaccaaggagggcatcgcccgggagcgggtggagaacaccagccaccctggagagatgcaggtgaccatccagaacctgatgcctgccaccgtgtacatcttccgggtgatggcccagaacaagcacggcagcggggagagcagcgcccccctgcgggtggagacccagcctgaggtgcagctgcccggccctgcccccaacctgcgggcctatgctgccagccccaccagcatcaccgtgacctgggagacccctgtgtctggaaatggagagatccagaactacaagctgtactacatggagaagggcacagacaaggagcaggatgtggatgtgagcagccacagctacaccatcaatggcctgaagaagtacacagagtacagcttccgggtggtggcctacaacaagcacggccctggggtgtccaccccagatgtggccgtgaggaccctgagtgatgtgcccagcgctgccccccagaacctgagcctggaggtgaggaacagcaagagcatcatgatccactggcagcccccagccccagccacccagaatggccagatcaccggctacaagatccgctacaggaaggccagcaggaagagtgatgtgacagagaccctggtgtctggcacccagctgagccagctgattgagggcctggaccggggcacagagtacaacttccgggtggccgccctgaccatcaatggaactggacctgccacagactggctgtctgctgagacctttgaaagtgacctggatgagaccagggtgcctgaggtgcccagcagcctgcacgtgcggcccctggtgaccagcatcgtggtgtcctggaccccacctgagaaccagaacatcgtggtgcggggctacgccatcggctatggaattggcagcccccacgcccagaccatcaaggtggactacaagcagcgctactacaccatcgagaacctggaccccagcagccactacgtgatcaccctgaaggccttcaacaacgtgggggagggcatccccctgtatgagagcgctgtgacccggccccacacagtgcctgaccccacccccatgatgcctcctgtgggcgtgcaggccagcatcctgagccatgacaccatccgcatcacctgggccgacaacagcctgcccaagcaccagaagatcacagacagccgctactacacagtgcgctggaagaccaacatcccagccaacaccaagtacaagaatgccaatgccaccaccctgagctacctggtgacaggcctgaagcccaacaccctgtatgagttctctgtgatggtgaccaagggccgccgcagcagcacctggagcatgacagcccacggcaccacctttgagctggtgcccaccagcccccccaaggatgtgacagtggtgtccaaggagggcaagcccaagaccatcatcgtgaactggcagcccccatctgaggccaacgggaagatcaccggctacatcatctactacagcacagatgtgaatgctgagatccatgactgggtgattgagcctgtggtgggcaaccggctgacccaccagatccaggagctgaccctggacaccccctactacttcaagatccaggccaggaacagcaagggcatgggccccatgtctgaggccgtgcagttccgcacccccaaggccagcggcagcggcggcaagggcagccggctgcctgacctgggcagtgactacaagccacccatgagcggcagcaacagcccccacggcagccccaccagccccctggacagcaacatgctgctggtgatcatcgtgtctgtgggcgtcatcaccatcgtggtggtggtgatcatcgctgtgttctgcaccaggaggaccaccagccaccagaagaagaagagagctgcctgcaagtctgtgaatggcagccacaagtacaagggcaacagcaaggatgtgaagcccccagacctgtggatccaccacgagcggctggagctgaagcccatcgacaagagcccagaccccaaccccatcatgacagacacccccatccccaggaacagccaggacatcacccctgtggacaacagcatggacagcaacatccaccagaggagaaattcctaccggggccatgaaagtgaggacagcatgagcaccctggccggcagaagaggcatgaggcccaagatgatgatgccctttgacagccagcccccccagcctgtgatcagcgcccaccccatccacagcctggacaacccccaccaccacttccacagcagcagcctggccagccctgcccggagccacctgtaccaccctggcagcccctggcccatcggcacctccatgagcctgagtgaccgggccaacagcacagaatctgtgaggaacacccccagcacagacaccatgcctgccagcagcagccagacctgctgcacagaccaccaggaccctgagggcgccaccagcagcagctacctggccagcagccaggaggaggacagcggccagagcctgcccacagcccacgtgcggcccagccaccccctgaagagctttgctgtgcctgccatccccccacctggcccccccacctatgaccctgccctgcccagcacccccctgctgagccagcaggccctgaaccaccacatccacagcgtgaagacagccagcatcggcaccctgggccgcagcaggcctcccatgcctgtggtggtgcccagcgcccctgaggtgcaggagaccaccaggatgctggaggacagcgagagcagctatgagccagatgagctgaccaaggagatggcccacctggagggcctgatgaaggacctgaatgccatcaccacagcctag

SEQ ID NO: 161375 - DNA, 4353 bp, Artificial Sequence
  Description of Artificial Sequence: Synthetic coding sequence
atggctgctgagcggggggcccggcggctgctgagcacccccagcttctggctgtactgcctgctgctgctgggccggcgggcccctggagctgctgctgcccggagcggcagcgccccccagagccctggggccagcatccgcaccttcacccccttctacttcctggtggagcctgtggacaccctgtctgtgcggggcagcagcgtcatcctgaactgcagcgcctacagcgagcccagccccaagattgagtggaagaaggatggcaccttcctgaacctggtgtctgatgaccggcggcagctgctgcctgatggcagcctcttcatcagcaatgtggtgcacagcaagcacaacaagccagatgagggctactaccagtgtgtggccaccgtggagagcctgggcaccatcatcagcaggacagccaagctgattgtggccggcctgccccgcttcaccagccagcctgagcccagctctgtgtatgccggcaacaatgccatcctgaactgtgaggtgaatgctgacctggtgccctttgtgcgctgggagcagaaccggcagcccctgctgctggatgacagagtcatcaagctgcccagcggcatgctggtgatcagcaatgccacagaaggagatggcggcctgtaccgctgtgtggtggagagcggcggcccccccaagtacagtgatgaggtggagctgaaggtgctgcctgaccctgaggtgatcagtgacctggtgttcctgaagcagcccagccccctggtgcgggtcatcggccaggatgtggtgctgccctgtgtggccagcggcctgcccacccccaccatcaagtggatgaagaatgaggaggccctggacacagagagcagcgagcggctggtgctgctggccggcggcagcctggagatcagtgatgtgacagaagatgatgctggcacctacttctgcatcgctgacaatggaaatgagaccatcgaggcccaggccgagctgactgtgcaggcccagcctgagttcctgaagcagcccaccaacatctatgcccacgagagcatggacatcgtgtttgaatgtgaggtgacaggcaagcccacccccaccgtgaagtgggtgaagaatggagacatggtgatccccagcgactacttcaagatcgtgaaggagcacaacctgcaggtgctgggcctggtgaagagtgatgagggcttctaccagtgcatcgcagaaaatgatgtgggcaatgcccaggccggggcccagctgatcatcctggagcacgccccagccaccaccggccccctgcccagcgcccccagagatgtggtggccagcctggtgtccacccgcttcatcaagctgacctggaggaccccagccagtgacccccatggagacaacctgacctacagcgtcttctacaccaaggagggcatcgcccgggagcgggtggagaacaccagccaccctggagagatgcaggtgaccatccagaacctgatgcctgccaccgtgtacatcttccgggtgatggcccagaacaagcacggcagcggggagagcagcgcccccctgcgggtggagacccagcctgaggtgcagctgcccggccctgcccccaacctgcgggcctatgctgccagccccaccagcatcaccgtgacctgggagacccctgtgtctggaaatggagagatccagaactacaagctgtactacatggagaagggcacagacaaggagcaggatgtggatgtgagcagccacagctacaccatcaatggcctgaagaagtacacagagtacagcttccgggtggtggcctacaacaagcacggccctggggtgtccaccccagatgtggccgtgaggaccctgagtgatgtgcccagcgctgccccccagaacctgagcctggaggtgaggaacagcaagagcatcatgatccactggcagcccccagccccagccacccagaatggccagatcaccggctacaagatccgctacaggaaggccagcaggaagagtgatgtgacagagaccctggtgtctggcacccagctgagccagctgattgagggcctggaccggggcacagagtacaacttccgggtggccgccctgaccatcaatggaactggacctgccacagactggctgtctgctgagacctttgaaagtgacctggatgagaccagggtgcctgaggtgcccagcagcctgcacgtgcggcccctggtgaccagcatcgtggtgtcctggaccccacctgagaaccagaacatcgtggtgcggggctacgccatcggctatggaattggcagcccccacgcccagaccatcaaggtggactacaagcagcgctactacaccatcgagaacctggaccccagcagccactacgtgatcaccctgaaggccttcaacaacgtgggggagggcatccccctgtatgagagcgctgtgacccggccccacacagacaccagcgaggtggacctgtttgtgatcaatgccccctacacccctgtgcctgaccccacccccatgatgcctcctgtgggcgtgcaggccagcatcctgagccatgacaccatccgcatcacctgggccgacaacagcctgcccaagcaccagaagatcacagacagccgctactacacagtgcgctggaagaccaacatcccagccaacaccaagtacaagaatgccaatgccaccaccctgagctacctggtgacaggcctgaagcccaacaccctgtatgagttctctgtgatggtgaccaagggccgccgcagcagcacctggagcatgacagcccacggcaccacctttgagctggtgcccaccagcccccccaaggatgtgacagtggtgtccaaggagggcaagcccaagaccatcatcgtgaactggcagcccccatctgaggccaacgggaagatcaccggctacatcatctactacagcacagatgtgaatgctgagatccatgactgggtgattgagcctgtggtgggcaaccggctgacccaccagatccaggagctgaccctggacaccccctactacttcaagatccaggccaggaacagcaagggcatgggccccatgtctgaggccgtgcagttccgcacccccaaggccagcggcagcggcggcaagggcagccggctgcctgacctgggcagtgactacaagccacccatgagcggcagcaacagcccccacggcagccccaccagccccctggacagcaacatgctgctggtgatcatcgtgtctgtgggcgtcatcaccatcgtggtggtggtgatcatcgctgtgttctgcaccaggaggaccaccagccaccagaagaagaagagagctgcctgcaagtctgtgaatggcagccacaagtacaagggcaacagcaaggatgtgaagcccccagacctgtggatccaccacgagcggctggagctgaagcccatcgacaagagcccagaccccaaccccatcatgacagacacccccatccccaggaacagccaggacatcacccctgtggacaacagcatggacagcaacatccaccagaggagaaattcctaccggggccatgaaagtgaggacagcatgagcaccctggccggcagaagaggcatgaggcccaagatgatgatgccctttgacagccagcccccccagcctgtgatcagcgcccaccccatccacagcctggacaacccccaccaccacttccacagcagcagcctggccagccctgcccggagccacctgtaccaccctggcagcccctggcccatcggcacctccatgagcctgagtgaccgggccaacagcacagaatctgtgaggaacacccccagcacagacaccatgcctgccagcagcagccagacctgctgcacagaccaccaggaccctgagggcgccaccagcagcagctacctggccagcagccaggaggaggacagcggccagagcctgcccacagcccacgtgcggcccagccaccccctgaagagctttgctgtgcctgccatccccccacctggcccccccacctatgaccctgccctgcccagcacccccctgctgagccagcaggccctgaaccaccacatccacagcgtgaagacagccagcatcggcaccctgggccgcagcaggcctcccatgcctgtggtggtgcccagcgcccctgaggtgcaggagaccaccaggatgctggaggacagcgagagcagctatgagccagatgagctgaccaaggagatggcccacctggagggcctgatgaaggacctgaatgccatcaccacagcctag

SEQ ID NO: 161376 - DNA, 4227 bp, Artificial Sequence
  Description of Artificial Sequence: Synthetic coding sequence
atggctgctgagcggggggcccggcggctgctgagcacccccagcttctggctgtactgcctgctgctgctgggccggcgggcccctggagctgctgctgcccggagcggcagcgccccccagagccctggggccagcatccgcaccttcacccccttctacttcctggtggagcctgtggacaccctgtctgtgcggggcagcagcgtcatcctgaactgcagcgcctacagcgagcccagccccaagattgagtggaagaaggatggcaccttcctgaacctggtgtctgatgaccggcggcagctgctgcctgatggcagcctcttcatcagcaatgtggtgcacagcaagcacaacaagccagatgagggctactaccagtgtgtggccaccgtggagagcctgggcaccatcatcagcaggacagccaagctgattgtggccggcctgccccgcttcaccagccagcctgagcccagctctgtgtatgccggcaacaatgccatcctgaactgtgaggtgaatgctgacctggtgccctttgtgcgctgggagcagaaccggcagcccctgctgctggatgacagagtcatcaagctgcccagcggcatgctggtgatcagcaatgccacagaaggagatggcggcctgtaccgctgtgtggtggagagcggcggcccccccaagtacagtgatgaggtggagctgaaggtgctgcctgaccctgaggtgatcagtgacctggtgttcctgaagcagcccagccccctggtgcgggtcatcggccaggatgtggtgctgccctgtgtggccagcggcctgcccacccccaccatcaagtggatgaagaatgaggaggccctggacacagagagcagcgagcggctggtgctgctggccggcggcagcctggagatcagtgatgtgacagaagatgatgctggcacctacttctgcatcgctgacaatggaaatgagaccatcgaggcccaggccgagctgactgtgcaggcccagcctgagttcctgaagcagcccaccaacatctatgcccacgagagcatggacatcgtgtttgaatgtgaggtgacaggcaagcccacccccaccgtgaagtgggtgaagaatggagacatggtgatccccagcgactacttcaagatcgtgaaggagcacaacctgcaggtgctgggcctggtgaagagtgatgagggcttctaccagtgcatcgcagaaaatgatgtgggcaatgcccaggccggggcccagctgatcatcctggagcacgccccagccaccaccggccccctgcccagcgcccccagagatgtggtggccagcctggtgtccacccgcttcatcaagctgacctggaggaccccagccagtgacccccatggagacaacctgacctacagcgtcttctacaccaaggagggcatcgcccgggagcgggtggagaacaccagccaccctggagagatgcaggtgaccatccagaacctgatgcctgccaccgtgtacatcttccgggtgatggcccagaacaagcacggcagcggggagagcagcgcccccctgcgggtggagacccagcctgaggtgcagctgcccggccctgcccccaacctgcgggcctatgctgccagccccaccagcatcaccgtgacctgggagacccctgtgtctggaaatggagagatccagaactacaagctgtactacatggagaagggcacagacaaggagcaggatgtggatgtgagcagccacagctacaccatcaatggcctgaagaagtacacagagtacagcttccgggtggtggcctacaacaagcacggccctggggtgtccaccccagatgtggccgtgaggaccctgagtgatgtgcccagcgctgccccccagaacctgagcctggaggtgaggaacagcaagagcatcatgatccactggcagcccccagccccagccacccagaatggccagatcaccggctacaagatccgctacaggaaggccagcaggaagagtgatgtgacagagaccctggtgtctggcacccagctgagccagctgattgagggcctggaccggggcacagagtacaacttccgggtggccgccctgaccatcaatggaactggacctgccacagactggctgtctgctgagacctttgaaagtgacctggatgagaccagggtgcctgaggtgcccagcagcctgcacgtgcggcccctggtgaccagcatcgtggtgtcctggaccccacctgagaaccagaacatcgtggtgcggggctacgccatcggctatggaattggcagcccccacgcccagaccatcaaggtggactacaagcagcgctactacaccatcgagaacctggaccccagcagccactacgtgatcaccctgaaggccttcaacaacgtgggggagggcatccccctgtatgagagcgctgtgacccggccccacacagacaccagcgaggtggacctgtttgtgatcaatgccccctacacccctgtgcctgaccccacccccatgatgcctcctgtgggcgtgcaggccagcatcctgagccatgacaccatccgcatcacctgggccgacaacagcctgcccaagcaccagaagatcacagacagccgctactacacagtgcgctggaagaccaacatcccagccaacaccaagtacaagaatgccaatgccaccaccctgagctacctggtgacaggcctgaagcccaacaccctgtatgagttctctgtgatggtgaccaagggccgccgcagcagcacctggagcatgacagcccacggcaccacctttgagctggtgcccaccagcccccccaaggatgtgacagtggtgtccaaggagggcaagcccaagaccatcatcgtgaactggcagcccccatctgaggccaacgggaagatcaccggctacatcatctactacagcacagatgtgaatgctgagatccatgactgggtgattgagcctgtggtgggcaaccggctgacccaccagatccaggagctgaccctggacaccccctactacttcaagatccaggccaggaacagcaagggcatgggccccatgtctgaggccgtgcagttccgcacccccaaggctgacagcagtgacaagatgcccaatgaccaggccagcggcagcggcggcaagggcagccggctgcctgacctgggcagtgactacaagccacccatgagcggcagcaacagcccccacggcagccccaccagccccctggacagcaacatgctgctggtgatcatcgtgtctgtgggcgtcatcaccatcgtggtggtggtgatcatcgctgtgttctgcaccaggaggaccaccagccaccagaagaagaagagagctgcctgcaagtctgtgaatggcagccacaagtacaagggcaacagcaaggatgtgaagcccccagacctgtggatccaccacgagcggctggagctgaagcccatcgacaagagcccagaccccaaccccatcatgacagacacccccatccccaggaacagccaggacatcacccctgtggacaacagcatggacagcaacatccaccagaggaggaacagctaccggggccacgagagtgaagattccatgagcaccctggccggccggcggggcatgaggcccaagatgatgatgccctttgacagccagcccccccagcagagcgtgaggaacacccccagcacagacaccatgcctgccagcagcagccagacctgctgcacagaccaccaggaccctgagggcgccaccagcagcagctacctggccagcagccaggaggaggacagcggccagagcctgcccacagcccacgtgcggcccagccaccccctgaagagctttgctgtgcctgccatccccccacctggcccccccacctatgaccctgccctgcccagcacccccctgctgagccagcaggccctgaaccaccacatccacagcgtgaagacagccagcatcggcaccctgggccgcagcaggcctcccatgcctgtggtggtgcccagcgcccctgaggtgcaggagaccaccaggatgctggaggacagcgagagcagctatgagccagatgagctgaccaaggagatggcccacctggagggcctgatgaaggacctgaatgccatcaccacagcctag

SEQ ID NO: 161377 - DNA, 1074 bp, Artificial Sequence
  Description of Artificial Sequence: Synthetic coding sequence
atgcagagcgtgcagagcaccagcttctgcctgaggaagcagtgcctgtgcctgaccttcctgctgctgcacctgctgggccaggtggccgccacccagcgctgccccccccagtgccccggccgctgcccagccaccccacccacctgtgcccctggggtgcgggctgtgctggatggctgcagctgctgcctggtgtgtgcccggcagagaggagagagctgcagcgacctggagccctgtgatgagagcagcggcctgtactgtgacagatctgctgaccccagcaaccagacaggcatctgcacagctgtggagggggacaactgtgtgtttgatggagtcatctacagaagtggagagaagttccagcccagctgcaagttccagtgcacctgcagagatggccagatcggctgtgtgccccgctgccagctggatgtgctgctgcctgagcccaactgcccagcccccaggaaggtggaggtgcctggagagtgctgtgagaagtggatctgtggcccagatgaggaggacagcctgggcggcctgaccctggccgcctacagacctgaggccaccctgggcgtggaggtgtctgacagctctgtgaactgcatcgagcagaccacagagtggacagcctgcagcaagagctgtggcatgggcttcagcaccagggtgaccaacagaaaccggcagtgtgagatgctgaagcagacccggctgtgcatggtgcggccctgtgagcaggagcctgagcagcccacagacaagaagggcaagaagtgcctgcggaccaagaagagcctgaaggccatccacctgcagttcaagaactgcaccagcctgcacacctacaagccccgcttctgtggggtgtgcagtgatggccgctgctgcaccccccacaacaccaagaccatccaggccgagttccagtgcagccctggccagatcgtgaagaagcctgtgatggtgattggcacctgcacctgccacaccaactgccccaagaacaatgaggccttcctgcaggagctggagctgaagaccacccggggcaagatgtag

SEQ ID NO: 161378 - DNA, 2202 bp, Artificial Sequence
  Description of Artificial Sequence: Synthetic coding sequence
atgctggcccggcggcagagggaccccctgcaggccctgcggcggaggaaccaggagctgaagcagcaggtggacagcctgctgtctgagagccagctgaaggaggccctggagcccaacaagaggcagcacatctaccagcgctgcatccagctgaagcaggccattgatgagaacaagaatgccctgcagaagctgagcaaggcagatgagagcgcccctgtggccaactacaaccagaggaaggaggaggagcacaccctgctggacaagctgacccagcagctgcagggcctggccgtgaccatcagccgggagaacatcacagaggtgggcgcccccacagaggaggaggaggagagcgagagcgaggacagtgaagattctggaggagaggaggaggatgctgaggaggaggaggaggagaaggaggagaatgaaagccacaagtggagcactggagaggagtacatcgctgtgggggacttcaccgcccagcaggtgggggacctgaccttcaagaagggggagatcctgctggtgattgagaagaagccagatggctggtggatcgccaaggatgccaagggaaatgaaggcctggtgcccaggacctacctggagccctacagcgaggaggaggagggccaggagagcagcgaggagggcagcgaggaggatgtggaggccgtggatgaaacagcagatggagctgaggtgaagcagaggacagacccccactggagcgctgtgcagaaggccatcagcgaggccggcatcttctgcctggtgaaccacgtgtccttctgctacctgattgtgctgatgaggaacaggatggagaccgtggaggacaccaatggaagtgaaacaggcttccgggcctggaatgtgcagagccggggccgcatcttcctggtgtccaagcctgtgctgcagcagatcaacacagtggatgtgctgaccaccatgggcgccatcccagctggcttccggcccagcaccctgagccagctgctggaggagggcaaccagttccgggccaactacttcctgcagcctgagctgatgcccagccagctggccttccgggacctgatgtgggatgccacagagggcaccatccgcagccggcccagccgcatcagcctcatcctgaccctgtggagctgcaagatgatccccctgcccggcatgagcatccaggtgctgagcagacatgtgcggctgtgcctgtttgatggcaacaaggtgctgagcaacatccacacagtgcgggccacctggcagcccaagaagcccaagacctggaccttcagcccccaggtgacccgcatcctgccctgcctgctggatggagactgcttcatccgcagcaacagcgccagcccagacctgggcatcctgtttgagctgggcatctcctacatccggaacagcactggagagcggggggagctgagctgtggctgggtgttcctgaagctgtttgatgccagcggcgtgcccatcccagccaagacctatgagctgttcctgaatggaggcaccccctatgaaaaaggaattgaggtggaccccagcatcagcagaagagcccacggcagcgtcttctaccagatcatgaccatgaggcggcagccccagctgctggtgaagctgcggagcctgaacagaagaagcagaaatgtgctgagcctgctgcctgagaccctgattggcaacatgtgcagcatccacctgctgatcttctaccggcagatcctgggagatgtgctgctgaaggacaggatgagcctgcagagcacagacctgatcagccaccccatgctggccaccttccccatgctgctggagcagccagatgtgatggatgccctgcggagctcctgggccggcaaggagagcaccctgaagaggtctgagaagagggacaaggagttcctgaagagcaccttcctgctggtgtaccatgactgtgtgctgcccctgctgcacagcacccggctgccccccttccgctgggccgaggaggagacagaaacagcccgctggaaggtgatcacagacttcctgaagcagaaccaggagaaccagggcgccctgcaggccctgctgagcccagatggagtgcatgagccctttgacctgtctgagcagacctatgacttcctgggggagatgaggaagaatgctgtgtag

SEQ ID NO: 161379 - DNA, 1845 bp, Artificial Sequence
  Description of Artificial Sequence: Synthetic coding sequence
atgctggcccggcggcagagggaccccctgcaggccctgcggcggaggaaccaggagctgaagcagcaggtggacagcctgctgtctgagagccagctgaaggaggccctggagcccaacaagaggcagcacatctaccagagggtgggcgcccccacagaggaggaggaggagagcgagagcgaggacagtgaagattctggaggagaggaggaggatgctgaggaggaggaggaggagaaggaggagaatgaaagccacaagtggagcactggagaggagtacatcgctgtgggggacttcaccgcccagcaggtgggggacctgaccttcaagaagggggagatcctgctggtgattgagaagaagccagatggctggtggatcgccaaggatgccaagggaaatgaaggcctggtgcccaggacctacctggagccctacagcgaggaggaggagggccaggagagcagcgaggagggcagcgaggaggatgtggaggccgtggatgaaacagcagatggagctgaggtgaagcagaggacagacccccactggagcgctgtgcagaaggccatcagcgagatcaacacagtggatgtgctgaccaccatgggcgccatcccagctggcttccggcccagcaccctgagccagctgctggaggagggcaaccagttccgggccaactacttcctgcagcctgagctgatgcccagccagctggccttccgggacctgatgtgggatgccacagagggcaccatccgcagccggcccagccgcatcagcctcatcctgaccctgtggagctgcaagatgatccccctgcccggcatgagcatccaggtgctgagccgccacgtgcggctgtgcctgtttgatggcaacaaggtgctgagcaacatccacacagtgcgggccacctggcagcccaagaagcccaagacctggaccttcagcccccaggtgacccgcatcctgccctgcctgctggatggagactgcttcatccgcagcaacagcgccagcccagacctgggcatcctgtttgagctgggcatctcctacatccggaacagcactggagagcggggggagctgagctgtggctgggtgttcctgaagctgtttgatgccagcggcgtgcccatcccagccaagacctatgagctgttcctgaatggaggcaccccctatgagaagggcatcgaggtggaccccagcatcagccggcgggcccacggctctgtgttctaccagatcatgaccatgaggcggcagccccagctgctggtgaagctgcggagcctgaacagaagaagcagaaatgtgctgagcctgctgcctgagaccctcatcggcaacatgtgcagcatccacctgctgatcttctaccggcagatcctgggagatgtgctgctgaaggacaggatgagcctgcagagcacagacctgatcagccaccccatgctggccaccttccccatgctgctggagcagccagatgtgatggatgccctgcggagctcctgggccggcaaggagagcaccctgaagaggtctgagaagagggacaaggagttcctgaagagcaccttcctgctggtgtaccatgactgtgtgctgcccctgctgcacagcacccggctgccccccttccgctgggccgaggaggagacagaaacagcccgctggaaggtgatcacagacttcctgaagcagaaccaggagaaccagggcgccctgcaggccctgctgagcccagatggagtgcatgagccctttgacctgtctgagcagacctatgacttcctgggggagatgaggaagaatgctgtgtag

SEQ ID NO: 161380 - DNA, 2199 bp, Artificial Sequence
  Description of Artificial Sequence: Synthetic coding sequence
atgctggcccggcggcagagggaccccctgcaggccctgcggcggaggaaccaggagctgaagcagcaggtggacagcctgctgtctgagagccagctgaaggaggccctggagcccaacaagaggcagcacatctaccagcgctgcatccagctgaagcaggccattgatgagaacaagaatgccctgcagaagctgagcaaggcagatgagagcgcccctgtggccaactacaaccagaggaaggaggaggagcacaccctgctggacaagctgacccagcagctgcagggcctggccgtgaccatcagccgggagaacatcacagaggtgggcgcccccacagaggaggaggaggagagcgagagcgaggacagtgaagattctggaggagaggaggaggatgctgaggaggaggaggaggagaaggaggagaatgaaagccacaagtggagcactggagaggagtacatcgctgtgggggacttcaccgcccagcaggtgggggacctgaccttcaagaagggggagatcctgctggtgattgagaagaagccagatggctggtggatcgccaaggatgccaagggaaatgaaggcctggtgcccaggacctacctggagccctacagcgaggaggaggagggccaggagagcagcgaggagggcagcgaggaggatgtggaggccgtggatgaaacagcagatggagctgaggtgaagcagaggacagacccccactggagcgctgtgcagaaggccatcagcgaggccggcatcttctgcctggtgaaccacgtgtccttctgctacctgattgtgctgatgaggaacaggatggagaccgtggaggacaccaatggaagtgaaacaggcttccgggcctggaatgtgcagagccggggccgcatcttcctggtgtccaagcctgtgctgcagatcaacacagtggatgtgctgaccaccatgggcgccatcccagctggcttccggcccagcaccctgagccagctgctggaggagggcaaccagttccgggccaactacttcctgcagcctgagctgatgcccagccagctggccttccgggacctgatgtgggatgccacagagggcaccatccgcagccggcccagccgcatcagcctcatcctgaccctgtggagctgcaagatgatccccctgcccggcatgagcatccaggtgctgagccgccacgtgcggctgtgcctgtttgatggcaacaaggtgctgagcaacatccacacagtgcgggccacctggcagcccaagaagcccaagacctggaccttcagcccccaggtgacccgcatcctgccctgcctgctggatggagactgcttcatccgcagcaacagcgccagcccagacctgggcatcctgtttgagctgggcatctcctacatccggaacagcactggagagcggggggagctgagctgtggctgggtgttcctgaagctgtttgatgccagcggcgtgcccatcccagccaagacctatgagctgttcctgaatggaggcaccccctatgagaagggcatcgaggtggaccccagcatcagccggcgggcccacggctctgtgttctaccagatcatgaccatgaggcggcagccccagctgctggtgaagctgcggagcctgaacagaagaagcagaaatgtgctgagcctgctgcctgagaccctcatcggcaacatgtgcagcatccacctgctgatcttctaccggcagatcctgggagatgtgctgctgaaggacaggatgagcctgcagagcacagacctgatcagccaccccatgctggccaccttccccatgctgctggagcagccagatgtgatggatgccctgcggagctcctgggccggcaaggagagcaccctgaagaggtctgagaagagggacaaggagttcctgaagagcaccttcctgctggtgtaccatgactgtgtgctgcccctgctgcacagcacccggctgccccccttccgctgggccgaggaggagacagaaacagcccgctggaaggtgatcacagacttcctgaagcagaaccaggagaaccagggcgccctgcaggccctgctgagcccagatggagtgcatgagccctttgacctgtctgagcagacctatgacttcctgggggagatgaggaagaatgctgtgtag

SEQ ID NO: 161381 - DNA, 2034 bp, Artificial Sequence
  Description of Artificial Sequence: Synthetic coding sequence
atgctggcccggcggcagagggaccccctgcaggccctgcggcggaggaaccaggagctgaagcagcaggtggacagcctgctgtctgagagccagctgaaggaggccctggagcccaacaagaggcagcacatctaccagcgctgcatccagctgaagcaggccattgatgagaacaagaatgccctgcagaagctgagcaaggcagatgagagcgcccctgtggccaactacaaccagaggaaggaggaggagcacaccctgctggacaagctgacccagcagctgcagggcctggccgtgaccatcagccgggagaacatcacagaggtgggcgcccccacagaggaggaggaggagagcgagagcgaggacagtgaagattctggaggagaggaggaggatgctgaggaggaggaggaggagaaggaggagaatgaaagccacaagtggagcactggagaggagtacatcgctgtgggggacttcaccgcccagcaggtgggggacctgaccttcaagaagggggagatcctgctggtgattgagaagaagccagatggctggtggatcgccaaggatgccaagggaaatgaaggcctggtgcccaggacctacctggagccctacagcgaggaggaggagggccaggagagcagcgaggagggcagcgaggaggatgtggaggccgtggatgaaacagcagatggagctgaggtgaagcagaggacagacccccactggagcgctgtgcagaaggccatcagcgagcagatcaacacagtggatgtgctgaccaccatgggcgccatcccagctggcttccggcccagcaccctgagccagctgctggaggagggcaaccagttccgggccaactacttcctgcagcctgagctgatgcccagccagctggccttccgggacctgatgtgggatgccacagagggcaccatccgcagccggcccagccgcatcagcctcatcctgaccctgtggagctgcaagatgatccccctgcccggcatgagcatccaggtgctgagcagacatgtgcggctgtgcctgtttgatggcaacaaggtgctgagcaacatccacacagtgcgggccacctggcagcccaagaagcccaagacctggaccttcagcccccaggtgacccgcatcctgccctgcctgctggatggagactgcttcatccgcagcaacagcgccagcccagacctgggcatcctgtttgagctgggcatctcctacatccggaacagcactggagagcggggggagctgagctgtggctgggtgttcctgaagctgtttgatgccagcggcgtgcccatcccagccaagacctatgagctgttcctgaatggaggcaccccctatgaaaaaggaattgaggtggaccccagcatcagcagaagagcccacggcagcgtcttctaccagatcatgaccatgaggcggcagccccagctgctggtgaagctgcggagcctgaacagaagaagcagaaatgtgctgagcctgctgcctgagaccctgattggcaacatgtgcagcatccacctgctgatcttctaccggcagatcctgggagatgtgctgctgaaggacaggatgagcctgcagagcacagacctgatcagccaccccatgctggccaccttccccatgctgctggagcagccagatgtgatggatgccctgcggagctcctgggccggcaaggagagcaccctgaagaggtctgagaagagggacaaggagttcctgaagagcaccttcctgctggtgtaccatgactgtgtgctgcccctgctgcacagcacccggctgccccccttccgctgggccgaggaggagacagaaacagcccgctggaaggtgatcacagacttcctgaagcagaaccaggagaaccagggcgccctgcaggccctgctgagcccagatggagtgcatgagccctttgacctgtctgagcagacctatgacttcctgggggagatgaggaagaatgctgtgtag

SEQ ID NO: 161382 - DNA, 2115 bp, Artificial Sequence
  Description of Artificial Sequence: Synthetic coding sequence
atgggcacagccagcagcctggtgtccccagctggaggagaggtgattgaggacacctacggggccggcggcggggaggcctgtgagatccctgtggaggtgaagcccaaggcccggctgctgaggaacagcttcagaagaggagctggagctgctgctggagctggccctggcagcctgccccggggcgtgggcgctgggggcctgctgggcgccagcttcaagagcacaggcagctctgtgcctgagctggagtatgctgctgctgaatatgagcggctgaggaaggagtatgagatcttccgggtgtccaagaaccaggagctgctgtccatgggccggcgggaggccaagctggacacagagaacaagaggctgcgggcagagctgcaggccctgcagaagacctaccagaagatcctgcgggagaaggagagcgccctggaggccaagtaccaggccatggagcgggccgccacctttgaacatgaccgggacaaggtgaagaggcagttcaagatcttccgggagaccaaggaaaatgagatccaggacctgctgcgggccaagcgggagctggagagcaagctgcagaggctgcaggcccagggcatccaggtgtttgaccccggggagagtgacagtgatgacaactgcacagatgtgacagctgctggcacccagtgtgagtactggacaggaggagccctgggcagcgagcccagcatcggctccatgatccagctgcagcagagcttccggggccctgagtttgcccacagcagcattgatgtggagggcccctttgccaacgtgaacagagatgactgggacattgctgtggccagcctgctgcaggtgacccccctcttcagccacagcctgtggagcaacacagtgcgctgctacctgatctacacagatgagacccagcctgagatggacctcttcctgaaggactacagccccaagctgaagaggatgtgtgagaccatgggctacttcttccacgctgtgtacttccccattgatgtggagaaccagtacctgactgtgaggaagtgggagattgagaagagcagcctggtgatcctcttcatccacctgaccctgcccagcctgctgctggaggactgtgaggaggccttcctgaagaaccctgagggcaagcccaggctcatcttccaccggctggaggatggcaaggtgtccagtgacagcgtgcagcagctgattgaccaggtgagcaacctgaacaagaccagcaaggccaagatcatcgaccacagcggggaccctgctgagggcgtgtacaagacctacatctgtgtggagaagatcatcaagcaggacatcctgggctttgagaacacagacctggagaccaaggacctgggcagcgaggacagcatccctgaggaggatgactttggagatgtgctgtgggacatccatgatgagcaggagcagatggagaccttccagcaggccagcaacagcgcccacgagctgggctttgagaagtactaccagaggctgaatgacctggtggccgccccagcccccatcccccccctgctggtgtctgggggccctggcagcggcaagagcctgctgctgagcaagtggatccagctgcagcagaagaacagccccaacaccctcatcctgagccactttgtgggccggcccatgagcaccagcagcgagagcagcctcatcatcaagaggctgaccctgaagctgatgcagcacagctggagcgtgtctgccctgaccctggaccctgccaagctgctggaggagttcccccgctggctggagaagctgagcgcccggcaccagggcagcatcatcatcgtcatcgacagcattgaccaggtgcagcaggtggagaagcacatgaagtggctgattgaccccctgcctgtgaatgtgcgggtgattgtgtctgtgaatgtggagacctgccccccagcctggaggctgtggcccaccctgcacctggaccccctgagccccaaggatgccaagagcatcatcatcgccgagtgccacagcgtggacatcaagctgagcaaggagcagtgctgggagagccggcagttcagatag

SEQ ID NO: 161383 - DNA, 3993 bp, Artificial Sequence
  Description of Artificial Sequence: Synthetic coding sequence
atgggcacagccagcagcctggtgtccccagctggaggagaggtgattgaggacacctacggggccggcggcggggaggcctgtgagatccctgtggaggtgaagcccaaggcccggctgctgaggaacagcttcagaagaggagctggagctgctgctggagctggccctggcagcctgccccggggcgtgggcgctgggggcctgctgggcgccagcttcaagagcacaggcagctctgtgcctgagctggagtatgctgctgctgaatatgagcggctgaggaaggagtatgagatcttccgggtgtccaagaaccaggagctgctgtccatgggccggcgggaggccaagctggacacagagaacaagaggctgcgggcagagctgcaggccctgcagaagacctaccagaagatcctgcgggagaaggagagcgccctggaggccaagtaccaggccatggagcgggccgccacctttgaacatgaccgggacaaggtgaagaggcagttcaagatcttccgggagaccaaggaaaatgagatccaggacctgctgcgggccaagcgggagctggagagcaagctgcagaggctgcaggcccagggcatccaggtgtttgaccccggggagagtgacagtgatgacaactgcacagatgtgacagctgctggcacccagtgtgagtactggacaggaggagccctgggcagcgagcccagcatcggctccatgatccagctgcagcagagcttccggggccctgagtttgcccacagcagcattgatgtggagggcccctttgccaacgtgaacagagatgactgggacattgctgtggccagcctgctgcaggtgacccccctcttcagccacagcctgtggagcaacacagtgcgctgctacctgatctacacagatgagacccagcctgagatggacctcttcctgaaggactacagccccaagctgaagaggatgtgtgagaccatgggctacttcttccacgctgtgtacttccccattgatgtggagaaccagtacctgactgtgaggaagtgggagattgagaagagcagcctggtgatcctcttcatccacctgaccctgcccagcctgctgctggaggactgtgaggaggccttcctgaagaaccctgagggcaagcccaggctcatcttccaccggctggaggatggcaaggtgtccagtgacagcgtgcagcagctgattgaccaggtgagcaacctgaacaagaccagcaaggccaagatcatcgaccacagcggggaccctgctgagggcgtgtacaagacctacatctgtgtggagaagatcatcaagcaggacatcctgggctttgagaacacagacctggagaccaaggacctgggcagcgaggacagcatccctgaggaggatgactttggagatgtgctgtgggacatccatgatgagcaggagcagatggagaccttccagcaggccagcaacagcgcccacgagctgggctttgagaagtactaccagaggctgaatgacctggtggccgccccagcccccatcccccccctgctggtgtctgggggccctggcagcggcaagagcctgctgctgagcaagtggatccagctgcagcagaagaacagccccaacaccctcatcctgagccactttgtgggccggcccatgagcaccagcagcgagagcagcctcatcatcaagaggctgaccctgaagctgatgcagcacagctggagcgtgtctgccctgaccctggaccctgccaagctgctggaggagttcccccgctggctggagaagctgagcgcccggcaccagggcagcatcatcatcgtcatcgacagcattgaccaggtgcagcaggtggagaagcacatgaagtggctgattgaccccctgcctgtgaatgtgcgggtgattgtgtctgtgaatgtggagacctgccccccagcctggaggctgtggcccaccctgcacctggaccccctgagccccaaggatgccaagagcatcatcatcgccgagtgccacagcgtggacatcaagctgagcaaggagcaggagaagaagctggagcggcactgccgcagcgccaccacctgcaatgccctgtatgtgaccctgtttgggaagatgattgcccgggccggccgggccggcaacctggacaagatcctgcaccagtgcttccagtgccaggacaccctgagcctgtaccgcctggtgctgcacagcatccgggagagcatggccaatgatgtggacaaggagctgatgaagcagatcctgtgcctggtgaatgtgagccacaacggggtgtctgagagcgagctgatggagctgtacccagagatgtcctggaccttcctgaccagcctcatccacagcctgtacaagatgtgcctgctgacctacggctgcggcctgctgcgcttccagcacctgcaggcctgggagaccgtgcggctggagtacctggagggccccaccgtgaccagcagctaccggcagaagctgatcaactacttcaccctgcagctgagccaggacagagtgacctggaggtctgcagatgagctgccctggctgttccagcagcagggcagcaagcagaagctgcatgactgcctgctgaacctgtttgtgtcccagaacctgtacaagaggggccactttgctgagctgctgagctactggcagtttgtgggcaaggacaagagcgccatggccacagagtactttgacagcctgaagcagtatgagaagaactgtgagggggaggacaacatgagctgcctggccgacctgtatgagaccctgggccgcttcctgaaggacctgggcctgctgagccaggccatcgtgcccctgcagaggagcctggagatccgggagacagccctggaccctgaccacccccgggtggcccagagcctgcaccagctggcctctgtgtatgtgcagtggaagaagtttggaaatgctgagcagctgtacaagcaggccctggagatcagtgaaaatgcctatggagctgaccacccctacacagcccgggagctggaggccctggccaccctgtaccagaagcagaacaagtatgagcaggccgagcacttcaggaagaagagcttcaagatccaccagaaggccatcaagaagaagggcaacctgtatggctttgccctgctgcggcggcgggccctgcagctggaggagctgaccctgggcaaggacaccccagacaatgcccggaccctgaatgagctgggcgtgctgtactacctgcagaacaacctggagacagctgaccagttcctgaagaggagcctggagatgagggagcgggtgctgggccctgaccacccagactgtgcccagagcctgaacaacctggccgccctgtgcaatgagaagaagcagtatgacaaggccgaggagctgtatgaaagagccctggacatcagaagaagagccctggccccagaccaccccagcctggcctacacagtgaagcacctggccatcctgtacaagaagatgggcaagctggacaaggctgtgcccctgtatgagctggccgtggagatccggcagaagagctttggccccaagcaccccagcgtggccacagccctggtgaacctggccgtgctgtacagccagatgaagaagcacgtggaggccctgcccctgtatgaaagagccctgaagatctatgaggacagcctgggccgcatgcacccccgggtgggggagaccctgaagaacctggccgtgctgtcctatgagggcggggactttgagaaggctgctgagctgtacaagagggccatggagatcaaggaggccgagaccagcctgctgggcggcaaggcccccagccgccacagcagcagcggggacaccttcagcctgaagacagcccacagccccaacgtgttcctgcagcagggccagaggtag

SEQ ID NO: 161384 - DNA, 720 bp, Artificial Sequence
  Description of Artificial Sequence: Synthetic coding sequence
atgggcacagccagcagcctggtgtccccagctggaggagaggtgattgaggacacctacggggccggcggcggggaggcctgtgagatccctgtggaggtgaagcccaaggcccggctgctgaggaacagcttcagaagaggagctggagctgctgctggagctggccctggcagcctgccccggggcgtgggcgctgggggcctgctgggcgccagcttcaagagcacaggcagctctgtgcctgagctggagtatgctgctgctgaatatgagcggctgaggaaggagtatgagatcttccgggtgtccaagaaccaggagctgctgtccatgggccggcgggaggccaagctggacacagagaacaagaggctgcgggcagagctgcaggccctgcagaagacctaccagaagatcctgcgggagaaggagagcgccctggaggccaagtaccaggccatggagcgggccgccacctttgaacatgaccgggacaaggtgaagaggcagttcaagatcttccgggagaccaaggaaaatgagatccaggacctgctgcgggccaagcgggagctggagagcaagctgcagaggctgcaggcccagggcatccaggtgtttgaccccggggagagtgacagtgatgacaactgcacagatgtgacagtgtccctggagagtgaccagcaccctggcatcttcatcgccaacttctag

SEQ ID NO: 161385 - DNA, 453 bp, Artificial Sequence
  Description of Artificial Sequence: Synthetic coding sequence
atgggcacagccagcagcctggtgtccccagctggaggagaggtgattgaggacacctacggggccggcggcggggaggcctgtgagatccctgtggaggtgaagcccaaggcccggctgctgaggaacagcttcagaagaggagctggagctgctgctggagctggccctggcagcctgccccggggcgtgggcgctgggggcctgctgggcgccagcttcaagagcacaggcagctctgtgcctgagctggagtatgctgctgctgaatatgagcggctgaggaaggagtatgagatcttccgggtgtccaagaaccaggagctgctgtccatgggccggcgggaggccaagctggacacagagaacaagaggctgcgggcagagctgcagggcctggccgctgtggcccggagccggctgacagccacctggaacagctgggcccagtag

SEQ ID NO: 161386 - DNA, 1914 bp, Artificial Sequence
  Description of Artificial Sequence: Synthetic coding sequence
atcatcgccaatgccggccgggccggcaacctggacaagatcctgcaccagtgcttccagtgccaggacaccctgagcctgtaccgcctggtgctgcacagcatccgggagagcatggccaatgatgtggacaaggagctgatgaagcagatcctgtgcctggtgaatgtgagccacaacggggtgtctgagagcgagctgatggagctgtacccagagatgtcctggaccttcctgaccagcctcatccacagcctgtacaagatgtgcctgctgacctacggctgcggcctgctgcgcttccagcacctgcaggcctgggagaccgtgcggctggagtacctggagggccccaccgtgaccagcagctaccggcagaagctgatcaactacttcaccctgcagctgagccaggacagagtgacctggaggtctgcagatgagctgccctggctgttccagcagcagggcagcaagcagaagctgcatgactgcctgctgaacctgtttgtgtcccagaacctgtacaagaggggccactttgctgagctgctgagctactggcagtttgtgggcaaggacaagagcgccatggccacagagtactttgacagcctgaagcagtatgagaagaactgtgagggggaggacaacatgagctgcctggccgacctgtatgagaccctgggccgcttcctgaaggacctgggcctgctgagccaggccatcgtgcccctgcagaggagcctggagatccgggagacagccctggaccctgaccacccccgggtggcccagagcctgcaccagctggcctctgtgtatgtgcagtggaagaagtttggaaatgctgagcagctgtacaagcaggccctggagatcagtgaaaatgcctatggagctgaccacccctacacagcccgggagctggaggccctggccaccctgtaccagaagcagaacaagtatgagcaggccgagcacttcaggaagaagagcttcaagatccaccagaaggccatcaagaagaagggcaacctgtatggctttgccctgctgcggcggcgggccctgcagctggaggagctgaccctgggcaaggacaccccagacaatgcccggaccctgaatgagctgggcgtgctgtactacctgcagaacaacctggagacagctgaccagttcctgaagaggagcctggagatgagggagcgggtgctgggccctgaccacccagactgtgcccagagcctgaacaacctggccgccctgtgcaatgagaagaagcagtatgacaaggccgaggagctgtatgaaagagccctggacatcagaagaagagccctggccccagaccaccccagcctggcctacacagtgaagcacctggccatcctgtacaagaagatgggcaagctggacaaggctgtgcccctgtatgagctggccgtggagatccggcagaagagctttggccccaagcaccccagcgtggccacagccctggtgaacctggccgtgctgtacagccagatgaagaagcacgtggaggccctgcccctgtatgaaagagccctgaagatctatgaggacagcctgggccgcatgcacccccgggtgggggagaccctgaagaacctggccgtgctgtcctatgagggcggggactttgagaaggctgctgagctgtacaagagggccatggagatcaaggaggccgagaccagcctgctgggcggcaaggcccccagccgccacagcagcagcggggacaccttcagcctgaagacagcccacagccccaacgtgttcctgcagcagggccagaggaaggtgcagagcaacctgctgagccctgagggcctgagcaacatctgtgcccaggagaagaccacccgcttcaccagcagctag

SEQ ID NO: 161387 - DNA, 1236 bp, Artificial Sequence
  Description of Artificial Sequence: Synthetic coding sequence
atgagctgcctggccgacctgtatgagaccctgggccgcttcctgaaggacctgggcctgctgagccaggccatcgtgcccctgcagaggagcctggagatccgggagacagccctggaccctgaccacccccgggtggcccagagcctgcaccagctggcctctgtgtatgtgcagtggaagaagtttggaaatgctgagcagctgtacaagcaggccctggagatcagtgaaaatgcctatggagctgaccacccctacacagcccgggagctggaggccctggccaccctgtaccagaagcagaacaagtatgagcaggccgagcacttcaggaagaagagcttcaagatccaccagaaggccatcaagaagaagggcaacctgtatggctttgccctgctgcggcggcgggccctgcagctggaggagctgaccctgggcaaggacaccccagacaatgcccggaccctgaatgagctgggcgtgctgtactacctgcagaacaacctggagacagctgaccagttcctgaagaggagcctggagatgagggagcgggtgctgggccctgaccacccagactgtgcccagagcctgaacaacctggccgccctgtgcaatgagaagaagcagtatgacaaggccgaggagctgtatgaaagagccctggacatcagaagaagagccctggccccagaccaccccagcctggcctacacagtgaagcacctggccatcctgtacaagaagatgggcaagctggacaaggctgtgcccctgtatgagctggccgtggagatccggcagaagagctttggccccaagcaccccagcgtggccacagccctggtgaacctggccgtgctgtacagccagatgaagaagcacgtggaggccctgcccctgtatgaaagagccctgaagatctatgaggacagcctgggccgcatgcacccccgggtgggggagaccctgaagaacctggccgtgctgtcctatgagggcggggactttgagaaggctgctgagctgtacaagagggccatggagatcaaggaggccgagaccagcctgctgggcggcaaggcccccagccgccacagcagcagcggggacaccttcagcctgaagacagcccacagccccaacgtgttcctgcagcagggccagagagctgggaagagcaaccccaccttctacctgcagaagggcttccagacctacgtgctgtag

SEQ ID NO: 161388 - DNA, 4281 bp, Artificial Sequence
  Description of Artificial Sequence: Synthetic coding sequence
atgaatgactggcaccgcatcttcacccagaatgtgctggtgcccccccacccccagagggcccggcagccctggaaggagagcacagccttccagtgtgtgctgaagtggctggatggccctgtgatccggcagggcgtgctggaggtgctgtctgaggtggagtgccacctgcgggtgtccttctttgatgtgacctaccgccacttctttggaagaacctggaagaccaccgtgaagcccaccaagaggcctcccagcagaattgtgttcaatgagcccctgtacttccacaccagcctgaaccacccccacatcgtggccgtggtggaggtggtggccgagggcaagaagagagatggcagcctgcagaccctgagctgtggcttcggcatcctgcgcatcttcagcaaccagcctgacagccccatcagcgccagccaggacaagaggctgcggctgtaccacggcaccccccgggccctgctgcaccccctgctgcaggaccctgctgagcagaacagacacatgaccctgattgagaactgcagcctgcagtacaccctgaagccccacccagccctggagcccgccttccacctgctgcctgagaacctgctggtgtctggcctgcagcagatccctggcctgctgcctgcccatggagagagcggagatgccctgaggaagccccggctgcagaagcccatcaccggccacctggatgacctcttcttcaccctgtaccccagcctggagaagtttgaggaggagctgctggagctgcacgtgcaggaccacttccaggagggctgcggccccctggatggaggagccctggagatcctggagcggcggctgcgggtgggcgtgcacaacggcctgggctttgtgcagaggccccaggtggtggtgctggtgcctgagatggatgtggccctgaccaggtctgccagcttcagcaggaaggtggtgagcagcagcaagaccagcagcggcagccaggccctggtgctgcggagccggctgcggctgcctgagatggtgggccacccagcctttgctgtgatcttccagctggagtatgtgttcagcagccctgctggggtggatggaaatgctgcctctgtgaccagcctgagcaacctggcctgcatgcacatggtgcgctgggccgtgtggaaccccctgctggaggccgacagcggccgggtgaccctgcccctgcagggcggcatccagcccaaccccagccactgcctggtgtacaaggtgcccagcgcctccatgagcagcgaggaggtgaagcaggtggagagcggcaccctgcgcttccagttcagcctgggcagcgaggagcacctggatgcccccacagagcctgtgtctggccccaaggtggagcggcggcccagcaggaagccacccaccagccccagcagccccccagcccctgtgccccgggtgctggccgccccccagaacagccctgtgggccctggcctgagcatcagccagctggccgccagccccaggagccccacccagcactgcctggcccggcccaccagccagctgccccacggcagccaggccagccctgcccaggcccaggagttccccctggaggccggcatcagccacctggaggccgacctgagccagaccagcctggtgctggagaccagcattgctgagcagctgcaggagctgcccttcacccccctgcacgcccccatcgtggtgggcacccagaccaggagcagcgctggccagcccagccgggcctccatggtgctgctgcagagcagcggcttccctgagatcctggatgccaacaagcagcctgctgaggccgtgtctgccacagagcctgtgaccttcaacccccagaaggaggagagtgactgcctgcagagcaatgagatggtgctgcagttcctggccttcagccgggtggcccaggactgccggggcacctcctggcccaagacagtgtacttcaccttccagttctaccgcttccccccagccaccaccccccggctgcagctggtgcagctggatgaagctggccagcccagcagcggggccctgacccacatcctggtgcctgtgtccagagatggcacctttgatgctggcagccctggcttccagctgcgctacatggtgggccctggcttcctgaagccaggagagcggcgctgctttgcccgctacctggccgtgcagaccctgcagattgatgtgtgggatggagacagcctgctgctgattggcagcgctgctgtgcagatgaagcacctgctgcggcagggccggcctgctgtgcaggccagccatgagctggaggtggtggccacagaatatgagcaggacaacatggtggtgtctggggacatgctgggcttcggccgggtgaagcccatcggcgtgcacagcgtggtgaagggccgcctgcacctgaccctggccaacgtgggccacccctgtgagcagaaggtgcggggctgcagcaccctgccccccagccgcagcagggtcatcagcaatgatggagccagccgcttcagcggcggcagcctgctgaccaccggcagcagcaggaggaagcacgtggtgcaggcccagaagctggctgatgtggacagcgagctggccgccatgctgctgacccacgcccggcagggcaagggcccccaggatgtgtcccgggagagtgatgccaccaggaggaggaagctggagaggatgaggtctgtgcggctgcaggaggccggcggggacctgggcagaagaggcacctctgtgctggcccagcagagcgtgaggacccagcacctgcgggacctgcaggtgattgctgcctaccgggagaggaccaaggccgagagcatcgccagcctgctgagcctggccatcaccacagagcacaccctgcacgccaccctgggcgtggccgagttctttgaatttgtgctgaagaacccccacaacacccagcacacagtgacagtggagattgacaaccctgagctgtctgtgattgtggacagccaggagtggagggacttcaagggagctgctggcctgcacacccctgtggaggaggacatgttccacctgcggggcagcctggccccccagctgtacctgcggccccatgaaacagcccacgtgcccttcaagttccagagcttctctgctggccagctggccatggtgcaggccagccctggcctgagcaatgagaagggcatggatgctgtgagcccctggaagagcagcgctgtgcccaccaagcacgccaaggtgctcttccgggccagcggcggcaagcccatcgctgtgctgtgcctgactgtggagctgcagccccacgtggtggaccaggtgttccgcttctaccaccctgagctgtccttcctgaagaaggccatccggctgcccccctggcacaccttccctggggcccctgtgggcatgctgggggaggacccccctgtgcacgtgcgctgcagcgaccccaacgtcatctgtgagacccagaatgtgggccctggagagccccgggacatcttcctgaaggtggccagcggccccagccctgagatcaaggacttcttcgtcatcatctacagcgaccgctggctggccacccccacccagacctggcaggtgtacctgcacagcctgcagagggtggatgtgtcctgtgtggccggccagctgacccggctgagcctggtgctgcggggcacccagacagtgaggaaggtgcgggccttcaccagccacccccaggagctgaagacagaccccaagggcgtgtttgtgctgcccccccggggcgtgcaggacctgcacgtgggcgtgcggcccctgcgggccggcagcagatttgtgcacctgaacctggtggatgtggactgccaccagctggtggcctcctggctggtgtgcctgtgctgccggcagcccctcatcagcaaggcctttgagatcatgctggccgccggggagggcaagggcgtgaacaagaggatcacctacaccaacccctaccccagcaggaggaccttccacctgcacagcgaccaccctgagctgctgcgcttccgggaggacagcttccaggtgggcggcggggagacctacaccatcggcctgcagtttgcccccagccagagggtgggggaggaggagatcctgatctacatcaatgaccacgaggacaagaatgaggaggccttctgtgtgaaggtgatctaccagtag

SEQ ID NO: 161389 - DNA, 546 bp, Artificial Sequence
  Description of Artificial Sequence: Synthetic coding sequence
atggtgctgctgcagagcagcggcttccctgagatcctggatgccaacaagcagcctgctgaggccgtgtctgccacagagcctgtgaccttcaacccccagaaggaggagagtgactgcctgcagagcaatgagatggtgctgcagttcctggccttcagccgggtggcccaggactgccggggcacctcctggcccaagacagtgtacttcaccttccagttctaccgcttccccccagccaccaccccccggctgcagctggtgcagctggatgaggccggccagcccagcagcggggccctgacccacatcctggtgcctgtgtccagagatggcacctttgatgctggcagccctggcttccagctgcgctacatggtgggccctggcttcctgaagccaggagagcggcgctgctttgcccgctacctggccgtgcagaccctgcagattgatgtgtgggatggagacagcctgctgctgattggcagcgctgctgtgcagatgaaggagaccagccacatcttctctgtgtcccagtag

SEQ ID NO: 161390 - DNA, 3606 bp, Artificial Sequence
  Description of Artificial Sequence: Synthetic coding sequence
atggccctgggcaccaccctgcgggccagcctgctgctgctgggcctgctgacagagggcctggcccagctggccatcccagcctctgtgccccggggcttctgggccctgcctgagaacctgactgtggtggagggcgcctctgtggagctgcgctgtggggtgtccaccccaggcagcgctgtgcagtgggccaaggatggcctgctgctgggccctgacccccgcatccctggcttcccccgctaccgcctggagggggaccctgcccggggggagttccacctgcacatcgaggcctgtgacctgagtgatgatgctgaatatgagtgccaggtgggccgctctgagatgggccctgagctggtgagccccagggtcatcctgagcatcctggtgccccccaagctgctgctgctgaccccagaggccggcaccatggtgacctgggtggccggccaggagtatgtggtgaactgtgtgtctggagatgccaagccagccccagacatcaccatcctgctgagcggccagaccatcagtgacatcagcgccaacgtgaatgaaggcagccagcagaagctgttcaccgtggaggccacagcccgggtgacccccaggagcagtgacaaccggcagctgctggtgtgtgaggccagcagccctgccctggaggcccccatcaaggccagcttcaccgtgaatgtgctcttccccccaggcccccctgtgattgagtggccaggcctggatgagggccacgtgcgggccggccagagcctggagctgccctgtgtggcccggggcggcaaccccctggccaccctgcagtggctgaagaatggccagcctgtgtccacagcctggggcacagagcacacccaggccgtggcccggtctgtgctggtgatgacagtgcggccagaagatcatggagcccagctgagctgtgaggcccacaacagcgtgtctgctggcacccaggagcacggcatcaccctgcaggtgaccttccccccatctgccatcatcatcctgggcagcgccagccagacagagaacaagaatgtgaccctgagctgtgtgtccaagagcagccggccccgggtgctgctgcgctggtggctgggctggaggcagctgctgcccatggaggagaccgtgatggatggcctgcatggaggccacatctccatgagcaacctgaccttcctggccaggagagaagataatggcctgaccctgacctgtgaggccttcagcgaggccttcaccaaggagaccttcaagaagagcctcatcctgaatgtgaagtacccagcccagaagctgtggattgagggccccccagagggccagaagctgcgggccggcaccagggtgcggctggtgtgcctggccatcggcggcaaccctgagcccagcctgatgtggtacaaggacagcaggacagtgacagagagccggctgccccaggagagcagaagagtgcacctgggctctgtggagaagagcggcagcaccttcagccgggagctggtgctggtgacaggccccagcgacaaccaggccaagttcacctgcaaggccggccagctgagcgccagcacccagctggccgtgcagttcccccccaccaacgtgaccatcctggccaatgccagcgccctgcggcctggagatgccctgaacctgacctgtgtgtctgtgagcagcaacccccctgtgaacctgtcctgggacaaggagggggagcggctggagggcgtggccgcccccccaagaagagcccccttcaagggcagcgctgctgcccggtctgtgctgctgcaggtgagcagccgggaccacggccagagggtgacctgccgggcccacagcgctgagctgcgggagaccgtgagcagcttctaccgcctgaatgtgctgtacagacctgagttcctgggggagcaggtgctggtggtgacagctgtggagcagggcgaggccctgctgcctgtgtctgtgtctgccaacccagcccctgaggccttcaactggaccttccggggctaccgcctgagccctgctgggggccccaggcaccgcatcctgagcagcggggccctgcacctgtggaatgtgaccagggcagatgatggcctgtaccagctgcactgccagaacagcgagggcacagctgaggcccggctgcggctggatgtgcactacgcccccaccatccgggccctgcaggaccccacagaggtgaatgtgggcggctctgtggacatcgtgtgcaccgtggatgccaaccccatcctgcccggcatgttcaactgggagcggctgggggaggatgaggaggaccagagcctggatgacatggagaagatcagccggggccccaccggccgcctgcgcatccaccacgccaagctggcccaggccggggcctaccagtgcatcgtggacaacggggtggcccccccagcccggcggctgctgcggctggtggtgcgctttgccccccaggtggagcaccccacccccctgaccaaggtggccgccgccggggacagcaccagcagcgccaccctgcactgccgggcccggggcgtgcccaacatcgtgttcacctggaccaagaatggagtgcccctggacctgcaggacccccgctacacagagcacacctaccaccagggcggcgtgcacagcagcctgctgaccatcgccaacgtgtctgctgcccaggactatgccctcttcacctgcacagccaccaatgccctgggcagtgaccagaccaacatccagctggtgtccatcagcaggccagaccccccatctggcctgaaggtggtgtccctgaccccccacagcgtgggcctggagtggaagccaggctttgatggcggcctgccccagcgcttctgcatccgctatgaggccctgggcaccccaggcttccactacgtggatgtggtgcccccccaggccaccaccttcaccctgaccggcctgcagcccagcacccgctacagagtgtggctgctggccagcaatgccctgggggacagcggcctggccgacaagggcacccagctgcccatcaccaccccaggcctgcaccagcccagcggggagcctgaggaccagctgcccacagagcccccatctggcatcagcgagaagacagaagctggctctgaagaagatagagtgagaaatgaatatgaggagagccagtggacaggagagcgggacacccagagcagcacagtgtccaccacagaagctgagccctactaccgcagcctgcgggacttcagcccccagctgccccccacccaggaggaggtgtcctacagccggggcttcaccggagaagatgaggacatggccttccctggccacctgtatgatgaggtggagaggacctacccacccagcggggcctggggccccctgtatgatgaggtgcagatgggcccctgggacctgcactggccagaggacacctaccaggacccccggggcatctatgaccaggtggccggggacctggacaccctggagccagacagcctgccctttgagctgcggggccacctggtgtag

SEQ ID NO: 161391 - DNA, 3726 bp, Artificial Sequence
  Description of Artificial Sequence: Synthetic coding sequence
atggccctgggcaccaccctgcgggccagcctgctgctgctgggcctgctgacagagggcctggcccagctggccatcccagcctctgtgccccggggcttctgggccctgcctgagaacctgactgtggtggagggcgcctctgtggagctgcgctgtggggtgtccaccccaggcagcgctgtgcagtgggccaaggatggcctgctgctgggccctgacccccgcatccctggcttcccccgctaccgcctggagggggaccctgcccggggggagttccacctgcacatcgaggcctgtgacctgagtgatgatgctgaatatgagtgccaggtgggccgctctgagatgggccctgagctggtgagccccagggtcatcctgagcatcctggtgccccccaagctgctgctgctgaccccagaggccggcaccatggtgacctgggtggccggccaggagtatgtggtgaactgtgtgtctggagatgccaagccagccccagacatcaccatcctgctgagcggccagaccatcagtgacatcagcgccaacgtgaatgaaggcagccagcagaagctgttcaccgtggaggccacagcccgggtgacccccaggagcagtgacaaccggcagctgctggtgtgtgaggccagcagccctgccctggaggcccccatcaaggccagcttcaccgtgaatgtgctcttccccccaggcccccctgtgattgagtggccaggcctggatgagggccacgtgcgggccggccagagcctggagctgccctgtgtggcccggggcggcaaccccctggccaccctgcagtggctgaagaatggccagcctgtgtccacagcctggggcacagagcacacccaggccgtggcccggtctgtgctggtgatgacagtgcggccagaagatcatggagcccagctgagctgtgaggcccacaacagcgtgtctgctggcacccaggagcacggcatcaccctgcaggtgaccttccccccatctgccatcatcatcctgggcagcgccagccagacagagaacaagaatgtgaccctgagctgtgtgtccaagagcagccggccccgggtgctgctgcgctggtggctgggctggaggcagctgctgcccatggaggagaccgtgatggatggcctgcatggaggccacatctccatgagcaacctgaccttcctggccaggagagaagataatggcctgaccctgacctgtgaggccttcagcgaggccttcaccaaggagaccttcaagaagagcctcatcctgaatgtgaagtacccagcccagaagctgtggattgagggccccccagagggccagaagctgcgggccggcaccagggtgcggctggtgtgcctggccatcggcggcaaccctgagcccagcctgatgtggtacaaggacagcaggacagtgacagagagccggctgccccaggagagcagaagagtgcacctgggctctgtggagaagagcggcagcaccttcagccgggagctggtgctggtgacaggccccagcgacaaccaggccaagttcacctgcaaggccggccagctgagcgccagcacccagctggccgtgcagttcccccccaccaacgtgaccatcctggccaatgccagcgccctgcggcctggagatgccctgaacctgacctgtgtgtctgtgagcagcaacccccctgtgaacctgtcctgggacaaggagggggagcggctggagggcgtggccgcccccccaagaagagcccccttcaagggcagcgctgctgcccggtctgtgctgctgcaggtgagcagccgggaccacggccagagggtgacctgccgggcccacagcgctgagctgcgggagaccgtgagcagcttctaccgcctgaatgtgctgtacagacctgagttcctgggggagcaggtgctggtggtgacagctgtggagcagggcgaggccctgctgcctgtgtctgtgtctgccaacccagcccctgaggccttcaactggaccttccggggctaccgcctgagccctgctgggggccccaggcaccgcatcctgagcagcggggccctgcacctgtggaatgtgaccagggcagatgatggcctgtaccagctgcactgccagaacagcgagggcacagctgaggcccggctgcggctggatgtgcactacgcccccaccatccgggccctgcaggaccccacagaggtgaatgtgggcggctctgtggacatcgtgtgcaccgtggatgccaaccccatcctgcccggcatgttcaactgggagcggctgggggaggatgaggaggaccagagcctggatgacatggagaagatcagccggggccccaccggccgcctgcgcatccaccacgccaagctggcccaggccggggcctaccagtgcatcgtggacaacggggtggcccccccagcccggcggctgctgcggctggtggtgcgctttgccccccaggtggagcaccccacccccctgaccaaggtggccgccgccggggacagcaccagcagcgccaccctgcactgccgggcccggggcgtgcccaacatcgtgttcacctggaccaagaatggagtgcccctggacctgcaggacccccgctacacagagcacacctaccaccagggcggcgtgcacagcagcctgctgaccatcgccaacgtgtctgctgcccaggactatgccctcttcacctgcacagccaccaatgccctgggcagtgaccagaccaacatccagctggtgtccatcagcaggccagaccccccatctggcctgaaggtggtgtccctgaccccccacagcgtgggcctggagtggaagccaggctttgatggcggcctgccccagcgcttctgcatccgctatgaggccctgggcaccccaggcttccactacgtggatgtggtgcccccccaggccaccaccttcaccctgaccggcctgcagcccagcacccgctacagagtgtggctgctggccagcaatgccctgggggacagcggcctggccgacaagggcacccagctgcccatcaccaccccaggcctgcaccagcccagcggggagcctgaggaccagctgcccacagagcccccatctggccccagcggcctgcccctgctgcctgtgctgtttgccctgggcggcctgctgctgctgagcaatgccagctgtgtgggcggcgtgctgtggcagaggcggctgcggcggctggccgagggcatcagcgagaagacagaagctggctctgaagaagatagagtgagaaatgaatatgaggagagccagtggacaggagagcgggacacccagagcagcacagtgtccaccacagaagctgagccctactaccgcagcctgcgggacttcagcccccagctgccccccacccaggaggaggtgtcctacagccggggcttcaccggagaagatgaggacatggccttccctggccacctgtatgatgaggtggagaggacctacccacccagcggggcctggggccccctgtatgatgaggtgcagatgggcccctgggacctgcactggccagaggacacctaccaggacccccggggcatctatgaccaggtggccggggacctggacaccctggagccagacagcctgccctttgagctgcggggccacctggtgtag

SEQ ID NO: 161392 - DNA, 1152 bp, Artificial Sequence
  Description of Artificial Sequence: Synthetic coding sequence
atggagcggcgggcccggagcagcagccgggagagccggggccggggcggccgcaccccccacaaggagaacaagagggccaaggccgagaggtctgggggcggccggggccggcaggaggccggccctgagcccagcggcagcggccgggccggcaccccaggagagccccgggccccagctgccaccgtggtggatgtggatgaggtgcggggcagcggggaggagggcacagaggtggtggccctgctggagagcgagaggcctgaggagggcaccaagagcagcggcctgggcgcctgtgagtggctgctggtgctgatcagcctgctcttcatcatcatgaccttccccttcagcatctggttctgtgtgaaggtggtgcaggagtatgaaagagtcatcatcttccggctgggccacctgctgcccggccgggccaagggccctggcctcttcttcttcctgccctgcctggacacctaccacaaggtggacctgcggctgcagaccctggagatccccttccatgaaattgtgaccaaggacatgttcatcatggagattgatgccatctgctactacaggatggagaatgccagcctgctgctgagcagcctggcccacgtgtccaaggctgtgcagttcctggtgcagaccaccatgaagaggctgctggcccacaggagcctgacagagatcctgctggagaggaagagcatcgcccaggatgccaaggtggccctggacagcgtgacctgcatctggggcatcaaggtggagagaattgagatcaaggatgtgcggctgcctgctggcctgcagcacagcctggccgtggaggccgaggcccagaggcaggccaaggtgaggatgattgctgctgaggccgagaaggccgccagcgagagcctgaggatggctgctgagatcctgagcggcaccccagctgctgtgcagctgcgctacctgcacaccctgcagagcctgagcacagagaagcccagcacagtggtgctgcccctgccctttgacctgctgaactgcctgagcagccccagcaacagaacccagggcagcctgcccttccccagccccagcaagcctgtggagcccctgaaccccaagaagaaggacagccccatgctgtag

SEQ ID NO: 161393 - DNA, 948 bp, Artificial Sequence
  Description of Artificial Sequence: Synthetic coding sequence
atggagcggcgggcccggagcagcagccgggagagccggggccggggcggccgcaccccccacaaggagaacaagagggccaaggccgagaggtctgggggcggccggggccggcaggaggccggccctgagcccagcggcagcggccgggccggcaccccaggagagccccgggccccagctgccaccgtggtggatgtggatgaggtgcggggcagcggggaggagggcacagaggtggtggccctgctggagagcgagaggcctgaggagggcaccaagagcagcggcctgggcgcctgtgagtggctgctggtgctgatcagcctgctcttcatcatcatgaccttccccttcagcatctggttctgtgtgaaggtggtgcaggagtatgaaagagtcatcatcttccggctgggccacctgctgcccggccgggccaagggccctggcctcttcttcttcctgccctgcctggacacctaccacaaggtggacctgcggctgcagaccctggagatccccttccacgaggtggccctggacagcgtgacctgcatctggggcatcaaggtggagagaattgagatcaaggatgtgcggctgcctgctggcctgcagcacagcctggccgtggaggccgaggcccagaggcaggccaaggtgaggatgattgctgctgaggccgagaaggccgccagcgagagcctgaggatggctgctgagatcctgagcggcaccccagctgctgtgcagctgcgctacctgcacaccctgcagagcctgagcacagagaagcccagcacagtggtgctgcccctgccctttgacctgctgaactgcctgagcagccccagcaacagaacccagggcagcctgcccttccccagccccagcaagcctgtggagcccctgaaccccaagaagaaggacagccccatgctgtag

SEQ ID NO: 161394 - DNA, 1284 bp, Artificial Sequence
  Description of Artificial Sequence: Synthetic coding sequence
atgggcgctggggccaccggccgggccatggatggcccccggctgctgctgctgctgctgctgggcgtgtccctgggcggggccaaggaggcctgccccaccggcctgtacacccacagcggggagtgctgcaaggcctgcaacctgggggagggcgtggcccagccctgtggggccaaccagacagtgtgtgagccctgcctggacagcgtgaccttcagtgatgtggtgtctgccacagagccctgcaagccctgcacagaatgtgtgggcctgcagagcatgtctgccccctgtgtggaggctgatgatgctgtgtgccgctgtgcctacggctactaccaggatgagaccaccggccgctgtgaggcctgccgggtgtgtgaggccggcagcggcctggtgttcagctgccaggacaagcagaacacagtgtgtgaggagtgcccagatggcacctacagtgatgaggccaaccacgtggacccctgcctgccctgcaccgtgtgtgaggacacagagcggcagctgagagaatgtacccgctgggcagatgctgaatgtgaggagatccctggccgctggatcaccaggagcaccccacctgagggcagtgacagcacagcccccagcacccaggagcctgaggcccctcctgagcaggacctgattgccagcacagtggccggcgtggtgaccaccgtgatgggcagcagccagcctgtggtgacccggggcaccacagacaacctgatccctgtgtactgcagcatcctggccgctgtggtggtgggcctggtggcctacatcgccttcaagcgctggaacagctgcaagcagaacaagcagggcgccaacagcaggcctgtgaaccagaccccacctcctgagggggagaagctgcacagcgacagcggcatctctgtggacagccagagcctgcatgaccagcagccccacacccagacagccagcggccaggccctgaagggagatggcggcctgtacagcagcctgcccccagccaagcgggaggaggtggagaagctgctgaatggcagcgctggggacacctggaggcacctggccggggagctgggctaccagcctgagcacatcgacagcttcacccatgaggcctgccctgtgcgggccctgctggcctcctgggccacccaggacagcgccaccctggatgccctgctggccgccctgcggcgcatccagagagctgacctggtggagagcctgtgcagcgagagcacagccaccagccctgtgtag

SEQ ID NO: 161395 - DNA, 1002 bp, Artificial Sequence
  Description of Artificial Sequence: Synthetic coding sequence
atgtctgccccctgtgtggaggctgatgatgctgtgtgccgctgtgcctacggctactaccaggatgagaccaccggccgctgtgaggcctgccgggtgtgtgaggccggcagcggcctggtgttcagctgccaggacaagcagaacacagtgtgtgaggagtgcccagatggcacctacagtgatgaggccaaccacgtggacccctgcctgccctgcaccgtgtgtgaggacacagagcggcagctgagagaatgtacccgctgggcagatgctgaatgtgaggagatccctggccgctggatcaccaggagcaccccacctgagggcagtgacagcacagcccccagcacccaggagcctgaggcccctcctgagcaggacctgattgccagcacagtggccggcgtggtgaccaccgtgatgggcagcagccagcctgtggtgacccggggcaccacagacaacctgatccctgtgtactgcagcatcctggccgctgtggtggtgggcctggtggcctacatcgccttcaagcgctggaacagctgcaagcagaacaagcagggcgccaacagcaggcctgtgaaccagaccccacctcctgagggggagaagctgcacagcgacagcggcatctctgtggacagccagagcctgcatgaccagcagccccacacccagacagccagcggccaggccctgaagggagatggcggcctgtacagcagcctgcccccagccaagcgggaggaggtggagaagctgctgaatggcagcgctggggacacctggaggcacctggccggggagctgggctaccagcctgagcacatcgacagcttcacccatgaggcctgccctgtgcgggccctgctggcctcctgggccacccaggacagcgccaccctggatgccctgctggccgccctgcggcgcatccagagagctgacctggtggagagcctgtgcagcgagagcacagccaccagccctgtgtag

SEQ ID NO: 161396 - DNA, 336 bp, Artificial Sequence
  Description of Artificial Sequence: Synthetic coding sequence
atggccaacatccaccaggagaatgaggagatggagcagcccatgcagaatggagaggaggaccggcccctgggcggcggggagggccaccagcctgctggcaacagaagaggccaggcccggcggctggcccccaacttccgctgggccatccccaaccggcagatcaatgatggcatgggaggagatggagatgacatggagatcttcatggaggagatgagggagatccggaggaagctgcgggagctgcagctgaggaactgcctgcgcatcctgatgggagagctgagcaaccaccacgaccaccatgatgagttctgcctgatgccctag

SEQ ID NO: 161397 - DNA, 306 bp, Artificial Sequence
  Description of Artificial Sequence: Synthetic coding sequence
atggagcagcccatgcagaatggagaggaggaccggcccctgggcggcggggagggccaccagcctgctggcaacagaagaggccaggcccggcggctggcccccaacttccgctgggccatccccaaccggcagatcaatgatggcatgggaggagatggagatgacatggagatcttcatggaggagatgagggagatccggaggaagctgcgggagctgcagctgaggaactgcctgcgcatcctgatgggagagctgagcaaccaccacgaccaccatgatgagttctgcctgatgccctag

SEQ ID NO: 161398 - DNA, 306 bp, Artificial Sequence; identical to SEQ ID NO: 161397
  Description of Artificial Sequence: Synthetic coding sequence

SEQ ID NO: 161399 - DNA, 336 bp, Artificial Sequence; identical to SEQ ID NO: 161396
  Description of Artificial Sequence: Synthetic coding sequence

SEQ ID NO: 161400 - DNA, 336 bp, Artificial Sequence; identical to SEQ ID NO: 161396
  Description of Artificial Sequence: Synthetic coding sequence

SEQ ID NO: 161401 - DNA, 402 bp, Artificial Sequence
  Description of Artificial Sequence: Synthetic coding sequence
atgatgctgaacagcgacaccatggagctggacctgccccccacccacagcgagacagaaagtggcttcagtgactgtggcggcggggccggcccagatggagctggccctgggggccctgggggcggccaggcccggggccctgagcccggggagcccggcaggaaggacctgcagcacctgagccgggaggagaggagaagaagaagaagagccacagccaagtacagaacagcccacgccacccgggagcgcatccgggtggaggccttcaacctggcctttgctgagctgaggaagctgctgcccaccctgcccccagacaagaagctgagcaagattgagatcctgcggctggccatctgctacatctcctacctgaaccacgtgctggatgtgtag

SEQ ID NO: 161402 - DNA, 408 bp, Artificial Sequence
  Description of Artificial Sequence: Synthetic coding sequence
atgatgctgagcccagaccaggccgctgacagcgaccaccccagcagcgcccacagcgaccctgagagcctgggcggcacagacaccaaggtgctgggctctgtgtctgacctggagcctgtggaggaggccgagggagatggaaaaggaggcagccgggccgccctgtacccccacccccagcagctgagccgggaggagaagagaagaagaagaagagccacagccaagtaccgcagcgcccacgccacccgggagcgcatccgggtggaggccttcaacctggcctttgctgagctgaggaagctgctgcccaccctgcccccagacaagaagctgagcaagattgagatcctgcggctggccatctgctacatctcctacctgaaccacgtgctggatgtgtag

SEQ ID NO: 161403 - DNA, 408 bp, Artificial Sequence; identical to SEQ ID NO: 161402
  Description of Artificial Sequence: Synthetic coding sequence

SEQ ID NO: 161404 - DNA, 324 bp, Artificial Sequence
  Description of Artificial Sequence: Synthetic coding sequence
atgatgctgagcccagaccaggccgctgacagcgaccaccccagcagcgcccacagcgaccctgagagcctgggcggcacagacaccaaggtgctgggctctgtgtctgacctggagcctgtggaggaggccgagggagatggaaaaggaggcagccgggccgccctgtacccccacccccagcagctgagccgggaggagaagagaagaagaagaagagccacagccaagtaccgcagcgcccacgccacccgggagcgcatccgggtggaggccttcaacctggcctttgctgagctgaggaagctgctgcccaccctgtag

SEQ ID NO: 161405 - DNA, 1125 bp, Artificial Sequence
  Description of Artificial Sequence: Synthetic coding sequence
atgggcctgccccggggcagcttcttctggctgctgctgctgctgacagctgcctgcagcggcctgctgtttgccctgtacttctctgctgtgcagcgctacccaggccctgctgctggggcccgggacaccaccagctttgaggccttcttccagagcaaggccagcaacagctggacaggcaagggccaggcctgccgccacctgctgcacctggccatccagaggcacccccacttccggggcctcttcaacctgagcatccctgtgctgctgtggggagacctcttcaccccagccctgtgggaccggctgagccagcacaaggccccctacggctggaggggcctgagccaccaggtgattgccagcaccctgagcctgctgaatggcagcgagagcgccaagctgtttgccccaccccgggacaccccacccaagtgcatccgctgtgctgtggtgggcaatggaggcatcctgaatggcagccggcagggccccaacattgatgcccatgactatgtgttccggctgaatggagctgtgatcaagggctttgaaagagatgtgggcaccaagaccagcttctacggcttcaccgtgaacaccatgaagaacagcctggtgtcctactggaacctgggcttcacctctgtgccccagggccaggacctgcagtacatcttcatccccagcgacatccgggactatgtgatgctgcggagcgccatcctgggcgtgcctgtgcctgagggcctggacaagggggaccggccccacgcctactttggacctgaggccagcgccagcaagttcaagctgctgcacccagacttcatctcctacctgacagagcgcttcctgaagagcaagctgatcaacacccactttggagacctgtacatgcccagcactggagccctgatgctgctgacagccctgcacacctgtgaccaggtgtctgcctacggcttcatcaccagcaactactggaagttcagtgaccactactttgagaggaagatgaagcccctcatcttctacgccaaccacgacctgagcctggaggccgccctgtggagggacctgcacaaggccggcatcctgcagctgtaccagaggtag

SEQ ID NO: 161406 - DNA, 2235 bp, Artificial Sequence
  Description of Artificial Sequence: Synthetic coding sequence
atggccggccgctccatgcaggccgcccgctgccccacagatgagctgagcctgaccaactgtgctgtggtgaatgagaaggacttccagagcggccagcacgtgattgtgaggaccagccccaaccaccgctacaccttcaccctgaagacccaccccagcgtggtgcccggcagcatcgccttcagcctgccccagaggaagtgggccggcctgagcatcggccaggagattgaggtgtccctgtacacctttgacaaggccaagcagtgcatcggcaccatgaccattgaaattgacttcctgcagaagaagagcattgacagcaacccctatgacacagacaagatggctgctgagttcatccagcagttcaacaaccaggccttctctgtgggccagcagctggtgttctccttcaatgagaagctgtttggcctgctggtgaaggacatcgaggccatggaccccagcatcctgaagggggagcccgccaccgggaagaggcagaagattgaggtgggcctggtggtgggcaacagccaggtggcctttgagaaggccgagaacagcagcctgaacctgattggcaaggccaagaccaaggaaaatcggcagagcatcatcaacccagactggaactttgagaagatgggcatcggcggcctggacaaggagttcagtgacatcttccggcgggcctttgccagcagggtcttccccccagagatcgtggagcagatgggctgcaagcacgtgaagggcatcctgctgtatggccccccaggctgtgggaagaccctgctggcccggcagatcggcaagatgctgaatgcccgggagcccaaggtggtgaatggacctgagatcctgaacaagtatgtgggggagagcgaggccaacatcaggaagctgtttgctgatgctgaggaggagcagaggcggctgggcgccaacagcggcctgcacatcatcatctttgatgaaattgatgccatctgcaagcagaggggctccatggccggcagcactggagtgcatgacacagtggtgaaccagctgctgagcaagattgatggagtggagcagctgaacaacatcctggtgattggcatgaccaacagaccagacctgattgatgaggccctgctgcggcccggccgcctggaggtgaagatggagatcggcctgcctgatgagaagggccgcctgcagatcctgcacatccacacagccaggatgaggggccaccagctgctgtctgcagatgtggacatcaaggagctggccgtggagaccaagaacttctctggagctgagctggagggcctggtgcgggccgcccagagcacagccatgaacagacacatcaaggccagcaccaaggtggaggtggacatggagaaggccgagagcctgcaggtgaccaggggggacttcctggccagcctggagaatgacatcaagccagccttcggcaccaaccaggaggactatgccagctacatcatgaatggcatcatcaagtggggagaccctgtgaccagggtgctggatgatggagagctgctggtgcagcagaccaagaacagcgacaggacccccctggtgtctgtgctgctggagggccccccccacagcggcaagacagccctggccgccaagattgctgaggagagcaacttccccttcatcaagatctgcagcccagacaagatgattggcttcagcgagacagccaagtgccaggccatgaagaagatctttgatgatgcctacaagagccagctgagctgtgtggtggtggatgacatcgagcggctgctggactatgtgcccatcggcccccgcttcagcaacctggtgctgcaggccctgctggtgctgctgaagaaggccccaccccagggcaggaagctgctgatcatcggcaccaccagcaggaaggatgtgctgcaggagatggagatgctgaatgccttcagcaccaccatccacgtgcccaacatcgccaccggggagcagctgctggaggccctggagctgctgggcaacttcaaggacaaggagaggaccaccatcgcccagcaggtgaagggcaagaaggtgtggattggcatcaagaagctgctgatgctgattgagatgagcctgcagatggaccctgagtacagagtgaggaagttcctggccctgctgcgggaggagggcgccagccccctggactttgattag

SEQ ID NO: 161407 - DNA, 888 bp, Artificial Sequence
  Description of Artificial Sequence: Synthetic coding sequence
atggacaacagcggcaaggaggccgaggccatggccctgctggccgaggccgagaggaaggtgaagaacagccagagcttcttcagcggcctgtttggaggcagcagcaagattgaggaggcctgtgagatctatgcccgggccgccaacatgttcaagatggccaagaactggagcgctgctggaaatgccttctgccaggccgcccagctgcacctgcagctgcagagcaagcatgatgctgccacctgctttgtggatgctggaaatgccttcaagaaggctgacccccaggaggccatcaactgcctgatgagggccatcgagatctacacagacatgggccgcttcaccatcgccgccaagcaccacatcagcattgctgagatctatgaaacagagctggtggacatcgagaaggccatcgcccactatgagcagagcgctgactactacaagggggaggagagcaacagcagcgccaacaagtgcctgctgaaggtggccggctacgccgccctgctggagcagtaccagaaggccatcgacatctatgagcaggtgggcaccaatgccatggacagccccctgctgaagtacagcgccaaggactacttcttcaaggccgccctgtgccacttctgcatcgacatgctgaatgccaagctggccgtgcagaagtatgaggagctgtttcctgccttcagtgacagccgggagtgcaagctgatgaagaagctgctggaggcccacgaggagcagaatgtggacagctacacagagagcgtgaaggagtatgacagcatcagccggctggaccagtggctgaccaccatgctgctgcgcatcaagaagaccatccagggagatgaggaggacctgaggtag

SEQ ID NO: 161408 - DNA, 897 bp, Artificial Sequence
  Description of Artificial Sequence: Synthetic coding sequence
atggacaatgctgggaaggagcgggaggccgtgcagctgatggccgaggccgagaagagggtgaaggccagccacagcttcctgcggggcctgtttggaggcaacacccgcatcgaggaggcctgtgagatgtacacccgggccgccaacatgttcaagatggccaagaactggagcgctgctggaaatgccttctgccaggccgccaagctgcacatgcagctgcagagcaagcatgattctgccaccagctttgtggatgctggaaatgcctacaagaaggctgacccccaggaggccatcaactgcctgaatgctgccatcgacatctacacagacatgggccgcttcaccatcgccgccaagcaccacatcaccatcgccgagatctatgaaacagagctggtggacatcgagaaggccatcgcccactatgagcagagcgctgactactacaagggggaggagagcaacagcagcgccaacaagtgcctgctgaaggtggccgcctatgctgcccagctggagcagtaccagaaggccatcgagatctatgagcaggtgggcgccaacaccatggacaaccccctgctgaagtacagcgccaaggactacttcttcaaggccgccctgtgccacttcatcgtggatgagctgaatgccaagctggccctggagaagtatgaggagatgtttcctgccttcacagacagccgggagtgcaagctgctgaagaagctgctggaggcccacgaggagcagaacagcgaggcctacacagaggccgtgaaggagtttgacagcatcagccggctggaccagtggctgaccaccatgctgctgcgcatcaagaagagcatccagggagatggagaaggagatggagacctgaagtag

SEQ ID NO: 161409 - DNA, 615 bp, Artificial Sequence
  Description of Artificial Sequence: Synthetic coding sequence
atgaccctgctgcctgccctgtggatgctggagatgctgaccaagaggcagatccccaagggccgcttcaccatcgccgccaagcaccacatcaccatcgccgagatctatgaaacagagctggtggacatcgagaaggccatcgcccactatgagcagagcgctgactactacaagggggaggagagcaacagcagcgccaacaagtgcctgctgaaggtggccgcctatgctgcccagctggagcagtaccagaaggccatcgagatctatgagcaggtgggcgccaacaccatggacaaccccctgctgaagtacagcgccaaggactacttcttcaaggccgccctgtgccacttcatcgtggatgagctgaatgccaagctggccctggagaagtatgaggagatgtttcctgccttcacagacagccgggagtgcaagctgctgaagaagctgctggaggcccacgaggagcagaacagcgaggcctacacagaggccgtgaaggagtttgacagcatcagccggctggaccagtggctgaccaccatgctgctgcgcatcaagaagagcatccagggagatggagaaggagatggagacctgaagtag

SEQ ID NO: 161410 - DNA, 768 bp, Artificial Sequence
  Description of Artificial Sequence: Synthetic coding sequence
atgtacaccagggctgccaacatgttcaagatggccaagaactggagcgctgctggaaatgccttctgccaggccgccaagctgcacatgcagctgcagagcaagcatgacagcgccaccagctttgtggatgctggaaatgcctacaagaaggctgacccccaggaggccatcaactgcctgaatgctgccatcgacatctacacagacatgggccgcttcaccatcgccgccaagcaccacatcaccatcgccgagatctatgaaacagagctggtggacatcgagaaggccatcgcccactatgagcagagcgctgactactacaagggggaggagagcaacagcagcgccaacaagtgcctgctgaaggtggccgcctatgctgcccagctggagcagtaccagaaggccatcgagatctatgagcaggtgggcgccaacaccatggacaaccccctgctgaagtacagcgccaaggactacttcttcaaggccgccctgtgccacttcatcgtggatgagctgaatgccaagctggccctggagaagtatgaggagatgtttcctgccttcacagacagccgggagtgcaagctgctgaagaagctgctggaggcccacgaggagcagaacagcgaggcctacacagaagctgtgaaggagtttgacagcatcagccggctggaccagtggctgaccaccatgctgctgcgcatcaagaagagcatccagggagatggagaaggagatggagacctgaagtag

SEQ ID NO: 161411 - DNA, 780 bp, Artificial Sequence
  Description of Artificial Sequence: Synthetic coding sequence
atggacaatgctgggaaggagcgggaggccgtgcagctgatggccgaggccgagaagagggtgaaggccagccacagcttcctgcggggcctgtttggaggcaacacccgcatcgaggaggcctgtgagatgtacacccgggccgccaacatgttcaagatggccaagaactggagcgaggccatcaactgcctgaatgctgccatcgacatctacacagacatgggccgcttcaccatcgccgccaagcaccacatcaccatcgccgagatctatgaaacagagctggtggacatcgagaaggccatcgcccactatgagcagagcgctgactactacaagggggaggagagcaacagcagcgccaacaagtgcctgctgaaggtggccgcctatgctgcccagctggagcagtaccagaaggccatcgagatctatgagcaggtgggcgccaacaccatggacaaccccctgctgaagtacagcgccaaggactacttcttcaaggccgccctgtgccacttcatcgtggatgagctgaatgccaagctggccctggagaagtatgaggagatgtttcctgccttcacagacagccgggagtgcaagctgctgaagaagctgctggaggcccacgaggagcagaacagcgaggcctacacagaagctgtgaaggagtttgacagcatcagccggctggaccagtggctgaccaccatgctgctgcgcatcaagaagagcatccagggagatggagaaggagatggagacctgaagtag

SEQ ID NO: 161412 - DNA, 1887 bp, Artificial Sequence
  Description of Artificial Sequence: Synthetic coding sequence
atgggcagctgtgcccggctgctgctgctgtggggctgcaccgtggtggccgccggcctgtctggagtggccggcgtgagcagccgctgtgagaaggcctgcaaccccaggatgggcaacctggccctgggcaggaagctgtgggccgacaccacctgtggccagaatgccacagagctgtactgcttctacagcgagaacacagacctgacctgccggcagcccaagtgtgacaagtgcaatgctgcctacccccacctggcccacctgcccagcgccatggctgacagcagcttccgcttccccaggacctggtggcagagcgcagaagatgtgcaccgggagaagatccagctggacctggaggccgagttctacttcacccacctgattgtgatgttcaagagccccaggcctgctgccatggtgctggacaggagccaggactttgggaagacctggaagccctacaagtactttgccaccaactgcagcgccaccttcggcctggaggatgatgtggtgaagaagggggccatctgcaccagcaagtacagcagccccttcccctgcaccggcggggaggtgatcttcaaggccctgagccccccctatgacacagagaacccctacagcgccaaggtgcaggagcagctgaagatcaccaacctgcgggtgcagctgctgaagaggcagagctgcccctgccagagaaatgacctgaatgaggagccccagcacttcacccactacgccatctatgacttcatcgtgaagggcagctgcttctgcaatggacatgctgaccagtgcatccctgtgcacggcttccggcctgtgaaggcccctggcaccttccacatggtgcacggcaagtgcatgtgcaagcacaacacagctggcagccactgccagcactgtgcccccctgtacaatgaccggccctgggaggccgcagatggcaagacaggagccccaaatgaatgtaggacctgcaagtgcaatggacatgctgacacctgccactttgatgtgaatgtgtgggaggccagcggcaacagaagtggaggagtgtgtgatgactgccagcacaacacagagggccagtactgccagcgctgcaagccaggcttctacagagacctgcggcggcccttcagcgccccagatgcctgcaagccctgcagctgccaccctgtgggcagcgctgtgctgcctgccaacagcgtgaccttctgtgaccccagcaatggagactgcccctgcaagccaggagtggccggcagaagatgtgaccgctgcatggtgggctactggggctttggagactatggctgccggccctgtgactgtgccggcagctgtgaccccatcactggagactgcatcagcagccacacagacatcgactggtaccacgaggtgcctgacttccggcctgtgcacaacaagtctgagcccgcctgggagtgggaggatgcccagggcttcagcgccctgctgcacagcgggaaatgtgagtgcaaggagcagaccctgggcaatgccaaggccttctgtggcatgaagtacagctatgtgctgaagatcaagatcctgagcgcccatgacaagggcacccacgtggaggtgaatgtgaagatcaagaaggtgctgaagagcaccaagctgaagatcttccggggcaagaggaccctgtacccagagagctggacagaccggggctgcacctgccccatcctgaaccctggcctggagtacctggtggccggccacgaggacatcagaacaggcaagctgattgtgaacatgaagagctttgtgcagcactggaagcccagcctgggcaggaaggtgatggacatcctgaagcgggagtgcaagtag

SEQ ID NO: 161413 - DNA, 1776 bp, Artificial Sequence
  Description of Artificial Sequence: Synthetic coding sequence
atgggcaacctggccctgggcaggaagctgtgggccgacaccacctgtggccagaatgccacagagctgtactgcttctacagtgaaaatacagacctgacctgccggcagcccaagtgtgacaagtgcaatgctgcctacccccacctggcccacctgcccagcgccatggctgacagcagcttccgcttccccaggacctggtggcagagcgcagaagatgtgcaccgggagaagatccagctggacctggaggccgagttctacttcacccacctgattgtgatgttcaagagccccaggcctgctgccatggtgctggacaggagccaggactttgggaagacctggaagccctacaagtactttgccaccaactgcagcgccaccttcggcctggaggatgatgtggtgaagaagggggccatctgcaccagcaagtacagcagccccttcccctgcacaggaggagaggtgatcttcaaggccctgagccccccctatgacacagagaacccctacagcgccaaggtgcaggagcagctgaagatcaccaacctgcgggtgcagctgctgaagaggcagagctgcccctgccagagaaatgacctgaatgaggagccccagcacttcacccactacgccatctatgacttcatcgtgaagggcagctgcttctgcaatggacatgctgaccagtgcatccctgtgcacggcttccggcctgtgaaggcccctggcaccttccacatggtgcacggcaagtgcatgtgcaagcacaacacagctggcagccactgccagcactgtgcccccctgtacaatgaccggccctgggaggccgcagatggcaagacaggagccccaaatgaatgtaggacctgcaagtgcaatggacatgctgacacctgccactttgatgtgaatgtgtgggaggccagcggcaacagaagtggcggcgtgtgtgatgactgccagcacaacacagagggccagtactgccagcgctgcaagccaggcttctacagagacctgcggcggcccttcagcgccccagatgcctgcaagccctgcagctgccaccctgtgggcagcgctgtgctgcctgccaacagcgtgaccttctgtgaccccagcaatggagactgcccctgcaagccaggagtggccggccgccgctgtgaccgctgcatggtgggctactggggctttggagactatggctgccggccctgtgactgtgccggcagctgtgaccccatcaccggggactgcatcagcagccacacagacatcgactggtaccacgaggtgcctgacttccggcctgtgcacaacaagtctgagcccgcctgggagtgggaggatgcccagggcttcagcgccctgctgcacagcgggaaatgtgagtgcaaggagcagaccctgggcaatgccaaggccttctgtggcatgaagtacagctatgtgctgaagatcaagatcctgagcgcccatgacaagggcacccacgtggaggtgaatgtgaagatcaagaaggtgctgaagagcaccaagctgaagatcttccggggcaagaggaccctgtacccagagagctggacagaccggggctgcacctgccccatcctgaaccctggcctggagtacctggtggccggccacgaggacatcagaacaggcaagctgattgtgaacatgaagagctttgtgcagcactggaagcccagcctgggcaggaaggtgatggacatcctgaagcgggagtgcaagtag

SEQ ID NO: 161414 - DNA, 1818 bp, Artificial Sequence
  Description of Artificial Sequence: Synthetic coding sequence
atgggcagctgtgcccggctgctgctgctgtggggctgcaccgtggtggccgccggcctgtctggagtggccggcgtgagcagccgctgtgagaaggcctgcaaccccaggatgggcaacctggccctgggcaggaagctgtgggccgacaccacctgtggccagaatgccacagagctgtactgcttctacagcgagaacacagacctgacctgccggcagcccaagtgtgacaagtgcaatgctgcctacccccacctggcccacctgcccagcgccatggctgacagcagcttccgcttccccaggacctggtggcagagcgcagaagatgtgcaccgggagaagatccagctggacctggaggccgagttctacttcacccacctgattgtgatgttcaagagccccaggcctgctgccatggtgctggacaggagccaggactttgggaagacctggaagccctacaagtactttgccaccaactgcagcgccaccttcggcctggaggatgatgtggtgaagaagggggccatctgcaccagcaagtacagcagccccttcccctgcaccggcggggaggtgatcttcaaggccctgagccccccctatgacacagagaacccctacagcgccaaggtgcaggagcagctgaagatcaccaacctgcgggtgcagctgctgaagaggcagagctgcccctgccagagaaatgacctgaatgaggagccccagcacttcacccactacgccatctatgacttcatcgtgaagggcagctgcttctgcaatggacatgctgaccagtgcatccctgtgcacggcttccggcctgtgaaggcccctggcaccttccacatggtgcacggcaagtgcatgtgcaagcacaacacagctggcagccactgccagcactgtgcccccctgtacaatgaccggccctgggaggccgcagatggcaagacaggagccccaaatgaatgtaggacctgcaagtgcaatggacatgctgacacctgccactttgatgtgaatgtgtgggaggccagcggcaacagaagtggaggagtgtgtgatgactgccagcacaacacagagggccagtactgccagcgctgcaagccaggcttctacagagacctgcggcggcccttcagcgccccagatgcctgcaagccctgcagctgccaccctgtgggcagcgctgtgctgcctgccaacagcgtgaccttctgtgaccccagcaatggagactgcccctgcaagccaggagtggccggcagaagatgtgaccgctgcatggtgggctactggggctttggagactatggctgccggccctgtgactgtgccggcagctgtgaccccatcactggagactgcatcagcagccacacagacatcgactggtaccacgaggtgcctgacttccggcctgtgcacaacaagtctgagcccgcctgggagtgggaggatgcccagggcttcagcgccctgctgcacagcgtgctgaagatcaagatcctgagcgcccatgacaagggcacccacgtggaggtgaatgtgaagatcaagaaggtgctgaagagcaccaagctgaagatcttccggggcaagaggaccctgtacccagagagctggacagaccggggctgcacctgccccatcctgaaccctggcctggagtacctggtggccggccacgaggacatcagaacaggcaagctgattgtgaacatgaagagctttgtgcagcactggaagcccagcctgggcaggaaggtgatggacatcctgaagcgggagtgcaagtag

SEQ ID NO: 161415 - DNA, 1095 bp, Artificial Sequence
  Description of Artificial Sequence: Synthetic coding sequence
atgtacctgagccgcttcctgagcatccacgccctgtgggtgacagtgtcctctgtgatgcagccctaccccctggtgtggggccactatgacctgtgcaagacccagatctacacagaggagggcaaggtgtgggactacatggcctgccagcctgagagcacagacatgaccaagtacctgaaggtgaagctggaccccccagacatcacctgtggggaccccccagagaccttctgtgccatgggcaacccctacatgtgcaacaatgaatgtgatgccagcaccccagagctggcccaccccccagagctgatgtttgattttgagggccgccaccccagcaccttctggcagagcgccacctggaaggagtaccccaagcccctgcaggtgaacatcaccctgtcctggagcaagaccatcgagctgacagacaacatcgtcatcacctttgagagcggccgcccagaccagatgatcctggagaagagcctggactatggccgcacctggcagccctaccagtactatgccacagactgcctggatgccttccacatggaccccaagtctgtgaaggacctgagccagcacacagtgctggagatcatctgcacagaggagtacagcacaggctacaccaccaacagcaagatcatccactttgagatcaaggacagatttgccttctttgctggcccccggctgaggaacatggccagcctgtatggccagctggacaccaccaagaagctgcgggacttcttcaccgtgacagacctgcgcatccggctgctgcggcctgctgtgggggagatctttgtggatgagctgcacctggcccgctacttctacgccatcagtgacatcaaggtgcggggccgctgcaagtgcaacctgcacgccaccgtgtgtgtgtatgacaacagcaagctgacctgtgaatgtgagcacaacaccaccggccctgactgtgggaagtgcaagaagaactaccagggccggccctggagccctggcagctacctgcccatccccaagggcacagccaacacctgcatccccagcatcagcagcatcggcagcaagtag

SEQ ID NO: 161416 - DNA, 1518 bp, Artificial Sequence
  Description of Artificial Sequence: Synthetic coding sequence
atgtacctgagccgcttcctgagcatccacgccctgtgggtgacagtgtcctctgtgatgcagccctaccccctggtgtggggccactatgacctgtgcaagacccagatctacacagaggagggcaaggtgtgggactacatggcctgccagcctgagagcacagacatgaccaagtacctgaaggtgaagctggaccccccagacatcacctgtggggaccccccagagaccttctgtgccatgggcaacccctacatgtgcaacaatgaatgtgatgccagcaccccagagctggcccaccccccagagctgatgtttgattttgagggccgccaccccagcaccttctggcagagcgccacctggaaggagtaccccaagcccctgcaggtgaacatcaccctgtcctggagcaagaccatcgagctgacagacaacatcgtcatcacctttgagagcggccgcccagaccagatgatcctggagaagagcctggactatggccgcacctggcagccctaccagtactatgccacagactgcctggatgccttccacatggaccccaagtctgtgaaggacctgagccagcacacagtgctggagatcatctgcacagaggagtacagcacaggctacaccaccaacagcaagatcatccactttgagatcaaggacagatttgccttctttgctggcccccggctgaggaacatggccagcctgtatggccagctggacaccaccaagaagctgcgggacttcttcaccgtgacagacctgcgcatccggctgctgcggcctgctgtgggggagatctttgtggatgagctgcacctggcccgctacttctacgccatcagtgacatcaaggtgcggggccgctgcaagtgcaacctgcacgccaccgtgtgtgtgtatgacaacagcaagctgacctgtgaatgtgagcacaacaccaccggccctgactgtgggaagtgcaagaagaactaccagggccggccctggagccctggcagctacctgcccatccccaagggcacagccaacacctgcatccccagcatcagcagcatcggcaacccccccaagttcaaccgcatctggcccaacatcagcagcctggaggtgagcaaccccaagcaggagtgctactgcaaccccctgggcagcatccatgaccgctgcaatggaagtggcttctgtgagtgcaagacaggcaccaccggccccaagtgtgatgaatgtctgcccggcaacagctggcactacggctgccagcccaacgtgtgtgacaatgagctgctgcactgccagaatggaggcacctgccacaacaacgtgcgctgcctgtgcccagctgcctacacaggcatcctgtgtgagaagctgcgctgtgaggaggccggcagctgtggcagtgacagcggccagggcgcccctcctcatggcagccctgccctgctgctgctgaccaccctgctgggcacagccagccccctggtgttctag

SEQ ID NO: 161417 - DNA, 861 bp, Artificial Sequence
  Description of Artificial Sequence: Synthetic coding sequence
atggccagcctgtatggccagctggacaccaccaagaagctgcgggacttcttcaccgtgacagacctgcgcatccggctgctgcggcctgctgtgggggagatctttgtggatgagctgcacctggcccgctacttctacgccatcagtgacatcaaggtgcggggccgctgcaagtgcaacctgcacgccaccgtgtgtgtgtatgacaacagcaagctgacctgtgaatgtgagcacaacaccactggaccagactgtgggaagtgcaagaagaactaccagggccggccctggagccctggcagctacctgcccatccccaagggcacagccaacacctgcatccccagcatcagcagcatcggcaacccccccaagttcaaccgcatctggcccaacatcagcagcctggaggtgagcaaccccaagcaggtggcccccaagctggccctgagcacagtgtcctctgtgcaggtggccaaccacaagcgggagtgctactgcaaccccctgggcagcatccatgaccgctgcaatggcagcggcttctgtgagtgcaagacaggcaccaccggccccaagtgtgatgagtgcctgcccggcaacagctggcactacggctgccagcccaacgtgtgtgacaatgagctgctgcactgccagaatggaggcacctgccacaacaacgtgcgctgcctgtgcccagctgcctacacaggcatcctgtgtgagaagctgcgctgtgaggaggccggcagctgtggcagtgacagcggccagggcgccccaccccacggcagccctgccctgctgctgctgaccaccctgctgggcacagccagccccctggtgttctag

SEQ ID NO: 161418 - DNA, 1029 bp, Artificial Sequence
  Description of Artificial Sequence: Synthetic coding sequence
atggccagcctgtatggccagctggacaccaccaagaagctgcgggacttcttcaccgtgacagacctgcgcatccggctgctgcggcctgctgtgggggagatctttgtggatgagctgcacctggcccgctacttctacgccatcagtgacatcaaggtgcggggccgctgcaagtgcaacctgcacgccaccgtgtgtgtgtatgacaacagcaagctgacctgtgaatgtgagcacaacaccactggaccagactgtgggaagtgcaagaagaactaccagggccggccctggagccctggcagctacctgcccatccccaagggcacagccaacacctgcatccccagcatcagcagcatcggcaacccccccaagttcaaccgcatctggcccaacatcagcagcctggaggtgagcaaccccaagcaggtggcccccaagctggccctgagcacagtgtcctctgtgcaggtggccaaccacaagagggactgtgagtgcttcggccacagcaaccgctgcagctacatcgacctgctgaacacagtcatctgtgtgtcctgcaagcacaacacccggggccagcactgtgagctgtgccgcctgggctacttcagaaatgccagcgcccagctggatgatgaaaatgtgtgcatcgagtgctactgcaaccccctgggcagcatccatgaccgctgcaatggcagcggcttctgtgagtgcaagacaggcaccaccggccccaagtgtgatgagtgcctgcccggcaacagctggcactacggctgccagcccaacgtgtgtgacaatgagctgctgcactgccagaatggaggcacctgccacaacaacgtgcgctgcctgtgcccagctgcctacacaggcatcctgtgtgagaagctgcgctgtgaggaggccggcagctgtggcagtgacagcggccagggcgccccaccccacggcagccctgccctgctgctgctgaccaccctgctgggcacagccagccccctggtgttctag

SEQ ID NO: 161419 - DNA, 1485 bp, Artificial Sequence
  Description of Artificial Sequence: Synthetic coding sequence
atgtacctgagccgcttcctgagcatccacgccctgtgggtgacagtgtcctctgtgatgcagccctaccccctggtgtggggccactatgacctgtgcaagacccagatctacacagaggagggcaaggtgtgggactacatggcctgccagcctgagagcacagacatgaccaagtacctgaaggtgaagctggaccccccagacatcacctgtggggaccccccagagaccttctgtgccatgggcaacccctacatgtgcaacaatgaatgtgatgccagcaccccagagctggcccaccccccagagctgatgtttgattttgagggccgccaccccagcaccttctggcagagcgccacctggaaggagtaccccaagcccctgcaggtgaacatcaccctgtcctggagcaagaccatcgagctgacagacaacatcgtcatcacctttgagagcggccgcccagaccagatgatcctggagaagagcctggactatggccgcacctggcagccctaccagtactatgccacagactgcctggatgccttccacatggaccccaagtctgtgaaggacctgagccagcacacagtgctggagatcatctgcacagaggagtacagcacaggctacaccaccaacagcaagatcatccactttgagatcaaggacagatttgccttctttgctggcccccggctgaggaacatggccagcctgtatggccagctggacaccaccaagaagctgcgggacttcttcaccgtgacagacctgcgcatccggctgctgcggcctgctgtgggggagatctttgtggatgagctgcacctggcccgctacttctacgccatcagtgacatcaaggtgcggggccgctgcaagtgcaacctgcacgccaccgtgtgtgtgtatgacaacagcaagctgacctgtgaatgtgagcacaacaccaccggccctgactgtgggaagtgcaagaagaactaccagggccggccctggagccctggcagctacctgcccatccccaagggcacagccaacacctgcatccccagcatcagcagcatcggcaactgtgaatgttttggccacagcaaccgctgcagctacatcgacctgctgaacacagtcatctgtgtgtcctgcaagcacaacacccggggccagcactgtgagctgtgccgcctgggctacttcagaaatgccagcgcccagctggatgatgaaaatgtgtgcatcgccaacgtgtgtgacaatgagctgctgcactgccagaatggaggcacctgccacaacaacgtgcgctgcctgtgcccagctgcctacacaggcatcctgtgtgagaagctgcgctgtgaggaggccggcagctgtggcagtgacagcggccagggcgccccaccccacggcagccctgccctgctgctgctgaccaccctgctgggcacagccagccccctggtgttctag

SEQ ID NO: 161420 - DNA, 1443 bp, Artificial Sequence
  Description of Artificial Sequence: Synthetic coding sequence
atgtacctgagccgcttcctgagcatccacgccctgtgggtgacagtgtcctctgtgatgcagccctaccccctggtgtggggccactatgacctgtgcaagacccagatctacacagaggagggcaaggtgtgggactacatggcctgccagcctgagagcacagacatgaccaagtacctgaaggtgaagctggaccccccagacatcacctgtggggaccccccagagaccttctgtgccatgggcaacccctacatgtgcaacaatgaatgtgatgccagcaccccagagctggcccaccccccagagctgatgtttgattttgagggccgccaccccagcaccttctggcagagcgccacctggaaggagtaccccaagcccctgcaggtgaacatcaccctgtcctggagcaagaccatcgagctgacagacaacatcgtcatcacctttgagagcggccgcccagaccagatgatcctggagaagagcctggactatggccgcacctggcagccctaccagtactatgccacagactgcctggatgccttccacatggaccccaagtctgtgaaggacctgagccagcacacagtgctggagatcatctgcacagaggagtacagcacaggctacaccaccaacagcaagatcatccactttgagatcaaggacagatttgccttctttgctggcccccggctgaggaacatggccagcctgtatggccagctggacaccaccaagaagctgcgggacttcttcaccgtgacagacctgcgcatccggctgctgcggcctgctgtgggggagatctttgtggatgagctgcacctggcccgctacttctacgccatcagtgacatcaaggtgcggggccgctgcaagtgcaacctgcacgccaccgtgtgtgtgtatgacaacagcaagctgacctgtgaatgtgagcacaacaccaccggccctgactgtgggaagtgcaagaagaactaccagggccggccctggagccctggcagctacctgcccatccccaagggcacagccaacacctgcatccccagcatcagcagcatcggcaacccccccaagttcaaccgcatctggcccaacatcagcagcctggaggtgagcaaccccaagcaggtggcccccaagctggccctgagcacagtgtcctctgtgcaggtggccaaccacaagagggccaacgtgtgtgacaatgagctgctgcactgccagaatggaggcacctgccacaacaacgtgcgctgcctgtgcccagctgcctacacaggcatcctgtgtgagaagctgcgctgtgaggaggccggcagctgtggcagtgacagcggccagggcgccccaccccacggcagccctgccctgctgctgctgaccaccctgctgggcacagccagccccctggtgttctag

SEQ ID NO: 161421 - DNA, 1383 bp, Artificial Sequence
  Description of Artificial Sequence: Synthetic coding sequence
atgtacctgagccgcttcctgagcatccacgccctgtgggtgacagtgtcctctgtgatgcagccctaccccctggtgtggggccactatgacctgtgcaagacccagatctacacagaggagggcaaggtgtgggactacatggcctgccagcctgagagcacagacatgaccaagtacctgaaggtgaagctggaccccccagacatcacctgtggggaccccccagagaccttctgtgccatgggcaacccctacatgtgcaacaatgaatgtgatgccagcaccccagagctggcccaccccccagagctgatgtttgattttgagggccgccaccccagcaccttctggcagagcgccacctggaaggagtaccccaagcccctgcaggtgaacatcaccctgtcctggagcaagaccatcgagctgacagacaacatcgtcatcacctttgagagcggccgcccagaccagatgatcctggagaagagcctggactatggccgcacctggcagccctaccagtactatgccacagactgcctggatgccttccacatggaccccaagtctgtgaaggacctgagccagcacacagtgctggagatcatctgcacagaggagtacagcacaggctacaccaccaacagcaagatcatccactttgagatcaaggacagatttgccttctttgctggcccccggctgaggaacatggccagcctgtatggccagctggacaccaccaagaagctgcgggacttcttcaccgtgacagacctgcgcatccggctgctgcggcctgctgtgggggagatctttgtggatgagctgcacctggcccgctacttctacgccatcagtgacatcaaggtgcggggccgctgcaagtgcaacctgcacgccaccgtgtgtgtgtatgacaacagcaagctgacctgtgaatgtgagcacaacaccaccggccctgactgtgggaagtgcaagaagaactaccagggccggccctggagccctggcagctacctgcccatccccaagggcacagccaacacctgcatccccagcatcagcagcatcggcaacccccccaagttcaaccgcatctggcccaacatcagcagcctggaggtgagcaaccccaagcaggccaacgtgtgtgacaatgagctgctgcactgccagaatggaggcacctgccacaacaacgtgcgctgcctgtgcccagctgcctacacaggcatcctgtgtgagaagctgcgctgtgaggaggccggcagctgtggcagtgacagcggccagggcgccccaccccacggcagccctgccctgctgctgctgaccaccctgctgggcacagccagccccctggtgttctag

SEQ ID NO: 161422 - DNA, 1620 bp, Artificial Sequence
  Description of Artificial Sequence: Synthetic coding sequence
atgtacctgagccgcttcctgagcatccacgccctgtgggtgacagtgtcctctgtgatgcagccctaccccctggtgtggggccactatgacctgtgcaagacccagatctacacagaggagggcaaggtgtgggactacatggcctgccagcctgagagcacagacatgaccaagtacctgaaggtgaagctggaccccccagacatcacctgtggggaccccccagagaccttctgtgccatgggcaacccctacatgtgcaacaatgaatgtgatgccagcaccccagagctggcccaccccccagagctgatgtttgattttgagggccgccaccccagcaccttctggcagagcgccacctggaaggagtaccccaagcccctgcaggtgaacatcaccctgtcctggagcaagaccatcgagctgacagacaacatcgtcatcacctttgagagcggccgcccagaccagatgatcctggagaagagcctggactatggccgcacctggcagccctaccagtactatgccacagactgcctggatgccttccacatggaccccaagtctgtgaaggacctgagccagcacacagtgctggagatcatctgcacagaggagtacagcacaggctacaccaccaacagcaagatcatccactttgagatcaaggacagatttgccttctttgctggcccccggctgaggaacatggccagcctgtatggccagctggacaccaccaagaagctgcgggacttcttcaccgtgacagacctgcgcatccggctgctgcggcctgctgtgggggagatctttgtggatgagctgcacctggcccgctacttctacgccatcagtgacatcaaggtgcggggccgctgcaagtgcaacctgcacgccaccgtgtgtgtgtatgacaacagcaagctgacctgtgaatgtgagcacaacaccaccggccctgactgtgggaagtgcaagaagaactaccagggccggccctggagccctggcagctacctgcccatccccaagggcacagccaacacctgcatccccagcatcagcagcatcggcaactgtgaatgttttggccacagcaaccgctgcagctacatcgacctgctgaacacagtcatctgtgtgtcctgcaagcacaacacccggggccagcactgtgagctgtgccgcctgggctacttcagaaatgccagcgcccagctggatgatgaaaatgtgtgcatcgagtgctactgcaaccccctgggcagcatccatgaccgctgcaatggaagtggcttctgtgagtgcaagacaggcaccaccggccccaagtgtgatgaatgtctgcccggcaacagctggcactacggctgccagcccaacgtgtgtgacaatgagctgctgcactgccagaatggaggcacctgccacaacaacgtgcgctgcctgtgcccagctgcctacacaggcatcctgtgtgagaagctgcgctgtgaggaggccggcagctgtggcagtgacagcggccagggcgcccctcctcatggcagccctgccctgctgctgctgaccaccctgctgggcacagccagccccctggtgttctag

SEQ ID NO: 161423 - DNA, 1383 bp, Artificial Sequence
  Description of Artificial Sequence: Synthetic coding sequence
atgtacctgagccgcttcctgagcatccacgccctgtgggtgacagtgtcctctgtgatgcagccctaccccctggtgtggggccactatgacctgtgcaagacccagatctacacagaggagggcaaggtgtgggactacatggcctgccagcctgagagcacagacatgaccaagtacctgaaggtgaagctggaccccccagacatcacctgtggggaccccccagagaccttctgtgccatgggcaacccctacatgtgcaacaatgaatgtgatgccagcaccccagagctggcccaccccccagagctgatgtttgattttgagggccgccaccccagcaccttctggcagagcgccacctggaaggagtaccccaagcccctgcaggtgaacatcaccctgtcctggagcaagaccatcgagctgacagacaacatcgtcatcacctttgagagcggccgcccagaccagatgatcctggagaagagcctggactatggccgcacctggcagccctaccagtactatgccacagactgcctggatgccttccacatggaccccaagtctgtgaaggacctgagccagcacacagtgctggagatcatctgcacagaggagtacagcacaggctacaccaccaacagcaagatcatccactttgagatcaaggacagatttgccttctttgctggcccccggctgaggaacatggccagcctgtatggccagctggacaccaccaagaagctgcgggacttcttcaccgtgacagacctgcgcatccggctgctgcggcctgctgtgggggagatctttgtggatgagctgcacctggcccgctacttctacgccatcagtgacatcaaggtgcggggccgctgcaagtgcaacctgcacgccaccgtgtgtgtgtatgacaacagcaagctgacctgtgaatgtgagcacaacaccaccggccctgactgtgggaagtgcaagaagaactaccagggccggccctggagccctggcagctacctgcccatccccaagggcacagccaacacctgtgacccctacctgaccagctgtggggacccccccaagttcaaccgcatctggcccaacatcagcagcctggaggtgagcaaccccaagcaggccaacgtgtgtgacaatgagctgctgcactgccagaatggaggcacctgccacaacaacgtgcgctgcctgtgcccagctgcctacacaggcatcctgtgtgagaagctgcgctgtgaggaggccggcagctgtggcagtgacagcggccagggcgccccaccccacggcagccctgccctgctgctgctgaccaccctgctgggcacagccagccccctggtgttctag

SEQ ID NO: 161424 - DNA, 1443 bp, Artificial Sequence; identical to SEQ ID NO: 161420
  Description of Artificial Sequence: Synthetic coding sequence

SEQ ID NO: 161425 - DNA, 1485 bp, Artificial Sequence
  Description of Artificial Sequence: Synthetic coding sequence
atgtacctgagccgcttcctgagcatccacgccctgtgggtgacagtgtcctctgtgatgcagccctaccccctggtgtggggccactatgacctgtgcaagacccagatctacacagaggagggcaaggtgtgggactacatggcctgccagcctgagagcacagacatgaccaagtacctgaaggtgaagctggaccccccagacatcacctgtggggaccccccagagaccttctgtgccatgggcaacccctacatgtgcaacaatgaatgtgatgccagcaccccagagctggcccaccccccagagctgatgtttgattttgagggccgccaccccagcaccttctggcagagcgccacctggaaggagtaccccaagcccctgcaggtgaacatcaccctgtcctggagcaagaccatcgagctgacagacaacatcgtcatcacctttgagagcggccgcccagaccagatgatcctggagaagagcctggactatggccgcacctggcagccctaccagtactatgccacagactgcctggatgccttccacatggaccccaagtctgtgaaggacctgagccagcacacagtgctggagatcatctgcacagaggagtacagcacaggctacaccaccaacagcaagatcatccactttgagatcaaggacagatttgccttctttgctggcccccggctgaggaacatggccagcctgtatggccagctggacaccaccaagaagctgcgggacttcttcaccgtgacagacctgcgcatccggctgctgcggcctgctgtgggggagatctttgtggatgagctgcacctggcccgctacttctacgccatcagtgacatcaaggtgcggggccgctgcaagtgcaacctgcacgccaccgtgtgtgtgtatgacaacagcaagctgacctgtgaatgtgagcacaacaccaccggccctgactgtgggaagtgcaagaagaactaccagggccggccctggagccctggcagctacctgcccatccccaagggcacagccaacacctgtgacccctacctgaccagctgtggggactgtgaatgttttggccacagcaaccgctgcagctacatcgacctgctgaacacagtcatctgtgtgtcctgcaagcacaacacccggggccagcactgtgagctgtgccgcctgggctacttcagaaatgccagcgcccagctggatgatgaaaatgtgtgcatcgccaacgtgtgtgacaatgagctgctgcactgccagaatggaggcacctgccacaacaacgtgcgctgcctgtgcccagctgcctacacaggcatcctgtgtgagaagctgcgctgtgaggaggccggcagctgtggcagtgacagcggccagggcgccccaccccacggcagccctgccctgctgctgctgaccaccctgctgggcacagccagccccctggtgttctag

SEQ ID NO: 161426 - DNA, 1620 bp, Artificial Sequence; identical to SEQ ID NO: 161422
  Description of Artificial Sequence: Synthetic coding sequence

SEQ ID NO: 161427 - DNA, 1317 bp, Artificial Sequence
  Description of Artificial Sequence: Synthetic coding sequence
atgtacctgagccgcttcctgagcatccacgccctgtgggtgacagtgtcctctgtgatgcagccctaccccctggtgtggggccactatgacctgtgcaagacccagatctacacagaggagggcaaggtgtgggactacatggcctgccagcctgagagcacagacatgaccaagtacctgaaggtgaagctggaccccccagacatcacctgtggggaccccccagagaccttctgtgccatgggcaacccctacatgtgcaacaatgaatgtgatgccagcaccccagagctggcccaccccccagagctgatgtttgattttgagggccgccaccccagcaccttctggcagagcgccacctggaaggagtaccccaagcccctgcaggtgaacatcaccctgtcctggagcaagaccatcgagctgacagacaacatcgtcatcacctttgagagcggccgcccagaccagatgatcctggagaagagcctggactatggccgcacctggcagccctaccagtactatgccacagactgcctggatgccttccacatggaccccaagtctgtgaaggacctgagccagcacacagtgctggagatcatctgcacagaggagtacagcacaggctacaccaccaacagcaagatcatccactttgagatcaaggacagatttgccttctttgctggcccccggctgaggaacatggccagcctgtatggccagctggacaccaccaagaagctgcgggacttcttcaccgtgacagacctgcgcatccggctgctgcggcctgctgtgggggagatctttgtggatgagctgcacctggcccgctacttctacgccatcagtgacatcaaggtgcggggccgctgcaagtgcaacctgcacgccaccgtgtgtgtgtatgacaacagcaagctgacctgtgaatgtgagcacaacaccaccggccctgactgtgggaagtgcaagaagaactaccagggccggccctggagccctggcagctacctgcccatccccaagggcacagccaacacctgcatccccagcatcagcagcatcggcaccaacgtgtgtgacaatgagctgctgcactgccagaatggaggcacctgccacaacaacgtgcgctgcctgtgcccagctgcctacacaggcatcctgtgtgagaagctgcgctgtgaggaggccggcagctgtggcagtgacagcggccagggcgccccaccccacggcagccctgccctgctgctgctgaccaccctgctgggcacagccagccccctggtgttctag

SEQ ID NO: 161428 - DNA, 1095 bp, Artificial Sequence; identical to SEQ ID NO: 161415
  Description of Artificial Sequence: Synthetic coding sequence

SEQ ID NO: 161429 - DNA, 1317 bp, Artificial Sequence
  Description of Artificial Sequence: Synthetic coding sequence
atgtacctgagccgcttcctgagcatccacgccctgtgggtgacagtgtcctctgtgatgcagccctaccccctggtgtggggccactatgacctgtgcaagacccagatctacacagaggagggcaaggtgtgggactacatggcctgccagcctgagagcacagacatgaccaagtacctgaaggtgaagctggaccccccagacatcacctgtggggaccccccagagaccttctgtgccatgggcaacccctacatgtgcaacaatgaatgtgatgccagcaccccagagctggcccaccccccagagctgatgtttgattttgagggccgccaccccagcaccttctggcagagcgccacctggaaggagtaccccaagcccctgcaggtgaacatcaccctgtcctggagcaagaccatcgagctgacagacaacatcgtcatcacctttgagagcggccgcccagaccagatgatcctggagaagagcctggactatggccgcacctggcagccctaccagtactatgccacagactgcctggatgccttccacatggaccccaagtctgtgaaggacctgagccagcacacagtgctggagatcatctgcacagaggagtacagcacaggctacaccaccaacagcaagatcatccactttgagatcaaggacagatttgccttctttgctggcccccggctgaggaacatggccagcctgtatggccagctggacaccaccaagaagctgcgggacttcttcaccgtgacagacctgcgcatccggctgctgcggcctgctgtgggggagatctttgtggatgagctgcacctggcccgctacttctacgccatcagtgacatcaaggtgcggggccgctgcaagtgcaacctgcacgccaccgtgtgtgtgtatgacaacagcaagctgacctgtgaatgtgagcacaacaccaccggccctgactgtgggaagtgcaagaagaactaccagggccggccctggagccctggcagctacctgcccatccccaagggcacagccaacacctacctgcccagcatgtacagcgtggccgccaacgtgtgtgacaatgagctgctgcactgccagaatggaggcacctgccacaacaacgtgcgctgcctgtgcccagctgcctacacaggcatcctgtgtgagaagctgcgctgtgaggaggccggcagctgtggcagtgacagcggccagggcgccccaccccacggcagccctgccctgctgctgctgaccaccctgctgggcacagccagccccctggtgttctag

SEQ ID NO: 161430 - DNA, 1620 bp, Artificial Sequence
  Description of Artificial Sequence: Synthetic coding sequence
atgtacctgagccgcttcctgagcatccacgccctgtgggtgacagtgtcctctgtgatgcagccctaccccctggtgtggggccactatgacctgtgcaagacccagatctacacagaggagggcaaggtgtgggactacatggcctgccagcctgagagcacagacatgaccaagtacctgaaggtgaagctggaccccccagacatcacctgtggggaccccccagagaccttctgtgccatgggcaacccctacatgtgcaacaatgaatgtgatgccagcaccccagagctggcccaccccccagagctgatgtttgattttgagggccgccaccccagcaccttctggcagagcgccacctggaaggagtaccccaagcccctgcaggtgaacatcaccctgtcctggagcaagaccatcgagctgacagacaacatcgtcatcacctttgagagcggccgcccagaccagatgatcctggagaagagcctggactatggccgcacctggcagccctaccagtactatgccacagactgcctggatgccttccacatggaccccaagtctgtgaaggacctgagccagcacacagtgctggagatcatctgcacagaggagtacagcacaggctacaccaccaacagcaagatcatccactttgagatcaaggacagatttgccttctttgctggcccccggctgaggaacatggccagcctgtatggccagctggacaccaccaagaagctgcgggacttcttcaccgtgacagacctgcgcatccggctgctgcggcctgctgtgggggagatctttgtggatgagctgcacctggcccgctacttctacgccatcagtgacatcaaggtgcggggccgctgcaagtgcaacctgcacgccaccgtgtgtgtgtatgacaacagcaagctgacctgtgaatgtgagcacaacaccaccggccctgactgtgggaagtgcaagaagaactaccagggccggccctggagccctggcagctacctgcccatccccaagggcacagccaacacctgtgacccctacctgaccagctgtggggactgtgaatgttttggccacagcaaccgctgcagctacatcgacctgctgaacacagtcatctgtgtgtcctgcaagcacaacacccggggccagcactgtgagctgtgccgcctgggctacttcagaaatgccagcgcccagctggatgatgaaaatgtgtgcatcgagtgctactgcaaccccctgggcagcatccatgaccgctgcaatggaagtggcttctgtgagtgcaagacaggcaccaccggccccaagtgtgatgaatgtctgcccggcaacagctggcactacggctgccagcccaacgtgtgtgacaatgagctgctgcactgccagaatggaggcacctgccacaacaacgtgcgctgcctgtgcccagctgcctacacaggcatcctgtgtgagaagctgcgctgtgaggaggccggcagctgtggcagtgacagcggccagggcgcccctcctcatggcagccctgccctgctgctgctgaccaccctgctgggcacagccagccccctggtgttctag

SEQ ID NO: 161431 - DNA, 519 bp, Artificial Sequence
  Description of Artificial Sequence: Synthetic coding sequence
atggtgggccctgccccccggcggcggctgcggcccctggccgccctggccctggtgctggccctggcccctggcctgcccacagcccgggccggccagacccccaggcctgctgagcggggcccccctgtgcggctcttcacagaggaggagctggcccgctatggaggagaggaggaggaccagcccatctacctggccgtgaagggcgtggtgtttgatgtgaccagcggcaaggagttctacggccgcggggccccctacaatgccctgaccgggaaggacagcacccggggcgtggccaagatgagcctggaccctgctgacctgacccatgacaccaccggcctgacagccaaggagctggaggccctggatgaggtgttcaccaaggtgtacaaggccaagtaccccatcgtgggctacacagcccggcgcatcctgaatgaagatggcagccccaacctggacttcaagccagaggaccagccccactttgacatcaaggatgagttctag

SEQ ID NO: 161432 - DNA, 2088 bp, Artificial Sequence
  Description of Artificial Sequence: Synthetic coding sequence
atgagcctgctgctgtccttctacctgctgggcctgctggtgagcagcggccaggacagatttgccatgctggccaacaacaacctgcagatcctgaacatcaacaagagtgatgagggcatctaccgctgtgagggccgggtggaggcccggggggagattgacttccgggacatcatcgtcatcgtgaatgtgcccccagccatctccatgccccagaagagcttcaatgccacagctgagcggggggaggagatgaccttcagctgccgggccagcggcagccctgagcccgccatctcctggttcagaaatggcaagctgattgaagaaaatgagaagtacatcctgaagggcagcaacacagagctgactgtgaggaacatcatcaacagtgatggcggcccctacgtgtgccgggccaccaacaaggctggagaagatgagaagcaggccttcctgcaggtgtttgtgcagccccacatcatccagctgaagaatgagaccacctatgaaaatggccaggtgaccctggtgtgtgatgctgagggggagcccatccctgagatcacctggaagagagctgtggatggcttcaccttcacagaaggagacaagagcctggatggccgcatcgaggtgaagggccagcacggcagcagcagcctgcacatcaaggatgtgaagctgagtgacagcggccgctatgactgtgaggccgccagccgcatcggcggccaccagaagtccatgtacctggacattgaatatgcccccaagttcatcagcaaccagaccatctactacagctgggagggcaaccccatcaacatcagctgtgatgtgaagagcaaccccccagccagcatccactggaggcgggacaagctggtgctgcctgccaagaacaccaccaacctgaagacctacagcacaggcaggaagatgatcctggagatcgcccccaccagtgacaatgactttggccgctacaactgcacagccaccaaccacatcggcacccgcttccaggagtacatcctggccctggctgatgtgcccagcagcccctacggcgtgaagatcatcgagctgagccagaccacagccaaggtgtccttcaacaagccagacagccacggcggcgtgcccatccaccactaccaggtggatgtgaaggaggtggccagcgagatctggaagatcgtgcgcagccacggcgtgcagaccatggtggtgctgaacaacctggagcccaacaccacctatgagatccgggtggccgctgtgaatggcaagggccagggcgactacagcaagattgagatcttccagaccctgcctgtgcgggagcccagcccccccagcatccacggccagcccagcagcggcaagagcttcaagctgagcatcaccaagcaggatgatggaggagcccccatcctggagtacatcgtgaagtaccgcagcaaggacaaggaggaccagtggctggagaagaaggtgcagggcaacaaggaccacatcatcctggagcacctgcagtggaccatgggctatgaggtgcagatcacagctgccaaccggctgggctacagcgagcccaccgtgtatgagttctccatgccacccaagcccaacatcatcaaggacaccctcttcaacggcctgggcctgggcgctgtgattggcctgggcgtggccgccctgctgctgatcctggtggtgacagatgtgtcctgcttcttcatccggcagtgtggcctgctgatgtgcatcaccaggaggatgtgtgggaagaagagcggcagcagcggcaagagcaaggagctggaggagggcaaggccgcctacctgaaggatggcagcaaggagcccatcgtggagatgaggacagaagatgagcgggtgaccaaccatgaagatggcagccctgtgaatgagcccaatgagaccacccccctgacagagcctgagaagctgcccctgaaggaggaggatggcaaggaggccctgaaccctgagaccatcgagatcaaggtgtccaatgacatcatccagagcaaggaggatgacagcaaggcctag

SEQ ID NO: 161433 - DNA, 2514 bp, Artificial Sequence
  Description of Artificial Sequence: Synthetic coding sequence
atgagcctgctgctgtccttctacctgctgggcctgctggtgagcagcggccaggccctgctgcaggtgaccatcagcctgagcaaggtggagctgtctgtgggggagagcaagttcttcacctgcacagccatcggggagcctgagagcattgactggtacaacccccagggcgagaagatcatcagcacccagagggtggtggtgcagaaggagggcgtgcgcagccggctgaccatctacaatgccaacattgaagatgctggcatctaccgctgccaggccacagatgccaagggccagacccaggaggccaccgtggtgctggagatctaccagaagctgaccttccgggaggtggtgagcccccaggagttcaagcagggagaagatgctgaggtggtgtgccgggtgagcagcagccctgccccagctgtgtcctggctgtaccacaatgaggaggtgaccaccatcagtgacaacagatttgccatgctggccaacaacaacctgcagatcctgaacatcaacaagagtgatgagggcatctaccgctgtgagggccgggtggaggcccggggggagattgacttccgggacatcatcgtcatcgtgaatgtgcccccagccatctccatgccccagaagagcttcaatgccacagctgagcggggggaggagatgaccttcagctgccgggccagcggcagccctgagcccgccatctcctggttcagaaatggcaagctgattgaagaaaatgagaagtacatcctgaagggcagcaacacagagctgactgtgaggaacatcatcaacagtgatggcggcccctacgtgtgccgggccaccaacaaggctggagaagatgagaagcaggccttcctgcaggtgtttgtgcagccccacatcatccagctgaagaatgagaccacctatgaaaatggccaggtgaccctggtgtgtgatgctgagggggagcccatccctgagatcacctggaagagagctgtggatggcttcaccttcacagaaggagacaagagcctggatggccgcatcgaggtgaagggccagcacggcagcagcagcctgcacatcaaggatgtgaagctgagtgacagcggccgctatgactgtgaggccgccagccgcatcggcggccaccagaagtccatgtacctggacattgaatatgcccccaagttcatcagcaaccagaccatctactacagctgggagggcaaccccatcaacatcagctgtgatgtgaagagcaaccccccagccagcatccactggaggcgggacaagctggtgctgcctgccaagaacaccaccaacctgaagacctacagcacaggcaggaagatgatcctggagatcgcccccaccagtgacaatgactttggccgctacaactgcacagccaccaaccacatcggcacccgcttccaggagtacatcctggccctggctgatgtgcccagcagcccctacggcgtgaagatcatcgagctgagccagaccacagccaaggtgtccttcaacaagccagacagccacggcggcgtgcccatccaccactaccaggtggatgtgaaggaggtggccagcgagatctggaagatcgtgcgcagccacggcgtgcagaccatggtggtgctgaacaacctggagcccaacaccacctatgagatccgggtggccgctgtgaatggcaagggccagggcgactacagcaagattgagatcttccagaccctgcctgtgcgggagcccagcccccccagcatccacggccagcccagcagcggcaagagcttcaagctgagcatcaccaagcaggatgatggaggagcccccatcctggagtacatcgtgaagtaccgcagcaaggacaaggaggaccagtggctggagaagaaggtgcagggcaacaaggaccacatcatcctggagcacctgcagtggaccatgggctatgaggtgcagatcacagctgccaaccggctgggctacagcgagcccaccgtgtatgagttctccatgccacccaagcccaacatcatcaaggacaccctcttcaacggcctgggcctgggcgctgtgattggcctgggcgtggccgccctgctgctgatcctggtggtgacagatgtgtcctgcttcttcatccggcagtgtggcctgctgatgtgcatcaccaggaggatgtgtgggaagaagagcggcagcagcggcaagagcaaggagctggaggagggcaaggccgcctacctgaaggatggcagcaaggagcccatcgtggagatgaggacagaagatgagcgggtgaccaaccatgaagatggcagccctgtgaatgagcccaatgagaccacccccctgacagagcctgagaagctgcccctgaaggaggaggatggcaaggaggccctgaaccctgagaccatcgagatcaaggtgtccaatgacatcatccagagcaaggaggatgacagcaaggcctag

SEQ ID NO: 161434 - DNA, 1275 bp, Artificial Sequence
  Description of Artificial Sequence: Synthetic coding sequence
atggtgcggagtgacagcggcggccaggtgtacctggactaccacaaccggcagggcctgtttgtggactggaagtacaatgaggccctgtacctggaggagggccagcctgagacctactacagaacagccctgctgcaggtgaccatcagcctgagcaaggtggagctgtctgtgggggagagcaagttcttcacctgcacagccatcggggagcctgagagcattgactggtacaacccccagggcgagaagatcatcagcacccagagggtggtggtgcagaaggagggcgtgcgcagccggctgaccatctacaatgccaacattgaagatgctggcatctaccgctgccaggccacagatgccaagggccagacccaggaggccaccgtggtgctggagatctaccagaagctgaccttccgggaggtggtgagcccccaggagttcaagcagggagaagatgctgaggtggtgtgccgggtgagcagcagccctgccccagctgtgtcctggctgtaccacaatgaggaggtgaccaccatcagtgacaacagatttgccatgctggccaacaacaacctgcagatcctgaacatcaacaagagtgatgagggcatctaccgctgtgagggccgggtggaggcccggggggagattgacttccgggacatcatcgtgattgtgaatgtgcccccagccatctccatgccccagaagagcttcaatgccacagctgagcggggggaggagatgaccttcagctgccgggccagcggcagccctgagcccgccatctcctggttcagaaatggcaagctgattgaggagaatgagaagtacatcctgaagggcagcaacacagagctgactgtgaggaacatcatcaacagtgatggcggcccctacgtgtgccgggccaccaacaaggccggggaggatgagaagcaggccttcctgcaggtgtttgtgcagccccacatcatccagctgaagaatgagaccacctatgaaaatggccaggtgaccctggtgtgtgatgctgagggggagcccatccctgagatcacctggaagagagctgtggatggcttcaccttcacagaaggagacaagagcctggatggaagaattgaggtgaagggccagcacggcagcagcagcctgcacatcaaggatgtgaagctgagtgacagcggccgctatgactgtgaggccgccagcagaattggaggccaccagaagtccatgtacctggacatcgagagctag

SEQ ID NO: 161435 - DNA, 1983 bp, Artificial Sequence
  Description of Artificial Sequence: Synthetic coding sequence
atgcaggagaacctgcgctttgccagcagtggagatgacatcaagatctgggatgccagctccatgaccctggtggacaagttcaacccccacaccagcccccacggcatcagcagcatctgctggagcagcaacaacaacttcctggtgacagccagcagcagcggggacaagatcgtggtgagcagctgcaagtgcaagcctgtgcccctgctggagctggccgagggccagaagcagacctgtgtgaacctgaacagcacctccatgtacctggtgtctgggggcctgaacaacacagtgaacatctgggacctgaagagcaagagggtgcacaggagcctgaaggaccacaaggaccaggtgacctgtgtgacctacaactggaatgactgctacatcgccagcggcagcctgagcggggagatcatcctgcacagcgtgaccaccaacctgagcagcaccccatttggacatggcagcaaccagagcgtgcgccacctgaagtacagcctcttcaagaagagcctgctgggctctgtgtctgacaatggcatcgtgaccctgtgggatgtgaacagccagagcccctaccacaactttgattctgtgcacaaggccccagccagcggcatctgcttcagccctgtgaatgagctgctgtttgtgaccatcggcctggacaagaggatcatcctgtatgacaccagcagcaagaagctggtgaagaccctggtggccgacacccccctgacagctgtggacttcatgccagatggagccaccctggccatcggcagcagccggggcaagatctaccagtatgacctgaggatgctgaagagccctgtgaagaccatcagcgcccacaagacctctgtgcagtgcatcgccttccagtacagcacagtgctgaccaagagcagcctgaacaagggctgcagcaacaagcccaccaccgtgaacaagaggtctgtgaatgtgaatgctgccagcggcggcgtgcagaacagcggcatcgtgcgggaggccccagccaccagcatcgccaccgtgctgccccagcccatgaccagcgccatgggcaaaggaacagtggccgtgcaggagaaggccggcctgcccaggagcatcaacacagacaccctgagcaaggagacagattctgggaagaaccaggacttcagcagctttgatgacaccgggaagagcagcctgggggacatgttcagccccatcagagatgatgctgtggtgaacaagggcagtgatgagagcattggaaaaggagatggctttgacttcctgccccagctgaacagcgtcttcccccccaggaagaaccctgtgaccagcagcacctctgtgctgcacagcagccccctgaatgtgttcatgggcagccctgggaaggaggagaatgaaaatagagacctgacagctgagagcaagaagatctacatgggcaagcaggagagcaaggacagcttcaagcagctggccaagctggtgaccagcggggctgagagcggcaacctgaacaccagccccagcagcaaccagaccagaaattctgagaagtttgagaagccagaaaatgaaattgaggcccagctgatctgtgagccccccatcaatggcagcagcacccccaaccccaagatcgccagctctgtgacagctggggtggccagcagcctgtctgagaagattgctgacagcatcggcaacaaccggcagaatgcccccctgaccagcatccagatccgcttcatccagaacatgatccaggagaccctggatgacttccgggaggcctgccaccgggacatcgtgaacctgcaggtggagatgatcaagcagttccacatgcagctgaatgagatgcacagcctgctggagcgctacagcgtgaatgaaggcctggtggccgagattgaaaggctgcgggaggagaacaagaggctgcgggcccacttctag

SEQ ID NO: 161436 - DNA, 1716 bp, Artificial Sequence
  Description of Artificial Sequence: Synthetic coding sequence
atgtacctggtgtctgggggcctgaacaacacagtgaacatctgggacctgaagagcaagagggtgcacaggagcctgaaggaccacaaggaccaggtgacctgtgtgacctacaactggaatgactgctacatcgccagcggcagcctgtctggagagatcatcctgcacagcgtgaccaccaacctgagcagcacccccttcggccacggcagcaaccagagcgtgcgccacctgaagtacagcctcttcaagaagagcctgctgggctctgtgtctgacaatggaattgtgaccctgtgggatgtgaacagccagagcccctaccacaactttgacagcgtgcacaaggccccagccagcggcatctgcttcagccctgtgaatgagctgctgtttgtgaccatcggcctggacaagaggatcatcctgtatgacaccagcagcaagaagctggtgaagaccctggtggccgacacccccctgacagctgtggacttcatgccagatggagccaccctggccatcggcagcagccggggcaagatctaccagtatgacctgaggatgctgaagagccctgtgaagaccatcagcgcccacaagacctctgtgcagtgcatcgccttccagtacagcacagtgctgaccaagagcagcctgaacaagggctgcagcaacaagcccaccaccgtgaacaagaggtctgtgaatgtgaatgctgccagcggaggagtgcagaacagcggcatcgtgcgggaggccccagccaccagcatcgccaccgtgctgccccagcccatgaccagcgccatgggcaagggcaccgtggccgtgcaggagaaggccggcctgcccaggagcatcaacacagacaccctgagcaaggagacagacagcggcaagaaccaggacttcagcagctttgatgacaccgggaagagcagcctgggggacatgttcagccccatcagagatgatgctgtggtgaacaagggcagtgatgagagcatcggcaaaggagatggctttgacttcctgccccagctgaacagcgtcttcccccccaggaagaaccctgtgaccagcagcacctctgtgctgcacagcagccccctgaatgtgttcatgggcagccctgggaaggaggagaatgaaaatagagacctgacagctgagagcaagaagatctacatgggcaagcaggagagcaaggacagcttcaagcagctggccaagctggtgaccagcggggctgagagcggcaacctgaacaccagccccagcagcaaccagaccaggaacagcgagaagtttgagaagccagaaaatgaaattgaggcccagctgatctgtgagccccccatcaatggcagcagcacccccaaccccaagatcgccagctctgtgacagctggggtggccagcagcctgtctgagaagattgctgacagcatcggcaacaaccggcagaatgcccccctgaccagcatccagatccgcttcatccagaacatgatccaggagaccctggatgacttccgggaggcctgccaccgggacatcgtgaacctgcaggtggagatgatcaagcagttccacatgcagctgaatgagatgcacagcctgctggagcgctacagcgtgaatgaaggcctggtggccgagattgagcggctgcgggaggagaacaagaggctgcgggcccacttctag

SEQ ID NO: 161437 - DNA, 1983 bp, Artificial Sequence; identical to SEQ ID NO: 161435
  Description of Artificial Sequence: Synthetic coding sequence

SEQ ID NO: 161438 - DNA, 1716 bp, Artificial Sequence; identical to SEQ ID NO: 161436
  Description of Artificial Sequence: Synthetic coding sequence

SEQ ID NO: 161439 - DNA, 483 bp, Artificial Sequence
  Description of Artificial Sequence: Synthetic coding sequence
atgtacctggtgtctgggggcctgaacaacacagtgaacatctgggacctgaagagcaagagggtgcacaggagcctgaaggaccacaaggaccaggtgacctgtgtgacctacaactggaatgactgctacatcgccagcggcagcctgtctggagagatcatcctgcacagcgtgaccaccaacctgagcagcacccccttcggccacggcagcaaccagagcgtgcgccacctgaagtacagcctcttcaagaagagcctgctgggctctgtgtctgacaatggaattgtgaccctgtgggatgtgaacagccagagcccctaccacaactttgacagcgtgcacaaggccccagccagcggcatctgcttcagccctgtgaatgagctgctgtttgtgaccatcggcctggacaagaggatcatcctgtatgacaccagcagcaagaagctggtgaagaccctggtggccgacacctag

SEQ ID NO: 161440 - DNA, 504 bp, Artificial Sequence
  Description of Artificial Sequence: Synthetic coding sequence
atgcacttcaccggggctgtgatgcaggagaacctgcgctttgccagcagtggagatgacatcaagatctgggatgccagctccatgaccctggtggacaagttcaacccccacaccagcccccacggcatcagcagcatctgctggagcagcaacaacaacttcctggtgacagccagcagcagcggggacaagatcgtggtgagcagctgcaagtgcaagcctgtgcccctgctggagctggccgagggccagaagcagacctgtgtgaacctgaacagcacctccatgtacctggtgtctgggggcctgaacaacacagtgaacatctgggacctgaagagcaagagggtgcacaggagcctgaaggaccacaaggaccaggtgacctgtgtgacctacaactggaatgactgctacatcgccagcggcagcctgtctggagagatcatcctgcacagcgtgaccaccaacctgagcagcacccccttcggccacggctag

SEQ ID NO: 161441 - DNA, 306 bp, Artificial Sequence
  Description of Artificial Sequence: Synthetic coding sequence
atgcaggagaacctgcgctttgccagcagtggagatgacatcaagatctgggatgccagctccatgaccctggtggacaagttcaacccccacaccagcccccacggcatcagcagcatctgctggagcagcaacaacaacttcctggtgacagccagcagcagcggggacaagatcgtggtgagcagctgcaagtgcaagcctgtgcccctgctggagctggccgagggccagaagcagacctgtgtgaacctgaacagcacctccatgtacctggtgtctgggggcctgaacaacacagtgtag

SEQ ID NO: 161442 - DNA, 498 bp, Artificial Sequence
  Description of Artificial Sequence: Synthetic coding sequence
atgcaggagaacctgcgctttgccagcagtggagatgacatcaagatctgggatgccagctccatgaccctggtggacaagttcaacccccacaccagcccccacggcatcagcagcatctgctggagcagcaacaacaacttcctggtgacagccagcagcagcggggacaagatcgtggtgagcagctgcaagtgcaagcctgtgcccctgctggagctggccgagggccagaagcagacctgtgtgaacctgaacagcacctccatgtacctggtgtctgggggcctgaacaacacagtgaacatctgggacctgaagagcaagagggtgcacaggagcctgaaggaccacaaggaccaggtgacctgtgtgacctacaactggaatgactgctacatcgccagcggcagcctgagcggggagatcatcctgcacagcgtgaccaccaacctgagcagcaccccatttggacatggcagcaaccagagcgtgtag

SEQ ID NO: 161443 - DNA, 2004 bp, Artificial Sequence
  Description of Artificial Sequence: Synthetic coding sequence
atgcacttcaccggggctgtgatgcaggagaacctgcgctttgccagcagtggagatgacatcaagatctgggatgccagctccatgaccctggtggacaagttcaacccccacaccagcccccacggcatcagcagcatctgctggagcagcaacaacaacttcctggtgacagccagcagcagcggggacaagatcgtggtgagcagctgcaagtgcaagcctgtgcccctgctggagctggccgagggccagaagcagacctgtgtgaacctgaacagcacctccatgtacctggtgtctgggggcctgaacaacacagtgaacatctgggacctgaagagcaagagggtgcacaggagcctgaaggaccacaaggaccaggtgacctgtgtgacctacaactggaatgactgctacatcgccagcggcagcctgtctggagagatcatcctgcacagcgtgaccaccaacctgagcagcacccccttcggccacggcagcaaccagagcgtgcgccacctgaagtacagcctcttcaagaagagcctgctgggctctgtgtctgacaatggaattgtgaccctgtgggatgtgaacagccagagcccctaccacaactttgacagcgtgcacaaggccccagccagcggcatctgcttcagccctgtgaatgagctgctgtttgtgaccatcggcctggacaagaggatcatcctgtatgacaccagcagcaagaagctggtgaagaccctggtggccgacacccccctgacagctgtggacttcatgccagatggagccaccctggccatcggcagcagccggggcaagatctaccagtatgacctgaggatgctgaagagccctgtgaagaccatcagcgcccacaagacctctgtgcagtgcatcgccttccagtacagcacagtgctgaccaagagcagcctgaacaagggctgcagcaacaagcccaccaccgtgaacaagaggtctgtgaatgtgaatgctgccagcggaggagtgcagaacagcggcatcgtgcgggaggccccagccaccagcatcgccaccgtgctgccccagcccatgaccagcgccatgggcaagggcaccgtggccgtgcaggagaaggccggcctgcccaggagcatcaacacagacaccctgagcaaggagacagacagcggcaagaaccaggacttcagcagctttgatgacaccgggaagagcagcctgggggacatgttcagccccatcagagatgatgctgtggtgaacaagggcagtgatgagagcatcggcaaaggagatggctttgacttcctgccccagctgaacagcgtcttcccccccaggaagaaccctgtgaccagcagcacctctgtgctgcacagcagccccctgaatgtgttcatgggcagccctgggaaggaggagaatgaaaatagagacctgacagctgagagcaagaagatctacatgggcaagcaggagagcaaggacagcttcaagcagctggccaagctggtgaccagcggggctgagagcggcaacctgaacaccagccccagcagcaaccagaccaggaacagcgagaagtttgagaagccagaaaatgaaattgaggcccagctgatctgtgagccccccatcaatggcagcagcacccccaaccccaagatcgccagctctgtgacagctggggtggccagcagcctgtctgagaagattgctgacagcatcggcaacaaccggcagaatgcccccctgaccagcatccagatccgcttcatccagaacatgatccaggagaccctggatgacttccgggaggcctgccaccgggacatcgtgaacctgcaggtggagatgatcaagcagttccacatgcagctgaatgagatgcacagcctgctggagcgctacagcgtgaatgaaggcctggtggccgagattgagcggctgcgggaggagaacaagaggctgcgggcccacttctag

SEQ ID NO: 161444 - DNA, 3744 bp, Artificial Sequence
  Description of Artificial Sequence: Synthetic coding sequence
atggcccagagcctgcggctgcactttgctgcccggcgcagcaacacctaccccctgtctgagaccagcggagatgacctggacagccacgtgcacatgtgcttcaagaggcccacccgcatcagcaccagcaatgtggtgcagatgaagctgaccccccggcagacagccctggcccccctcatcaaggaaaatgtgcagagccaggagaggagctctgtgcccagcagtgaaaatgtgaacaagaagagcagctgcctgcagatcagcctgcagcccacccgctacagcggctacctgcagagcagcaatgtgctggccgacagtgatgatgccagcttcacctgcatcctgaaggatggcatctacagcagcgctgtggtggacaatgagctgaatgctgtgaatgatggccacctggtgagcagccctgccatctgcagcggcagcctgagcaacttcagcaccagtgacaatggcagctacagcagcaatggaagtgactttggcagctgtgccagcatcaccagcggcggcagctacaccaacagcgtcatcagtgacagcagcagctacaccttccccccatctgatgacaccttcctgggcggcaacctgcccagcgacagcaccagcaacagatctgtgcccaacagaaacaccaccccctgtgagatcttcagccgcagcaccagcacagacccctttgtgcaggatgacctggagcacggcctggagatcatgaagctgcctgtgtccaggaacaccaagatccccctgaagcgctacagcagcctggtgatcttccccaggagccccagcaccacccggcccaccagccccaccagcctgtgcaccctgctgagcaagggcagctaccagaccagccaccagttcatcatcagccccagcgagatcgcccacaatgaagatggcaccagcgccaagggcttcctgagcacagctgtgaatggcctgcggctgagcaagaccatctgcaccccaggagaggtgcgggacatccggcccctgcacaggaagggcagcctgcagaagaagatcgtgctgagcaacaacaccccccggcagacagtgtgtgagaagagcagcgagggctacagctgtgtgtctgtgcacttcacccagaggaaggccgccaccctggactgtgagaccaccaacggggactgcaagccagagatgtctgagatcaagctgaacagcgacagcgagtacatcaagctgatgcacaggaccagcgcctgcctgcccagcagccagaatgtggactgccagatcaacatcaacggggagctggagcggccccacagccagatgaacaagaaccacggcatcctgcggcgcagcatcagcctgggcggggcctaccccaacatcagctgcctgagcagcctgaagcacaactgcagcaagggcggccccagccagctgctgatcaagtttgccagcggaaatgaaggcaaggtggacaacctgagccgggacagcaacagagactgcaccaatgagctgagcaacagctgcaagccaggctgggtggtgctggaccagccagatgctgcctgccacctgcagcagcagcaggagcccagccccctgcccccaggctgggaggagcggcaggacatcctgggccgcacctactacgtgaaccacgagagcaggaggacccagtggaagaggcccaccccccaggacaacctgacagatgctgaaaatggaaacatccagctgcaggcccagagggccttcaccacccggcggcagatcagcgaggagacagaatctgtggacaaccgggagagcagcgagaactgggagatcatccgggaggatgaggccaccatgtacagcaaccaggccttccccagccccccacccagcagcaacctggatgtgcccacccacctggccgaggagctgaatgcccggctgaccatctttggaaacagcgctgtgtcccagcctgccagcagcagcaaccacagcagccggcggggcagcctgcaggcctacacctttgaggagcagcccaccctgcctgtgctgctgcccaccagcagcggcctgcccccaggctgggaggagaagcaggatgagcggggccgcagctactacgtggaccacaacagcaggaccaccacctggaccaagcccaccgtgcaggccaccgtggagaccagccagctgaccagcagccagagcagcgctggcccccagagccaggccagcaccagtgacagcggccagcaggtgacccagcccagcgagattgagcagggcttcctgcccaagggctgggaggtgagacatgccccaaatggccggcccttcttcatcgaccacaacaccaagaccaccacctgggaggacccccggctgaagatcccagcccacctgcggggcaagaccagcctggacaccagcaatgacctgggccccctgcccccaggctgggaggagaggacccacacagatggccgcatcttctacatcaaccacaacatcaagaggacccagtgggaggacccccggctggagaatgtggccatcactggacctgctgtgccctacagccgggactacaagaggaaatatgagttcttccggaggaagctgaagaagcagaatgacatccccaacaagtttgagatgaagctgcggcgggccaccgtgctggaggacagctaccgccgcatcatgggcgtgaagagagctgacttcctgaaggcccggctgtggattgaatttgatggagagaagggcctggactatggaggagtggcccgggagtggttcttcctgatcagcaaggagatgttcaacccctactacggcctgtttgagtacagcgccacagacaactacaccctgcagatcaaccccaacagcggcctgtgcaatgaagaccacctgagctacttcaagttcatcggccgggtggccggcatggctgtgtaccacggcaagctgctggatggcttcttcatccggcccttctacaagatgatgctgcacaagcccatcaccctgcatgacatggagagcgtggacagcgagtactacaacagcctgcgctggatcctggagaatgaccccacagagctggacctgcgcttcatcattgatgaggagctgtttggccagacccaccagcacgagctgaagaatggaggcagcgagatcgtggtgaccaacaagaacaagaaggagtacatctacctggtgatccagtggaggtttgtgaaccgcatccagaagcagatggccgccttcaaggagggcttctttgagctgatcccccaggacctgatcaagatctttgatgaaaatgagctggagctgctgatgtgtggcctgggagatgtggatgtgaatgactggagggagcacaccaagtacaagaatggctacagcgccaaccaccaggtgatccagtggttctggaaggctgtgctgatgatggacagcgagaagaggatccggctgctgcagtttgtgacaggcaccagccgggtgcccatgaatggatttgctgagctgtatggcagcaatggcccccagagcttcaccgtggagcagtggggcaccccagagaagctgccccgggcccacacctgcttcaaccggctggacctgcccccctatgagagctttgaggagctgtgggacaagctgcagatggccatcgagaacacccagggctttgatggagtggactag

SEQ ID NO: 161445 - DNA, 2703 bp, Artificial Sequence
  Description of Artificial Sequence: Synthetic coding sequence
atggccacctgtgctgtggaggtgtttggcctgctggaggatgaggagaacagccgcatcgtgcgggtgcgggtgattgctggcatcggcctggccaagaaggacatcctgggcgccagtgacccctacgtgcgggtgaccctgtatgaccccatgaatggagtgctgacctctgtgcagaccaagaccatcaagaagagcctgaaccccaagtggaatgaggagatcctcttccgggtgcacccccagcagcaccggctgctgtttgaggtgtttgatgagaaccggctgaccagagatgacttcctgggccaggtggatgtgcccctgtaccccctgcccacagagaacccccggctggagcggccctacaccttcaaggactttgtgctgcaccccaggagccacaagagccgggtgaagggctacctgcggctgaagatgacctacctgcccaagaccagcggctctgaagatgacaatgctgagcaggccgaggagctggagcccggctgggtggtgctggaccagccagatgctgcctgccacctgcagcagcagcaggagcccagccccctgcccccaggctgggaggagcggcaggacatcctgggccgcacctactacgtgaaccacgagagcaggaggacccagtggaagaggcccaccccccaggacaacctgacagatgctgaaaatggaaacatccagctgcaggcccagagggccttcaccacccggcggcagatcagcgaggagacagagagcgtggacaaccgggagagcagcgagaactgggagatcatcagagaagatgaggccaccatgtacagcaaccaggccttccccagccccccacccagcagcaacctggatgtgcccacccacctggccgaggagctgaatgcccggctgaccatcttcggcaacagcgctgtgtcccagcctgccagcagcagcaaccacagcagcagaagaggcagcctgcaggcctacacctttgaggagcagcccaccctgcctgtgctgctgcccaccagcagcggcctgcccccaggctgggaggagaagcaggatgagcggggccgcagctactacgtggaccacaacagcaggaccaccacctggaccaagcccaccgtgcaggccaccgtggagaccagccagctgaccagcagccagagcagcgctggcccccagagccaggccagcaccagtgacagcggccagcaggtgacccagcccagcgagattgagcagggcttcctgcccaagggctgggaggtgagacatgcccccaacggccggcccttcttcatcgaccacaacaccaagaccaccacctgggaggacccccggctgaagatcccagcccacctgcggggcaagaccagcctggacaccagcaatgacctgggccccctgcccccaggctgggaggagaggacccacacagatggccgcatcttctacatcaaccacaacatcaagaggacccagtgggaggacccccggctggagaatgtggccatcaccggccctgctgtgccctacagccgggactacaagaggaaatatgagttcttccggaggaagctgaagaagcagaatgacatccccaacaagtttgagatgaagctgcggcgggccaccgtgctggaggacagctaccgccgcatcatgggcgtgaagagagctgacttcctgaaggcccggctgtggattgaatttgatggagagaagggcctggactatggaggagtggcccgggagtggttcttcctgatcagcaaggagatgttcaacccctactacggcctgtttgagtacagcgccacagacaactacaccctgcagatcaaccccaacagcggcctgtgcaatgaagaccacctgagctacttcaagttcatcggccgggtggccggcatggctgtgtaccacggcaagctgctggatggcttcttcatccggcccttctacaagatgatgctgcacaagcccatcaccctgcatgacatggagagcgtggacagcgagtactacaacagcctgcgctggatcctggagaatgaccccacagagctggacctgcgcttcatcattgatgaggagctgtttggccagacccaccagcacgagctgaagaatggaggcagcgagatcgtggtgaccaacaagaacaagaaggagtacatctacctggtgatccagtggaggtttgtgaaccgcatccagaagcagatggccgccttcaaggagggcttctttgagctgatcccccaggacctgatcaagatctttgatgaaaatgagctggagctgctgatgtgtggcctgggagatgtggatgtgaatgactggagggagcacaccaagtacaagaatggctacagcgccaaccaccaggtgatccagtggttctggaaggctgtgctgatgatggattctgagaagaggatccggctgctgcagtttgtgacaggcaccagccgggtgcccatgaatggatttgctgagctgtatggcagcaatggcccccagagcttcaccgtggagcagtggggcaccccagagaagctgccccgggcccacacctgcttcaaccggctggacctgcccccctatgagagctttgaggagctgtgggacaagctgcagatggccatcgagaacacccagggctttgatggagtggactag

SEQ ID NO: 161446 - DNA, 3912 bp, Artificial Sequence
  Description of Artificial Sequence: Synthetic coding sequence
atggcccagagcctgcggctgcactttgctgcccggcgcagcaacacctaccccctgtctgagaccagcggagatgacctggacagccacgtgcacatgtgcttcaagaggcccacccgcatcagcaccagcaatgtggtgcagatgaagctgaccccccggcagacagccctggcccccctcatcaaggaaaatgtgcagagccaggagaggagctctgtgcccagcagtgaaaatgtgaacaagaagagcagctgcctgcagatcagcctgcagcccacccgctacagcggctacctgcagagcagcaatgtgctggccgacagtgatgatgccagcttcacctgcatcctgaaggatggcatctacagcagcgctgtggtggacaatgagctgaatgctgtgaatgatggccacctggtgagcagccctgccatctgcagcggcagcctgagcaacttcagcaccagtgacaatggcagctacagcagcaatggaagtgactttggcagctgtgccagcatcaccagcggcggcagctacaccaacagcgtcatcagtgacagcagcagctacaccttccccccatctgatgacaccttcctgggcggcaacctgcccagcgacagcaccagcaacagatctgtgcccaacagaaacaccaccccctgtgagatcttcagccgcagcaccagcacagacccctttgtgcaggatgacctggagcacggcctggagatcatgaagctgcctgtgtccaggaacaccaagatccccctgaagcgctacagcagcctggtgatcttccccaggagccccagcaccacccggcccaccagccccaccagcctgtgcaccctgctgagcaagggcagctaccagaccagccaccagttcatcatcagccccagcgagatcgcccacaatgaagatggcaccagcgccaagggcttcctgagcacagctgtgaatggcctgcggctgagcaagaccatctgcaccccaggagaggtgcgggacatccggcccctgcacaggaagggcagcctgcagaagaagatcgtgctgagcaacaacaccccccggcagacagtgtgtgagaagagcagcgagggctacagctgtgtgtctgtgcacttcacccagaggaaggccgccaccctggactgtgagaccaccaacggggactgcaagccagagatgtctgagatcaagctgaacagcgacagcgagtacatcaagctgatgcacaggaccagcgcctgcctgcccagcagccagaatgtggactgccagatcaacatcaacggggagctggagcggccccacagccagatgaacaagaaccacggcatcctgcggcgcagcatcagcctgggcggggcctaccccaacatcagctgcctgagcagcctgaagcacaactgcagcaagggcggccccagccagctgctgatcaagtttgccagcggaaatgaaggcaaggtggacaacctgagccgggacagcaacagagactgcaccaatgagctgagcaacagctgcaagaccagagatgacttcctgggccaggtggatgtgcccctgtaccccctgcccacagagaacccccggctggagcggccctacaccttcaaggactttgtgctgcaccccaggagccacaagagccgggtgaagggctacctgcggctgaagatgacctacctgcccaagaccagcggctctgaagatgacaatgctgagcaggccgaggagctggagcagcagcaggagcccagccccctgcccccaggctgggaggagcggcaggacatcctgggccgcacctactacgtgaaccacgagagcaggaggacccagtggaagaggcccaccccccaggacaacctgacagatgctgaaaatggaaacatccagctgcaggcccagagggccttcaccacccggcggcagatcagcgaggagacagaatctgtggacaaccgggagagcagcgagaactgggagatcatccgggaggatgaggccaccatgtacagcaaccaggccttccccagccccccacccagcagcaacctggatgtgcccacccacctggccgaggagctgaatgcccggctgaccatctttggaaacagcgctgtgtcccagcctgccagcagcagcaaccacagcagccggcggggcagcctgcaggcctacacctttgaggagcagcccaccctgcctgtgctgctgcccaccagcagcggcctgcccccaggctgggaggagaagcaggatgagcggggccgcagctactacgtggaccacaacagcaggaccaccacctggaccaagcccaccgtgcaggccaccgtggagaccagccagctgaccagcagccagagcagcgctggcccccagagccaggccagcaccagtgacagcggccagcaggtgacccagcccagcgagattgagcagggcttcctgcccaagggctgggaggtgagacatgccccaaatggccggcccttcttcatcgaccacaacaccaagaccaccacctgggaggacccccggctgaagatcccagcccacctgcggggcaagaccagcctggacaccagcaatgacctgggccccctgcccccaggctgggaggagaggacccacacagatggccgcatcttctacatcaaccacaacatcaagaggacccagtgggaggacccccggctggagaatgtggccatcactggacctgctgtgccctacagccgggactacaagaggaaatatgagttcttccggaggaagctgaagaagcagaatgacatccccaacaagtttgagatgaagctgcggcgggccaccgtgctggaggacagctaccgccgcatcatgggcgtgaagagagctgacttcctgaaggcccggctgtggattgaatttgatggagagaagggcctggactatggaggagtggcccgggagtggttcttcctgatcagcaaggagatgttcaacccctactacggcctgtttgagtacagcgccacagacaactacaccctgcagatcaaccccaacagcggcctgtgcaatgaagaccacctgagctacttcaagttcatcggccgggtggccggcatggctgtgtaccacggcaagctgctggatggcttcttcatccggcccttctacaagatgatgctgcacaagcccatcaccctgcatgacatggagagcgtggacagcgagtactacaacagcctgcgctggatcctggagaatgaccccacagagctggacctgcgcttcatcattgatgaggagctgtttggccagacccaccagcacgagctgaagaatggaggcagcgagatcgtggtgaccaacaagaacaagaaggagtacatctacctggtgatccagtggaggtttgtgaaccgcatccagaagcagatggccgccttcaaggagggcttctttgagctgatcccccaggacctgatcaagatctttgatgaaaatgagctggagctgctgatgtgtggcctgggagatgtggatgtgaatgactggagggagcacaccaagtacaagaatggctacagcgccaaccaccaggtgatccagtggttctggaaggctgtgctgatgatggacagcgagaagaggatccggctgctgcagtttgtgacaggcaccagccgggtgcccatgaatggatttgctgagctgtatggcagcaatggcccccagagcttcaccgtggagcagtggggcaccccagagaagctgccccgggcccacacctgcttcaaccggctggacctgcccccctatgagagctttgaggagctgtgggacaagctgcagatggccatcgagaacacccagggctttgatggagtggactag

SEQ ID NO: 161447 - DNA, 3960 bp, Artificial Sequence
  Description of Artificial Sequence: Synthetic coding sequence
atggcccagagcctgcggctgcactttgctgcccggcgcagcaacacctaccccctgtctgagaccagcggagatgacctggacagccacgtgcacatgtgcttcaagaggcccacccgcatcagcaccagcaatgtggtgcagatgaagctgaccccccggcagacagccctggcccccctcatcaaggaaaatgtgcagagccaggagaggagctctgtgcccagcagtgaaaatgtgaacaagaagagcagctgcctgcagatcagcctgcagcccacccgctacagcggctacctgcagagcagcaatgtgctggccgacagtgatgatgccagcttcacctgcatcctgaaggatggcatctacagcagcgctgtggtggacaatgagctgaatgctgtgaatgatggccacctggtgagcagccctgccatctgcagcggcagcctgagcaacttcagcaccagtgacaatggcagctacagcagcaatggaagtgactttggcagctgtgccagcatcaccagcggcggcagctacaccaacagcgtcatcagtgacagcagcagctacaccttccccccatctgatgacaccttcctgggcggcaacctgcccagcgacagcaccagcaacagatctgtgcccaacagaaacaccaccccctgtgagatcttcagccgcagcaccagcacagacccctttgtgcaggatgacctggagcacggcctggagatcatgaagctgcctgtgtccaggaacaccaagatccccctgaagcgctacagcagcctggtgatcttccccaggagccccagcaccacccggcccaccagccccaccagcctgtgcaccctgctgagcaagggcagctaccagaccagccaccagttcatcatcagccccagcgagatcgcccacaatgaagatggcaccagcgccaagggcttcctgagcacagctgtgaatggcctgcggctgagcaagaccatctgcaccccaggagaggtgcgggacatccggcccctgcacaggaagggcagcctgcagaagaagatcgtgctgagcaacaacaccccccggcagacagtgtgtgagaagagcagcgagggctacagctgtgtgtctgtgcacttcacccagaggaaggccgccaccctggactgtgagaccaccaacggggactgcaagccagagatgtctgagatcaagctgaacagcgacagcgagtacatcaagctgatgcacaggaccagcgcctgcctgcccagcagccagaatgtggactgccagatcaacatcaacggggagctggagcggccccacagccagatgaacaagaaccacggcatcctgcggcgcagcatcagcctgggcggggcctaccccaacatcagctgcctgagcagcctgaagcacaactgcagcaagggcggccccagccagctgctgatcaagtttgccagcggaaatgaaggcaaggtggacaacctgagccgggacagcaacagagactgcaccaatgagctgagcaacagctgcaagaccagagatgacttcctgggccaggtggatgtgcccctgtaccccctgcccacagagaacccccggctggagcggccctacaccttcaaggactttgtgctgcaccccaggagccacaagagccgggtgaagggctacctgcggctgaagatgacctacctgcccaagaccagcggctctgaagatgacaatgctgagcaggccgaggagctggagcccggctgggtggtgctggaccagccagatgctgcctgccacctgcagcagcagcaggagcccagccccctgcccccaggctgggaggagcggcaggacatcctgggccgcacctactacgtgaaccacgagagcaggaggacccagtggaagaggcccaccccccaggacaacctgacagatgctgaaaatggaaacatccagctgcaggcccagagggccttcaccacccggcggcagatcagcgaggagacagaatctgtggacaaccgggagagcagcgagaactgggagatcatccgggaggatgaggccaccatgtacagcaaccaggccttccccagccccccacccagcagcaacctggatgtgcccacccacctggccgaggagctgaatgcccggctgaccatctttggaaacagcgctgtgtcccagcctgccagcagcagcaaccacagcagccggcggggcagcctgcaggcctacacctttgaggagcagcccaccctgcctgtgctgctgcccaccagcagcggcctgcccccaggctgggaggagaagcaggatgagcggggccgcagctactacgtggaccacaacagcaggaccaccacctggaccaagcccaccgtgcaggccaccgtggagaccagccagctgaccagcagccagagcagcgctggcccccagagccaggccagcaccagtgacagcggccagcaggtgacccagcccagcgagattgagcagggcttcctgcccaagggctgggaggtgagacatgccccaaatggccggcccttcttcatcgaccacaacaccaagaccaccacctgggaggacccccggctgaagatcccagcccacctgcggggcaagaccagcctggacaccagcaatgacctgggccccctgcccccaggctgggaggagaggacccacacagatggccgcatcttctacatcaaccacaacatcaagaggacccagtgggaggacccccggctggagaatgtggccatcactggacctgctgtgccctacagccgggactacaagaggaaatatgagttcttccggaggaagctgaagaagcagaatgacatccccaacaagtttgagatgaagctgcggcgggccaccgtgctggaggacagctaccgccgcatcatgggcgtgaagagagctgacttcctgaaggcccggctgtggattgaatttgatggagagaagggcctggactatggaggagtggcccgggagtggttcttcctgatcagcaaggagatgttcaacccctactacggcctgtttgagtacagcgccacagacaactacaccctgcagatcaaccccaacagcggcctgtgcaatgaagaccacctgagctacttcaagttcatcggccgggtggccggcatggctgtgtaccacggcaagctgctggatggcttcttcatccggcccttctacaagatgatgctgcacaagcccatcaccctgcatgacatggagagcgtggacagcgagtactacaacagcctgcgctggatcctggagaatgaccccacagagctggacctgcgcttcatcattgatgaggagctgtttggccagacccaccagcacgagctgaagaatggaggcagcgagatcgtggtgaccaacaagaacaagaaggagtacatctacctggtgatccagtggaggtttgtgaaccgcatccagaagcagatggccgccttcaaggagggcttctttgagctgatcccccaggacctgatcaagatctttgatgaaaatgagctggagctgctgatgtgtggcctgggagatgtggatgtgaatgactggagggagcacaccaagtacaagaatggctacagcgccaaccaccaggtgatccagtggttctggaaggctgtgctgatgatggacagcgagaagaggatccggctgctgcagtttgtgacaggcaccagccgggtgcccatgaatggatttgctgagctgtatggcagcaatggcccccagagcttcaccgtggagcagtggggcaccccagagaagctgccccgggcccacacctgcttcaaccggctggacctgcccccctatgagagctttgaggagctgtgggacaagctgcagatggccatcgagaacacccagggctttgatggagtggactag

SEQ ID NO: 161448 - DNA, 2616 bp, Artificial Sequence
  Description of Artificial Sequence: Synthetic coding sequence
atggccaccggcctgggggagcctgtgtatggcctgtctgaagatgaaggagagagccgcatcctgcgggtgaaggtggtgtctggcatcgacctggccaagaaggacatctttggagccagtgacccctacgtgaagctgagcctgtatgtggctgatgagaaccgggagctggccctggtgcagaccaagaccatcaagaagaccctgaaccccaagtggaatgaggagttctacttccgggtgaaccccagcaaccaccggctgctgtttgaggtgtttgatgagaaccggctgaccagagatgacttcctgggccaggtggatgtgcccctgagccacctgcccacagaggaccccaccatggagcggccctacaccttcaaggacttcctgctgcggcccaggagccacaagagccgggtgaagggcttcctgcggctgaagatggcctacatgcccaagaatggaggccaggatgaggagaacagcgaccagagagatgacatggagcacggctgggaggtggtggacagcaatgacagcgccagccagcaccaggaggagctgcccccaccacccctgcccccaggctgggaggagaaggtggacaacctgggccgcacctactacgtgaaccacaacaacagaaccacccagtggcaccggcccagcctgatggatgtgtcctctgagagtgacaacaacatccggcagatcaaccaggaggccgcccaccggcgcttccgcagccgccgccacatcagcgaggacctggagcctgagcccagcgagggcggagatgtgcctgagccctgggagaccatcagcgaggaggtgaacattgctggggacagcctgggcctggccctgcccccacctccagccagccctggcagcaggaccagcccccaggagctgtctgaggagctgagccggcggctgcagatcaccccagacagcaatggagagcagttcagcagcctcatccagcgggagcccagcagccggctgcggagctgcagcgtgacagatgctgtggccgagcagggccacctgcccccaggggccaaggacagccctgtgagaagagctgtgaaggacaccctgagcaacccccagagcccccagcccagcccctacaacagccccaagccccagcacaaggtgacccagagcttcctgcccccaggctgggagatgagaattgcccccaacggccggcccttcttcatcgaccacaacaccaagaccaccacctgggaggacccccggctgaagtttcctgtgcacatgaggagcaagaccagcctgaaccccaatgacctgggccccctgcccccaggctgggaggagcgcatccacctggatggccgcaccttctacatcgaccacaacagcaagatcacccagtgggaggacccccggctgcagaacccagccatcactggacctgctgtgccctacagccgggagttcaagcagaagtatgactacttcaggaagaagctgaagaagccagctgacatccccaacagatttgagatgaagctgcacaggaacaacatctttgaggagagctaccgccgcatcatgtctgtgaagaggccagatgtgctgaaggcccggctgtggattgaatttgagagcgagaagggcctggactatggaggagtggcccgggagtggttcttcctgctgagcaaggagatgttcaacccctactacggcctgtttgagtacagcgccacagacaactacaccctgcagatcaaccccaacagcggcctgtgcaatgaagaccacctgagctacttcaccttcatcggccgggtggccggcctggccgtgttccacggcaagctgctggatggcttcttcatccggcccttctacaagatgatgctgggcaagcagatcaccctgaatgacatggagagcgtggacagcgagtactacaacagcctgaagtggatcctggagaatgaccccacagagctggacctgatgttctgcattgatgaggagaactttggccagacctaccaggtggacctgaagcccaatggaagtgagatcatggtgaccaatgaaaacaagcgggagtacatcgacctggtgatccagtggaggtttgtgaacagagtgcagaagcagatgaatgccttcctggagggcttcacagagctgctgcccatcgacctgatcaagatctttgatgaaaatgagctggagctgctgatgtgtggcctgggagatgtggatgtgaatgactggaggcagcacagcatctacaagaatggctactgccccaaccaccctgtgatccagtggttctggaaggctgtgctgctgatggatgctgagaagaggatccggctgctgcagtttgtgacaggcaccagccgggtgcccatgaatggatttgctgagctgtatggcagcaatggcccccagctgttcaccatcgagcagtggggcagccctgagaagctgccccgggcccacacctgcttcaaccggctggacctgcccccctatgagacctttgaggacctgcgggagaagctgctgatggctgtggagaatgcccagggctttgaaggagtggactag

SEQ ID NO: 161449 - DNA, 2508 bp, Artificial Sequence
  Description of Artificial Sequence: Synthetic coding sequence
atggagcggccctacaccttcaaggacttcctgctgcggcccaggagccacaagagccgggtgaagggcttcctgcggctgaagatggcctacatgcccaagaatggaggccaggatgaagaaaattctgaccagagagatgacatggagcacggctgggaggtggtggacagcaatgattctgccagccagcaccaggaggagctgcccccaccacccctgcccccaggctgggaggagaaggtggacaacctgggccgcacctactacgtgaaccacaacaacagaaccacccagtggcaccggcccagcctgatggatgtgagcagcgagagtgacaacaacatccggcagatcaaccaggaggccgcccaccggcgcttccgcagcagaagacacatcagcgaggacctggagcctgagcccagcgagggcggagatgtgcctgagccctgggagaccatcagcgaggaggtgaacattgctggggacagcctgggcctggccctgcccccacctccagccagccctggcagcaggaccagcccccaggagctgtctgaggagctgagccggcggctgcagatcaccccagacagcaatggagagcagttcagcagcctcatccagcgggagcccagcagccggctgcggagctgcagcgtgacagatgctgtggccgagcagggccacctgcccccacccagcgtggcctacgtgcacaccaccccaggcctgcccagcggctgggaggagaggaaggatgccaagggccgcacctactacgtgaaccacaacaacagaaccaccacctggacccggcccatcatgcagctggctgaagatggagccagcggcagcgccaccaacagcaacaaccacctgattgagccccagatcagaagacccaggagcctgagcagccccaccgtgaccctgagcgcccccctggagggcgccaaggacagccctgtgcggcgggctgtgaaggacaccctgagcaacccccagagcccccagcccagcccctacaacagccccaagccccagcacaaggtgacccagagcttcctgcccccaggctgggagatgagaattgccccaaatggccggcccttcttcatcgaccacaacaccaagaccaccacctgggaggacccccggctgaagtttcctgtgcacatgaggagcaagaccagcctgaaccccaatgacctgggccccctgcccccaggctgggaggagcgcatccacctggatggccgcaccttctacatcgaccacaacagcaagatcacccagtgggaggacccccggctgcagaacccagccatcaccggccccaaggctgtgccctacagccgggagttcaagcagaagtatgactacttcaggaagaagctgaagaagccagctgacatccccaacagatttgagatgaagctgcacaggaacaacatctttgaggagagctaccgccgcatcatgtctgtgaagaggccagatgtgctgaaggcccggctgtggattgaatttgagagcgagaagggcctggactatggaggagtggcccgggagtggttcttcctgctgagcaaggagatgttcaacccctactacggcctgtttgagtacagcgccacagacaactacaccctgcagatcaaccccaacagcggcctgtgcaatgaagaccacctgagctacttcaccttcatcggccgggtggccggcctggccgtgttccacggcaagctgctggatggcttcttcatccggcccttctacaagatgatgctgggcaagcagatcaccctgaatgacatggagagcgtggacagcgagtactacaacagcctgaagtggatcctggagaatgaccccacagagctggacctgatgttctgcattgatgaggagaactttggccagacctaccaggtggacctgaagcccaatggaagtgagatcatggtgaccaatgaaaacaagcgggagtacatcgacctggtgatccagtggaggtttgtgaacagagtgcagaagcagatgaatgccttcctggagggcttcacagagctgctgcccatcgacctgatcaagatctttgatgaaaatgagctggagctgctgatgtgtggcctgggagatgtggatgtgaatgactggaggcagcacagcatctacaagaatggctactgccccaaccaccctgtgatccagtggttctggaaggctgtgctgctgatggatgctgagaagaggatccggctgctgcagtttgtgacaggcaccagccgggtgcccatgaatggatttgctgagctgtatggcagcaatggcccccagctgttcaccatcgagcagtggggcagccctgagaagctgccccgggcccacacctgcttcaaccggctggacctgcccccctatgagacctttgaggacctgcgggagaagctgctgatggctgtggagaatgcccagggctttgaaggagtggactag

SEQ ID NO: 161450 - DNA, 2736 bp, Artificial Sequence
  Description of Artificial Sequence: Synthetic coding sequence
atggccaccggcctgggggagcctgtgtatggcctgtctgaagatgaaggagagagccgcatcctgcgggtgaaggtggtgtctggcatcgacctggccaagaaggacatctttggagccagtgacccctacgtgaagctgagcctgtatgtggctgatgagaaccgggagctggccctggtgcagaccaagaccatcaagaagaccctgaaccccaagtggaatgaggagttctacttccgggtgaaccccagcaaccaccggctgctgtttgaggtgtttgatgagaaccggctgaccagagatgacttcctgggccaggtggatgtgcccctgagccacctgcccacagaggaccccaccatggagcggccctacaccttcaaggacttcctgctgcggcccaggagccacaagagccgggtgaagggcttcctgcggctgaagatggcctacatgcccaagaatggaggccaggatgaggagaacagcgaccagagagatgacatggagcacggctgggaggtggtggacagcaatgacagcgccagccagcaccaggaggagctgcccccaccacccctgcccccaggctgggaggagaaggtggacaacctgggccgcacctactacgtgaaccacaacaacagaaccacccagtggcaccggcccagcctgatggatgtgtcctctgagagtgacaacaacatccggcagatcaaccaggaggccgcccaccggcgcttccgcagccgccgccacatcagcgaggacctggagcctgagcccagcgagggcggagatgtgcctgagccctgggagaccatcagcgaggaggtgaacattgctggggacagcctgggcctggccctgcccccacctccagccagccctggcagcaggaccagcccccaggagctgtctgaggagctgagccggcggctgcagatcaccccagacagcaatggagagcagttcagcagcctcatccagcgggagcccagcagccggctgcggagctgcagcgtgacagatgctgtggccgagcagggccacctgccccccctggccgaggatggagccagcggcagcgccaccaacagcaacaaccacctgattgagccccagatccggcggcccaggagcctgagcagccccaccgtgaccctgagcgcccccctggagggcgccaaggacagccctgtgagaagagctgtgaaggacaccctgagcaacccccagagcccccagcccagcccctacaacagccccaagccccagcacaaggtgacccagagcttcctgcccccaggctgggagatgagaattgcccccaacggccggcccttcttcatcgaccacaacaccaagaccaccacctgggaggacccccggctgaagtttcctgtgcacatgaggagcaagaccagcctgaaccccaatgacctgggccccctgcccccaggctgggaggagcgcatccacctggatggccgcaccttctacatcgaccacaacagcaagatcacccagtgggaggacccccggctgcagaacccagccatcactggacctgctgtgccctacagccgggagttcaagcagaagtatgactacttcaggaagaagctgaagaagccagctgacatccccaacagatttgagatgaagctgcacaggaacaacatctttgaggagagctaccgccgcatcatgtctgtgaagaggccagatgtgctgaaggcccggctgtggattgaatttgagagcgagaagggcctggactatggaggagtggcccgggagtggttcttcctgctgagcaaggagatgttcaacccctactacggcctgtttgagtacagcgccacagacaactacaccctgcagatcaaccccaacagcggcctgtgcaatgaagaccacctgagctacttcaccttcatcggccgggtggccggcctggccgtgttccacggcaagctgctggatggcttcttcatccggcccttctacaagatgatgctgggcaagcagatcaccctgaatgacatggagagcgtggacagcgagtactacaacagcctgaagtggatcctggagaatgaccccacagagctggacctgatgttctgcattgatgaggagaactttggccagacctaccaggtggacctgaagcccaatggaagtgagatcatggtgaccaatgaaaacaagcgggagtacatcgacctggtgatccagtggaggtttgtgaacagagtgcagaagcagatgaatgccttcctggagggcttcacagagctgctgcccatcgacctgatcaagatctttgatgaaaatgagctggagctgctgatgtgtggcctgggagatgtggatgtgaatgactggaggcagcacagcatctacaagaatggctactgccccaaccaccctgtgatccagtggttctggaaggctgtgctgctgatggatgctgagaagaggatccggctgctgcagtttgtgacaggcaccagccgggtgcccatgaatggatttgctgagctgtatggcagcaatggcccccagctgttcaccatcgagcagtggggcagccctgagaagctgccccgggcccacacctgcttcaaccggctggacctgcccccctatgagacctttgaggacctgcgggagaagctgctgatggctgtggagaatgcccagggctttgaaggagtggactag

SEQ ID NO: 161451 - DNA, 2904 bp, Artificial Sequence
  Description of Artificial Sequence: Synthetic coding sequence
atgaggcggctggcctttgagcagggcgagagccgcatcctgcgggtgaaggtggtgtctggcatcgacctggccaagaaggacatctttggagccagtgacccctacgtgaagctgagcctgtatgtggctgatgagaaccgggagctggccctggtgcagaccaagaccatcaagaagaccctgaaccccaagtggaatgaggagttctacttccgggtgaaccccagcaaccaccggctgctgtttgaggtgtttgatgagaaccggctgaccagagatgacttcctgggccaggtggatgtgcccctgagccacctgcccacagaggaccccaccatggagcggccctacaccttcaaggacttcctgctgcggcccaggagccacaagagccgggtgaagggcttcctgcggctgaagatggcctacatgcccaagaatggaggccaggatgaggagaacagcgaccagagagatgacatggagcacggctgggaggtggtggacagcaatgacagcgccagccagcaccaggaggagctgcccccaccacccctgcccccaggctgggaggagaaggtggacaacctgggccgcacctactacgtgaaccacaacaacagaaccacccagtggcaccggcccagcctgatggatgtgtcctctgagagtgacaacaacatccggcagatcaaccaggaggccgcccaccggcgcttccgcagccgccgccacatcagcgaggacctggagcctgagcccagcgagggcggagatgtgcctgagccctgggagaccatcagcgaggaggtgaacattgctggggacagcctgggcctggccctgcccccacctccagccagccctggcagcaggaccagcccccaggagctgtctgaggagctgagccggcggctgcagatcaccccagacagcaatggagagcagttcagcagcctcatccagcgggagcccagcagccggctgcggagctgcagcgtgacagatgctgtggccgagcagggccacctgcccccaccttctgccccagctggccgggcccggagcagcacagtgactggaggagaggagcccaccccatctgtggcctacgtgcacaccaccccaggcctgcccagcggctgggaggagaggaaggatgccaagggccgcacctactacgtgaaccacaacaacagaaccaccacctggacccggcccatcatgcagctggccgaggatggagccagcggcagcgccaccaacagcaacaaccacctgattgagccccagatccggcggcccaggagcctgagcagccccaccgtgaccctgagcgcccccctggagggcgccaaggacagccctgtgagaagagctgtgaaggacaccctgagcaacccccagagcccccagcccagcccctacaacagccccaagccccagcacaaggtgacccagagcttcctgcccccaggctgggagatgagaattgcccccaacggccggcccttcttcatcgaccacaacaccaagaccaccacctgggaggacccccggctgaagtttcctgtgcacatgaggagcaagaccagcctgaaccccaatgacctgggccccctgcccccaggctgggaggagcgcatccacctggatggccgcaccttctacatcgaccacaacagcaagatcacccagtgggaggacccccggctgcagaacccagccatcactggacctgctgtgccctacagccgggagttcaagcagaagtatgactacttcaggaagaagctgaagaagccagctgacatccccaacagatttgagatgaagctgcacaggaacaacatctttgaggagagctaccgccgcatcatgtctgtgaagaggccagatgtgctgaaggcccggctgtggattgaatttgagagcgagaagggcctggactatggaggagtggcccgggagtggttcttcctgctgagcaaggagatgttcaacccctactacggcctgtttgagtacagcgccacagacaactacaccctgcagatcaaccccaacagcggcctgtgcaatgaagaccacctgagctacttcaccttcatcggccgggtggccggcctggccgtgttccacggcaagctgctggatggcttcttcatccggcccttctacaagatgatgctgggcaagcagatcaccctgaatgacatggagagcgtggacagcgagtactacaacagcctgaagtggatcctggagaatgaccccacagagctggacctgatgttctgcattgatgaggagaactttggccagacctaccaggtggacctgaagcccaatggaagtgagatcatggtgaccaatgaaaacaagcgggagtacatcgacctggtgatccagtggaggtttgtgaacagagtgcagaagcagatgaatgccttcctggagggcttcacagagctgctgcccatcgacctgatcaagatctttgatgaaaatgagctggagctgctgatgtgtggcctgggagatgtggatgtgaatgactggaggcagcacagcatctacaagaatggctactgccccaaccaccctgtgatccagtggttctggaaggctgtgctgctgatggatgctgagaagaggatccggctgctgcagtttgtgacaggcaccagccgggtgcccatgaatggatttgctgagctgtatggcagcaatggcccccagctgttcaccatcgagcagtggggcagccctgagaagctgccccgggcccacacctgcttcaaccggctggacctgcccccctatgagacctttgaggacctgcgggagaagctgctgatggctgtggagaatgcccagggctttgaaggagtggactag

SEQ ID NO: 161452 - DNA, 2868 bp, Artificial Sequence
  Description of Artificial Sequence: Synthetic coding sequence
atggccaccggcctgggggagcctgtgtatggcctgtctgaagatgaaggagagagccgcatcctgcgggtgaaggtggtgtctggcatcgacctggccaagaaggacatctttggagccagtgacccctacgtgaagctgagcctgtatgtggctgatgagaaccgggagctggccctggtgcagaccaagaccatcaagaagaccctgaaccccaagtggaatgaggagttctacttccgggtgaaccccagcaaccaccggctgctgtttgaggtgtttgatgagaaccggctgaccagagatgacttcctgggccaggtggatgtgcccctgagccacctgcccacagaggaccccaccatggagcggccctacaccttcaaggacttcctgctgcggcccaggagccacaagagccgggtgaagggcttcctgcggctgaagatggcctacatgcccaagaatggaggccaggatgaggagaacagcgaccagagagatgacatggagcacggctgggaggtggtggacagcaatgacagcgccagccagcaccaggaggagctgcccccaccacccctgcccccaggctgggaggagaaggtggacaacctgggccgcacctactacgtgaaccacaacaacagaaccacccagtggcaccggcccagcctgatggatgtgtcctctgagagtgacaacaacatccggcagatcaaccaggaggccgcccaccggcgcttccgcagccgccgccacatcagcgaggacctggagcctgagcccagcgagggcggagatgtgcctgagccctgggagaccatcagcgaggaggtgaacattgctggggacagcctgggcctggccctgcccccacctccagccagccctggcagcaggaccagcccccaggagctgtctgaggagctgagccggcggctgcagatcaccccagacagcaatggagagcagttcagcagcctcatccagcgggagcccagcagccggctgcggagctgcagcgtgacagatgctgtggccgagcagggccacctgcccccaccttctgtggcctacgtgcacaccaccccaggcctgcccagcggctgggaggagaggaaggatgccaagggccgcacctactacgtgaaccacaacaacagaaccaccacctggacccggcccatcatgcagctggccgaggatggagccagcggcagcgccaccaacagcaacaaccacctgattgagccccagatccggcggcccaggagcctgagcagccccaccgtgaccctgagcgcccccctggagggcgccaaggacagccctgtgagaagagctgtgaaggacaccctgagcaacccccagagcccccagcccagcccctacaacagccccaagccccagcacaaggtgacccagagcttcctgcccccaggctgggagatgagaattgcccccaacggccggcccttcttcatcgaccacaacaccaagaccaccacctgggaggacccccggctgaagtttcctgtgcacatgaggagcaagaccagcctgaaccccaatgacctgggccccctgcccccaggctgggaggagcgcatccacctggatggccgcaccttctacatcgaccacaacagcaagatcacccagtgggaggacccccggctgcagaacccagccatcactggacctgctgtgccctacagccgggagttcaagcagaagtatgactacttcaggaagaagctgaagaagccagctgacatccccaacagatttgagatgaagctgcacaggaacaacatctttgaggagagctaccgccgcatcatgtctgtgaagaggccagatgtgctgaaggcccggctgtggattgaatttgagagcgagaagggcctggactatggaggagtggcccgggagtggttcttcctgctgagcaaggagatgttcaacccctactacggcctgtttgagtacagcgccacagacaactacaccctgcagatcaaccccaacagcggcctgtgcaatgaagaccacctgagctacttcaccttcatcggccgggtggccggcctggccgtgttccacggcaagctgctggatggcttcttcatccggcccttctacaagatgatgctgggcaagcagatcaccctgaatgacatggagagcgtggacagcgagtactacaacagcctgaagtggatcctggagaatgaccccacagagctggacctgatgttctgcattgatgaggagaactttggccagacctaccaggtggacctgaagcccaatggaagtgagatcatggtgaccaatgaaaacaagcgggagtacatcgacctggtgatccagtggaggtttgtgaacagagtgcagaagcagatgaatgccttcctggagggcttcacagagctgctgcccatcgacctgatcaagatctttgatgaaaatgagctggagctgctgatgtgtggcctgggagatgtggatgtgaatgactggaggcagcacagcatctacaagaatggctactgccccaaccaccctgtgatccagtggttctggaaggctgtgctgctgatggatgctgagaagaggatccggctgctgcagtttgtgacaggcaccagccgggtgcccatgaatggatttgctgagctgtatggcagcaatggcccccagctgttcaccatcgagcagtggggcagccctgagaagctgccccgggcccacacctgcttcaaccggctggacctgcccccctatgagacctttgaggacctgcgggagaagctgctgatggctgtggagaatgcccagggctttgaaggagtggactag

SEQ ID NO: 161453 - DNA, 2928 bp, Artificial Sequence
  Description of Artificial Sequence: Synthetic coding sequence
atggccaccggcctgggggagcctgtgtatggcctgtctgaagatgaaggagagagccgcatcctgcgggtgaaggtggtgtctggcatcgacctggccaagaaggacatctttggagccagtgacccctacgtgaagctgagcctgtatgtggctgatgagaaccgggagctggccctggtgcagaccaagaccatcaagaagaccctgaaccccaagtggaatgaggagttctacttccgggtgaaccccagcaaccaccggctgctgtttgaggtgtttgatgagaaccggctgaccagagatgacttcctgggccaggtggatgtgcccctgagccacctgcccacagaggaccccaccatggagcggccctacaccttcaaggacttcctgctgcggcccaggagccacaagagccgggtgaagggcttcctgcggctgaagatggcctacatgcccaagaatggaggccaggatgaggagaacagcgaccagagagatgacatggagcacggctgggaggtggtggacagcaatgacagcgccagccagcaccaggaggagctgcccccaccacccctgcccccaggctgggaggagaaggtggacaacctgggccgcacctactacgtgaaccacaacaacagaaccacccagtggcaccggcccagcctgatggatgtgtcctctgagagtgacaacaacatccggcagatcaaccaggaggccgcccaccggcgcttccgcagccgccgccacatcagcgaggacctggagcctgagcccagcgagggcggagatgtgcctgagccctgggagaccatcagcgaggaggtgaacattgctggggacagcctgggcctggccctgcccccacctccagccagccctggcagcaggaccagcccccaggagctgtctgaggagctgagccggcggctgcagatcaccccagacagcaatggagagcagttcagcagcctcatccagcgggagcccagcagccggctgcggagctgcagcgtgacagatgctgtggccgagcagggccacctgcccccaccttctgccccagctggccgggcccggagcagcacagtgactggaggagaggagcccaccccatctgtggcctacgtgcacaccaccccaggcctgcccagcggctgggaggagaggaaggatgccaagggccgcacctactacgtgaaccacaacaacagaaccaccacctggacccggcccatcatgcagctggccgaggatggagccagcggcagcgccaccaacagcaacaaccacctgattgagccccagatccggcggcccaggagcctgagcagccccaccgtgaccctgagcgcccccctggagggcgccaaggacagccctgtgagaagagctgtgaaggacaccctgagcaacccccagagcccccagcccagcccctacaacagccccaagccccagcacaaggtgacccagagcttcctgcccccaggctgggagatgagaattgcccccaacggccggcccttcttcatcgaccacaacaccaagaccaccacctgggaggacccccggctgaagtttcctgtgcacatgaggagcaagaccagcctgaaccccaatgacctgggccccctgcccccaggctgggaggagcgcatccacctggatggccgcaccttctacatcgaccacaacagcaagatcacccagtgggaggacccccggctgcagaacccagccatcactggacctgctgtgccctacagccgggagttcaagcagaagtatgactacttcaggaagaagctgaagaagccagctgacatccccaacagatttgagatgaagctgcacaggaacaacatctttgaggagagctaccgccgcatcatgtctgtgaagaggccagatgtgctgaaggcccggctgtggattgaatttgagagcgagaagggcctggactatggaggagtggcccgggagtggttcttcctgctgagcaaggagatgttcaacccctactacggcctgtttgagtacagcgccacagacaactacaccctgcagatcaaccccaacagcggcctgtgcaatgaagaccacctgagctacttcaccttcatcggccgggtggccggcctggccgtgttccacggcaagctgctggatggcttcttcatccggcccttctacaagatgatgctgggcaagcagatcaccctgaatgacatggagagcgtggacagcgagtactacaacagcctgaagtggatcctggagaatgaccccacagagctggacctgatgttctgcattgatgaggagaactttggccagacctaccaggtggacctgaagcccaatggaagtgagatcatggtgaccaatgaaaacaagcgggagtacatcgacctggtgatccagtggaggtttgtgaacagagtgcagaagcagatgaatgccttcctggagggcttcacagagctgctgcccatcgacctgatcaagatctttgatgaaaatgagctggagctgctgatgtgtggcctgggagatgtggatgtgaatgactggaggcagcacagcatctacaagaatggctactgccccaaccaccctgtgatccagtggttctggaaggctgtgctgctgatggatgctgagaagaggatccggctgctgcagtttgtgacaggcaccagccgggtgcccatgaatggatttgctgagctgtatggcagcaatggcccccagctgttcaccatcgagcagtggggcagccctgagaagctgccccgggcccacacctgcttcaaccggctggacctgcccccctatgagacctttgaggacctgcgggagaagctgctgatggctgtggagaatgcccagggctttgaaggagtggactag

SEQ ID NO: 161454 - DNA, 2565 bp, Artificial Sequence
  Description of Artificial Sequence: Synthetic coding sequence
atggagcggccctacaccttcaaggacttcctgctgcggcccaggagccacaagagccgggtgaagggcttcctgcggctgaagatggcctacatgcccaagaatggaggccaggatgaagaaaattctgaccagagagatgacatggagcacggctgggaggtggtggacagcaatgattctgccagccagcaccaggaggagctgcccccaccacccctgcccccaggctgggaggagaaggtggacaacctgggccgcacctactacgtgaaccacaacaacagaaccacccagtggcaccggcccagcctgatggatgtgagcagcgagagtgacaacaacatccggcagatcaaccaggaggccgcccaccggcgcttccgcagcagaagacacatcagcgaggacctggagcctgagcccagcgagggcggagatgtgcctgagccctgggagaccatcagcgaggaggtgaacattgctggggacagcctgggcctggccctgcccccacctccagccagccctggcagcaggaccagcccccaggagctgtctgaggagctgagccggcggctgcagatcaccccagacagcaatggagagcagttcagcagcctcatccagcgggagcccagcagccggctgcggagctgcagcgtgacagatgctgtggccgagcagggccacctgcccccacccagcgccccagctggccgggcccggagcagcacagtgactggaggagaggagcccacccccagcgtggcctacgtgcacaccaccccaggcctgcccagcggctgggaggagaggaaggatgccaagggccgcacctactacgtgaaccacaacaacagaaccaccacctggacccggcccatcatgcagctggctgaagatggagccagcggcagcgccaccaacagcaacaaccacctgattgagccccagatcagaagacccaggagcctgagcagccccaccgtgaccctgagcgcccccctggagggcgccaaggacagccctgtgcggcgggctgtgaaggacaccctgagcaacccccagagcccccagcccagcccctacaacagccccaagccccagcacaaggtgacccagagcttcctgcccccaggctgggagatgagaattgccccaaatggccggcccttcttcatcgaccacaacaccaagaccaccacctgggaggacccccggctgaagtttcctgtgcacatgaggagcaagaccagcctgaaccccaatgacctgggccccctgcccccaggctgggaggagcgcatccacctggatggccgcaccttctacatcgaccacaacagcaagatcacccagtgggaggacccccggctgcagaacccagccatcaccggccctgctgtgccctacagccgggagttcaagcagaagtatgactacttcaggaagaagctgaagaagccagctgacatccccaacagatttgagatgaagctgcacaggaacaacatctttgaggagagctaccgccgcatcatgtctgtgaagaggccagatgtgctgaaggcccggctgtggattgaatttgaaagtgagaagggcctggactatggaggagtggcccgggagtggttcttcctgctgagcaaggagatgttcaacccctactacggcctgtttgagtacagcgccacagacaactacaccctgcagatcaaccccaacagcggcctgtgcaatgaagaccacctgagctacttcaccttcatcggccgggtggccggcctggccgtgttccacggcaagctgctggatggcttcttcatccggcccttctacaagatgatgctgggcaagcagatcaccctgaatgacatggagagcgtggacagcgagtactacaacagcctgaagtggatcctggagaatgaccccacagagctggacctgatgttctgcattgatgaagaaaattttggccagacctaccaggtggacctgaagcccaacggcagcgagatcatggtgaccaatgaaaacaagcgggagtacatcgacctggtgatccagtggaggtttgtgaacagagtgcagaagcagatgaatgccttcctggagggcttcacagagctgctgcccatcgacctgatcaagatctttgatgaaaatgagctggagctgctgatgtgtggcctgggagatgtggatgtgaatgactggaggcagcacagcatctacaagaatggctactgccccaaccaccctgtgatccagtggttctggaaggctgtgctgctgatggatgctgagaagaggatccggctgctgcagtttgtgacaggcaccagccgggtgcccatgaatggatttgctgagctgtatggcagcaatggcccccagctgttcaccatcgagcagtggggcagccctgagaagctgccccgggcccacacctgcttcaaccggctggacctgcccccctatgagacctttgaggacctgcgggagaagctgctgatggctgtggagaatgcccagggctttgagggcgtggactag

SEQ ID NO: 161455 - DNA, 2505 bp, Artificial Sequence
  Description of Artificial Sequence: Synthetic coding sequence
atggagcggccctacaccttcaaggacttcctgctgcggcccaggagccacaagagccgggtgaagggcttcctgcggctgaagatggcctacatgcccaagaatggaggccaggatgaagaaaattctgaccagagagatgacatggagcacggctgggaggtggtggacagcaatgattctgccagccagcaccaggaggagctgcccccaccacccctgcccccaggctgggaggagaaggtggacaacctgggccgcacctactacgtgaaccacaacaacagaaccacccagtggcaccggcccagcctgatggatgtgagcagcgagagtgacaacaacatccggcagatcaaccaggaggccgcccaccggcgcttccgcagcagaagacacatcagcgaggacctggagcctgagcccagcgagggcggagatgtgcctgagccctgggagaccatcagcgaggaggtgaacattgctggggacagcctgggcctggccctgcccccacctccagccagccctggcagcaggaccagcccccaggagctgtctgaggagctgagccggcggctgcagatcaccccagacagcaatggagagcagttcagcagcctcatccagcgggagcccagcagccggctgcggagctgcagcgtgacagatgctgtggccgagcagggccacctgcccccacccagcgtggcctacgtgcacaccaccccaggcctgcccagcggctgggaggagaggaaggatgccaagggccgcacctactacgtgaaccacaacaacagaaccaccacctggacccggcccatcatgcagctggctgaagatggagccagcggcagcgccaccaacagcaacaaccacctgattgagccccagatcagaagacccaggagcctgagcagccccaccgtgaccctgagcgcccccctggagggcgccaaggacagccctgtgcggcgggctgtgaaggacaccctgagcaacccccagagcccccagcccagcccctacaacagccccaagccccagcacaaggtgacccagagcttcctgcccccaggctgggagatgagaattgccccaaatggccggcccttcttcatcgaccacaacaccaagaccaccacctgggaggacccccggctgaagtttcctgtgcacatgaggagcaagaccagcctgaaccccaatgacctgggccccctgcccccaggctgggaggagcgcatccacctggatggccgcaccttctacatcgaccacaacagcaagatcacccagtgggaggacccccggctgcagaacccagccatcaccggccctgctgtgccctacagccgggagttcaagcagaagtatgactacttcaggaagaagctgaagaagccagctgacatccccaacagatttgagatgaagctgcacaggaacaacatctttgaggagagctaccgccgcatcatgtctgtgaagaggccagatgtgctgaaggcccggctgtggattgaatttgaaagtgagaagggcctggactatggaggagtggcccgggagtggttcttcctgctgagcaaggagatgttcaacccctactacggcctgtttgagtacagcgccacagacaactacaccctgcagatcaaccccaacagcggcctgtgcaatgaagaccacctgagctacttcaccttcatcggccgggtggccggcctggccgtgttccacggcaagctgctggatggcttcttcatccggcccttctacaagatgatgctgggcaagcagatcaccctgaatgacatggagagcgtggacagcgagtactacaacagcctgaagtggatcctggagaatgaccccacagagctggacctgatgttctgcattgatgaagaaaattttggccagacctaccaggtggacctgaagcccaacggcagcgagatcatggtgaccaatgaaaacaagcgggagtacatcgacctggtgatccagtggaggtttgtgaacagagtgcagaagcagatgaatgccttcctggagggcttcacagagctgctgcccatcgacctgatcaagatctttgatgaaaatgagctggagctgctgatgtgtggcctgggagatgtggatgtgaatgactggaggcagcacagcatctacaagaatggctactgccccaaccaccctgtgatccagtggttctggaaggctgtgctgctgatggatgctgagaagaggatccggctgctgcagtttgtgacaggcaccagccgggtgcccatgaatggatttgctgagctgtatggcagcaatggcccccagctgttcaccatcgagcagtggggcagccctgagaagctgccccgggcccacacctgcttcaaccggctggacctgcccccctatgagacctttgaggacctgcgggagaagctgctgatggctgtggagaatgcccagggctttgagggcgtggactag

SEQ ID NO: 161456 - DNA, 2505 bp, Artificial Sequence; identical to SEQ ID NO: 161455
  Description of Artificial Sequence: Synthetic coding sequence

SEQ ID NO: 161457 - DNA, 2565 bp, Artificial Sequence; identical to SEQ ID NO: 161454
  Description of Artificial Sequence: Synthetic coding sequence

SEQ ID NO: 161458 - DNA, 525 bp, Artificial Sequence
  Description of Artificial Sequence: Synthetic coding sequence
atgaagtacaagaacctgatggcccgggccctgtatgacaacgtgcctgaatgtgccgaggagctggccttcaggaagggggacatcctgactgtgattgagcagaacacaggaggcctggagggctggtggctgtgcagcctgcacggccggcagggcatcgtgcccggcaacagagtgaagctgctgattggccccatgcaggagacagccagcagccatgagcagcctgccagcggcctgatgcagcagaccttcggccagcagaagctgtaccaggtgcccaacccccaggccgccccccgggacaccatctaccaggtgcccccatcctaccagaaccagggcatctaccaggtgcccaccggccacggcacccaggagcaggaggtgtaccaggtgcccccatctgtgcagaggagcatcggcggcaccagcggcccccacgtgggcaagaaggtgttccagagagatggccaggtgtcctacttcctggtgcgggccagcaagcagaccagcctgtag

SEQ ID NO: 161459 - DNA, 2505 bp, Artificial Sequence
  Description of Artificial Sequence: Synthetic coding sequence
atgaagtacaagaacctgatggcccgggccctgtatgacaacgtgcctgaatgtgccgaggagctggccttcaggaagggggacatcctgactgtgattgagcagaacacaggaggcctggagggctggtggctgtgcagcctgcacggccggcagggcatcgtgcccggcaacagagtgaagctgctgattggccccatgcaggagacagccagcagccatgagcagcctgccagcggcctgatgcagcagaccttcggccagcagaagctgtaccaggtgcccaacccccaggccgccccccgggacaccatctaccaggtgcccccatcctaccagaaccagggcatctaccaggtgcccaccggccacggcacccaggagcaggaggtgtaccaggtgcccccatctgtgcagaggagcatcggcggcaccagcggcccccacgtgggcaagaaggtgatcacccctgtgaggacaggccacggctacgtgtatgagtaccccagccgctaccagaaggatgtgtatgacatcccccccagccacaccacccagggcgtgtatgacatcccccccagcagcgccaagggccctgtgttttctgtgcctgtgggggagatcaagccccagggcgtgtatgacatcccccccaccaagggcgtgtatgccatcccccccagcgcctgcagagatgaggccggcctgcgggagaaggactatgacttccccccacccatgaggcaggccggccgcccagacctgcggcctgagggcgtgtatgacatcccccccacctgcaccaagccagctgggaaggacctgcacgtgaagtacaactgtgacatccctggagctgctgagcctgtggcccggcggcaccagagcctgagccccaaccaccccccaccccagctgggccagagcgtgggcagccagaatgatgcctatgatgtgccccggggcgtgcagttcctggagcccccagctgagaccagcgagaaggccaacccccaggagagagatggagtgtatgatgtgcccctgcacaaccccccagatgccaagggcagccgggacctggtggatggcatcaaccggctgtccttcagcagcacaggcagcaccaggagcaacatgagcaccagcagcaccagcagcaaggagagcagcctgagcgccagccctgcccaggacaagaggctcttcctggaccctgacacagccatcgagcggctgcagaggctgcagcaggccctggagatgggcgtgagcagcctgatggccctggtgaccacagactggcgctgctacggctacatggagcggcacatcaatgagatcagaacagctgtggacaaggtggagctgttcctgaaggagtacctgcactttgtgaagggagctgtggccaatgctgcctgcctgcctgagctgatcctgcacaacaagatgaagcgggagctgcagagggtggaggacagccaccagatcctgagccagaccagccatgacctgaatgaatgttcctggagcctgaacatcctggccatcaacaagccccagaacaagtgtgatgacctggacagatttgtgatggtggccaagacagtgcctgatgatgccaagcagctgaccaccaccatcaacaccaatgctgaggccctcttccggcccggccctggcagcctgcacctgaagaatggacctgagagcatcatgaacagcacagagtacccccatggaggcagccagggccagctgctgcaccctggggaccacaaggcccaggcccacaacaaggccctgcccccaggcctgagcaaggagcaggccccagactgcagcagcagtgatggcagcgagaggtcctggatggatgattatgactatgtgcacctgcagggcaaggaggagtttgagcggcagcagaaggagctgctggagaaggagaacatcatgaagcagaacaagatgcagctggagcaccaccagctgagccagttccagctgctggagcaggagatcaccaagcctgtggagaatgacatcagcaagtggaagcccagccagagcctgcccaccaccaacagcggcgtgtctgcccaggaccggcagctgctgtgcttctactatgaccagtgtgagacccacttcatcagcctgctgaatgccattgatgccctcttcagctgtgtgtcctctgcccagcccccacgcatctttgtggcccacagcaagtttgtgatcctgagcgcccacaagctggtgttcatcggggacaccctgacccggcaggtgacagcccaggacatccggaacaaggtgatgaacagcagcaaccagctgtgtgagcagctgaagaccatcgtgatggccaccaagatggccgccctgcactaccccagcaccacagccctgcaggagatggtgcaccaggtgacagacctgagcagaaatgcccagctgttcaagaggagcctgctggagatggccaccttctag

SEQ ID NO: 161460 - DNA, 99 bp, Artificial Sequence
  Description of Artificial Sequence: Synthetic coding sequence
atgtggaccaggaacctgatggcccgggccctgtatgacaacgtgcctgaatgtgccgaggagctggccttcaggaagggggacatcctgactgtgtag

SEQ ID NO: 161461 - DNA, 2505 bp, Artificial Sequence
  Description of Artificial Sequence: Synthetic coding sequence
atgtggaccaggaacctgatggcccgggccctgtatgacaacgtgcctgaatgtgccgaggagctggccttcaggaagggggacatcctgactgtgattgagcagaacacaggaggcctggagggctggtggctgtgcagcctgcacggccggcagggcatcgtgcccggcaacagagtgaagctgctgattggccccatgcaggagacagccagcagccatgagcagcctgccagcggcctgatgcagcagaccttcggccagcagaagctgtaccaggtgcccaacccccaggccgccccccgggacaccatctaccaggtgcccccatcctaccagaaccagggcatctaccaggtgcccaccggccacggcacccaggagcaggaggtgtaccaggtgcccccatctgtgcagaggagcatcggcggcaccagcggcccccacgtgggcaagaaggtgatcacccctgtgaggacaggccacggctacgtgtatgagtaccccagccgctaccagaaggatgtgtatgacatcccccccagccacaccacccagggcgtgtatgacatcccccccagcagcgccaagggccctgtgttttctgtgcctgtgggggagatcaagccccagggcgtgtatgacatcccccccaccaagggcgtgtatgccatcccccccagcgcctgcagagatgaggccggcctgcgggagaaggactatgacttccccccacccatgaggcaggccggccgcccagacctgcggcctgagggcgtgtatgacatcccccccacctgcaccaagccagctgggaaggacctgcacgtgaagtacaactgtgacatccctggagctgctgagcctgtggcccggcggcaccagagcctgagccccaaccaccccccaccccagctgggccagagcgtgggcagccagaatgatgcctatgatgtgccccggggcgtgcagttcctggagcccccagctgagaccagcgagaaggccaacccccaggagagagatggagtgtatgatgtgcccctgcacaaccccccagatgccaagggcagccgggacctggtggatggcatcaaccggctgtccttcagcagcacaggcagcaccaggagcaacatgagcaccagcagcaccagcagcaaggagagcagcctgagcgccagccctgcccaggacaagaggctcttcctggaccctgacacagccatcgagcggctgcagaggctgcagcaggccctggagatgggcgtgagcagcctgatggccctggtgaccacagactggcgctgctacggctacatggagcggcacatcaatgagatcagaacagctgtggacaaggtggagctgttcctgaaggagtacctgcactttgtgaagggagctgtggccaatgctgcctgcctgcctgagctgatcctgcacaacaagatgaagcgggagctgcagagggtggaggacagccaccagatcctgagccagaccagccatgacctgaatgaatgttcctggagcctgaacatcctggccatcaacaagccccagaacaagtgtgatgacctggacagatttgtgatggtggccaagacagtgcctgatgatgccaagcagctgaccaccaccatcaacaccaatgctgaggccctcttccggcccggccctggcagcctgcacctgaagaatggacctgagagcatcatgaacagcacagagtacccccatggaggcagccagggccagctgctgcaccctggggaccacaaggcccaggcccacaacaaggccctgcccccaggcctgagcaaggagcaggccccagactgcagcagcagtgatggcagcgagaggtcctggatggatgattatgactatgtgcacctgcagggcaaggaggagtttgagcggcagcagaaggagctgctggagaaggagaacatcatgaagcagaacaagatgcagctggagcaccaccagctgagccagttccagctgctggagcaggagatcaccaagcctgtggagaatgacatcagcaagtggaagcccagccagagcctgcccaccaccaacagcggcgtgtctgcccaggaccggcagctgctgtgcttctactatgaccagtgtgagacccacttcatcagcctgctgaatgccattgatgccctcttcagctgtgtgtcctctgcccagcccccacgcatctttgtggcccacagcaagtttgtgatcctgagcgcccacaagctggtgttcatcggggacaccctgacccggcaggtgacagcccaggacatccggaacaaggtgatgaacagcagcaaccagctgtgtgagcagctgaagaccatcgtgatggccaccaagatggccgccctgcactaccccagcaccacagccctgcaggagatggtgcaccaggtgacagacctgagcagaaatgcccagctgttcaagaggagcctgctggagatggccaccttctag

SEQ ID NO: 161462 - DNA, 1212 bp, Artificial Sequence
  Description of Artificial Sequence: Synthetic coding sequence
atgctgcggcctgaggccggcctggtgggcctgcacggccctgcccaggagaacagcgccctgcccggccggcgggacagcgccagcgagctgcgggccctgagcggcctggaggtggaccctggagagggctggggccgggtggtgctgatcagccccaggacagtgcgcttccgggtgctgagccctggggtgcgggaggagggccacgtgcagaacaacggccagaaccaggcccggcctgcccggggcgtgactggagctgggggctggggcagcgctgctgtgtgccggggccgggccctgcggggccgggagcccgccctgcccagcgccagcttcccagatgtggccgcctgccccggcagcctggactgtgccctgaagaggcgggcccgctgccccccaggggcccacgcctgtggcccctgcctgcagcccttccaggaggaccagcagggcctgtgtgtgcccaggatgagaagacctcctgggggcggccggccccagccccggctggaggatgaaattgacttcctggcccaggagctggccaggaaggagagcggccacagcaccccacccctgcccaaggaccggcagaggctgcctgagcccgccaccctgggcttcagcgcccggggccagggcctggagctgggcctgcccagcaccccaggcacccccacccccaccccccacaccagcctgggcagccctgtgtccagtgaccctgtgcacatgagccccctggagccccggggcggccagggagatggcctggccctggtgctgatcctggccttctgtgtggccggggctgctgccctgtctgtggccagcctgtgctggtgccgcctgcagcgggagatccggctgacccagaaggctgactatgccacagccaaggcccctggcagccctgctgccccccgcatcagccctggggaccagaggctggcccagagcgctgagatgtaccactaccagcaccagaggcagcagatgctgtgcctggagcggcacaaggagccccccaaggagctggacacagccagcagtgatgaagaaaatgaagatggagacttcaccgtgtatgaatgtcctggcctggcccccaccggggagatggaggtgaggaaccccctgtttgaccatgctgccctgagcgcccccctgcctgcccccagcagccccccagccctgccctag

SEQ ID NO: 161463 - DNA, 978 bp, Artificial Sequence
  Description of Artificial Sequence: Synthetic coding sequence
atggccacccccctgcccccacccagccccaggcacctgcggctgctgcggctgctgctgagcggcctggtgctgggcgccgccctgcggggagctgctgctggccacccagatgtggccgcctgccccggcagcctggactgtgccctgaagaggcgggcccgctgccccccaggggcccacgcctgtggcccctgcctgcagcccttccaggaggaccagcagggcctgtgtgtgcccaggatgagaagacctcctgggggcggccggccccagccccggctggaggatgaaattgacttcctggcccaggagctggccaggaaggagagcggccacagcaccccacccctgcccaaggaccggcagaggctgcctgagcccgccaccctgggcttcagcgcccggggccagggcctggagctgggcctgcccagcaccccaggcacccccacccccaccccccacaccagcctgggcagccctgtgtccagtgaccctgtgcacatgagccccctggagccccggggcggccagggagatggcctggccctggtgctgatcctggccttctgtgtggccggggctgctgccctgtctgtggccagcctgtgctggtgccgcctgcagcgggagatccggctgacccagaaggctgactatgccacagccaaggcccctggcagccctgctgccccccgcatcagccctggggaccagaggctggcccagagcgctgagatgtaccactaccagcaccagaggcagcagatgctgtgcctggagcggcacaaggagccccccaaggagctggacacagccagcagtgatgaagaaaatgaagatggagacttcaccgtgtatgaatgtcctggcctggcccccaccggggagatggaggtgaggaaccccctgtttgaccatgctgccctgagcgcccccctgcctgcccccagcagccccccagccctgccctag

SEQ ID NO: 161464 - DNA, 297 bp, Artificial Sequence
  Description of Artificial Sequence: Synthetic coding sequence
atgtctgtgcgggagctgaaccggcagctgcggggctgcggcagagatgaggccctgcggctgaagcagaggaggaggaccctgaagaacagaggctacgcccaggcctgccgcagcaagaggctgcagcagaggcggggcctggaggccgagcgggcccggctggccgcccagctggatgccctgcgggcagaggtggcccggctggcccgggagcgggacctgtacaaggcccgctgtgaccggctgaccagcagcggccctggcagcggggaccccagccacctgttcctgtag

SEQ ID NO: 161465 - DNA, 714 bp, Artificial Sequence
  Description of Artificial Sequence: Synthetic coding sequence
atggccctgccccccagccccctggccatggagtatgtgaatgactttgacctgatgaagtttgaggtgaagcgggagcccagcgagggccggcccggccccccaacagccagcctgggcagcaccccctacagctctgtgccccccagccccaccttcagcgagcccggcatggtgggcgccacagagggcaccaggcctggcctggaggagctgtactggctggccaccctgcagcagcagctgggcgctggggaggccctgggcctgagccctgaggaggccatggagctgctgcagggccagggccctgtgcctgtggatggcccccacggctactacccaggcagccctgaggagactggagcccagcacgtgcagctggccgagcgcttcagtgatgctgccctggtgtccatgtctgtgcgggagctgaaccggcagctgcggggctgcggcagagatgaggccctgcggctgaagcagaggaggaggaccctgaagaacagaggctacgcccaggcctgccgcagcaagaggctgcagcagaggcggggcctggaggccgagcgggcccggctggccgcccagctggatgccctgcgggcagaggtggcccggctggcccgggagcgggacctgtacaaggcccgctgtgaccggctgaccagcagcggccctggcagcggggaccccagccacctgttcctgtag

SEQ ID NO: 161466 - DNA, 714 bp, Artificial Sequence; identical to SEQ ID NO: 161465
  Description of Artificial Sequence: Synthetic coding sequence

SEQ ID NO: 161467 - DNA, 198 bp, Artificial Sequence
  Description of Artificial Sequence: Synthetic coding sequence
atggccctgccccccagccccctggccatggagtatgtgaatgactttgacctgatgaagtttgaggtgaagcgggagcccagcgagggccggcccggccccccaacagccagcctgggcagcaccccctacagctctgtgccccccagccccaccttcagcgagcccggcatggtgggcgccacagagggcacctag

SEQ ID NO: 161468 - DNA, 297 bp, Artificial Sequence; identical to SEQ ID NO: 161464
  Description of Artificial Sequence: Synthetic coding sequence

SEQ ID NO: 161469 - DNA, 714 bp, Artificial Sequence; identical to SEQ ID NO: 161465
  Description of Artificial Sequence: Synthetic coding sequence

SEQ ID NO: 161470 - DNA, 1674 bp, Artificial Sequence
  Description of Artificial Sequence: Synthetic coding sequence
atgggcggccagatcaccaggagcaccctgcatgacagcatcggcggccccttccctgtgaccagccaccgctgccaccacaagcagaagcactgcccagctgtgctgcccagcggcggcctgcctgccacccccctgctcttccacccccacaccaagggcagccagatcctgatggacctgagccacaaggctgtgaagaggcaggccagcttctgcaatgccatcaccttcagcaacagacctgtgctgatctatgagcaggtgcggctgaagatcaccaagaagcagtgctgctggagcggggccctgcggctgggcttcaccagcaaggaccccagccgcatccacccagacagcctgcccaagtatgcctgcccagacctggtgtcccagagcggcttctgggccaaggccctgcctgaggagtttgccaatgaaggcaacatcatcgccttctgggtggacaagaagggccgggtcttccaccgcatcaatgacagcgctgtgatgctgttcttctctggagtgaggacagctgaccccctgtgggccctggtggatgtgtatggcctgacccggggcgtgcagctgctggacagcgagctggtgctgcctgactgcctgcggcccaggagcttcaccgccctgcggcggcccagcctgcggcgggaggctgatgatgcccggctgtctgtgtccctgtgtgacctgaatgtgcctggagcagatggagatgaggccgccccagctgctggctgccccatcccccagaacagcctgaacagccagcacagccgggccctgcctgcccagctggatggagacctgcgcttccacgccctgcgggccggggcccacgtgcgcatcctggatgagcagacagtggcccgggtggagcacggcagagatgagcgggccctggtgttcaccagcaggcctgtgcgggtggccgagaccatctttgtgaaggtgaccaggtctgggggcgcccggcctggggccctgagctttggagtgaccacctgtgaccccggcaccctgcggcctgctgacctgcccttcagccctgaggccctggtggacaggaaggagttctgggccgtgtgccgggtgcccggccccctgcacagcggggacatcctgggcctggtggtgaatgctgatggagagctgcacctgagccacaatggagctgctgctggcatgcagctgtgtgtggatgccagccagcccctgtggatgctgtttggcctgcacggcaccatcacccagatccgcatcctgggcagcaccatcctggccgagcggggcatccccagcctgccctgcagccctgccagcacccccaccagccccagcgccctgggcagccggctgagtgaccccctgctgagcacctgcagcagcggccccctgggcagcagcgctgggggcacagcccccaacagccctgtgtccctgcctgagagccctgtgaccccaggcctgggccagtggagcgatgaatgtaccatctgctatgagcacgctgtggacaccgtcatctacacctgtggccacatgtgcctgtgctacgcctgtggcctgcggctgaagaaggccctgcacgcctgctgccccatctgccggcggcccatcaaggacatcatcaagacctaccgcagcagctag

SEQ ID NO: 161471 - DNA, 1725 bp, Artificial Sequence
  Description of Artificial Sequence: Synthetic coding sequence
atgggcaacaacttcagcagcatccccagcctgccccggggcaaccccagccgggccccccggggccacccccagaacctgaaggacagcattggaggccccttccctgtgaccagccaccgctgccaccacaagcagaagcactgcccagctgtgctgcccagcggcggcctgcctgccacccccctgctcttccacccccacaccaagggcagccagatcctgatggacctgagccacaaggctgtgaagaggcaggccagcttctgcaatgccatcaccttcagcaacagacctgtgctgatctatgagcaggtgcggctgaagatcaccaagaagcagtgctgctggagcggggccctgcggctgggcttcaccagcaaggaccccagccgcatccacccagacagcctgcccaagtatgcctgcccagacctggtgtcccagagcggcttctgggccaaggccctgcctgaggagtttgccaatgaaggcaacatcatcgccttctgggtggacaagaagggccgggtcttccaccgcatcaatgattctgctgtgatgctgttcttcagcggcgtgaggacagctgaccccctgtgggccctggtggatgtgtatggcctgacccggggcgtgcagctgctggacagcgagctggtgctgcctgactgcctgcggcccaggagcttcaccgccctgcggcggcccagcctgcggcgggaggctgatgatgcccggctgtctgtgtccctgtgtgacctgaatgtgcctggagcagatggagatgaagctgccccagctgctggctgccccatcccccagaacagcctgaacagccagcacagccgggccctgcctgcccagctggatggagacctgcgcttccacgccctgcgggccggggcccacgtgcgcatcctggatgagcagacagtggcccgggtggagcacggcagagatgagcgggccctggtgttcaccagcaggcctgtgcgggtggccgagaccatctttgtgaaggtgaccaggtctggaggagcccggcctggggccctgagctttggagtgaccacctgtgaccccggcaccctgcggcctgctgacctgcccttcagccctgaggccctggtggacaggaaggagttctgggccgtgtgccgggtgcccggccccctgcacagcggggacatcctgggcctggtggtgaatgctgatggagagctgcacctgagccacaacggggctgctgctggcatgcagctgtgtgtggatgccagccagcccctgtggatgctgtttggcctgcacggcaccatcacccagatccgcatcctgggcagcaccatcctggccgagcggggcatccccagcctgccctgcagccctgccagcacccccaccagccccagcgccctgggcagccggctgagtgaccccctgctgagcacctgcagcagcggccccctgggcagcagcgctgggggcacagcccccaacagccctgtgtccctgcctgagagccctgtgaccccaggcctgggccagtggagcgatgagtgcaccatctgctatgaacatgctgtggacaccgtcatctacacctgtggccacatgtgcctgtgctacgcctgtggcctgcggctgaagaaggccctgcacgcctgctgccccatctgcagaagacccatcaaggacatcatcaagacctaccgcagcagctag

SEQ ID NO: 161472 - DNA, 600 bp, Artificial Sequence
  Description of Artificial Sequence: Synthetic coding sequence
atgggcggccagatcaccaggagcaccctgcatgacagcatcggcggccccttccctgtgaccagccaccgctgccaccacaagcagaagcactgcccagctgtgctgcccagcggcggcctgcctgccacccccctgctcttccacccccacaccaagggcagccagatcctgatggacctgagccacaaggctgtgaagaggcaggccagcttctgcaatgccatcaccttcagcaacagacctgtgctgatctatgagcaggtgcggctgaagatcaccaagaagcagtgctgctggagcggggccctgcggctgggcttcaccagcaaggaccccagccgcatccacccagacagcctgcccaagtatgcctgcccagacctggtgtcccagagcggcttctgggccaaggccctgcctgaggagtttgccaatgaaggcaacatcatcgccttctgggtggacaagaagggccgggtcttccaccgcatcaatgacagcgctgtgatgctgttcttctctggagtgaggacagctgaccccctgtgggccctggtggatgtgtatggcctgacccggggcgtgcagctgctgtag

SEQ ID NO: 161473 - DNA, 327 bp, Artificial Sequence
  Description of Artificial Sequence: Synthetic coding sequence
atggacctgagccacaaggctgtgaagaggcaggccagcttctgcaatgccatcaccttcagcaacagacctgtgctgatctatgagcaggtgcggctgaagatcaccaagaagcagtgctgctggagcggggccctgcggctgggcttcaccagcaaggaccccagccgcatccacccagacagcctgcccaagtatgcctgcccagacctggtgtcccagagcggcttctgggccaaggccctgcctgaggagtttgccaatgaaggcaacatcatcgccttctgggtggacaagaagggccgggtcttccaccgcatcaactag

SEQ ID NO: 161474 - DNA, 2553 bp, Artificial Sequence
  Description of Artificial Sequence: Synthetic coding sequence
atgaggcaggtgtgctgcagcgccctgcccccaccacccctggagaagggccgctgcagcagctacagcgacagcagcagcagcagcagcgagaggagcagcagcagcagcagcagcagcagcgagagcggcagcagcagccgcagcagcagcaacaacagcagcatcagcaggcctgctgcccctcctgagccccggccccagcagcagccccagcccaggagccctgctgccaggagagctgctgcccggagcagagctgctgctgctgggggcatgaggcgggaccctgcccctggcttctccatgctgctgtttggagtgtccctggcctgctacagccccagcctgaagtctgtgcaggaccaggcctacaaggcccctgtggtggtggagggcaaggtgcagggcctggtgcctgctgggggcagcagcagcaacagcacccgggagcccccagccagcggccgggtggccctggtgaaggtgctggacaagtggcccctgcggagcggcggcctgcagcgggagcaggtgatctctgtgggcagctgtgtgcccctggagaggaaccagcgctacatcttcttcctggagcccacagagcagcccctggtgttcaagacagcctttgcccccctggacaccaacgggaagaacctgaagaaggaggtgggcaagatcctgtgcacagactgtgccacccggcccaagctgaagaagatgaagagccagacaggccaggtgggggagaagcagagcctgaagtgtgaggccgctgctggcaacccccagcccagctaccgctggttcaaggatggcaaggagctgaacagaagccgggacatccgcatcaagtatggaaatggaaggaagaacagccggctgcagttcaacaaggtgaaggtggaggatgctggggagtatgtgtgtgaggccgagaacatcctgggcaaggacacagtgcggggccgcctgtatgtgaacagcgtgtccaccaccctgagctcctggagcggccacgccaggaagtgcaatgaaacagccaagagctactgtgtgaatggaggagtgtgctactacatcgagggcatcaaccagctgagctgcaagtgccccaacggcttcttcggccagcgctgcctggagaagctgcccctgcggctgtacatgccagaccccaagcagaaggccgaggagctgtaccagaagagggtgctgaccatcaccggcatctgtgtggccctgctggtggtgggcatcgtgtgtgtggtggcctactgcaagaccaagaagcagaggaagcagatgcacaaccacctgcggcagaacatgtgcccagcccaccagaacagaagcctggccaacggccccagccacccccggctggaccctgaggagatccagatggctgactacatcagcaagaatgtgcctgccacagaccacgtgatccggcgggagacagagaccaccttcagcggcagccacagctgcagccccagccaccactgcagcacagccacccccaccagcagccacagacatgagagccacacctggagcctggagaggtctgagagcctgaccagtgacagccagagcggcatcatgctgagctctgtgggcaccagcaagtgcaacagccctgcctgtgtggaggcccgggcccggcgggctgctgcctacaacctggaggagaggagaagagccacagccccaccctaccatgattctgtggacagcctgcgggacagcccccacagcgagcgctacgtgtctgccctgaccaccccagcccggctgagccctgtggacttccactacagcctggccacccaggtgcccacctttgagatcaccagccccaacagcgcccatgctgtgtccctgcccccagctgcccccatctcctaccgcctggccgagcagcagcccctgctgcggcacccagcccctcctggccctggccctggccctggccctggccctggccctggagctgacatgcagaggagctatgacagctactactacccagctgctggccctggcccccggcggggcacctgtgccctgggcggcagcctgggcagcctgcctgccagccccttccgcatcccagaagatgatgaatatgagaccacccaggagtgtgcccctcctcctccaccccggccccgggcccggggggccagcaggaggaccagcgctggcccccggcgctggaggaggagccggctgaatggcctggccgcccagagggcccgggccgcccgggacagcctgagcctgagcagcggcagcggcggcggcagcgccagcgccagtgatgatgatgctgatgatgctgatggagccctggccgctgagagcacccccttcctgggcctgcggggggcccatgatgccctgcggagtgacagcccccccctgtgcccagctgctgacagcaggacctactacagcctggacagccacagcacccgggccagcagccgccacagccggggccccccaccccgggccaagcaggacagcgcccccctgtag

SEQ ID NO: 161475 - DNA, 1281 bp, Artificial Sequence
  Description of Artificial Sequence: Synthetic coding sequence
atgaggcaggtgtgctgcagcgccctgcccccaccacccctggagaagggccgctgcagcagctacagcgacagcagcagcagcagcagcgagaggagcagcagcagcagcagcagcagcagcgagagcggcagcagcagccgcagcagcagcaacaacagcagcatcagcaggcctgctgcccctcctgagccccggccccagcagcagccccagcccaggagccctgctgccaggagagctgctgcccggagcagagctgctgctgctgggggcatgaggcgggaccctgcccctggcttctccatgctgctgtttggagtgtccctggcctgctacagccccagcctgaagtctgtgcaggaccaggcctacaaggcccctgtggtggtggagggcaaggtgcagggcctggtgcctgctgggggcagcagcagcaacagcacccgggagcccccagccagcggccgggtggccctggtgaaggtgctggacaagtggcccctgcggagcggcggcctgcagcgggagcaggtgatctctgtgggcagctgtgtgcccctggagaggaaccagcgctacatcttcttcctggagcccacagagcagcccctggtgttcaagacagcctttgcccccctggacaccaacgggaagaacctgaagaaggaggtgggcaagatcctgtgcacagactgtgccacccggcccaagctgaagaagatgaagagccagacaggccaggtgggggagaagcagagcctgaagtgtgaggccgctgctggcaacccccagcccagctaccgctggttcaaggatggcaaggagctgaacagaagccgggacatccgcatcaagtatggaaatggaaggaagaacagccggctgcagttcaacaaggtgaaggtggaggatgctggggagtatgtgtgtgaggccgagaacatcctgggcaaggacacagtgcggggccgcctgtatgtgaacagcgtgtccaccaccctgagctcctggagcggccacgccaggaagtgcaatgaaacagccaagagctactgtgtgaatggaggagtgtgctactacatcgagggcatcaaccagctgagctgcaagtgccccaacggcttcttcggccagcgctgcctggagaagctgcccctgcggctgtacatgccagaccccaagcagagcgtgctgtgggacaccccaggcactggagtgagcagcagccagtggagcaccagccccaagcccaggagctgcacccggcggggcagctag

SEQ ID NO: 161476 - DNA, 2577 bp, Artificial Sequence
  Description of Artificial Sequence: Synthetic coding sequence
atgaggcaggtgtgctgcagcgccctgcccccaccacccctggagaagggccgctgcagcagctacagcgacagcagcagcagcagcagcgagaggagcagcagcagcagcagcagcagcagcgagagcggcagcagcagccgcagcagcagcaacaacagcagcatcagcaggcctgctgcccctcctgagccccggccccagcagcagccccagcccaggagccctgctgccaggagagctgctgcccggagcagagctgctgctgctgggggcatgaggcgggaccctgcccctggcttctccatgctgctgtttggagtgtccctggcctgctacagccccagcctgaagtctgtgcaggaccaggcctacaaggcccctgtggtggtggagggcaaggtgcagggcctggtgcctgctgggggcagcagcagcaacagcacccgggagcccccagccagcggccgggtggccctggtgaaggtgctggacaagtggcccctgcggagcggcggcctgcagcgggagcaggtgatctctgtgggcagctgtgtgcccctggagaggaaccagcgctacatcttcttcctggagcccacagagcagcccctggtgttcaagacagcctttgcccccctggacaccaacgggaagaacctgaagaaggaggtgggcaagatcctgtgcacagactgtgccacccggcccaagctgaagaagatgaagagccagacaggccaggtgggggagaagcagagcctgaagtgtgaggccgctgctggcaacccccagcccagctaccgctggttcaaggatggcaaggagctgaacagaagccgggacatccgcatcaagtatggaaatggaaggaagaacagccggctgcagttcaacaaggtgaaggtggaggatgctggggagtatgtgtgtgaggccgagaacatcctgggcaaggacacagtgcggggccgcctgtatgtgaacagcgtgtccaccaccctgagctcctggagcggccacgccaggaagtgcaatgaaacagccaagagctactgtgtgaatggaggagtgtgctactacatcgagggcatcaaccagctgagctgcaagtgccccaacggcttcttcggccagcgctgcctggagaagctgcccctgcggctgtacatgccagaccccaagcagagcttcctgagctttgagctgagcaaggccgaggagctgtaccagaagagggtgctgaccatcaccggcatctgtgtggccctgctggtggtgggcatcgtgtgtgtggtggcctactgcaagaccaagaagcagaggaagcagatgcacaaccacctgcggcagaacatgtgcccagcccaccagaacagaagcctggccaacggccccagccacccccggctggaccctgaggagatccagatggctgactacatcagcaagaatgtgcctgccacagaccacgtgatccggcgggagacagagaccaccttcagcggcagccacagctgcagccccagccaccactgcagcacagccacccccaccagcagccacagacatgagagccacacctggagcctggagaggtctgagagcctgaccagtgacagccagagcggcatcatgctgagctctgtgggcaccagcaagtgcaacagccctgcctgtgtggaggcccgggcccggcgggctgctgcctacaacctggaggagaggagaagagccacagccccaccctaccatgattctgtggacagcctgcgggacagcccccacagcgagcgctacgtgtctgccctgaccaccccagcccggctgagccctgtggacttccactacagcctggccacccaggtgcccacctttgagatcaccagccccaacagcgcccatgctgtgtccctgcccccagctgcccccatctcctaccgcctggccgagcagcagcccctgctgcggcacccagcccctcctggccctggccctggccctggccctggccctggccctggagctgacatgcagaggagctatgacagctactactacccagctgctggccctggcccccggcggggcacctgtgccctgggcggcagcctgggcagcctgcctgccagccccttccgcatcccagaagatgatgaatatgagaccacccaggagtgtgcccctcctcctccaccccggccccgggcccggggggccagcaggaggaccagcgctggcccccggcgctggaggaggagccggctgaatggcctggccgcccagagggcccgggccgcccgggacagcctgagcctgagcagcggcagcggcggcggcagcgccagcgccagtgatgatgatgctgatgatgctgatggagccctggccgctgagagcacccccttcctgggcctgcggggggcccatgatgccctgcggagtgacagcccccccctgtgcccagctgctgacagcaggacctactacagcctggacagccacagcacccgggccagcagccgccacagccggggccccccaccccgggccaagcaggacagcgcccccctgtag

SEQ ID NO: 161477 - DNA, 2355 bp, Artificial Sequence
  Description of Artificial Sequence: Synthetic coding sequence
atgaggcaggtgtgctgcagcgccctgcccccaccacccctggagaagggccgctgcagcagctacagcgacagcagcagcagcagcagcgagaggagcagcagcagcagcagcagcagcagcgagagcggcagcagcagccgcagcagcagcaacaacagcagcatcagcaggcctgctgcccctcctgagccccggccccagcagcagccccagcccaggagccctgctgccaggagagctgctgcccggagcagagctgctgctgctgggggcatgaggcgggaccctgcccctggcttctccatgctgctgtttggagtgtccctggcctgctacagccccagcctgaagtctgtgcaggaccaggcctacaaggcccctgtggtggtggagggcaaggtgcagggcctggtgcctgctgggggcagcagcagcaacagcacccgggagcccccagccagcggccgggtggccctggtgaaggtgctggacaagtggcccctgcggagcggcggcctgcagcgggagcaggtgatctctgtgggcagctgtgtgcccctggagaggaaccagcgctacatcttcttcctggagcccacagagcagcccctggtgttcaagacagcctttgcccccctggacaccaacgggaagaacctgaagaaggaggtgggcaagatcctgtgcacagactgtgccacccggcccaagctgaagaagatgaagagccagacaggccaggtgggggagaagcagagcctgaagtgtgaggccgctgctggcaacccccagcccagctaccgctggttcaaggatggcaaggagctgaacagaagccgggacatccgcatcaagtatggaaatggaaggaagaacagccggctgcagttcaacaaggtgaaggtggaggatgctggggagtatgtgtgtgaggccgagaacatcctgggcaaggacacagtgcggggccgcctgtatgtgaacagcgaggccgaggagctgtaccagaagagggtgctgaccatcaccggcatctgtgtggccctgctggtggtgggcatcgtgtgtgtggtggcctactgcaagaccaagaagcagaggaagcagatgcacaaccacctgcggcagaacatgtgcccagcccaccagaacagaagcctggccaacggccccagccacccccggctggaccctgaggagatccagatggctgactacatcagcaagaatgtgcctgccacagaccacgtgatccggcgggagacagagaccaccttcagcggcagccacagctgcagccccagccaccactgcagcacagccacccccaccagcagccacagacatgagagccacacctggagcctggagaggtctgagagcctgaccagtgacagccagagcggcatcatgctgagctctgtgggcaccagcaagtgcaacagccctgcctgtgtggaggcccgggcccggcgggctgctgcctacaacctggaggagaggagaagagccacagccccaccctaccatgattctgtggacagcctgcgggacagcccccacagcgagcgctacgtgtctgccctgaccaccccagcccggctgagccctgtggacttccactacagcctggccacccaggtgcccacctttgagatcaccagccccaacagcgcccatgctgtgtccctgcccccagctgcccccatctcctaccgcctggccgagcagcagcccctgctgcggcacccagcccctcctggccctggccctggccctggccctggccctggccctggagctgacatgcagaggagctatgacagctactactacccagctgctggccctggcccccggcggggcacctgtgccctgggcggcagcctgggcagcctgcctgccagccccttccgcatcccagaagatgatgaatatgagaccacccaggagtgtgcccctcctcctccaccccggccccgggcccggggggccagcaggaggaccagcgctggcccccggcgctggaggaggagccggctgaatggcctggccgcccagagggcccgggccgcccgggacagcctgagcctgagcagcggcagcggcggcggcagcgccagcgccagtgatgatgatgctgatgatgctgatggagccctggccgctgagagcacccccttcctgggcctgcggggggcccatgatgccctgcggagtgacagcccccccctgtgcccagctgctgacagcaggacctactacagcctggacagccacagcacccgggccagcagccgccacagccggggccccccaccccgggccaagcaggacagcgcccccctgtag

SEQ ID NO: 161478 - DNA, 993 bp, Artificial Sequence
  Description of Artificial Sequence: Synthetic coding sequence
atgaggcgggaccctgcccctggcttctccatgctgctgtttggagtgtccctggcctgctacagccccagcctgaagtctgtgcaggaccaggcctacaaggcccctgtggtggtggagggcaaggtgcagggcctggtgcctgctgggggcagcagcagcaacagcacccgggagcccccagccagcggccgggtggccctggtgaaggtgctggacaagtggcccctgcggagcggcggcctgcagcgggagcaggtgatctctgtgggcagctgtgtgcccctggagaggaaccagcgctacatcttcttcctggagcccacagagcagcccctggtgttcaagacagcctttgcccccctggacaccaacgggaagaacctgaagaaggaggtgggcaagatcctgtgcacagactgtgccacccggcccaagctgaagaagatgaagagccagacaggccaggtgggggagaagcagagcctgaagtgtgaggccgctgctggcaacccccagcccagctaccgctggttcaaggatggcaaggagctgaacagaagccgggacatccgcatcaagtatggaaatggaaggaagaacagccggctgcagttcaacaaggtgaaggtggaggatgctggggagtatgtgtgtgaggccgagaacatcctgggcaaggacacagtgcggggccgcctgtatgtgaacagcgtgtccaccaccctgagctcctggagcggccacgccaggaagtgcaatgaaacagccaagagctactgtgtgaatggaggagtgtgctactacatcgagggcatcaaccagctgagctgcaagtgccccaacggcttcttcggccagcgctgcctggagaagctgcccctgcggctgtacatgccagaccccaagcagagcgtgctgtgggacaccccaggcactggagtgagcagcagccagtggagcaccagccccagcaccctggacctgaactag

SEQ ID NO: 161479 - DNA, 2559 bp, Artificial Sequence
  Description of Artificial Sequence: Synthetic coding sequence
atgaggcaggtgtgctgcagcgccctgcccccaccacccctggagaagggccgctgcagcagctacagcgacagcagcagcagcagcagcgagaggagcagcagcagcagcagcagcagcagcgagagcggcagcagcagccgcagcagcagcaacaacagcagcatcagcaggcctgctgcccctcctgagccccggccccagcagcagccccagcccaggagccctgctgccaggagagctgctgcccggagcagagctgctgctgctgggggcatgaggcgggaccctgcccctggcttctccatgctgctgtttggagtgtccctggcctgctacagccccagcctgaagtctgtgcaggaccaggcctacaaggcccctgtggtggtggagggcaaggtgcagggcctggtgcctgctgggggcagcagcagcaacagcacccgggagcccccagccagcggccgggtggccctggtgaaggtgctggacaagtggcccctgcggagcggcggcctgcagcgggagcaggtgatctctgtgggcagctgtgtgcccctggagaggaaccagcgctacatcttcttcctggagcccacagagcagcccctggtgttcaagacagcctttgcccccctggacaccaacgggaagaacctgaagaaggaggtgggcaagatcctgtgcacagactgtgccacccggcccaagctgaagaagatgaagagccagacaggccaggtgggggagaagcagagcctgaagtgtgaggccgctgctggcaacccccagcccagctaccgctggttcaaggatggcaaggagctgaacagaagccgggacatccgcatcaagtatggaaatggaaggaagaacagccggctgcagttcaacaaggtgaaggtggaggatgctggggagtatgtgtgtgaggccgagaacatcctgggcaaggacacagtgcggggccgcctgtatgtgaacagcgtgtccaccaccctgagctcctggagcggccacgccaggaagtgcaatgaaacagccaagagctactgtgtgaatggaggagtgtgctactacatcgagggcatcaaccagctgagctgcaagtgccctgtgggctacacaggagaccgctgccagcagtttgccatggtgaacttcagcacccggctgggcggagatgtggaggaggccgaggagctgtaccagaagagggtgctgaccatcaccggcatctgtgtggccctgctggtggtgggcatcgtgtgtgtggtggcctactgcaagaccaagaagcagaggaagcagatgcacaaccacctgcggcagaacatgtgcccagcccaccagaacagaagcctggccaacggccccagccacccccggctggaccctgaggagatccagatggctgactacatcagcaagaatgtgcctgccacagaccacgtgatccggcgggagacagagaccaccttcagcggcagccacagctgcagccccagccaccactgcagcacagccacccccaccagcagccacagacatgagagccacacctggagcctggagaggtctgagagcctgaccagtgacagccagagcggcatcatgctgagctctgtgggcaccagcaagtgcaacagccctgcctgtgtggaggcccgggcccggcgggctgctgcctacaacctggaggagaggagaagagccacagccccaccctaccatgattctgtggacagcctgcgggacagcccccacagcgagcgctacgtgtctgccctgaccaccccagcccggctgagccctgtggacttccactacagcctggccacccaggtgcccacctttgagatcaccagccccaacagcgcccatgctgtgtccctgcccccagctgcccccatctcctaccgcctggccgagcagcagcccctgctgcggcacccagcccctcctggccctggccctggccctggccctggccctggccctggagctgacatgcagaggagctatgacagctactactacccagctgctggccctggcccccggcggggcacctgtgccctgggcggcagcctgggcagcctgcctgccagccccttccgcatcccagaagatgatgaatatgagaccacccaggagtgtgcccctcctcctccaccccggccccgggcccggggggccagcaggaggaccagcgctggcccccggcgctggaggaggagccggctgaatggcctggccgcccagagggcccgggccgcccgggacagcctgagcctgagcagcggcagcggcggcggcagcgccagcgccagtgatgatgatgctgatgatgctgatggagccctggccgctgagagcacccccttcctgggcctgcggggggcccatgatgccctgcggagtgacagcccccccctgtgcccagctgctgacagcaggacctactacagcctggacagccacagcacccgggccagcagccgccacagccggggccccccaccccgggccaagcaggacagcgcccccctgtag

SEQ ID NO: 161480 - DNA, 2535 bp, Artificial Sequence
  Description of Artificial Sequence: Synthetic coding sequence
atgaggcaggtgtgctgcagcgccctgcccccaccacccctggagaagggccgctgcagcagctacagcgacagcagcagcagcagcagcgagaggagcagcagcagcagcagcagcagcagcgagagcggcagcagcagccgcagcagcagcaacaacagcagcatcagcaggcctgctgcccctcctgagccccggccccagcagcagccccagcccaggagccctgctgccaggagagctgctgcccggagcagagctgctgctgctgggggcatgaggcgggaccctgcccctggcttctccatgctgctgtttggagtgtccctggcctgctacagccccagcctgaagtctgtgcaggaccaggcctacaaggcccctgtggtggtggagggcaaggtgcagggcctggtgcctgctgggggcagcagcagcaacagcacccgggagcccccagccagcggccgggtggccctggtgaaggtgctggacaagtggcccctgcggagcggcggcctgcagcgggagcaggtgatctctgtgggcagctgtgtgcccctggagaggaaccagcgctacatcttcttcctggagcccacagagcagcccctggtgttcaagacagcctttgcccccctggacaccaacgggaagaacctgaagaaggaggtgggcaagatcctgtgcacagactgtgccacccggcccaagctgaagaagatgaagagccagacaggccaggtgggggagaagcagagcctgaagtgtgaggccgctgctggcaacccccagcccagctaccgctggttcaaggatggcaaggagctgaacagaagccgggacatccgcatcaagtatggaaatggaaggaagaacagccggctgcagttcaacaaggtgaaggtggaggatgctggggagtatgtgtgtgaggccgagaacatcctgggcaaggacacagtgcggggccgcctgtatgtgaacagcgtgtccaccaccctgagctcctggagcggccacgccaggaagtgcaatgaaacagccaagagctactgtgtgaatggaggagtgtgctactacatcgagggcatcaaccagctgagctgcaagtgccctgtgggctacacaggagaccgctgccagcagtttgccatggtgaacttcagcaaggccgaggagctgtaccagaagagggtgctgaccatcaccggcatctgtgtggccctgctggtggtgggcatcgtgtgtgtggtggcctactgcaagaccaagaagcagaggaagcagatgcacaaccacctgcggcagaacatgtgcccagcccaccagaacagaagcctggccaacggccccagccacccccggctggaccctgaggagatccagatggctgactacatcagcaagaatgtgcctgccacagaccacgtgatccggcgggagacagagaccaccttcagcggcagccacagctgcagccccagccaccactgcagcacagccacccccaccagcagccacagacatgagagccacacctggagcctggagaggtctgagagcctgaccagtgacagccagagcggcatcatgctgagctctgtgggcaccagcaagtgcaacagccctgcctgtgtggaggcccgggcccggcgggctgctgcctacaacctggaggagaggagaagagccacagccccaccctaccatgattctgtggacagcctgcgggacagcccccacagcgagcgctacgtgtctgccctgaccaccccagcccggctgagccctgtggacttccactacagcctggccacccaggtgcccacctttgagatcaccagccccaacagcgcccatgctgtgtccctgcccccagctgcccccatctcctaccgcctggccgagcagcagcccctgctgcggcacccagcccctcctggccctggccctggccctggccctggccctggccctggagctgacatgcagaggagctatgacagctactactacccagctgctggccctggcccccggcggggcacctgtgccctgggcggcagcctgggcagcctgcctgccagccccttccgcatcccagaagatgatgaatatgagaccacccaggagtgtgcccctcctcctccaccccggccccgggcccggggggccagcaggaggaccagcgctggcccccggcgctggaggaggagccggctgaatggcctggccgcccagagggcccgggccgcccgggacagcctgagcctgagcagcggcagcggcggcggcagcgccagcgccagtgatgatgatgctgatgatgctgatggagccctggccgctgagagcacccccttcctgggcctgcggggggcccatgatgccctgcggagtgacagcccccccctgtgcccagctgctgacagcaggacctactacagcctggacagccacagcacccgggccagcagccgccacagccggggccccccaccccgggccaagcaggacagcgcccccctgtag

SEQ ID NO: 161481 - DNA, 2577 bp, Artificial Sequence
  Description of Artificial Sequence: Synthetic coding sequence
atgaggcaggtgtgctgcagcgccctgcccccaccacccctggagaagggccgctgcagcagctacagcgacagcagcagcagcagcagcgagaggagcagcagcagcagcagcagcagcagcgagagcggcagcagcagccgcagcagcagcaacaacagcagcatcagcaggcctgctgcccctcctgagccccggccccagcagcagccccagcccaggagccctgctgccaggagagctgctgcccggagcagagctgctgctgctgggggcatgaggcgggaccctgcccctggcttctccatgctgctgtttggagtgtccctggcctgctacagccccagcctgaagtctgtgcaggaccaggcctacaaggcccctgtggtggtggagggcaaggtgcagggcctggtgcctgctgggggcagcagcagcaacagcacccgggagcccccagccagcggccgggtggccctggtgaaggtgctggacaagtggcccctgcggagcggcggcctgcagcgggagcaggtgatctctgtgggcagctgtgtgcccctggagaggaaccagcgctacatcttcttcctggagcccacagagcagcccctggtgttcaagacagcctttgcccccctggacaccaacgggaagaacctgaagaaggaggtgggcaagatcctgtgcacagactgtgccacccggcccaagctgaagaagatgaagagccagacaggccaggtgggggagaagcagagcctgaagtgtgaggccgctgctggcaacccccagcccagctaccgctggttcaaggatggcaaggagctgaacagaagccgggacatccgcatcaagtatggaaatggaaggaagaacagccggctgcagttcaacaaggtgaaggtggaggatgctggggagtatgtgtgtgaggccgagaacatcctgggcaaggacacagtgcggggccgcctgtatgtgaacagcgtgtccaccaccctgagctcctggagcggccacgccaggaagtgcaatgaaacagccaagagctactgtgtgaatggaggagtgtgctactacatcgagggcatcaaccagctgagctgcaagtgccccaacggcttcttcggccagcgctgcctggagaagctgcccctgcggctgtacatgccagaccccaagcagaagcacctgggctttgagctgaaggaggccgaggagctgtaccagaagagggtgctgaccatcaccggcatctgtgtggccctgctggtggtgggcatcgtgtgtgtggtggcctactgcaagaccaagaagcagaggaagcagatgcacaaccacctgcggcagaacatgtgcccagcccaccagaacagaagcctggccaacggccccagccacccccggctggaccctgaggagatccagatggctgactacatcagcaagaatgtgcctgccacagaccacgtgatccggcgggagacagagaccaccttcagcggcagccacagctgcagccccagccaccactgcagcacagccacccccaccagcagccacagacatgagagccacacctggagcctggagaggtctgagagcctgaccagtgacagccagagcggcatcatgctgagctctgtgggcaccagcaagtgcaacagccctgcctgtgtggaggcccgggcccggcgggctgctgcctacaacctggaggagaggagaagagccacagccccaccctaccatgattctgtggacagcctgcgggacagcccccacagcgagcgctacgtgtctgccctgaccaccccagcccggctgagccctgtggacttccactacagcctggccacccaggtgcccacctttgagatcaccagccccaacagcgcccatgctgtgtccctgcccccagctgcccccatctcctaccgcctggccgagcagcagcccctgctgcggcacccagcccctcctggccctggccctggccctggccctggccctggccctggagctgacatgcagaggagctatgacagctactactacccagctgctggccctggcccccggcggggcacctgtgccctgggcggcagcctgggcagcctgcctgccagccccttccgcatcccagaagatgatgaatatgagaccacccaggagtgtgcccctcctcctccaccccggccccgggcccggggggccagcaggaggaccagcgctggcccccggcgctggaggaggagccggctgaatggcctggccgcccagagggcccgggccgcccgggacagcctgagcctgagcagcggcagcggcggcggcagcgccagcgccagtgatgatgatgctgatgatgctgatggagccctggccgctgagagcacccccttcctgggcctgcggggggcccatgatgccctgcggagtgacagcccccccctgtgcccagctgctgacagcaggacctactacagcctggacagccacagcacccgggccagcagccgccacagccggggccccccaccccgggccaagcaggacagcgcccccctgtag

SEQ ID NO: 161482 - DNA, 2091 bp, Artificial Sequence
  Description of Artificial Sequence: Synthetic coding sequence
atgtctgagggcgctgctgctgccagccccccaggagctgccagcgctgctgctgccagcgctgaggagggcacagctgctgctgctgctgctgctgctgctgggggcggcccagatggcggcggggagggcgctgctgagcccccccgggagctgcgctgcagcgactgcatcgtgtggaaccggcagcagacctggctgtgtgtggtgcccctcttcatcggcttcatcggcctgggcctgagcctgatgctgctgaagtggatcgtggtgggctctgtgaaggagtatgtgcccacagacctggtggacagcaagggcatgggccaggaccccttcttcctgagcaagcccagcagcttccccaaggccatggagaccaccaccaccaccaccagcaccaccagccctgccaccccatctgctgggggcgccgccagcagcaggacccccaaccgcatcagcacccggctgaccaccatcacccgggcccccacccgcttccctggccaccgggtgcccatccgggccagccccaggagcaccacagccaggaacacagctgccccagccaccgtgcccagcaccacagcccccttcttcagcagcagcaccctgggcagccggccccctgtgcccggcacccccagcacccaggccatgcccagctggcccacagctgcctatgccaccagcagctacctgcatgacagcacccccagctggaccctgagccccttccaggatgctgccagcagcagcagcagcagcagcagcagcgccaccaccaccaccccagagaccagcaccagccccaagttccacaccaccacctacagcacagagaggtctgagcacttcaagccctgccgggacaaggacctggcctactgcctgaatgatggagaatgttttgtgattgagaccctgaccggcagccacaagcactgccgctgcaaggagggctaccagggcgtgcgctgtgaccagttcctgcccaagacagacagcatcctgagtgaccccacagaccacctgggcatcgagttcatggagagcgaggaggtgtaccagaggcaggtgctgagcatcagctgcatcatctttggaattgtgattgtgggcatgttctgtgccgccttctacttcaagagcaagaagcaggccaagcagatccaggagcagctgaaggtgccccagaatggcaagagctacagcctgaaggccagcagcaccatggccaagtctgagaacctggtgaagagccacgtgcagctgcagaactacagcaaggtggagcggcaccctgtgacagccctggagaagatgatggagagcagctttgtgggcccccagagcttccctgaggtgcccagcccagaccggggcagccagagcgtgaagcaccacaggagcctgagcagctgctgcagccctggccagaggagcggcatgctgcacagaaatgccttccggaggaccccacccagccccaggagccggctgggcggcatcgtgggccctgcctaccagcagctggaggagagccgcatcccagaccaggacaccatcccctgccagggctacagcagcagcggcctgaagacccagaggaacaccagcatcaacatgcagctgcccagccgggagaccaacccctacttcaacagcctggagcagaaggacctggtgggctacagcagcacccgggccagctctgtgcccatcatccccagcgtgggcctggaggagacctgcctgcagatgcctggcatcagcgaggtgaagagcatcaagtggtgcaagaacagctacagcgcagatgtggtgaatgtgtccatccctgtgtctgactgcctgattgctgagcagcaggaggtgaagatcctgctggagaccgtgcaggagcagatccgcatcctgacagatgccaggagaagtgaggactatgagctggcctctgtggagacagaggacagcgcctctgaaaatacagccttcctgcccctgagccccacagccaagtctgagcgggaggcccagtttgtgctgagaaatgagatccagagggacagcgccctgaccaagtag

SEQ ID NO: 161483 - DNA, 1500 bp, Artificial Sequence
  Description of Artificial Sequence: Synthetic coding sequence
atggagtgtggcatcccccccaccctggtgtgtgtgggccggggcggcggcctgcacaccatcaacatcatcatctggtactacttccccagcgcctggaggacctgcttcaacatcagcagctctgtgggcctgctgctgaccaacagctacaagttctacaccaccacctacagcacagagaggtctgagcacttcaagccctgccgggacaaggacctggcctactgcctgaatgatggagagtgcttcgtcatcgagaccctgaccggcagccacaagcactgccgctgcaaggagggctaccagggcgtgcgctgtgaccagttcctgcccaagacagacagcatcctgagtgaccccacagaccacctgggcatcgagttcatggagagcgaggaggtgtaccagaggcaggtgctgagcatcagctgcatcatcttcggcatcgtcatcgtgggcatgttctgtgccgccttctacttcaagagcaagaagcaggccaagcagatccaggagcagctgaaggtgccccagaatggcaagagctacagcctgaaggccagcagcaccatggccaagtctgagaacctggtgaagagccacgtgcagctgcagaactacagcaaggtggagcggcaccctgtgacagccctggagaagatgatggagagcagctttgtgggcccccagagcttccctgaggtgcccagcccagaccggggcagccagagcgtgaagcaccacaggagcctgagcagctgctgcagccctggccagaggagcggcatgctgcacagaaatgccttccggaggaccccacccagccccaggagccggctgggcggcatcgtgggccctgcctaccagcagctggaggagagccgcatcccagaccaggacaccatcccctgccagggcatcgaggtgaggaagaccatcagccacctgcccatccagctgtggtgtgtggagcggcccctggacctgaagtacagcagcagcggcctgaagacccagaggaacaccagcatcaacatgcagctgcccagccgggagaccaacccctacttcaacagcctggagcagaaggacctggtgggctacagcagcacccgggccagctctgtgcccatcatccccagcgtgggcctggaggagacctgcctgcagatgcctggcatcagcgaggtgaagagcatcaagtggtgcaagaacagctacagcgcagatgtggtgaatgtgtccatccctgtgtctgactgcctgattgctgagcagcaggaggtgaagatcctgctggagaccgtgcaggagcagatccgcatcctgacagatgcccggcggagtgaagattatgagctggcctctgtggagacagaagattctgccagcgagaacacagccttcctgcccctgagccccacagccaagtctgagcgggaggcccagtttgtgctgagaaatgagatccagagggacagcgccctgaccaagtag

SEQ ID NO: 161484 - DNA, 2163 bp, Artificial Sequence
  Description of Artificial Sequence: Synthetic coding sequence
atgtctgagggcgctgctgctgccagccccccaggagctgccagcgctgctgctgccagcgctgaggagggcacagctgctgctgctgctgctgctgctgctgggggcggcccagatggcggcggggagggcgctgctgagcccccccgggagctgcgctgcagcgactgcatcgtgtggaaccggcagcagacctggctgtgtgtggtgcccctcttcatcggcttcatcggcctgggcctgagcctgatgctgctgaagtggatcgtggtgggctctgtgaaggagtatgtgcccacagacctggtggacagcaagggcatgggccaggaccccttcttcctgagcaagcccagcagcttccccaaggccatggagaccaccaccaccaccaccagcaccaccagccctgccaccccatctgctgggggcgccgccagcagcaggacccccaaccgcatcagcacccggctgaccaccatcacccgggcccccacccgcttccctggccaccgggtgcccatccgggccagccccaggagcaccacagccaggaacacagctgccccagccaccgtgcccagcaccacagcccccttcttcagcagcagcaccctgggcagccggccccctgtgcccggcacccccagcacccaggccatgcccagctggcccacagctgcctatgccaccagcagctacctgcatgacagcacccccagctggaccctgagccccttccaggatgctgccagcagcagcagcagcagcagcagcagcgccaccaccaccaccccagagaccagcaccagccccaagttccacaccaccacctacagcacagagaggtctgagcacttcaagccctgccgggacaaggacctggcctactgcctgaatgatggagaatgttttgtgattgagaccctgaccggcagccacaagcactgccgctgcaaggagggctaccagggcgtgcgctgtgaccagttcctgcccaagacagacagcatcctgagtgaccccacagaccacctgggcatcgagttcatggagagcgaggaggtgtaccagaggcaggtgctgagcatcagctgcatcatctttggaattgtgattgtgggcatgttctgtgccgccttctacttcaagagcaagaagcaggccaagcagatccaggagcagctgaaggtgccccagaatggcaagagctacagcctgaaggccagcagcaccatggccaagtctgagaacctggtgaagagccacgtgcagctgcagaactacagcaaggtggagcggcaccctgtgacagccctggagaagatgatggagagcagctttgtgggcccccagagcttccctgaggtgcccagcccagaccggggcagccagagcgtgaagcaccacaggagcctgagcagctgctgcagccctggccagaggagcggcatgctgcacagaaatgccttccggaggaccccacccagccccaggagccggctgggcggcatcgtgggccctgcctaccagcagctggaggagagccgcatcccagaccaggacaccatcccctgccagggcatcgaggtgaggaagaccatcagccacctgcccatccagctgtggtgtgtggagcggcccctggacctgaagtacagcagcagcggcctgaagacccagaggaacaccagcatcaacatgcagctgcccagccgggagaccaacccctacttcaacagcctggagcagaaggacctggtgggctacagcagcacccgggccagctctgtgcccatcatccccagcgtgggcctggaggagacctgcctgcagatgcctggcatcagcgaggtgaagagcatcaagtggtgcaagaacagctacagcgcagatgtggtgaatgtgtccatccctgtgtctgactgcctgattgctgagcagcaggaggtgaagatcctgctggagaccgtgcaggagcagatccgcatcctgacagatgccaggagaagtgaggactatgagctggcctctgtggagacagaggacagcgcctctgaaaatacagccttcctgcccctgagccccacagccaagtctgagcgggaggcccagtttgtgctgagaaatgagatccagagggacagcgccctgaccaagtag

SEQ ID NO: 161485 - DNA, 2088 bp, Artificial Sequence
  Description of Artificial Sequence: Synthetic coding sequence
atgtctgagggcgctgctgctgccagccccccaggagctgccagcgctgctgctgccagcgctgaggagggcacagctgctgctgctgctgctgctgctgctgggggcggcccagatggcggcggggagggcgctgctgagcccccccgggagctgcgctgcagcgactgcatcgtgtggaaccggcagcagacctggctgtgtgtggtgcccctcttcatcggcttcatcggcctgggcctgagcctgatgctgctgaagtggatcgtggtgggctctgtgaaggagtatgtgcccacagacctggtggacagcaagggcatgggccaggaccccttcttcctgagcaagcccagcagcttccccaaggccatggagaccaccaccaccaccaccagcaccaccagccctgccaccccatctgctgggggcgccgccagcagcaggacccccaaccgcatcagcacccggctgaccaccatcacccgggcccccacccgcttccctggccaccgggtgcccatccgggccagccccaggagcaccacagccaggaacacagctgccccagccaccgtgcccagcaccacagcccccttcttcagcagcagcaccctgggcagccggccccctgtgcccggcacccccagcacccaggccatgcccagctggcccacagctgcctatgccaccagcagctacctgcatgacagcacccccagctggaccctgagccccttccaggatgctgccagcagcagcagcagcagcagcagcagcgccaccaccaccaccccagagaccagcaccagccccaagttccacaccaccacctacagcacagagaggtctgagcacttcaagccctgccgggacaaggacctggcctactgcctgaatgatggagaatgttttgtgattgagaccctgaccggcagccacaagcactgccgctgcaaggagggctaccagggcgtgcgctgtgaccagttcctgcccaagacagacagcatcctgagtgaccccacccacatcggcatcatcttcacagagagcgaggaggtgtaccagaggcaggtgctgagcatcagctgcatcatcttcggcatcgtcatcgtgggcatgttctgtgccgccttctacttcaagagcaagaagcaggccaagcagatccaggagcagctgaaggtgccccagaatggcaagagctacagcctgaaggccagcagcaccatggccaagtctgagaacctggtgaagagccacgtgcagctgcagaactacagcaaggtggagcggcaccctgtgacagccctggagaagatgatggagagcagctttgtgggcccccagagcttccctgaggtgcccagcccagaccggggcagccagagcgtgaagcaccacaggagcctgagcagctgctgcagccctggccagaggagcggcatgctgcacagaaatgccttccggaggaccccacccagccccaggagccggctgggcggcatcgtgggccctgcctaccagcagctggaggagagccgcatcccagaccaggacaccatcccctgccagggctacagcagcagcggcctgaagacccagaggaacaccagcatcaacatgcagctgcccagccgggagaccaacccctacttcaacagcctggagcagaaggacctggtgggctacagcagcacccgggccagctctgtgcccatcatccccagcgtgggcctggaggagacctgcctgcagatgcctggcatcagcgaggtgaagagcatcaagtggtgcaagaacagctacagcgcagatgtggtgaatgtgtccatccctgtgtctgactgcctgattgctgagcagcaggaggtgaagatcctgctggagaccgtgcaggagcagatccgcatcctgacagatgcccggcggagtgaagattatgagctggcctctgtggagacagaagattctgccagcgagaacacagccttcctgcccctgagccccacagccaagtctgagcgggaggcccagtttgtgctgagaaatgagatccagagggacagcgccctgaccaagtag

SEQ ID NO: 161486 - DNA, 1041 bp, Artificial Sequence
  Description of Artificial Sequence: Synthetic coding sequence
atggagagcgaggaggtgtaccagaggcaggtgctgagcatcagctgcatcatctttggaattgtgattgtgggcatgttctgtgccgccttctacttcaagagcaagaagcaggccaagcagatccaggagcagctgaaggtgccccagaatggcaagagctacagcctgaaggccagcagcaccatggccaagtctgagaacctggtgaagagccacgtgcagctgcagaactacagcaaggtggagcggcaccctgtgacagccctggagaagatgatggagagcagctttgtgggcccccagagcttccctgaggtgcccagcccagaccggggcagccagagcgtgaagcaccacaggagcctgagcagctgctgcagccctggccagaggagcggcatgctgcacagaaatgccttccggaggaccccacccagccccaggagccggctgggcggcatcgtgggccctgcctaccagcagctggaggagagccgcatcccagaccaggacaccatcccctgccagggctacagcagcagcggcctgaagacccagaggaacaccagcatcaacatgcagctgcccagccgggagaccaacccctacttcaacagcctggagcagaaggacctggtgggctacagcagcacccgggccagctctgtgcccatcatccccagcgtgggcctggaggagacctgcctgcagatgcctggcatcagcgaggtgaagagcatcaagtggtgcaagaacagctacagcgcagatgtggtgaatgtgtccatccctgtgtctgactgcctgattgctgagcagcaggaggtgaagatcctgctggagaccgtgcaggagcagatccgcatcctgacagatgccaggagaagtgaggactatgagctggcctctgtggagacagaggacagcgcctctgaaaatacagccttcctgcccctgagccccacagccaagtctgagcgggaggcccagtttgtgctgagaaatgagatccagagggacagcgccctgaccaagtag

SEQ ID NO: 161487 - DNA, 1041 bp, Artificial Sequence; identical to SEQ ID NO: 161486
  Description of Artificial Sequence: Synthetic coding sequence

SEQ ID NO: 161488 - DNA, 171 bp, Artificial Sequence
  Description of Artificial Sequence: Synthetic coding sequence
atgcccacagaccacgaggagccctgtggccccagccacaagagcttctgcctgaatggaggcctgtgctacgtgatccccaccatccccagccccttctgcagcctgcatgaaaatgaaaatgacaacaatgaagacctgtatgatgacctgctgcccctgaatgaatag

SEQ ID NO: 161489 - DNA, 348 bp, Artificial Sequence
  Description of Artificial Sequence: Synthetic coding sequence
atgcccacagaccacgaggagccctgtggccccagccacaagagcttctgcctgaatggaggcctgtgctacgtgatccccaccatccccagccccttctgccgctgtgtggagaactacacaggagcccgctgtgaggaggtgttcctgcccggcagcagcatccagaccaagagcaacctgtttgaggcctttgtggccctggccgtgctggtgaccctcatcatcggggccttctacttcctgtgcaggaagggccacttccagagggccagctctgtgcagtatgacatcaacctggtggagaccagcagcaccagcgcccaccacagccatgagcagcactag

SEQ ID NO: 161490 - DNA, 273 bp, Artificial Sequence
  Description of Artificial Sequence: Synthetic coding sequence
atgcccacagaccacgaggagccctgtggccccagccacaagagcttctgcctgaatggaggcctgtgctacgtgatccccaccatccccagccccttctgccgctgtgtggagaactacacaggagcccgctgtgaggaggtgttcctgcccggcagcagcatccagaccaagagcaacctgtttgaggcctttgtggccctggccgtgctggtgaccctcatcatcggggccttctacttcctgtgccgctgtggcaacacctgcatgtag

SEQ ID NO: 161491 - DNA, 615 bp, Artificial Sequence
  Description of Artificial Sequence: Synthetic coding sequence
atgatgcccagctgcaacagaagctgcagctgcagccggggccccagcgtggaggatggcaagtggtatggagtgcgcagctacctgcacctgttctatgaggactgtgccggcacagccctgagtgatgatcctgagggcccccctgtgctgtgcccccggcggccctggcccagcctgtgctggaagatcagcctgagcagcggcaccctgctgctgctgctgggcgtggccgccctgaccaccggctatgctgtgccccccaagctggagggcattggagagggggagttcctggtgctggaccagagagctgctgactacaaccaggccctgggcacctgccgcctggccggcacagccctgtgtgtggccgccggcgtgctgctggccatctgcctcttctgggccatgattggctggctgagccaggacaccaaggccgagcccctggaccctgaggccgacagccacgtggaggtgtttggagatgagcctgagcagcagctgagccccatcttcagaaatgccagcggccagagctggttcagccccccagccagccccttcggccagagctctgtgcagaccatccagcccaagagggacagctag

SEQ ID NO: 161492 - DNA, 615 bp, Artificial Sequence; identical to SEQ ID NO: 161491
  Description of Artificial Sequence: Synthetic coding sequence

SEQ ID NO: 161493 - DNA, 1329 bp, Artificial Sequence
  Description of Artificial Sequence: Synthetic coding sequence
atgtaccagaggatgctgcgctgtggggctgagctgggcagccctgggggcggcggcggcggcggcggcggcggcggggccggcggccgcctggccctgctgtggatcgtgcccctgaccctgagcggcctgctgggcgtggcctggggcgccagcagcctgggcgcccaccacatccaccacttccacggcagcagcaagcaccacagcgtgcccatcgccatctaccgcagccctgccagcctgcggggcggccatgctggcaccacctacatcttcagcaaaggaggcggccagatcacctacaagtggcccccaaatgaccggcccagcaccagggctgaccggctggccatcggcttcagcacagtgcagaaggaggccgtgctggtgcgggtggacagcagcagcggcctgggggactacctggagctgcacatccaccagggcaagattggagtgaagttcaacgtgggcacagatgacatcgccatcgaggagagcaatgccatcatcaatgatggcaagtaccacgtggtgcgcttcaccaggtctggaggaaatgccaccctgcaggtggacagctggcctgtgattgagcgctacccagctggccggcagctgaccatcttcaacagccaggccaccatcatcattggaggcaaggagcagggccagcccttccagggccagctgagcggcctgtactacaacggcctgaaggtgctgaacatggctgctgaaaatgatgccaacatcgccatcgtgggcaatgtgcggctggtgggggaggtgcccagctccatgaccacagagagcacagccacagccatgcagagcgagatgagcaccagcatcatggagaccaccaccaccctggccaccagcacagcccggcggggcaagccacccaccaaggagcccatcagccagaccacagatgacatcctggtggccagcgctgagtgccccagtgatgatgaggacatcgacccctgtgagcccagcagcggcggcctggccaaccccacccgggccggcggccgggagccctacccaggcagcgctgaggtgatccgggagagcagcagcaccaccggcatggtggtgggcatcgtggccgccgccgccctgtgcatcctgatcctgctgtatgccatgtacaagtacagaaacagagatgagggcagctaccacgtggatgagagcaggaactacatcagcaacagcgcccagagcaatggagctgtggtgaaggagaagcagcccagcagcgccaagagcagcaacaagaacaagaagaacaaggacaaggagtactacgtgtag

SEQ ID NO: 161494 - DNA, 4524 bp, Artificial Sequence
  Description of Artificial Sequence: Synthetic coding sequence
atgggcacagccctgctgcagagaggaggctgcttcctgctgtgcctgagcctgctgctgctgggctgctgggccgagctgggcagcggcctggagttccctggagctgagggccagtggacccgcttccccaagtggaatgcctgctgtgagagcgagatgtccttccagctgaagaccaggtctgcccggggcctggtgctgtactttgatgatgagggcttctgtgacttcctggagctgatcctgacccggggcggccgcctgcagctgtccttcagcatcttctgtgccgagcccgccaccctgctggccgacacccctgtgaatgatggagcctggcacagcgtgcgcatccggcggcagttcaggaacaccaccctcttcatcgaccaggtggaggccaagtgggtggaggtgaagagcaagaggcgggacatgaccgtcttcagcggcctgtttgtgggcggcctgcccccagagctgcgggctgctgccctgaagctgaccctggcctctgtgcgggagcgggagcccttcaagggctggatcagagatgtgcgggtgaacagcagccaggtgctgcctgtggacagcggggaggtgaagctggatgatgagccccccaacagcggcggcggcagcccctgtgaggccggggaggagggggagggcggcgtgtgcctgaatggaggagtgtgcagcgtggtggatgaccaggccgtgtgtgactgcagcaggacaggcttccggggcaaggactgcagccaggaggacaacaacgtggagggcctggcccacctgatgatgggagaccagggcaagagcaagggcaaggaggagtacatcgccaccttcaagggcagcgagtacttctgctatgacctgagccagaaccccatccagagcagcagtgatgagatcaccctgtccttcaagaccctgcagagaaatggcctgatgctgcacacaggcaagtctgctgactatgtgaacctggccctgaagaatggagctgtgtccctggtgatcaacctgggcagcggggcctttgaggccctggtggagcctgtgaatggcaagttcaatgacaatgcctggcatgatgtgaaggtgaccaggaacctgcggcagcacagcggcatcggccacgccatggtgaccatctctgtggatggcatcctgaccaccaccggctacacccaggaggactacaccatgctgggcagtgatgacttcttctacgtgggcggcagccccagcacagctgacctgcccggcagccctgtgagcaacaacttcatgggctgcctgaaggaggtggtgtacaagaacaatgatgtgcggctggagctgagccggctggccaagcagggcgaccccaagatgaagatccacggcgtggtggccttcaagtgtgaaaatgtggccaccctggaccccatcacctttgagaccccagagagcttcatcagcctgcccaagtggaatgccaagaagacaggcagcatcagctttgacttccgcaccacagagcccaacggcctcatcctcttcagccacggcaagcccaggcaccagaaggatgccaagcacccccagatgatcaaggtggacttctttgccatcgagatgctggatggccacctgtacctgctgctggacatgggcagcggcaccatcaagatcaaggccctgctgaagaaggtgaatgatggagagtggtaccacgtggacttccagagagatggccgcagcggcaccatctctgtgaacaccctgcggaccccctacacagcccctggagagagcgagatcctggacctggatgatgagctgtacctgggcggcctgcctgagaacaaggccggcctggtgttccccacagaggtgtggacagccctgctgaactacggctacgtgggctgcatccgggacctcttcattgatggccagagcaaggacatccggcagatggccgaggtgcagagcacagctggggtgaagcccagctgcagcaaggagacagccaagccctgcctgagcaacccctgcaagaacaacggcatgtgcagagatggctggaaccgctacgtgtgtgactgcagcggcaccggctacctgggccgcagctgtgagcgggaggccaccgtgctgtcctatgatggctccatgttcatgaagatccagctgcctgtggtgatgcacacagaagcagaagatgtgtccctgcgcttccgcagccagagggcctacggcatcctgatggccaccaccagccgggacagcgctgacaccctgcggctggagctggatgctggccgggtgaagctgactgtgaacctggactgcatccgcatcaactgcaacagcagcaaaggacctgagaccctgtttgctggctacaacctgaatgacaatgagtggcacacagtgcgggtggtgcggcggggcaagagcctgaagctgactgtggatgaccagcaggccatgacaggccagatggccggggaccacacccggctggagttccacaacattgaaacaggcatcatcacagaaagacgctacctgagctctgtgcccagcaacttcatcggccacctgcagagcctgaccttcaacggcatggcctacatcgacctgtgcaagaatggagacatcgactactgtgagctgaatgccaggtttggcttcaggaacatcatcgctgaccctgtgaccttcaagaccaagagcagctatgtggccctggccaccctgcaggcctacacctccatgcacctgttcttccagttcaagaccaccagcctggatggcctcatcctgtacaacagcggagatggaaatgacttcatcgtggtggagctggtgaagggctacctgcactacgtgtttgacctgggcaatggagccaacctgatcaagggcagcagcaacaagcccctgaatgacaaccagtggcacaacgtgatgatcagccgggacaccagcaacctgcacacagtgaagattgacaccaagatcaccacccagatcacagctggggccaggaacctggacctgaagagtgacctgtacatcggcggcgtggccaaggagacctacaagagcctgcccaagctggtgcacgccaaggagggcttccagggctgcctggcctctgtggacctgaatggccgcctgcctgacctgatcagtgatgccctcttctgcaatggccagatcgagcggggctgtgagggccccagcaccacctgccaggaggacagctgcagcaaccagggcgtgtgcctgcagcagtgggatggcttcagctgtgactgcagcatgaccagcttcagcggccccctgtgcaatgaccccggcaccacctacatcttcagcaagggcggcggccagatcacctacaagtggcccccaaatgaccggcccagcaccagggctgaccggctggccatcggcttcagcacagtgcagaaggaggccgtgctggtgcgggtggacagcagcagcggcctgggggactacctggagctgcacatccaccagggcaagattggagtgaagttcaacgtgggcacagatgacatcgccatcgaggagagcaatgccatcatcaatgatggcaagtaccacgtggtgcgcttcaccaggtctggaggaaatgccaccctgcaggtggacagctggcctgtgattgaaagatacccagctggcaacaatgacaatgaaaggctggccatcgcccggcagaggatcccctaccgcctgggccgggtggtggatgagtggctgctggacaagggccggcagctgaccatcttcaacagccaggccaccatcatcatcggcggcaaggagcagggccagcccttccagggccagctgagcggcctgtactacaacggcctgaaggtgctgaacatggccgcagaaaatgatgccaacatcgccatcgtgggcaatgtgcggctggtgggggaggtgcccagctccatgaccacagagagcacagccacagccatgcagagcgagatgagcaccagcatcatggagaccaccaccaccctggccaccagcacagcccggcggggcaagccacccaccaaggagcccatcagccagaccacagatgacatcctggtggccagcgcagaatgtcccagtgatgatgaagatattgacccctgtgagcccagcagcggcggcctggccaaccccaccagggctgggggccgggagccctacccaggcagcgctgaggtgatccgggagagcagcagcaccaccggcatggtggtgggcatcgtggccgctgctgccctgtgcatcctgatcctgctgtatgccatgtacaagtacagaaacagagatgagggcagctaccacgtggatgagagcaggaactacatcagcaacagcgcccagagcaatggagctgtggtgaaggagaagcagcccagcagcgccaagagcagcaacaagaacaagaagaacaaggacaaggagtactacgtgtag

SEQ ID NO: 161495 - DNA, 1488 bp, Artificial Sequence
  Description of Artificial Sequence: Synthetic coding sequence
atgatcagccgggacaccagcaacctgcacacagtgaagattgacaccaagatcaccacccagatcacagctggggccaggaacctggacctgaagagtgacctgtacatcggcggcgtggccaaggagacctacaagagcctgcccaagctggtgcacgccaaggagggcttccagggctgcctggcctctgtggacctgaatggccgcctgcctgacctgatcagtgatgccctcttctgcaatggccagatcgagcggggctgtgaggtggccctgatgaaggctgacctgcagggccccagcaccacctgccaggaggacagctgcagcaaccagggcgtgtgcctgcagcagtgggatggcttcagctgtgactgcagcatgaccagcttcagcggccccctgtgcaatgaccccggcaccacctacatcttcagcaagggcggcggccagatcacctacaagtggcccccaaatgaccggcccagcaccagggctgaccggctggccatcggcttcagcacagtgcagaaggaggccgtgctggtgcgggtggacagcagcagcggcctgggggactacctggagctgcacatccaccagggcaagattggagtgaagttcaacgtgggcacagatgacatcgccatcgaggagagcaatgccatcatcaatgatggcaagtaccacgtggtgcgcttcaccaggtctggaggaaatgccaccctgcaggtggacagctggcctgtgattgaaagatacccagctggccggcagctgaccatcttcaacagccaggccaccatcatcatcggcggcaaggagcagggccagcccttccagggccagctgagcggcctgtactacaacggcctgaaggtgctgaacatggccgcagaaaatgatgccaacatcgccatcgtgggcaatgtgcggctggtgggggaggtgcccagctccatgaccacagagagcacagccacagccatgcagagcgagatgagcaccagcatcatggagaccaccaccaccctggccaccagcacagcccggcggggcaagccacccaccaaggagcccatcagccagaccacagatgacatcctggtggccagcgcagaatgtcccagtgatgatgaagatattgacccctgtgagcccagcagcggcggcctggccaaccccaccagggctgggggccgggagccctacccaggcagcgctgaggtgatccgggagagcagcagcaccaccggcatggtggtgggcatcgtggccgctgctgccctgtgcatcctgatcctgctgtatgccatgtacaagtacagaaacagagatgagggcagctaccacgtggatgagagcaggaactacatcagcaacagcgcccagagcaatggagctgtggtgaaggagaagcagcccagcagcgccaagagcagcaacaagaacaagaagaacaaggacaaggagtactacgtgtag

SEQ ID NO: 161496 - DNA, 4500 bp, Artificial Sequence
  Description of Artificial Sequence: Synthetic coding sequence
atgggcacagccctgctgcagagaggaggctgcttcctgctgtgcctgagcctgctgctgctgggctgctgggccgagctgggcagcggcctggagttccctggagctgagggccagtggacccgcttccccaagtggaatgcctgctgtgagagcgagatgtccttccagctgaagaccaggtctgcccggggcctggtgctgtactttgatgatgagggcttctgtgacttcctggagctgatcctgacccggggcggccgcctgcagctgtccttcagcatcttctgtgccgagcccgccaccctgctggccgacacccctgtgaatgatggagcctggcacagcgtgcgcatccggcggcagttcaggaacaccaccctcttcatcgaccaggtggaggccaagtgggtggaggtgaagagcaagaggcgggacatgaccgtcttcagcggcctgtttgtgggcggcctgcccccagagctgcgggctgctgccctgaagctgaccctggcctctgtgcgggagcgggagcccttcaagggctggatcagagatgtgcgggtgaacagcagccaggtgctgcctgtggacagcggggaggtgaagctggatgatgagccccccaacagcggcggcggcagcccctgtgaggccggggaggagggggagggcggcgtgtgcctgaatggaggagtgtgcagcgtggtggatgaccaggccgtgtgtgactgcagcaggacaggcttccggggcaaggactgcagccaggccgacaccaacctggagggcctggcccacctgatgatgggagaccaggccaagagcaagaggaaggaggagtacatcgccaccttcaagggcagcgagtacttctgctatgacctgagccagaaccccatccagagcagcagtgatgagatcaccctgtccttcaagaccctgcagagaaatggcctgatgctgcacacaggcaagtctgctgactatgtgaacctggccctgaagaatggagctgtgtccctggtgatcaacctgggcagcggggcctttgaggccctggtggagcctgtgaatggcaagttcaatgacaatgcctggcatgatgtgaaggtgaccaggaacctgcggcaggtgaccatctctgtggatggcatcctgaccaccaccggctacacccaggaggactacaccatgctgggcagtgatgacttcttctacgtgggcggcagccccagcacagctgacctgcccggcagccctgtgagcaacaacttcatgggctgcctgaaggaggtggtgtacaagaacaatgatgtgcggctggagctgagccggctggccaagcagggcgaccccaagatgaagatccacggcgtggtggccttcaagtgtgaaaatgtggccaccctggaccccatcacctttgagaccccagagagcttcatcagcctgcccaagtggaatgccaagaagacaggcagcatcagctttgacttccgcaccacagagcccaacggcctcatcctcttcagccacggcaagcccaggcaccagaaggatgccaagcacccccagatgatcaaggtggacttctttgccatcgagatgctggatggccacctgtacctgctgctggacatgggcagcggcaccatcaagatcaaggccctgctgaagaaggtgaatgatggagagtggtaccacgtggacttccagagagatggccgcagcggcaccatctctgtgaacaccctgcggaccccctacacagcccctggagagagcgagatcctggacctggatgatgagctgtacctgggcggcctgcctgagaacaaggccggcctggtgttccccacagaggtgtggacagccctgctgaactacggctacgtgggctgcatccgggacctcttcattgatggccagagcaaggacatccggcagatggccgaggtgcagagcacagctggggtgaagcccagctgcagcaaggagacagccaagccctgcctgagcaacccctgcaagaacaacggcatgtgcagagatggctggaaccgctacgtgtgtgactgcagcggcaccggctacctgggccgcagctgtgagcgggaggccaccgtgctgtcctatgatggctccatgttcatgaagatccagctgcctgtggtgatgcacacagaagcagaagatgtgtccctgcgcttccgcagccagagggcctacggcatcctgatggccaccaccagccgggacagcgctgacaccctgcggctggagctggatgctggccgggtgaagctgactgtgaacctggactgcatccgcatcaactgcaacagcagcaaaggacctgagaccctgtttgctggctacaacctgaatgacaatgagtggcacacagtgcgggtggtgcggcggggcaagagcctgaagctgactgtggatgaccagcaggccatgacaggccagatggccggggaccacacccggctggagttccacaacattgaaacaggcatcatcacagaaagacgctacctgagctctgtgcccagcaacttcatcggccacctgcagagcctgaccttcaacggcatggcctacatcgacctgtgcaagaatggagacatcgactactgtgagctgaatgccaggtttggcttcaggaacatcatcgctgaccctgtgaccttcaagaccaagagcagctatgtggccctggccaccctgcaggcctacacctccatgcacctgttcttccagttcaagaccaccagcctggatggcctcatcctgtacaacagcggagatggaaatgacttcatcgtggtggagctggtgaagggctacctgcactacgtgtttgacctgggcaatggagccaacctgatcaagggcagcagcaacaagcccctgaatgacaaccagtggcacaacgtgatgatcagccgggacaccagcaacctgcacacagtgaagattgacaccaagatcaccacccagatcacagctggggccaggaacctggacctgaagagtgacctgtacatcggcggcgtggccaaggagacctacaagagcctgcccaagctggtgcacgccaaggagggcttccagggctgcctggcctctgtggacctgaatggccgcctgcctgacctgatcagtgatgccctcttctgcaatggccagatcgagcggggctgtgagggccccagcaccacctgccaggaggacagctgcagcaaccagggcgtgtgcctgcagcagtgggatggcttcagctgtgactgcagcatgaccagcttcagcggccccctgtgcaatgaccccggcaccacctacatcttcagcaagggcggcggccagatcacctacaagtggcccccaaatgaccggcccagcaccagggctgaccggctggccatcggcttcagcacagtgcagaaggaggccgtgctggtgcgggtggacagcagcagcggcctgggggactacctggagctgcacatccaccagggcaagattggagtgaagttcaacgtgggcacagatgacatcgccatcgaggagagcaatgccatcatcaatgatggcaagtaccacgtggtgcgcttcaccaggtctggaggaaatgccaccctgcaggtggacagctggcctgtgattgaaagatacccagctggcaacaatgacaatgaaaggctggccatcgcccggcagaggatcccctaccgcctgggccgggtggtggatgagtggctgctggacaagggccggcagctgaccatcttcaacagccaggccaccatcatcatcggcggcaaggagcagggccagcccttccagggccagctgagcggcctgtactacaacggcctgaaggtgctgaacatggccgcagaaaatgatgccaacatcgccatcgtgggcaatgtgcggctggtgggggaggtgcccagctccatgaccacagagagcacagccacagccatgcagagcgagatgagcaccagcatcatggagaccaccaccaccctggccaccagcacagcccggcggggcaagccacccaccaaggagcccatcagccagaccacagatgacatcctggtggccagcgcagaatgtcccagtgatgatgaagatattgacccctgtgagcccagcagcggcggcctggccaaccccaccagggctgggggccgggagccctacccaggcagcgctgaggtgatccgggagagcagcagcaccaccggcatggtggtgggcatcgtggccgctgctgccctgtgcatcctgatcctgctgtatgccatgtacaagtacagaaacagagatgagggcagctaccacgtggatgagagcaggaactacatcagcaacagcgcccagagcaatggagctgtggtgaaggagaagcagcccagcagcgccaagagcagcaacaagaacaagaagaacaaggacaaggagtactacgtgtag

SEQ ID NO: 161497 - DNA, 4644 bp, Artificial Sequence
  Description of Artificial Sequence: Synthetic coding sequence
atgggcacagccctgctgcagagaggaggctgcttcctgctgtgcctgagcctgctgctgctgggctgctgggccgagctgggcagcggcctggagttccctggagctgagggccagtggacccgcttccccaagtggaatgcctgctgtgagagcgagatgtccttccagctgaagaccaggtctgcccggggcctggtgctgtactttgatgatgagggcttctgtgacttcctggagctgatcctgacccggggcggccgcctgcagctgtccttcagcatcttctgtgccgagcccgccaccctgctggccgacacccctgtgaatgatggagcctggcacagcgtgcgcatccggcggcagttcaggaacaccaccctcttcatcgaccaggtggaggccaagtgggtggaggtgaagagcaagaggcgggacatgaccgtcttcagcggcctgtttgtgggcggcctgcccccagagctgcgggctgctgccctgaagctgaccctggcctctgtgcgggagcgggagcccttcaagggctggatcagagatgtgcgggtgaacagcagccaggtgctgcctgtggacagcggggaggtgaagctggatgatgagccccccaacagcggcggcggcagcccctgtgaggccggggaggagggggagggcggcgtgtgcctgaatggaggagtgtgcagcgtggtggatgaccaggccgtgtgtgactgcagcaggacaggcttccggggcaaggactgcagccaggagatcaagtttggcctgcagtgtgtgctgcctgtgctgctgcatgacaatgaccagggcaagtactgctgcatcaacacagccaagcccctgacagagaaggacaacaacgtggagggcctggcccacctgatgatgggagaccagggcaagagcaagggcaaggaggagtacatcgccaccttcaagggcagcgagtacttctgctatgacctgagccagaaccccatccagagcagcagtgatgagatcaccctgtccttcaagaccctgcagagaaatggcctgatgctgcacacaggcaagtctgctgactatgtgaacctggccctgaagaatggagctgtgtccctggtgatcaacctgggcagcggggcctttgaggccctggtggagcctgtgaatggcaagttcaatgacaatgcctggcatgatgtgaaggtgaccaggaacctgcggcagcacagcggcattggacatgccatggtgaacaagctgcactgcagcgtgaccatctctgtggatggcatcctgaccaccaccggctacacccaggaggactacaccatgctgggcagtgatgacttcttctacgtgggcggcagccccagcacagctgacctgcccggcagccctgtgagcaacaacttcatgggctgcctgaaggaggtggtgtacaagaacaatgatgtgcggctggagctgagccggctggccaagcagggcgaccccaagatgaagatccacggcgtggtggccttcaagtgtgaaaatgtggccaccctggaccccatcacctttgagaccccagagagcttcatcagcctgcccaagtggaatgccaagaagacaggcagcatcagctttgacttccgcaccacagagcccaacggcctcatcctcttcagccacggcaagcccaggcaccagaaggatgccaagcacccccagatgatcaaggtggacttctttgccatcgagatgctggatggccacctgtacctgctgctggacatgggcagcggcaccatcaagatcaaggccctgctgaagaaggtgaatgatggagagtggtaccacgtggacttccagagagatggccgcagcggcaccatctctgtgaacaccctgcggaccccctacacagcccctggagagagcgagatcctggacctggatgatgagctgtacctgggcggcctgcctgagaacaaggccggcctggtgttccccacagaggtgtggacagccctgctgaactacggctacgtgggctgcatccgggacctcttcattgatggccagagcaaggacatccggcagatggccgaggtgcagagcacagctggggtgaagcccagctgcagcaaggagacagccaagccctgcctgagcaacccctgcaagaacaacggcatgtgcagagatggctggaaccgctacgtgtgtgactgcagcggcaccggctacctgggccgcagctgtgagcgggaggccaccgtgctgtcctatgatggctccatgttcatgaagatccagctgcctgtggtgatgcacacagaagcagaagatgtgtccctgcgcttccgcagccagagggcctacggcatcctgatggccaccaccagccgggacagcgctgacaccctgcggctggagctggatgctggccgggtgaagctgactgtgaacctggactgcatccgcatcaactgcaacagcagcaaaggacctgagaccctgtttgctggctacaacctgaatgacaatgagtggcacacagtgcgggtggtgcggcggggcaagagcctgaagctgactgtggatgaccagcaggccatgacaggccagatggccggggaccacacccggctggagttccacaacattgaaacaggcatcatcacagaaagacgctacctgagctctgtgcccagcaacttcatcggccacctgcagagcctgaccttcaacggcatggcctacatcgacctgtgcaagaatggagacatcgactactgtgagctgaatgccaggtttggcttcaggaacatcatcgctgaccctgtgaccttcaagaccaagagcagctatgtggccctggccaccctgcaggcctacacctccatgcacctgttcttccagttcaagaccaccagcctggatggcctcatcctgtacaacagcggagatggaaatgacttcatcgtggtggagctggtgaagggctacctgcactacgtgtttgacctgggcaatggagccaacctgatcaagggcagcagcaacaagcccctgaatgacaaccagtggcacaacgtgatgatcagccgggacaccagcaacctgcacacagtgaagattgacaccaagatcaccacccagatcacagctggggccaggaacctggacctgaagagtgacctgtacatcggcggcgtggccaaggagacctacaagagcctgcccaagctggtgcacgccaaggagggcttccagggctgcctggcctctgtggacctgaatggccgcctgcctgacctgatcagtgatgccctcttctgcaatggccagatcgagcggggctgtgagggccccagcaccacctgccaggaggacagctgcagcaaccagggcgtgtgcctgcagcagtgggatggcttcagctgtgactgcagcatgaccagcttcagcggccccctgtgcaatgaccccggcaccacctacatcttcagcaagggcggcggccagatcacctacaagtggcccccaaatgaccggcccagcaccagggctgaccggctggccatcggcttcagcacagtgcagaaggaggccgtgctggtgcgggtggacagcagcagcggcctgggggactacctggagctgcacatccaccagggcaagattggagtgaagttcaacgtgggcacagatgacatcgccatcgaggagagcaatgccatcatcaatgatggcaagtaccacgtggtgcgcttcaccaggtctggaggaaatgccaccctgcaggtggacagctggcctgtgattgaaagatacccagctggcaacaatgacaatgaaaggctggccatcgcccggcagaggatcccctaccgcctgggccgggtggtggatgagtggctgctggacaagggccggcagctgaccatcttcaacagccaggccaccatcatcatcggcggcaaggagcagggccagcccttccagggccagctgagcggcctgtactacaacggcctgaaggtgctgaacatggccgcagaaaatgatgccaacatcgccatcgtgggcaatgtgcggctggtgggggaggtgcccagctccatgaccacagagagcacagccacagccatgcagagcgagatgagcaccagcatcatggagaccaccaccaccctggccaccagcacagcccggcggggcaagccacccaccaaggagcccatcagccagaccacagatgacatcctggtggccagcgcagaatgtcccagtgatgatgaagatattgacccctgtgagcccagcagcggcggcctggccaaccccaccagggctgggggccgggagccctacccaggcagcgctgaggtgatccgggagagcagcagcaccaccggcatggtggtgggcatcgtggccgctgctgccctgtgcatcctgatcctgctgtatgccatgtacaagtacagaaacagagatgagggcagctaccacgtggatgagagcaggaactacatcagcaacagcgcccagagcaatggagctgtggtgaaggagaagcagcccagcagcgccaagagcagcaacaagaacaagaagaacaaggacaaggagtactacgtgtag

SEQ ID NO: 161498 - DNA, 4434 bp, Artificial Sequence
  Description of Artificial Sequence: Synthetic coding sequence
atgggcacagccctgctgcagagaggaggctgcttcctgctgtgcctgagcctgctgctgctgggctgctgggccgagctgggcagcggcctggagttccctggagctgagggccagtggacccgcttccccaagtggaatgcctgctgtgagagcgagatgtccttccagctgaagaccaggtctgcccggggcctggtgctgtactttgatgatgagggcttctgtgacttcctggagctgatcctgacccggggcggccgcctgcagctgtccttcagcatcttctgtgccgagcccgccaccctgctggccgacacccctgtgaatgatggagcctggcacagcgtgcgcatccggcggcagttcaggaacaccaccctcttcatcgaccaggtggaggccaagtgggtggaggtgaagagcaagaggcgggacatgaccgtcttcagcggcctgtttgtgggcggcctgcccccagagctgcgggctgctgccctgaagctgaccctggcctctgtgcgggagcgggagcccttcaagggctggatcagagatgtgcgggtgaacagcagccaggtgctgcctgtggacagcggggaggtgaagctggatgatgagccccccaacagcggcggcggcagcccctgtgaggccggggaggagggggagggcggcgtgtgcctgaatggaggagtgtgcagcgtggtggatgaccaggccgtgtgtgactgcagcaggacaggcttccggggcaaggactgcagccaggaggacaacaacgtggagggcctggcccacctgatgatgggagaccagggcaagagcaagggcaaggaggagtacatcgccaccttcaagggcagcgagtacttctgctatgacctgagccagaaccccatccagagcagcagtgatgagatcaccctgtccttcaagaccctgcagagaaatggcctgatgctgcacacaggcaagtctgctgactatgtgaacctggccctgaagaatggagctgtgtccctggtgatcaacctgggcagcggggcctttgaggccctggtggagcctgtgaatggcaagttcaatgacaatgcctggcatgatgtgaaggtgaccaggaacctgcggcagcacagcggcatcggccacgccatggtgaccatctctgtggatggcatcctgaccaccaccggctacacccaggaggactacaccatgctgggcagtgatgacttcttctacgtgggcggcagccccagcacagctgacctgcccggcagccctgtgagcaacaacttcatgggctgcctgaaggaggtggtgtacaagaacaatgatgtgcggctggagctgagccggctggccaagcagggcgaccccaagatgaagatccacggcgtggtggccttcaagtgtgaaaatgtggccaccctggaccccatcacctttgagaccccagagagcttcatcagcctgcccaagtggaatgccaagaagacaggcagcatcagctttgacttccgcaccacagagcccaacggcctcatcctcttcagccacggcaagcccaggcaccagaaggatgccaagcacccccagatgatcaaggtggacttctttgccatcgagatgctggatggccacctgtacctgctgctggacatgggcagcggcaccatcaagatcaaggccctgctgaagaaggtgaatgatggagagtggtaccacgtggacttccagagagatggccgcagcggcaccatctctgtgaacaccctgcggaccccctacacagcccctggagagagcgagatcctggacctggatgatgagctgtacctgggcggcctgcctgagaacaaggccggcctggtgttccccacagaggtgtggacagccctgctgaactacggctacgtgggctgcatccgggacctcttcattgatggccagagcaaggacatccggcagatggccgaggtgcagagcacagctggggtgaagcccagctgcagcaaggagacagccaagccctgcctgagcaacccctgcaagaacaacggcatgtgcagagatggctggaaccgctacgtgtgtgactgcagcggcaccggctacctgggccgcagctgtgagcgggaggccaccgtgctgtcctatgatggctccatgttcatgaagatccagctgcctgtggtgatgcacacagaagcagaagatgtgtccctgcgcttccgcagccagagggcctacggcatcctgatggccaccaccagccgggacagcgctgacaccctgcggctggagctggatgctggccgggtgaagctgactgtgaacctggactgcatccgcatcaactgcaacagcagcaaaggacctgagaccctgtttgctggctacaacctgaatgacaatgagtggcacacagtgcgggtggtgcggcggggcaagagcctgaagctgactgtggatgaccagcaggccatgacaggccagatggccggggaccacacccggctggagttccacaacattgaaacaggcatcatcacagaaagacgctacctgagctctgtgcccagcaacttcatcggccacctgcagagcctgaccttcaacggcatggcctacatcgacctgtgcaagaatggagacatcgactactgtgagctgaatgccaggtttggcttcaggaacatcatcgctgaccctgtgaccttcaagaccaagagcagctatgtggccctggccaccctgcaggcctacacctccatgcacctgttcttccagttcaagaccaccagcctggatggcctcatcctgtacaacagcggagatggaaatgacttcatcgtggtggagctggtgaagggctacctgcactacgtgtttgacctgggcaatggagccaacctgatcaagggcagcagcaacaagcccctgaatgacaaccagtggcacaacgtgatgatcagccgggacaccagcaacctgcacacagtgaagattgacaccaagatcaccacccagatcacagctggggccaggaacctggacctgaagagtgacctgtacatcggcggcgtggccaaggagacctacaagagcctgcccaagctggtgcacgccaaggagggcttccagggctgcctggcctctgtggacctgaatggccgcctgcctgacctgatcagtgatgccctcttctgcaatggccagatcgagcggggctgtgagggccccagcaccacctgccaggaggacagctgcagcaaccagggcgtgtgcctgcagcagtgggatggcttcagctgtgactgcagcatgaccagcttcagcggccccctgtgcaatgaccccggcaccacctacatcttcagcaagggcggcggccagatcacctacaagtggcccccaaatgaccggcccagcaccagggctgaccggctggccatcggcttcagcacagtgcagaaggaggccgtgctggtgcgggtggacagcagcagcggcctgggggactacctggagctgcacatccaccagggcaagattggagtgaagttcaacgtgggcacagatgacatcgccatcgaggagagcaatgccatcatcaatgatggcaagtaccacgtggtgcgcttcaccaggtctggaggaaatgccaccctgcaggtggacagctggcctgtgattgaaagatacccagctggccggcagctgaccatcttcaacagccaggccaccatcatcatcggcggcaaggagcagggccagcccttccagggccagctgagcggcctgtactacaacggcctgaaggtgctgaacatggccgcagaaaatgatgccaacatcgccatcgtgggcaatgtgcggctggtgggggaggtgcccagctccatgaccacagagagcacagccacagccatgcagagcgagatgagcaccagcatcatggagaccaccaccaccctggccaccagcacagcccggcggggcaagccacccaccaaggagcccatcagccagaccacagatgacatcctggtggccagcgcagaatgtcccagtgatgatgaagatattgacccctgtgagcccagcagcggcggcctggccaaccccaccagggctgggggccgggagccctacccaggcagcgctgaggtgatccgggagagcagcagcaccaccggcatggtggtgggcatcgtggccgctgctgccctgtgcatcctgatcctgctgtatgccatgtacaagtacagaaacagagatgagggcagctaccacgtggatgagagcaggaactacatcagcaacagcgcccagagcaatggagctgtggtgaaggagaagcagcccagcagcgccaagagcagcaacaagaacaagaagaacaaggacaaggagtactacgtgtag

SEQ ID NO: 161499 - DNA, 4434 bp, Artificial Sequence
  Description of Artificial Sequence: Synthetic coding sequence
atgggcacagccctgctgcagagaggaggctgcttcctgctgtgcctgagcctgctgctgctgggctgctgggccgagctgggcagcggcctggagttccctggagctgagggccagtggacccgcttccccaagtggaatgcctgctgtgagagcgagatgtccttccagctgaagaccaggtctgcccggggcctggtgctgtactttgatgatgagggcttctgtgacttcctggagctgatcctgacccggggcggccgcctgcagctgtccttcagcatcttctgtgccgagcccgccaccctgctggccgacacccctgtgaatgatggagcctggcacagcgtgcgcatccggcggcagttcaggaacaccaccctcttcatcgaccaggtggaggccaagtgggtggaggtgaagagcaagaggcgggacatgaccgtcttcagcggcctgtttgtgggcggcctgcccccagagctgcgggctgctgccctgaagctgaccctggcctctgtgcgggagcgggagcccttcaagggctggatcagagatgtgcgggtgaacagcagccaggtgctgcctgtggacagcggggaggtgaagctggatgatgagccccccaacagcggcggcggcagcccctgtgaggccggggaggagggggagggcggcgtgtgcctgaatggaggagtgtgcagcgtggtggatgaccaggccgtgtgtgactgcagcaggacaggcttccggggcaaggactgcagccaggccgacaccaacctggagggcctggcccacctgatgatgggagaccaggccaagagcaagaggaaggaggagtacatcgccaccttcaagggcagcgagtacttctgctatgacctgagccagaaccccatccagagcagcagtgatgagatcaccctgtccttcaagaccctgcagagaaatggcctgatgctgcacacaggcaagtctgctgactatgtgaacctggccctgaagaatggagctgtgtccctggtgatcaacctgggcagcggggcctttgaggccctggtggagcctgtgaatggcaagttcaatgacaatgcctggcatgatgtgaaggtgaccaggaacctgcggcagcacagcggcatcggccacgccatggtgaccatctctgtggatggcatcctgaccaccaccggctacacccaggaggactacaccatgctgggcagtgatgacttcttctacgtgggcggcagccccagcacagctgacctgcccggcagccctgtgagcaacaacttcatgggctgcctgaaggaggtggtgtacaagaacaatgatgtgcggctggagctgagccggctggccaagcagggcgaccccaagatgaagatccacggcgtggtggccttcaagtgtgaaaatgtggccaccctggaccccatcacctttgagaccccagagagcttcatcagcctgcccaagtggaatgccaagaagacaggcagcatcagctttgacttccgcaccacagagcccaacggcctcatcctcttcagccacggcaagcccaggcaccagaaggatgccaagcacccccagatgatcaaggtggacttctttgccatcgagatgctggatggccacctgtacctgctgctggacatgggcagcggcaccatcaagatcaaggccctgctgaagaaggtgaatgatggagagtggtaccacgtggacttccagagagatggccgcagcggcaccatctctgtgaacaccctgcggaccccctacacagcccctggagagagcgagatcctggacctggatgatgagctgtacctgggcggcctgcctgagaacaaggccggcctggtgttccccacagaggtgtggacagccctgctgaactacggctacgtgggctgcatccgggacctcttcattgatggccagagcaaggacatccggcagatggccgaggtgcagagcacagctggggtgaagcccagctgcagcaaggagacagccaagccctgcctgagcaacccctgcaagaacaacggcatgtgcagagatggctggaaccgctacgtgtgtgactgcagcggcaccggctacctgggccgcagctgtgagcgggaggccaccgtgctgtcctatgatggctccatgttcatgaagatccagctgcctgtggtgatgcacacagaagcagaagatgtgtccctgcgcttccgcagccagagggcctacggcatcctgatggccaccaccagccgggacagcgctgacaccctgcggctggagctggatgctggccgggtgaagctgactgtgaacctggactgcatccgcatcaactgcaacagcagcaaaggacctgagaccctgtttgctggctacaacctgaatgacaatgagtggcacacagtgcgggtggtgcggcggggcaagagcctgaagctgactgtggatgaccagcaggccatgacaggccagatggccggggaccacacccggctggagttccacaacattgaaacaggcatcatcacagaaagacgctacctgagctctgtgcccagcaacttcatcggccacctgcagagcctgaccttcaacggcatggcctacatcgacctgtgcaagaatggagacatcgactactgtgagctgaatgccaggtttggcttcaggaacatcatcgctgaccctgtgaccttcaagaccaagagcagctatgtggccctggccaccctgcaggcctacacctccatgcacctgttcttccagttcaagaccaccagcctggatggcctcatcctgtacaacagcggagatggaaatgacttcatcgtggtggagctggtgaagggctacctgcactacgtgtttgacctgggcaatggagccaacctgatcaagggcagcagcaacaagcccctgaatgacaaccagtggcacaacgtgatgatcagccgggacaccagcaacctgcacacagtgaagattgacaccaagatcaccacccagatcacagctggggccaggaacctggacctgaagagtgacctgtacatcggcggcgtggccaaggagacctacaagagcctgcccaagctggtgcacgccaaggagggcttccagggctgcctggcctctgtggacctgaatggccgcctgcctgacctgatcagtgatgccctcttctgcaatggccagatcgagcggggctgtgagggccccagcaccacctgccaggaggacagctgcagcaaccagggcgtgtgcctgcagcagtgggatggcttcagctgtgactgcagcatgaccagcttcagcggccccctgtgcaatgaccccggcaccacctacatcttcagcaagggcggcggccagatcacctacaagtggcccccaaatgaccggcccagcaccagggctgaccggctggccatcggcttcagcacagtgcagaaggaggccgtgctggtgcgggtggacagcagcagcggcctgggggactacctggagctgcacatccaccagggcaagattggagtgaagttcaacgtgggcacagatgacatcgccatcgaggagagcaatgccatcatcaatgatggcaagtaccacgtggtgcgcttcaccaggtctggaggaaatgccaccctgcaggtggacagctggcctgtgattgaaagatacccagctggccggcagctgaccatcttcaacagccaggccaccatcatcatcggcggcaaggagcagggccagcccttccagggccagctgagcggcctgtactacaacggcctgaaggtgctgaacatggccgcagaaaatgatgccaacatcgccatcgtgggcaatgtgcggctggtgggggaggtgcccagctccatgaccacagagagcacagccacagccatgcagagcgagatgagcaccagcatcatggagaccaccaccaccctggccaccagcacagcccggcggggcaagccacccaccaaggagcccatcagccagaccacagatgacatcctggtggccagcgcagaatgtcccagtgatgatgaagatattgacccctgtgagcccagcagcggcggcctggccaaccccaccagggctgggggccgggagccctacccaggcagcgctgaggtgatccgggagagcagcagcaccaccggcatggtggtgggcatcgtggccgctgctgccctgtgcatcctgatcctgctgtatgccatgtacaagtacagaaacagagatgagggcagctaccacgtggatgagagcaggaactacatcagcaacagcgcccagagcaatggagctgtggtgaaggagaagcagcccagcagcgccaagagcagcaacaagaacaagaagaacaaggacaaggagtactacgtgtag

SEQ ID NO: 161500 - DNA, 4647 bp, Artificial Sequence
  Description of Artificial Sequence: Synthetic coding sequence
atgggcacagccctgctgcagagaggaggctgcttcctgctgtgcctgagcctgctgctgctgggctgctgggccgagctgggcagcggcctggagttccctggagctgagggccagtggacccgcttccccaagtggaatgcctgctgtgagagcgagatgtccttccagctgaagaccaggtctgcccggggcctggtgctgtactttgatgatgagggcttctgtgacttcctggagctgatcctgacccggggcggccgcctgcagctgtccttcagcatcttctgtgccgagcccgccaccctgctggccgacacccctgtgaatgatggagcctggcacagcgtgcgcatccggcggcagttcaggaacaccaccctcttcatcgaccaggtggaggccaagtgggtggaggtgaagagcaagaggcgggacatgaccgtcttcagcggcctgtttgtgggcggcctgcccccagagctgcgggctgctgccctgaagctgaccctggcctctgtgcgggagcgggagcccttcaagggctggatcagagatgtgcgggtgaacagcagccaggtgctgcctgtggacagcggggaggtgaagctggatgatgagccccccaacagcggcggcggcagcccctgtgaggccggggaggagggggagggcggcgtgtgcctgaatggaggagtgtgcagcgtggtggatgaccaggccgtgtgtgactgcagcaggacaggcttccggggcaaggactgcagccaggagatcaagtttggcctgcagtgtgtgctgcctgtgctgctgcatgacaatgaccagggcaagtactgctgcatcaacacagccaagcccctgacagagaagaaggacaatgactttgagggcctggcccacctgatgatgggagaccaggccaagagcaagaggaaggaggagtacatcgccaccttcaagggcagcgagtacttctgctatgacctgagccagaaccccatccagagcagcagtgatgagatcaccctgtccttcaagaccctgcagagaaatggcctgatgctgcacacaggcaagtctgctgactatgtgaacctggccctgaagaatggagctgtgtccctggtgatcaacctgggcagcggggcctttgaggccctggtggagcctgtgaatggcaagttcaatgacaatgcctggcatgatgtgaaggtgaccaggaacctgcggcagcacagcggcatcggccacgccatggtgaacaagctgcactgcagcgtgaccatctctgtggatggcatcctgaccaccaccggctacacccaggaggactacaccatgctgggcagtgatgacttcttctacgtgggcggcagccccagcacagctgacctgcccggcagccctgtgagcaacaacttcatgggctgcctgaaggaggtggtgtacaagaacaatgatgtgcggctggagctgagccggctggccaagcagggcgaccccaagatgaagatccatggagtggtggccttcaagtgtgaaaatgtggccaccctggaccccatcacctttgagaccccagagagcttcatcagcctgcccaagtggaatgccaagaagacaggcagcatcagctttgacttccgcaccacagagcccaacggcctcatcctcttcagccacggcaagcccaggcaccagaaggatgccaagcacccccagatgatcaaggtggacttctttgccatcgagatgctggatggccacctgtacctgctgctggacatgggcagcggcaccatcaagatcaaggccctgctgaagaaggtgaatgatggagagtggtaccacgtggacttccagagagatggccgcagcggcaccatctctgtgaacaccctgcggaccccctacacagcccctggagagagcgagatcctggacctggatgatgagctgtacctgggcggcctgcctgagaacaaggccggcctggtgttccccacagaggtgtggacagccctgctgaactacggctacgtgggctgcatccgggacctcttcattgatggccagagcaaggacatccggcagatggccgaggtgcagagcacagctggggtgaagcccagctgcagcaaggagacagccaagccctgcctgagcaacccctgcaagaacaacggcatgtgcagagatggctggaacagatatgtgtgtgactgcagcggcaccggctacctgggccgcagctgtgagcgggaggccaccgtgctgtcctatgatggctccatgttcatgaagatccagctgcctgtggtgatgcacacagaagcagaagatgtgtccctgcgcttccgcagccagagggcctacggcatcctgatggccaccaccagccgggacagcgctgacaccctgcggctggagctggatgctggccgggtgaagctgactgtgaacctggactgcatccgcatcaactgcaacagcagcaagggccctgagaccctgtttgctggctacaacctgaatgacaatgagtggcacacagtgcgggtggtgagaagaggcaagagcctgaagctgactgtggatgaccagcaggccatgacaggccagatggccggggaccacacccggctggagttccacaacatcgagaccggcatcatcacagagcggcgctacctgagctctgtgcccagcaacttcatcggccacctgcagagcctgaccttcaacggcatggcctacatcgacctgtgcaagaatggagacatcgactactgtgagctgaatgcccgcttcggcttcaggaacatcatcgctgaccctgtgaccttcaagaccaagagcagctatgtggccctggccaccctgcaggcctacacctccatgcacctgttcttccagttcaagaccaccagcctggatggcctcatcctgtacaacagcggagatggaaatgacttcatcgtggtggagctggtgaagggctacctgcactacgtgtttgacctgggcaatggagccaacctgatcaagggcagcagcaacaagcccctgaatgacaaccagtggcacaacgtgatgatcagccgggacaccagcaacctgcacacagtgaagattgacaccaagatcaccacccagatcacagctggggccaggaacctggacctgaagagtgacctgtacatcggcggcgtggccaaggagacctacaagagcctgcccaagctggtgcacgccaaggagggcttccagggctgcctggcctctgtggacctgaatggccgcctgcctgacctgatcagtgatgccctcttctgcaatggccagatcgagcggggctgtgagggccccagcaccacctgccaggaggacagctgcagcaaccagggcgtgtgcctgcagcagtgggatggcttcagctgtgactgcagcatgaccagcttcagcggccccctgtgcaatgaccccggcaccacctacatcttcagcaaaggaggcggccagatcacctacaagtggcccccaaatgaccggcccagcaccagggctgaccggctggccatcggcttcagcacagtgcagaaggaggccgtgctggtgcgggtggacagcagcagcggcctgggggactacctggagctgcacatccaccagggcaagattggagtgaagttcaacgtgggcacagatgacatcgccatcgaggagagcaatgccatcatcaatgatggcaagtaccacgtggtgcgcttcaccaggtctggaggaaatgccaccctgcaggtggacagctggcctgtgattgagcgctacccagctggcaacaatgacaatgaaaggctggccatcgcccggcagaggatcccctaccgcctgggccgggtggtggatgagtggctgctggacaagggccggcagctgaccatcttcaacagccaggccaccatcatcattggaggcaaggagcagggccagcccttccagggccagctgagcggcctgtactacaacggcctgaaggtgctgaacatggctgctgaaaatgatgccaacatcgccatcgtgggcaatgtgcggctggtgggggaggtgcccagctccatgaccacagagagcacagccacagccatgcagagcgagatgagcaccagcatcatggagaccaccaccaccctggccaccagcacagcccggcggggcaagccacccaccaaggagcccatcagccagaccacagatgacatcctggtggccagcgctgagtgccccagtgatgatgaggacatcgacccctgtgagcccagcagcggcggcctggccaaccccacccgggccggcggccgggagccctacccaggcagcgctgaggtgatccgggagagcagcagcaccaccggcatggtggtgggcatcgtggccgccgccgccctgtgcatcctgatcctgctgtatgccatgtacaagtacagaaacagagatgagggcagctaccacgtggatgagagcaggaactacatcagcaacagcgcccagagcaatggagctgtggtgaaggagaagcagcccagcagcgccaagagcagcaacaagaacaagaagaacaaggacaaggagtactacgtgtag

SEQ ID NO: 161501 - DNA, 1191 bp, Artificial Sequence
  Description of Artificial Sequence: Synthetic coding sequence
gccctggagatctgggagcagcccccagccccccggctgctcttccctggcctgcccttccgcaccagccccagccctgctgccttctaccgcagccctgccagcctgcggggcggccatgctggcaccacctacatcttcagcaaaggaggcggccagatcacctacaagtggcccccaaatgaccggcccagcaccagggctgaccggctggccatcggcttcagcacagtgcagaaggaggccgtgctggtgcgggtggacagcagcagcggcctgggggactacctggagctgcacatccaccagggcaagattggagtgaagttcaacgtgggcacagatgacatcgccatcgaggagagcaatgccatcatcaatgatggcaagtaccacgtggtgcgcttcaccaggtctggaggaaatgccaccctgcaggtggacagctggcctgtgattgagcgctacccagctggccggcagctgaccatcttcaacagccaggccaccatcatcattggaggcaaggagcagggccagcccttccagggccagctgagcggcctgtactacaacggcctgaaggtgctgaacatggctgctgaaaatgatgccaacatcgccatcgtgggcaatgtgcggctggtgggggaggtgcccagctccatgaccacagagagcacagccacagccatgcagagcgagatgagcaccagcatcatggagaccaccaccaccctggccaccagcacagcccggcggggcaagccacccaccaaggagcccatcagccagaccacagatgacatcctggtggccagcgctgagtgccccagtgatgatgaggacatcgacccctgtgagcccagcagcggcggcctggccaaccccacccgggccggcggccgggagccctacccaggcagcgctgaggtgatccgggagagcagcagcaccaccggcatggtggtgggcatcgtggccgccgccgccctgtgcatcctgatcctgctgtatgccatgtacaagtacagaaacagagatgagggcagctaccacgtggatgagagcaggaactacatcagcaacagcgcccagagcaatggagctgtggtgaaggagaagcagcccagcagcgccaagagcagcaacaagaacaagaagaacaaggacaaggagtactacgtgtag

SEQ ID NO: 161502 - DNA, 5139 bp, Artificial Sequence
  Description of Artificial Sequence: Synthetic coding sequence
atggccagcggcagccgctggaggcccaccccaccacccctgctgctgctgctgctgctggccctggccgcccgggcagatggcctggagtttggaggcggccctggccagtgggcccgctatgcccgctgggccggggccgccagcagcggggagctgtccttcagcctgcggaccaatgccacccgggccctgctgctgtacctggatgatggaggagactgtgacttcctggagctgctgctggtggatggccgcctgcggctgcgcttcaccctgagctgtgccgagcccgccaccctgcagctggacacccctgtggctgatgaccgctggcacatggtgctgctgaccagagatgcccggaggacagccctggccgtggatggagaggcccgggctgctgaggtgcgcagcaagagaagagagatgcaggtggccagtgacctgtttgtgggcggcatccccccagatgtgcggctgagcgccctgaccctgagcacagtgaagtatgagccccccttccggggcctgctggccaacctgaagctgggggagcggcccccagccctgctgggcagccagggcctgcggggggccacagctgaccccctgtgtgccccagccaggaacccctgtgccaatggaggcctgtgcaccgtgctggcccctggagaggtgggctgtgactgcagccacacaggctttggaggcaagttctgcagcgaggaggagcaccccatggagggccctgcccacctgaccctgaacagcgaggtgggcagcctgctcttcagcgagggcggggccggccggggcggcgctggagatgtgcaccagcccaccaagggcaaggaggagtttgtggccaccttcaagggaaatgagttcttctgctatgacctgagccacaaccccatccagagcagcacagatgagatcaccctggccttccgcaccctgcagagaaatggcctgatgctgcacacaggcaagtctgctgactatgtgaacctgagcctgaagtctggagctgtgtggctggtgatcaacctgggcagcggggcctttgaggccctggtggagcctgtgaatggcaagttcaatgacaatgcctggcatgatgtgcgggtgaccaggaacctgcggcagcacgccggcatcggccacgccatggtgaacaagctgcactacctggtgaccatctctgtggatggcatcctgaccaccaccggctacacccaggaggactacaccatgctgggcagtgatgacttcttctacatcggcggcagccccaacacagctgacctgcccggcagccctgtgagcaacaacttcatgggctgcctgaaggatgtggtgtacaagaacaatgacttcaagctggagctgagccggctggccaaggagggggaccccaagatgaagctgcagggcgacctgtccttccgctgtgaagatgtggccgccctggaccctgtgacctttgagagccctgaggcctttgtggccctgccccgctggagcgccaagaggacaggcagcatcagcctggacttccgcaccacagagcccaacggcctgctgctcttcagccagggccggcgggccggcggcggggccggcagccacagcagcgcccagagagctgactactttgccatggagctgctggatggccacctgtacctgctgctggacatgggcagcggcggcatcaagctgcgggccagcagcaggaaggtgaatgatggagagtggtgccacgtggacttccagagagatggcaggaagggcagcatctctgtgaacagccgcagcacccccttcctggccaccggggacagcgagatcctggacctggagagcgagctgtacctgggcggcctgcctgagggcggccgggtggacctgcccctgcccccagaggtgtggacagctgccctgcgggccggctacgtgggctgtgtgcgggacctcttcattgatggccgcagccgggacctgcggggcctggccgaggcccagggcgctgtgggcgtggcccccttctgcagccgggagaccctgaagcagtgtgccagcgccccctgcagaaatggaggagtgtgccgggagggctggaaccgcttcatctgtgactgcattggaacaggcttcctgggccgggtgtgtgagcgggaggccaccgtgctgtcctatgatggctccatgtacatgaagatcatgctgcccaatgccatgcacacagaagcagaagatgtgtccctgcgcttcatgagccagagggcctacggcctgatgatggccaccaccagccgggagagcgctgacaccctgcggctggagctggatggcggccagatgaagctgactgtgaacctggactgcctgcgggtgggctgtgcccccagcaaaggacctgagaccctgtttgctggccacaagctgaatgacaatgagtggcacacagtgcgggtggtgcggcggggcaagagcctgcagctgtctgtggacaacgtgacagtggagggccagatggccggggcccacatgaggctggagttccacaacatcgagaccggcatcatgacagagcggcgcttcatctctgtggtgcccagcaacttcatcggccacctgagcggcctggtgttcaacggccagccctacatggaccagtgcaaggatggagacatcacctactgtgagctgaatgcccgcttcggcctgcgggccatcgtggccgaccctgtgaccttcaagagccgcagcagctacctggccctggccaccctgcaggcctatgcctccatgcacctgttcttccagttcaagaccacagccccagatggcctgctgctcttcaacagcggaaatggaaatgacttcatcgtcatcgagctggtgaagggctacatccactacgtgtttgacctgggcaatggccccagcctgatgaagggcaacagcgacaagcctgtgaatgacaaccagtggcacaacgtggtggtgtcccgggaccctggaaatgtgcacaccctgaagattgacagcaggacagtgacccagcacagcaatggagccaggaacctggacctgaagggggagctgtacatcggcggcctgagcaagaacatgttcagcaacctgcccaagctggtggccagcagagatggcttccagggctgcctggcctctgtggacctgaatggccgcctgcctgacctgattgctgatgccctgcaccgcatcggccaggtggagcggggctgtgatggccccagcaccacctgcacagaggagagctgtgccaaccagggcgtgtgcctgcagcagtgggatggcttcacctgtgactgcaccatgaccagctatggaggccctgtgtgcaatgaccccggcaccacctacatctttggaaaaggaggagccctgatcacctacacctggcccccaaatgaccggcccagcaccaggatggaccggctggccgtgggcttcagcacccaccagaggtctgctgtgctggtgcgggtggacagcgccagcggcctgggggactacctgcagctgcacatcgaccagggcaccgtgggcgtcatcttcaacgtgggcacagatgacatcaccattgatgagcccaatgccatcgtgtctgatggcaagtaccacgtggtgcgcttcaccaggtctggaggaaatgccaccctgcaggtggacagctggcctgtgaatgaaagatacccagctggcaactttgacaatgaaaggctggccatcgcccggcagaggatcccctaccgcctgggccgggtggtggatgagtggctgctggacaagggccggcagctgaccatcttcaacagccaggccgccatcaagattggaggccgggaccagggccggcccttccagggccaggtgtctggcctgtactacaacggcctgaaggtgctggccctggccgctgagagtgaccccaacgtgaggacagagggccacctgcggctggtgggggagggccccagcgtgctgctgtctgctgagaccacagccaccaccctgctggccgacatggccaccaccatcatggagaccaccaccaccatggccaccaccaccacccggcggggccgcagccccaccctgcgggacagcaccacccagaacacagatgacctgctggtggccagcgctgagtgccccagtgatgatgaggacctggaggagtgtgagcccagcactggaggagagctgatcctgcccatcatcacagaggacagcctggaccccccacctgtggccaccaggagcccctttgtgcccccaccacccaccttctaccccttcctgactggagtgggcgccacccaggacaccctgcccccacctgctgcccggcggcccccatctgggggcccctgccaggccgagagagatgacagcgactgtgaggagcccatcgaggccagcggctttgccagcggggaggtgtttgacagcagcctgcccccaacagatgatgaggacttctacaccaccttccccctggtgacagacaggaccaccctgctgagccccaggaagccagccccccggcccaacctgaggacagatggagccaccggggcccctggggtgctgtttgcccccagcgccccagcccccaacctgcctgctgggaagatgaaccaccgggaccccctgcagcccctgctggagaacccccccctgggccctggggcccccaccagctttgagccccggcggcccccacccctgcggcctggggtgaccagcgcccctggcttcccccacctgcccacagccaaccccactggacctggagagcggggccccccaggagctgtggaggtgatccgggagagcagcagcaccaccggcatggtggtgggcatcgtggccgccgccgccctgtgcatcctgatcctgctgtatgccatgtacaagtacagaaacagagatgagggcagctaccaggtggaccagagcaggaactacatcagcaacagcgcccagagcaatggagctgtggtgaaggagaaggccccagctgcccccaagacccccagcaaggccaagaagaacaaggacaaggagtactacgtgtag

SEQ ID NO: 161503 - DNA, 4929 bp, Artificial Sequence
  Description of Artificial Sequence: Synthetic coding sequence
atggccagcggcagccgctggaggcccaccccaccacccctgctgctgctgctgctgctggccctggccgcccgggcagatggcctggagtttggaggcggccctggccagtgggcccgctatgcccgctgggccggggccgccagcagcggggagctgtccttcagcctgcggaccaatgccacccgggccctgctgctgtacctggatgatggaggagactgtgacttcctggagctgctgctggtggatggccgcctgcggctgcgcttcaccctgagctgtgccgagcccgccaccctgcagctggacacccctgtggctgatgaccgctggcacatggtgctgctgaccagagatgcccggaggacagccctggccgtggatggagaggcccgggctgctgaggtgcgcagcaagagaagagagatgcaggtggccagtgacctgtttgtgggcggcatccccccagatgtgcggctgagcgccctgaccctgagcacagtgaagtatgagccccccttccggggcctgctggccaacctgaagctgggggagcggcccccagccctgctgggcagccagggcctgcggggggccacagctgaccccctgtgtgccccagccaggaacccctgtgccaatggaggcctgtgcaccgtgctggcccctggagaggtgggctgtgactgcagccacacaggctttggaggcaagttctgcagcgaggcccccagccccttccagggccctgcccacctgaccctgaacagcgagggcaaggaggagtttgtggccaccttcaagggaaatgagttcttctgctatgacctgagccacaaccccatccagagcagcacagatgagatcaccctggccttccgcaccctgcagagaaatggcctgatgctgcacacaggcaagtctgctgactatgtgaacctgagcctgaagtctggagctgtgtggctggtgatcaacctgggcagcggggcctttgaggccctggtggagcctgtgaatggcaagttcaatgacaatgcctggcatgatgtgcgggtgaccaggaacctgcggcagcacgccggcatcggccacgccatggtgaccatctctgtggatggcatcctgaccaccaccggctacacccaggaggactacaccatgctgggcagtgatgacttcttctacatcggcggcagccccaacacagctgacctgcccggcagccctgtgagcaacaacttcatgggctgcctgaaggatgtggtgtacaagaacaatgacttcaagctggagctgagccggctggccaaggagggggaccccaagatgaagctgcagggcgacctgtccttccgctgtgaagatgtggccgccctggaccctgtgacctttgagagccctgaggcctttgtggccctgccccgctggagcgccaagaggacaggcagcatcagcctggacttccgcaccacagagcccaacggcctgctgctcttcagccagggcagaagagctgggggcggggccggcagccacagcagcgcccagagagctgactactttgccatggagctgctggatggccacctgtacctgctgctggacatgggcagcggcggcatcaagctgcgggccagcagcaggaaggtgaatgatggagagtggtgccacgtggacttccagagagatggcaggaagggcagcatctctgtgaacagccgcagcacccccttcctggccactggagacagcgagatcctggacctggagagcgagctgtacctgggcggcctgcctgagggcggccgggtggacctgcccctgcccccagaggtgtggacagctgccctgcgggccggctacgtgggctgtgtgcgggacctcttcattgatggccgcagccgggacctgcggggcctggccgaggcccagggcgctgtgggcgtggcccccttctgcagccgggagaccctgaagcagtgtgccagcgccccctgcagaaatggaggagtgtgccgggagggctggaaccgcttcatctgtgactgcatcggcaccggcttcctgggccgggtgtgtgagcgggaggccaccgtgctgtcctatgatggctccatgtacatgaagatcatgctgcccaatgccatgcacacagaagcagaagatgtgtccctgcgcttcatgagccagagggcctacggcctgatgatggccaccaccagccgggagagcgctgacaccctgcggctggagctggatggcggccagatgaagctgactgtgaacctgggcaaaggacctgagaccctgtttgctggccacaagctgaatgacaatgagtggcacacagtgcgggtggtgcggcggggcaagagcctgcagctgtctgtggacaacgtgacagtggagggccagatggccggggcccacatgaggctggagttccacaacatcgagaccggcatcatgacagagcggcgcttcatctctgtggtgcccagcaacttcatcggccacctgagcggcctggtgttcaacggccagccctacatggaccagtgcaaggatggagacatcacctactgtgagctgaatgcccgcttcggcctgcgggccatcgtggccgaccctgtgaccttcaagagccgcagcagctacctggccctggccaccctgcaggcctatgcctccatgcacctgttcttccagttcaagaccacagccccagatggcctgctgctcttcaacagcggaaatggaaatgacttcatcgtcatcgagctggtgaagggctacatccactacgtgtttgacctgggcaatggccccagcctgatgaagggcaacagcgacaagcctgtgaatgacaaccagtggcacaacgtggtggtgtcccgggaccctggaaatgtgcacaccctgaagattgacagcaggacagtgacccagcacagcaatggagccaggaacctggacctgaagggggagctgtacatcggcggcctgagcaagaacatgttcagcaacctgcccaagctggtggccagcagagatggcttccagggctgcctggcctctgtggacctgaatggccgcctgcctgacctgattgctgatgccctgcaccgcatcggccaggtggagcggggctgtgatggccccagcaccacctgcacagaggagagctgtgccaaccagggcgtgtgcctgcagcagtgggatggcttcacctgtgactgcaccatgaccagctatggaggccctgtgtgcaatgaccccggcaccacctacatctttggaaaaggaggagccctgatcacctacacctggcccccaaatgaccggcccagcaccaggatggaccggctggccgtgggcttcagcacccaccagaggtctgctgtgctggtgcgggtggacagcgccagcggcctgggggactacctgcagctgcacatcgaccagggcaccgtgggcgtcatcttcaacgtgggcacagatgacatcaccattgatgagcccaatgccatcgtgtctgatggcaagtaccacgtggtgcgcttcaccaggtctggaggaaatgccaccctgcaggtggacagctggcctgtgaatgaaagatacccagctggccggcagctgaccatcttcaacagccaggccgccatcaagattggaggccgggaccagggccggcccttccagggccaggtgtctggcctgtactacaacggcctgaaggtgctggccctggccgctgagagtgaccccaacgtgaggacagagggccacctgcggctggtgggggagggccccagcgtgctgctgtctgctgagaccacagccaccaccctgctggccgacatggccaccaccatcatggagaccaccaccaccatggccaccaccaccacccggcggggccgcagccccaccctgcgggacagcaccacccagaacacagatgacctgctggtggccagcgctgagtgccccagtgatgatgaggacctggaggagtgtgagcccagcactggaggagagctgatcctgcccatcatcacagaggacagcctggaccccccacctgtggccaccaggagcccctttgtgcccccaccacccaccttctaccccttcctgactggagtgggcgccacccaggacaccctgcccccacctgctgcccggcggcccccatctgggggcccctgccaggccgagagagatgacagcgactgtgaggagcccatcgaggccagcggctttgccagcggggaggtgtttgacagcagcctgcccccaacagatgatgaggacttctacaccaccttccccctggtgacagacaggaccaccctgctgagccccaggaagccagccccccggcccaacctgaggacagatggagccaccggggcccctggggtgctgtttgcccccagcgccccagcccccaacctgcctgctgggaagatgaaccaccgggaccccctgcagcccctgctggagaacccccccctgggccctggggcccccaccagctttgagccccggcggcccccacccctgcggcctggggtgaccagcgcccctggcttcccccacctgcccacagccaaccccactggacctggagagcggggccccccaggagctgtggaggtgatccgggagagcagcagcaccaccggcatggtggtgggcatcgtggccgccgccgccctgtgcatcctgatcctgctgtatgccatgtacaagtacagaaacagagatgagggcagctaccaggtggaccagagcaggaactacatcagcaacagcgcccagagcaatggagctgtggtgaaggagaaggccccagctgcccccaagacccccagcaaggccaagaagaacaaggacaaggagtactacgtgtag

SEQ ID NO: 161504 - DNA, 5139 bp, Artificial Sequence; identical to SEQ ID NO: 161502
  Description of Artificial Sequence: Synthetic coding sequence

SEQ ID NO: 161505 - DNA, 4929 bp, Artificial Sequence
  Description of Artificial Sequence: Synthetic coding sequence
atggccagcggcagccgctggaggcccaccccaccacccctgctgctgctgctgctgctggccctggccgcccgggcagatggcctggagtttggaggcggccctggccagtgggcccgctatgcccgctgggccggggccgccagcagcggggagctgtccttcagcctgcggaccaatgccacccgggccctgctgctgtacctggatgatggaggagactgtgacttcctggagctgctgctggtggatggccgcctgcggctgcgcttcaccctgagctgtgccgagcccgccaccctgcagctggacacccctgtggctgatgaccgctggcacatggtgctgctgaccagagatgcccggaggacagccctggccgtggatggagaggcccgggctgctgaggtgcgcagcaagagaagagagatgcaggtggccagtgacctgtttgtgggcggcatccccccagatgtgcggctgagcgccctgaccctgagcacagtgaagtatgagccccccttccggggcctgctggccaacctgaagctgggggagcggcccccagccctgctgggcagccagggcctgcggggggccacagctgaccccctgtgtgccccagccaggaacccctgtgccaatggaggcctgtgcaccgtgctggcccctggagaggtgggctgtgactgcagccacacaggctttggaggcaagttctgcagcgaggaggagcaccccatggagggccctgcccacctgaccctgaacagcgagggcaaggaggagtttgtggccaccttcaagggaaatgagttcttctgctatgacctgagccacaaccccatccagagcagcacagatgagatcaccctggccttccgcaccctgcagagaaatggcctgatgctgcacacaggcaagtctgctgactatgtgaacctgagcctgaagtctggagctgtgtggctggtgatcaacctgggcagcggggcctttgaggccctggtggagcctgtgaatggcaagttcaatgacaatgcctggcatgatgtgcgggtgaccaggaacctgcggcagcacgccggcatcggccacgccatggtgaccatctctgtggatggcatcctgaccaccaccggctacacccaggaggactacaccatgctgggcagtgatgacttcttctacatcggcggcagccccaacacagctgacctgcccggcagccctgtgagcaacaacttcatgggctgcctgaaggatgtggtgtacaagaacaatgacttcaagctggagctgagccggctggccaaggagggggaccccaagatgaagctgcagggcgacctgtccttccgctgtgaagatgtggccgccctggaccctgtgacctttgagagccctgaggcctttgtggccctgccccgctggagcgccaagaggacaggcagcatcagcctggacttccgcaccacagagcccaacggcctgctgctcttcagccagggcagaagagctgggggcggggccggcagccacagcagcgcccagagagctgactactttgccatggagctgctggatggccacctgtacctgctgctggacatgggcagcggcggcatcaagctgcgggccagcagcaggaaggtgaatgatggagagtggtgccacgtggacttccagagagatggcaggaagggcagcatctctgtgaacagccgcagcacccccttcctggccactggagacagcgagatcctggacctggagagcgagctgtacctgggcggcctgcctgagggcggccgggtggacctgcccctgcccccagaggtgtggacagctgccctgcgggccggctacgtgggctgtgtgcgggacctcttcattgatggccgcagccgggacctgcggggcctggccgaggcccagggcgctgtgggcgtggcccccttctgcagccgggagaccctgaagcagtgtgccagcgccccctgcagaaatggaggagtgtgccgggagggctggaaccgcttcatctgtgactgcatcggcaccggcttcctgggccgggtgtgtgagcgggaggccaccgtgctgtcctatgatggctccatgtacatgaagatcatgctgcccaatgccatgcacacagaagcagaagatgtgtccctgcgcttcatgagccagagggcctacggcctgatgatggccaccaccagccgggagagcgctgacaccctgcggctggagctggatggcggccagatgaagctgactgtgaacctgggcaaaggacctgagaccctgtttgctggccacaagctgaatgacaatgagtggcacacagtgcgggtggtgcggcggggcaagagcctgcagctgtctgtggacaacgtgacagtggagggccagatggccggggcccacatgaggctggagttccacaacatcgagaccggcatcatgacagagcggcgcttcatctctgtggtgcccagcaacttcatcggccacctgagcggcctggtgttcaacggccagccctacatggaccagtgcaaggatggagacatcacctactgtgagctgaatgcccgcttcggcctgcgggccatcgtggccgaccctgtgaccttcaagagccgcagcagctacctggccctggccaccctgcaggcctatgcctccatgcacctgttcttccagttcaagaccacagccccagatggcctgctgctcttcaacagcggaaatggaaatgacttcatcgtcatcgagctggtgaagggctacatccactacgtgtttgacctgggcaatggccccagcctgatgaagggcaacagcgacaagcctgtgaatgacaaccagtggcacaacgtggtggtgtcccgggaccctggaaatgtgcacaccctgaagattgacagcaggacagtgacccagcacagcaatggagccaggaacctggacctgaagggggagctgtacatcggcggcctgagcaagaacatgttcagcaacctgcccaagctggtggccagcagagatggcttccagggctgcctggcctctgtggacctgaatggccgcctgcctgacctgattgctgatgccctgcaccgcatcggccaggtggagcggggctgtgatggccccagcaccacctgcacagaggagagctgtgccaaccagggcgtgtgcctgcagcagtgggatggcttcacctgtgactgcaccatgaccagctatggaggccctgtgtgcaatgaccccggcaccacctacatctttggaaaaggaggagccctgatcacctacacctggcccccaaatgaccggcccagcaccaggatggaccggctggccgtgggcttcagcacccaccagaggtctgctgtgctggtgcgggtggacagcgccagcggcctgggggactacctgcagctgcacatcgaccagggcaccgtgggcgtcatcttcaacgtgggcacagatgacatcaccattgatgagcccaatgccatcgtgtctgatggcaagtaccacgtggtgcgcttcaccaggtctggaggaaatgccaccctgcaggtggacagctggcctgtgaatgaaagatacccagctggccggcagctgaccatcttcaacagccaggccgccatcaagattggaggccgggaccagggccggcccttccagggccaggtgtctggcctgtactacaacggcctgaaggtgctggccctggccgctgagagtgaccccaacgtgaggacagagggccacctgcggctggtgggggagggccccagcgtgctgctgtctgctgagaccacagccaccaccctgctggccgacatggccaccaccatcatggagaccaccaccaccatggccaccaccaccacccggcggggccgcagccccaccctgcgggacagcaccacccagaacacagatgacctgctggtggccagcgctgagtgccccagtgatgatgaggacctggaggagtgtgagcccagcactggaggagagctgatcctgcccatcatcacagaggacagcctggaccccccacctgtggccaccaggagcccctttgtgcccccaccacccaccttctaccccttcctgactggagtgggcgccacccaggacaccctgcccccacctgctgcccggcggcccccatctgggggcccctgccaggccgagagagatgacagcgactgtgaggagcccatcgaggccagcggctttgccagcggggaggtgtttgacagcagcctgcccccaacagatgatgaggacttctacaccaccttccccctggtgacagacaggaccaccctgctgagccccaggaagccagccccccggcccaacctgaggacagatggagccaccggggcccctggggtgctgtttgcccccagcgccccagcccccaacctgcctgctgggaagatgaaccaccgggaccccctgcagcccctgctggagaacccccccctgggccctggggcccccaccagctttgagccccggcggcccccacccctgcggcctggggtgaccagcgcccctggcttcccccacctgcccacagccaaccccactggacctggagagcggggccccccaggagctgtggaggtgatccgggagagcagcagcaccaccggcatggtggtgggcatcgtggccgccgccgccctgtgcatcctgatcctgctgtatgccatgtacaagtacagaaacagagatgagggcagctaccaggtggaccagagcaggaactacatcagcaacagcgcccagagcaatggagctgtggtgaaggagaaggccccagctgcccccaagacccccagcaaggccaagaagaacaaggacaaggagtactacgtgtag

SEQ ID NO: 161506 - DNA, 5118 bp, Artificial Sequence
  Description of Artificial Sequence: Synthetic coding sequence
atggccagcggcagccgctggaggcccaccccaccacccctgctgctgctgctgctgctggccctggccgcccgggcagatggcctggagtttggaggcggccctggccagtgggcccgctatgcccgctgggccggggccgccagcagcggggagctgtccttcagcctgcggaccaatgccacccgggccctgctgctgtacctggatgatggaggagactgtgacttcctggagctgctgctggtggatggccgcctgcggctgcgcttcaccctgagctgtgccgagcccgccaccctgcagctggacacccctgtggctgatgaccgctggcacatggtgctgctgaccagagatgcccggaggacagccctggccgtggatggagaggcccgggctgctgaggtgcgcagcaagagaagagagatgcaggtggccagtgacctgtttgtgggcggcatccccccagatgtgcggctgagcgccctgaccctgagcacagtgaagtatgagccccccttccggggcctgctggccaacctgaagctgggggagcggcccccagccctgctgggcagccagggcctgcggggggccacagctgaccccctgtgtgccccagccaggaacccctgtgccaatggaggcctgtgcaccgtgctggcccctggagaggtgggctgtgactgcagccacacaggctttggaggcaagttctgcagcgaggaggagcaccccatggagggccctgcccacctgaccctgaacagcgaggtgggcagcctgctcttcagcgagggcggggccggccggggcggcgctggagatgtgcaccagcccaccaagggcaaggaggagtttgtggccaccttcaagggaaatgagttcttctgctatgacctgagccacaaccccatccagagcagcacagatgagatcaccctggccttccgcaccctgcagagaaatggcctgatgctgcacacaggcaagtctgctgactatgtgaacctgagcctgaagtctggagctgtgtggctggtgatcaacctgggcagcggggcctttgaggccctggtggagcctgtgaatggcaagttcaatgacaatgcctggcatgatgtgcgggtgaccaggaacctgcggcagcacgccggcatcggccacgccatggtgaccatctctgtggatggcatcctgaccaccaccggctacacccaggaggactacaccatgctgggcagtgatgacttcttctacatcggcggcagccccaacacagctgacctgcccggcagccctgtgagcaacaacttcatgggctgcctgaaggatgtggtgtacaagaacaatgacttcaagctggagctgagccggctggccaaggagggggaccccaagatgaagctgcagggcgacctgtccttccgctgtgaagatgtggccgccctggaccctgtgacctttgagagccctgaggcctttgtggccctgccccgctggagcgccaagaggacaggcagcatcagcctggacttccgcaccacagagcccaacggcctgctgctcttcagccagggcagaagagctgggggcggggccggcagccacagcagcgcccagagagctgactactttgccatggagctgctggatggccacctgtacctgctgctggacatgggcagcggcggcatcaagctgcgggccagcagcaggaaggtgaatgatggagagtggtgccacgtggacttccagagagatggcaggaagggcagcatctctgtgaacagccgcagcacccccttcctggccactggagacagcgagatcctggacctggagagcgagctgtacctgggcggcctgcctgagggcggccgggtggacctgcccctgcccccagaggtgtggacagctgccctgcgggccggctacgtgggctgtgtgcgggacctcttcattgatggccgcagccgggacctgcggggcctggccgaggcccagggcgctgtgggcgtggcccccttctgcagccgggagaccctgaagcagtgtgccagcgccccctgcagaaatggaggagtgtgccgggagggctggaaccgcttcatctgtgactgcatcggcaccggcttcctgggccgggtgtgtgagcgggaggccaccgtgctgtcctatgatggctccatgtacatgaagatcatgctgcccaatgccatgcacacagaagcagaagatgtgtccctgcgcttcatgagccagagggcctacggcctgatgatggccaccaccagccgggagagcgctgacaccctgcggctggagctggatggcggccagatgaagctgactgtgaacctggactgcctgcgggtgggctgtgcccccagcaagggccctgagaccctgtttgctggccacaagctgaatgacaatgagtggcacacagtgcgggtggtgagaagaggcaagagcctgcagctgtctgtggacaacgtgacagtggagggccagatggccggggcccacatgaggctggagttccacaacattgaaacaggcatcatgacagaaagacgcttcatctctgtggtgcccagcaacttcatcggccacctgagcggcctggtgttcaacggccagccctacatggaccagtgcaaggatggagacatcacctactgtgagctgaatgccaggtttggcctgcgggccatcgtggccgaccctgtgaccttcaagagccgcagcagctacctggccctggccaccctgcaggcctatgcctccatgcacctgttcttccagttcaagaccacagccccagatggcctgctgctcttcaacagcggaaatggaaatgacttcatcgtgattgagctggtgaagggctacatccactacgtgtttgacctgggcaatggccccagcctgatgaagggcaacagcgacaagcctgtgaatgacaaccagtggcacaacgtggtggtgtcccgggaccctggaaatgtgcacaccctgaagattgacagcaggacagtgacccagcacagcaatggagccaggaacctggacctgaagggggagctgtacatcggcggcctgagcaagaacatgttcagcaacctgcccaagctggtggccagcagagatggcttccagggctgcctggcctctgtggacctgaatggccgcctgcctgacctgattgctgatgccctgcacagaattggccaggtggagcggggctgtgatggccccagcaccacctgcacagaggagagctgtgccaaccagggcgtgtgcctgcagcagtgggatggcttcacctgtgactgcaccatgaccagctatggaggccctgtgtgcaatgaccccggcaccacctacatctttgggaagggcggggccctgatcacctacacctggcccccaaatgaccggcccagcaccaggatggaccggctggccgtgggcttcagcacccaccagaggtctgctgtgctggtgcgggtggacagcgccagcggcctgggggactacctgcagctgcacatcgaccagggcaccgtgggcgtcatcttcaacgtgggcacagatgacatcaccattgatgagcccaatgccatcgtgtctgatggcaagtaccacgtggtgcgcttcaccaggtctggaggaaatgccaccctgcaggtggacagctggcctgtgaatgaaagatacccagctggcaactttgacaatgaaaggctggccatcgcccggcagaggatcccctaccgcctgggccgggtggtggatgagtggctgctggacaagggccggcagctgaccatcttcaacagccaggccgccatcaagattggaggccgggaccagggccggcccttccagggccaggtgtctggcctgtactacaacggcctgaaggtgctggccctggccgctgagagtgaccccaacgtgaggacagagggccacctgcggctggtgggggagggccccagcgtgctgctgtctgctgagaccacagccaccaccctgctggccgacatggccaccaccatcatggagaccaccaccaccatggccaccaccaccacccggcggggccgcagccccaccctgcgggacagcaccacccagaacacagatgacctgctggtggccagcgcagaatgtcccagtgatgatgaggacctggaggagtgtgagcccagcactggaggagagctgatcctgcccatcatcacagaggacagcctggaccccccacctgtggccaccaggagcccctttgtgcccccaccacccaccttctaccccttcctgactggagtgggcgccacccaggacaccctgcccccacctgctgcccggcggccccccagcggcggcccctgccaggccgagagagatgacagcgactgtgaggagcccatcgaggccagcggctttgccagcggggaggtgtttgacagcagcctgcccccaacagatgatgaggacttctacaccaccttccccctggtgacagacaggaccaccctgctgagccccaggaagccagccccccggcccaacctgaggacagatggagccactggagcccctggggtgctgtttgcccccagcgccccagcccccaacctgcctgctgggaagatgaaccaccgggaccccctgcagcccctgctggagaacccccccctgggccctggggcccccaccagctttgagccccggcggcccccacccctgcggcctggggtgaccagcgcccctggcttcccccacctgcccacagccaaccccaccggccctggagagcggggccccccaggagctgtggaggtgatccgggagagcagcagcaccaccggcatggtggtgggcatcgtggccgctgctgccctgtgcatcctgatcctgctgtatgccatgtacaagtacagaaacagagatgagggcagctaccaggtggaccagagcaggaactacatcagcaacagcgcccagagcaatggagctgtggtgaaggagaaggccccagctgcccccaagacccccagcaaggccaagaagaacaaggacaaggagtactacgtgtag

SEQ ID NO: 161507 - DNA, 2001 bp, Artificial Sequence
  Description of Artificial Sequence: Synthetic coding sequence
atgcctcctgggggcagcggccctgggggctgcccccggcggcccccagccctggccggccccctgcccccacctcctcctcctcctcctccacccctgctgcccctgctgcccctgctgctgctgctgctgctgggcgctgctgagggcgcccgggtgagcagcagcctgagcaccacccaccacgtgcaccacttccacagcaagcacggcaccgtgcccatcgccatcaacaggatgcccttcctgacccggggcggccatgctggcaccacctacatctttggaaaaggaggagccctgatcacctacacctggcccccaaatgaccggcccagcaccaggatggaccggctggccgtgggcttcagcacccaccagaggtctgctgtgctggtgcgggtggacagcgccagcggcctgggggactacctgcagctgcacatcgaccagggcaccgtgggcgtcatcttcaacgtgggcacagatgacatcaccattgatgagcccaatgccatcgtgtctgatggcaagtaccacgtggtgcgcttcaccaggtctggaggaaatgccaccctgcaggtggacagctggcctgtgaatgaaagatacccagctggcaactttgacaatgaaaggctggccatcgcccggcagaggatcccctaccgcctgggccgggtggtggatgagtggctgctggacaagggccggcagctgaccatcttcaacagccaggccgccatcaagattggaggccgggaccagggccggcccttccagggccaggtgtctggcctgtactacaacggcctgaaggtgctggccctggccgctgagagtgaccccaacgtgaggacagagggccacctgcggctggtgggggagggccccagcgtgctgctgtctgctgagaccacagccaccaccctgctggccgacatggccaccaccatcatggagaccaccaccaccatggccaccaccaccacccggcggggccgcagccccaccctgcgggacagcaccacccagaacacagatgacctgctggtggccagcgctgagtgccccagtgatgatgaggacctggaggagtgtgagcccagcactggaggagagctgatcctgcccatcatcacagaggacagcctggaccccccacctgtggccaccaggagcccctttgtgcccccaccacccaccttctaccccttcctgactggagtgggcgccacccaggacaccctgcccccacctgctgcccggcggcccccatctgggggcccctgccaggccgagagagatgacagcgactgtgaggagcccatcgaggccagcggctttgccagcggggaggtgtttgacagcagcctgcccccaacagatgatgaggacttctacaccaccttccccctggtgacagacaggaccaccctgctgagccccaggaagccagccccccggcccaacctgaggacagatggagccaccggggcccctggggtgctgtttgcccccagcgccccagcccccaacctgcctgctgggaagatgaaccaccgggaccccctgcagcccctgctggagaacccccccctgggccctggggcccccaccagctttgagccccggcggcccccacccctgcggcctggggtgaccagcgcccctggcttcccccacctgcccacagccaaccccactggacctggagagcggggccccccaggagctgtggaggtgatccgggagagcagcagcaccaccggcatggtggtgggcatcgtggccgccgccgccctgtgcatcctgatcctgctgtatgccatgtacaagtacagaaacagagatgagggcagctaccaggtggaccagagcaggaactacatcagcaacagcgcccagagcaatggagctgtggtgaaggagaaggccccagctgcccccaagacccccagcaaggccaagaagaacaaggacaaggagtactacgtgtag

SEQ ID NO: 161508 - DNA, 1299 bp, Artificial Sequence
  Description of Artificial Sequence: Synthetic coding sequence
atgcacctgcgcatccacgcccggcgcagccccccaagaagacctgcctggaccctgggcatctggttcctgttctggggctgcatcgtgtcctctgtgtggagcagcagcaatgtggccagcagcagcagcaccagcagcagccctggcagccacagccagcacgagcaccacttccacggcagcaagcaccacagcgtgcccatcagcatctaccgcagccctgtgtccctgcggggcggccatgctggggccacctacatctttgggaagagcggcggcctcatcctgtacacctggccagccaatgaccggcccagcaccaggagtgaccggctggccgtgggcttcagcaccaccgtgaaggatggcatcctggtgagaattgattctgcccctggcctgggggacttcctgcagctgcacatcgagcagggcaagattggagtggtgttcaacatcggcaccgtggacatcagcatcaaggaggagaggacccctgtgaatgatggcaagtaccacgtggtgcgcttcaccagaaatggaggaaatgccaccctgcaggtggacaactggcctgtgaatgagcactaccccaccggccggcagctgaccatcttcaacacccaggcccagatcgccatcggcggcaaggacaagggccgcctcttccagggccagctgagcggcctgtactatgatggcctgaaggtgctgaacatggctgctgagaacaaccccaacatcaagatcaatggatctgtgcggctggtgggggaggtgcccagcatcctgggcaccacccagaccacctccatgcctcctgagatgagcaccaccgtgatggagaccaccaccaccatggccaccaccaccaccaggaagaacagaagcacagccagcatccagcccaccagtgatgacctggtgagcagcgctgagtgcagcagtgatgatgaggactttgtggagtgtgagcccagcacaggccgcagcgccaaccccacagagcccggcatcagaagagtgcctggggccagcgaggtgatccgggagagcagcagcaccaccggcatggtggtgggcatcgtggccgctgctgccctgtgcatcctgatcctgctgtatgccatgtacaagtacagaaacagagatgagggcagctaccaggtggatgagaccaggaactacatcagcaacagcgcccagagcaatggcaccctgatgaaggagaagcagcagagcagcaagagcggccacaagaagcagaagaacaaggaccgggagtactacgtgtag

SEQ ID NO: 161509 - DNA, 4932 bp, Artificial Sequence
  Description of Artificial Sequence: Synthetic coding sequence
atgagcagcaccctgcacagcgtcttcttcaccctgaaggtgtccatcctgctgggcagcctgctgggcctgtgcctgggcctggagttcatgggcctgcccaaccagtgggcccgctacctgcgctgggatgccagcaccaggagtgacctgtccttccagttcaagaccaacgtgtccacaggcctgctgctgtacctggatgatggaggagtgtgtgacttcctgtgcctgagcctggtggatggccgggtgcagctgcgcttctccatggactgtgccgagacagctgtgctgagcaacaagcaggtgaatgacagctcctggcacttcctgatggtgtcccgggaccggctgaggacagtgctgatgctggatggagagggccagagcggggagctgcagccccagaggccctacatggatgtggtgtctgacctcttcctgggcggcgtgcccacagacatccggcccagcgccctgaccctggatggagtgcaggccatgcctggcttcaagggcctcatcctggacctgaagtatggcaacagcgagccccggctgctgggcagcagaggagtgcagatggatgctgagggcccctgtggggagcggccctgtgaaaatggaggcatctgcttcctgctggatggccaccccacctgtgactgcagcaccaccggctatggaggcaagctgtgcagcgagggcagcagcggggacccctgcctgagccacctgatgatgtctgagcaggcccgggaggagaatgtggccaccttccggggcagcgagtacctgtgctatgacctgagccagaaccccatccagagcagcagtgatgagatcaccctgtccttcaagacctggcagagaaatggcctcatcctgcacacaggcaagtctgctgactatgtgaacctggccctgaaggatggagctgtgtccctggtgatcaacctgggcagcggggcctttgaggccatcgtggagcctgtgaatggcaagttcaatgacaatgcctggcatgatgtgaaggtgaccaggaacctgcggcaggtgaccatctctgtggatggcatcctgaccaccaccggctacacccaggaggactacaccatgctgggcagtgatgacttcttctacgtgggcggcagccccagcacagctgacctgcccggcagccctgtgagcaacaacttcatgggctgcctgaaggaggtggtgtacaagaacaatgacatccggctggagctgagccggctggccagaattgctgacaccaagatgaagatctatggagaggtggtgttcaagtgtgaaaatgtggccaccctggaccccatcaactttgagaccccagaggcctacatcagcctgcccaagtggaacaccaagaggatgggcagcatcagctttgacttccgcaccacagagcccaacggcctcatcctcttcacccacggcaagccccaggagaggaaggatgcccggagccagaagaacaccaaggtggacttctttgctgtggagctgctggatggcaacctgtacctgctgctggacatgggcagcggcaccatcaaggtgaaggccacccagaagaaggccaatgatggagagtggtaccacgtggacatccagagagatggccgcagcggcaccatctctgtgaacagcaggaggacccccttcaccgccagcggggagagcgagatcctggacctggagggggacatgtacctgggcggcctgcctgaaaatagagctggcctcatcctgcccacagagctgtggacagccatgctgaactacggctacgtgggctgcatccgggacctcttcattgatggccgcagcaagaacatccggcagctggccgagatgcagaatgctgctggggtgaagagcagctgcagcaggatgtctgccaagcagtgtgacagctacccctgcaagaacaatgctgtgtgcaaggatggctggaaccgcttcatctgtgactgcaccggcaccggctactggggccgcacctgtgagcgggaggccagcatcctgtcctatgatggctccatgtacatgaagatcatcatgcccatggtgatgcacacagaagcagaagatgtgtccttccgcttcatgagccagagggcctacggcctgctggtggccaccaccagccgggacagcgctgacaccctgcggctggagctggatggcggccgggtgaagctgatggtgaacctggactgcatccgcatcaactgcaacagcagcaagggccctgagaccctgtatgccggccagaagctgaatgacaatgagtggcacacagtgcgggtggtgagaagaggcaagagcctgaagctgactgtggatgatgatgtggccgagggcaccatggtgggggaccacacccggctggagttccacaacattgaaacaggcatcatgacagagaagcgctacatctctgtggtgcccagcagcttcatcggccacctgcagagcctgatgtttaatggcctgctgtacatcgacctgtgcaagaatggagacatcgactactgtgagctgaaggccaggtttggcctgaggaacatcatcgctgaccctgtgaccttcaagaccaagagcagctacctgagcctggccaccctgcaggcctacacctccatgcacctgttcttccagttcaagaccaccagcccagatggcttcatcctcttcaacagcggagatggaaatgacttcatcgctgtggagctggtgaagggctacatccactacgtgtttgacctgggcaatggccccaacgtcatcaagggcaacagcgaccggcccctgaatgacaaccagtggcacaacgtggtgatcacccgggacaacagcaacacccacagcctgaaggtggacaccaaggtggtgacccaggtgatcaatggagccaagaacctggacctgaagggggacctgtacatggccggcctggcccagggcatgtacagcaacctgcccaagctggtggccagcagagatggcttccagggctgcctggcctctgtggacctgaatggccgcctgcctgacctgatcaatgatgccctgcacaggagcggccagatcgagcggggctgtgagggccccagcaccacctgccaggaggacagctgtgccaaccagggcgtgtgcatgcagcagtgggagggcttcacctgtgactgcagcatgaccagctacagcggcaaccagtgcaatgaccccggggccacctacatctttgggaagagcggcggcctcatcctgtacacctggccagccaatgaccggcccagcaccaggagtgaccggctggccgtgggcttcagcaccaccgtgaaggatggcatcctggtgagaattgacagcgcccctggcctgggggacttcctgcagctgcacatcgagcagggcaagattggagtggtgttcaacattggaacagtggacatcagcatcaaggaggagaggacccctgtgaatgatggcaagtaccacgtggtgcgcttcaccagaaatggaggaaatgccaccctgcaggtggacaactggcctgtgaatgagcactaccccaccggccggcagctgaccatcttcaacacccaggcccagatcgccatcggcggcaaggacaagggccgcctcttccagggccagctgagcggcctgtactatgatggcctgaaggtgctgaacatggctgctgagaacaaccccaacatcaagatcaatggatctgtgcggctggtgggggaggtgcccagcatcctgggcaccacccagaccacctccatgcctcctgagatgagcaccaccgtgatggagaccaccaccaccatggccaccaccaccaccaggaagaacagaagcacagccagcatccagcccaccagtgatgacctggtgtcctctgcagaatgttccagtgatgatgaagattttgtggagtgtgagcccagcacagcccggggggagctggtgatccccctgctggtggaggaccccctggccaccccacccatcgccacccgggcccccagcatcaccctgccccccaccttccggcccctgctgaccatcatcgagaccaccaaggacagcctgtccatgaccagcgaggccggcctgccctgcctgagtgaccagggcagtgatggctgtgatgatgatggcctggtgatcagcggctacggcagcggggagacctttgacagcaacctgcccccaacagatgatgaggacttctacaccaccttcagcctggtgacagacaagagcctgagcaccagcatctttgaaggaggctacaaggcccacgcccccaagtgggagagcaaggacttccggcccaacaaggtgtctgagaccagcaggaccaccaccaccagcctgagccctgagctgatccgcttcaccgccagcagcagcagcggcatggtgcccaagctgcctgctgggaagatgaacaacagagacctgaagccccagcctgacatcgtgctgctgcccctgcccacagcctatgagctggacagcaccaagctgaagagccccctcatcaccagccccatgttcagaaatgtgcccacagccaaccccacagagcccggcatccggcgggtgcctggggccagcgaggtgatccgggagagcagcagcaccaccggcatggtggtgggcatcgtggccgccgccgccctgtgcatcctgatcctgctgtatgccatgtacaagtacagaaacagagatgagggcagctaccaggtggatgagaccaggaactacatcagcaacagcgcccagagcaatggcaccctgatgaaggagaagcagcagagcagcaagagcggccacaagaagcagaagaacaaggaccgggagtactacgtgtag

SEQ ID NO: 161510 - DNA, 4179 bp, Artificial Sequence
  Description of Artificial Sequence: Synthetic coding sequence
atgagcagcaccctgcacagcgtcttcttcaccctgaaggtgtccatcctgctgggcagcctgctgggcctgtgcctgggcctggagttcatgggcctgcccaaccagtgggcccgctacctgcgctgggatgccagcaccaggagtgacctgtccttccagttcaagaccaacgtgtccacaggcctgctgctgtacctggatgatggaggagtgtgtgacttcctgtgcctgagcctggtggatggccgggtgcagctgcgcttctccatggactgtgccgagacagctgtgctgagcaacaagcaggtgaatgacagctcctggcacttcctgatggtgtcccgggaccggctgaggacagtgctgatgctggatggagagggccagagcggggagctgcagccccagaggccctacatggatgtggtgtctgacctcttcctgggcggcgtgcccacagacatccggcccagcgccctgaccctggatggagtgcaggccatgcctggcttcaagggcctcatcctggacctgaagtatggcaacagcgagccccggctgctgggcagcagaggagtgcagatggatgctgagggcccctgtggggagcggccctgtgaaaatggaggcatctgcttcctgctggatggccaccccacctgtgactgcagcaccaccggctatggaggcaagctgtgcagcgagggcctgagccacctgatgatgtctgagcagggccgctggaaggcccgggaggagaatgtggccaccttccggggcagcgagtacctgtgctatgacctgagccagaaccccatccagagcagcagtgatgagatcaccctgtccttcaagacctggcagagaaatggcctcatcctgcacacaggcaagtctgctgactatgtgaacctggccctgaaggatggagctgtgtccctggtgatcaacctgggcagcggggcctttgaggccatcgtggagcctgtgaatggcaagttcaatgacaatgcctggcatgatgtgaaggtgaccaggaacctgcggcaggtgaccatctctgtggatggcatcctgaccaccaccggctacacccaggaggactacaccatgctgggcagtgatgacttcttctacgtgggcggcagccccagcacagctgacctgcccggcagccctgtgagcaacaacttcatgggctgcctgaaggaggtggtgtacaagaacaatgacatccggctggagctgagccggctggccagaattgctgacaccaagatgaagatctatggagaggtggtgttcaagtgtgaaaatgtggccaccctggaccccatcaactttgagaccccagaggcctacatcagcctgcccaagtggaacaccaagaggatgggcagcatcagctttgacttccgcaccacagagcccaacggcctcatcctcttcacccacggcaagccccaggagaggaaggatgcccggagccagaagaacaccaaggtggacttctttgctgtggagctgctggatggcaacctgtacctgctgctggacatgggcagcggcaccatcaaggtgaaggccacccagaagaaggccaatgatggagagtggtaccacgtggacatccagagagatggccgcagcggcaccatctctgtgaacagcaggaggacccccttcaccgccagcggggagagcgagatcctggacctggagggggacatgtacctgggcggcctgcctgaaaatagagctggcctcatcctgcccacagagctgtggacagccatgctgaactacggctacgtgggctgcatccgggacctcttcattgatggccgcagcaagaacatccggcagctggccgagatgcagaatgctgctggggtgaagagcagctgcagcaggatgtctgccaagcagtgtgacagctacccctgcaagaacaatgctgtgtgcaaggatggctggaaccgcttcatctgtgactgcaccggcaccggctactggggccgcacctgtgagcgggaggccagcatcctgtcctatgatggctccatgtacatgaagatcatcatgcccatggtgatgcacacagaagcagaagatgtgtccttccgcttcatgagccagagggcctacggcctgctggtggccaccaccagccgggacagcgctgacaccctgcggctggagctggatggcggccgggtgaagctgatggtgaacctgggcaaaggacctgagaccctgtatgccggccagaagctgaatgacaatgagtggcacacagtgcgggtggtgcggcggggcaagagcctgaagctgactgtggatgatgatgtggccgagggcaccatggtgggggaccacacccggctggagttccacaacatcgagaccggcatcatgacagagaagcgctacatctctgtggtgcccagcagcttcatcggccacctgcagagcctgatgttcaacggcctgctgtacatcgacctgtgcaagaatggagacatcgactactgtgagctgaaggcccgcttcggcctgaggaacatcatcgctgaccctgtgaccttcaagaccaagagcagctacctgagcctggccaccctgcaggcctacacctccatgcacctgttcttccagttcaagaccaccagcccagatggcttcatcctcttcaacagcggagatggaaatgacttcatcgctgtggagctggtgaagggctacatccactacgtgtttgacctgggcaatggccccaacgtcatcaagggcaacagcgaccggcccctgaatgacaaccagtggcacaacgtggtgatcacccgggacaacagcaacacccacagcctgaaggtggacaccaaggtggtgacccaggtgatcaacggggccaagaacctggacctgaagggggacctgtacatggccggcctggcccagggcatgtacagcaacctgcccaagctggtggccagcagagatggcttccagggctgcctggcctctgtggacctgaatggccgcctgcctgacctgatcaatgatgccctgcacaggagcggccagatcgagcggggctgtgagggccccagcaccacctgccaggaggacagctgtgccaaccagggcgtgtgcatgcagcagtgggagggcttcacctgtgactgcagcatgaccagctacagcggcaaccagtgcaatgaccccggggccacctacatctttgggaagagcggcggcctcatcctgtacacctggccagccaatgaccggcccagcaccaggagtgaccggctggccgtgggcttcagcaccaccgtgaaggatggcatcctggtgagaattgattctgcccctggcctgggggacttcctgcagctgcacatcgagcagggcaagattggagtggtgttcaacatcggcaccgtggacatcagcatcaaggaggagaggacccctgtgaatgatggcaagtaccacgtggtgcgcttcaccagaaatggaggaaatgccaccctgcaggtggacaactggcctgtgaatgagcactaccccaccggcaacacagacaatgaacgcttccagatggtgaagcagaagatccccttcaagtacaacagacctgtggaggagtggctgcaggagaagggccggcagctgaccatcttcaacacccaggcccagatcgccatcggcggcaaggacaagggccgcctcttccagggccagctgagcggcctgtactatgatggcctgaaggtgctgaacatggctgctgagaacaaccccaacatcaagatcaatggatctgtgcggctggtgggggaggtgcccagcatcctgggcaccacccagaccacctccatgcctcctgagatgagcaccaccgtgatggagaccaccaccaccatggccaccaccaccaccaggaagaacagaagcacagccagcatccagcccaccagtgatgacctggtgagcagcgctgagtgcagcagtgatgatgaggactttgtggagtgtgagcccagcacaggccgcagcgcccggagcagcaatgctgcccggagcctgcgggccgccctgacctggacctggaggctgacctacaccttcacccccatcatcttcatcagctgtgtggtgcacagctag

SEQ ID NO: 161511 - DNA, 3186 bp, Artificial Sequence
  Description of Artificial Sequence: Synthetic coding sequence
atgctgggcagtgatgacttcttctacgtgggcggcagccccagcacagctgacctgcccggcagccctgtgagcaacaacttcatgggctgcctgaaggaggtggtgtacaagaacaatgacatccggctggagctgagccggctggccagaattgctgacaccaagatgaagatctacggggaggtggtgttcaagtgtgaaaatgtggccaccctggaccccatcaactttgagaccccagaggcctacatcagcctgcccaagtggaacaccaagaggatgggcagcatcagctttgacttccgcaccacagagcccaacggcctcatcctcttcacccacggcaagccccaggagaggaaggatgcccggagccagaagaacaccaaggtggacttctttgctgtggagctgctggatggcaacctgtacctgctgctggacatgggcagcggcaccatcaaggtgaaggccacccagaagaaggccaatgatggagagtggtaccacgtggacatccagagagatggccgcagcggcaccatctctgtgaacagcaggaggacccccttcaccgccagcggggagagcgagatcctggacctggagggggacatgtacctgggcggcctgcctgagaacagagctggcctcatcctgcccacagagctgtggacagccatgctgaactacggctacgtgggctgcatccgggacctcttcattgatggccgcagcaagaacatccggcagctggccgagatgcagaatgctgctggggtgaagagcagctgcagcaggatgtctgccaagcagtgtgacagctacccctgcaagaacaatgctgtgtgcaaggatggctggaaccgcttcatctgtgactgcacaggaacaggctactggggccgcacctgtgagcgggaggccagcatcctgtcctatgatggctccatgtacatgaagatcatcatgcccatggtgatgcacacagaagcagaagatgtgtccttccgcttcatgagccagagggcctacggcctgctggtggccaccaccagccgggacagcgctgacaccctgcggctggagctggatggcggccgggtgaagctgatggtgaacctggactgcatccgcatcaactgcaacagcagcaaaggacctgagaccctgtatgccggccagaagctgaatgacaatgagtggcacacagtgcgggtggtgcggcggggcaagagcctgaagctgactgtggatgatgatgtggccgagggcaccatggtgggggaccacacccggctggagttccacaacatcgagaccggcatcatgacagagaagcgctacatctctgtggtgcccagcagcttcatcggccacctgcagagcctgatgttcaacggcctgctgtacatcgacctgtgcaagaatggagacatcgactactgtgagctgaaggcccgcttcggcctgaggaacatcatcgctgaccctgtgaccttcaagaccaagagcagctacctgagcctggccaccctgcaggcctacacctccatgcacctgttcttccagttcaagaccaccagcccagatggcttcatcctcttcaacagcggagatggaaatgacttcatcgctgtggagctggtgaagggctacatccactacgtgtttgacctgggcaatggccccaacgtcatcaagggcaacagcgaccggcccctgaatgacaaccagtggcacaacgtggtgatcacccgggacaacagcaacacccacagcctgaaggtggacaccaaggtggtgacccaggtgatcaacggggccaagaacctggacctgaagggggacctgtacatggccggcctggcccagggcatgtacagcaacctgcccaagctggtggccagcagagatggcttccagggctgcctggcctctgtggacctgaatggccgcctgcctgacctgatcaatgatgccctgcacaggagcggccagatcgagcggggctgtgagggccccagcaccacctgccaggaggacagctgtgccaaccagggcgtgtgcatgcagcagtgggagggcttcacctgtgactgcagcatgaccagctacagcggcaaccagtgcaatgaccccggggccacctacatctttgggaagagcggcggcctcatcctgtacacctggccagccaatgaccggcccagcaccaggagtgaccggctggccgtgggcttcagcaccaccgtgaaggatggcatcctggtgagaattgattctgcccctggcctgggggacttcctgcagctgcacatcgagcagggcaagattggagtggtgttcaacatcggcaccgtggacatcagcatcaaggaggagaggacccctgtgaatgatggcaagtaccacgtggtgcgcttcaccagaaatggaggaaatgccaccctgcaggtggacaactggcctgtgaatgagcactaccccaccggccggcagctgaccatcttcaacacccaggcccagatcgccatcggcggcaaggacaagggccgcctcttccagggccagctgagcggcctgtactatgatggcctgaaggtgctgaacatggctgctgagaacaaccccaacatcaagatcaatggatctgtgcggctggtgggggaggtgcccagcatcctgggcaccacccagaccacctccatgcctcctgagatgagcaccaccgtgatggagaccaccaccaccatggccaccaccaccaccaggaagaacagaagcacagccagcatccagcccaccagtgatgacctggtgagcagcgctgagtgcagcagtgatgatgaggactttgtggagtgtgagcccagcacagccaaccccacagagcccggcatccggcgggtgcctggggccagcgaggtgatccgggagagcagcagcaccaccggcatggtggtgggcatcgtggccgccgccgccctgtgcatcctgatcctgctgtatgccatgtacaagtacagaaacagagatgagggcagctaccaggtggatgagaccaggaactacatcagcaacagcgcccagagcaatggcaccctgatgaaggagaagcagcagagcagcaagagcggccacaagaagcagaagaacaaggaccgggagtactacgtgtag

SEQ ID NO: 161512 - DNA, 1380 bp, Artificial Sequence
  Description of Artificial Sequence: Synthetic coding sequence
atgcacctgcgcatccacgcccggcgcagccccccaagaagacctgcctggaccctgggcatctggttcctgttctggggctgcatcgtgtcctctgtgtggagcagcagcaatgtggccagcagcagcagcaccagcagcagccctggcagccacagccagcacgagcaccacttccacggcagcaagcaccacagcgtgcccatcagcatctaccgcagccctgtgtccctgcggggcggccatgctggggccacctacatctttgggaagagcggcggcctcatcctgtacacctggccagccaatgaccggcccagcaccaggagtgaccggctggccgtgggcttcagcaccaccgtgaaggatggcatcctggtgagaattgattctgcccctggcctgggggacttcctgcagctgcacatcgagcagggcaagattggagtggtgttcaacatcggcaccgtggacatcagcatcaaggaggagaggacccctgtgaatgatggcaagtaccacgtggtgcgcttcaccagaaatggaggaaatgccaccctgcaggtggacaactggcctgtgaatgagcactaccccaccggcaacacagacaatgaacgcttccagatggtgaagcagaagatccccttcaagtacaacagacctgtggaggagtggctgcaggagaagggccggcagctgaccatcttcaacacccaggcccagatcgccatcggcggcaaggacaagggccgcctcttccagggccagctgagcggcctgtactatgatggcctgaaggtgctgaacatggctgctgagaacaaccccaacatcaagatcaatggatctgtgcggctggtgggggaggtgcccagcatcctgggcaccacccagaccacctccatgcctcctgagatgagcaccaccgtgatggagaccaccaccaccatggccaccaccaccaccaggaagaacagaagcacagccagcatccagcccaccagtgatgacctggtgagcagcgctgagtgcagcagtgatgatgaggactttgtggagtgtgagcccagcacagccaaccccacagagcccggcatccggcgggtgcctggggccagcgaggtgatccgggagagcagcagcaccaccggcatggtggtgggcatcgtggccgccgccgccctgtgcatcctgatcctgctgtatgccatgtacaagtacagaaacagagatgagggcagctaccaggtggatgagaccaggaactacatcagcaacagcgcccagagcaatggcaccctgatgaaggagaagcagcagagcagcaagagcggccacaagaagcagaagaacaaggaccgggagtactacgtgtag

SEQ ID NO: 161513 - DNA, 3186 bp, Artificial Sequence; identical to SEQ ID NO: 161511
  Description of Artificial Sequence: Synthetic coding sequence

SEQ ID NO: 161514 - DNA, 1914 bp, Artificial Sequence
  Description of Artificial Sequence: Synthetic coding sequence
atgcacctgcgcatccacgcccggcgcagccccccaagaagacctgcctggaccctgggcatctggttcctgttctggggctgcatcgtgtcctctgtgtggagcagcagcaatgtggccagcagcagcagcaccagcagcagccctggcagccacagccagcacgagcaccacttccacggcagcaagcaccacagcgtgcccatcagcatctaccgcagccctgtgtccctgcggggcggccatgctggggccacctacatctttgggaagagcggcggcctcatcctgtacacctggccagccaatgaccggcccagcaccaggagtgaccggctggccgtgggcttcagcaccaccgtgaaggatggcatcctggtgagaattgattctgcccctggcctgggggacttcctgcagctgcacatcgagcagggcaagattggagtggtgttcaacatcggcaccgtggacatcagcatcaaggaggagaggacccctgtgaatgatggcaagtaccacgtggtgcgcttcaccagaaatggaggaaatgccaccctgcaggtggacaactggcctgtgaatgagcactaccccaccggccggcagctgaccatcttcaacacccaggcccagatcgccatcggcggcaaggacaagggccgcctcttccagggccagctgagcggcctgtactatgatggcctgaaggtgctgaacatggctgctgagaacaaccccaacatcaagatcaatggatctgtgcggctggtgggggaggtgcccagcatcctgggcaccacccagaccacctccatgcctcctgagatgagcaccaccgtgatggagaccaccaccaccatggccaccaccaccaccaggaagaacagaagcacagccagcatccagcccaccagtgatgacctggtgagcagcgctgagtgcagcagtgatgatgaggactttgtggagtgtgagcccagcactggaggagagctggtgatccccctgctggtggaggaccccctggccaccccacccatcgccacccgggcccccagcatcaccctgccccccaccttccggcccctgctgaccatcatcgagaccaccaaggacagcctgtccatgaccagcgaggccggcctgccctgcctgagtgaccagggcagtgatggctgtgatgatgatggcctggtgatcagcggctacggcagcggggagacctttgacagcaacctgcccccaacagatgatgaggacttctacaccaccttcagcctggtgacagacaagagcctgagcaccagcatctttgaaggaggctacaaggcccacgcccccaagtgggagagcaaggacttccggcccaacaaggtgtctgagaccagcaggaccaccaccaccagcctgagccctgagctgatccgcttcaccgccagcagcagcagcggcatggtgcccaagctgcctgctgggaagatgaacaacagagacctgaagccccagcctgacatcgtgctgctgcccctgcccacagcctatgagctggacagcaccaagctgaagagccccctcatcaccagccccatgttcagaaatgtgcccacagccaaccccacagagcccggcatccggcgggtgcctggggccagcgaggtgatccgggagagcagcagcaccaccggcatggtggtgggcatcgtggccgccgccgccctgtgcatcctgatcctgctgtatgccatgtacaagtacagaaacagagatgagggcagctaccaggtggatgagaccaggaactacatcagcaacagcgcccagagcaatggcaccctgatgaaggagaagcagcagagcagcaagagcggccacaagaagcagaagaacaaggaccgggagtactacgtgtag

SEQ ID NO: 161515 - DNA, 429 bp, Artificial Sequence
  Description of Artificial Sequence: Synthetic coding sequence
atgggcctgaagctgaatggccgctacatcagcctcatcctggccgtgcagatcgcctacctggtgcaggccgtgcgggccgccgggaaatgtgatgctgtgttcaagggcttcagtgactgcctgctgaagctgggggacagcatggccaactacccccagggcctggatgacaagaccaacatcaagacagtgtgcacctactgggaggacttccacagctgcaccgtgacagccctgacagactgccaggagggcgccaaggacatgtgggacaagctgaggaaggagagcaagaacctgaacatccagggcagcctgtttgagctgtgtggcagcggaaatggagctgctggcagcctgctgcctgccttccctgtgctgctggtgtccctgtctgctgccctggccacctggctgtccttctag

SEQ ID NO: 161516 - DNA, 8841 bp, Artificial Sequence
  Description of Artificial Sequence: Synthetic coding sequence
atggccagcgagaagccaggccctggccctggcctggagccccagcctgtgggcctgattgctgtgggcgctgctgggggcggcggcggcggcagcggcggcggcggcactggaggcagcggcatgggagagctgcggggggccagcggcagcggctctgtgatgctgcctgctggcatgatcaaccccagcgtgcccatccggaacatccgcatgaagtttgctgtgctgattggcctcatccaggtgggggaggtgagcaacagagacatcgtggagaccgtgctgaacctgctggtgggcggggagtttgacctggagatgaacttcatcatccaggatgctgagagcatcacctgcatgacagagctgctggagcactgtgatgtgacctgccaggccgagatctggagcatgttcaccgccatcctgaggaagtctgtgaggaacctgcagaccagcacagaggtgggcctcatcgagcaggtgctgctgaagatgtctgctgtggatgacatgattgctgacctgctggtggacatgctgggcgtgctggccagctacagcatcaccgtgaaggagctgaagctgctcttctccatgctgcggggggagagcggcatctggcccaggcatgctgtgaagctgctgtctgtgctgaaccagatgccccagagacatggccctgacaccttcttcaacttccctggctgcagcgctgctgccatcgccctgccccccatcgccaagtggccctaccagaatggcttcaccctgaacacctggttcaggatggaccccctgaacaacatcaacgtggacaaggacaagccctacctgtactgcttccgcaccagcaaaggagtgggctacagcgcccactttgtgggcaactgcctgattgtgaccagcctgaagagcaagggcaagggcttccagcactgtgtgaagtatgacttccagcccaggaagtggtacatgatcagcatcgtgcacatctacaaccgctggaggaacagcgagatccgctgctacgtgaatggccagctggtgtcctatggagacatggcctggcacgtgaacaccaatgacagctatgacaagtgcttcctgggcagcagcgagacagcagatgccaacagagtcttctgtggccagctgggcgctgtgtatgtgttcagcgaggccctgaacccagcccagatctttgccatccaccagctgggccctggctacaagagcaccttcaagttcaagtctgagagtgacatccacctggccgagcaccacaagcaggtgctgtatgatggcaagctggccagcagcatcgccttcacctacaatgccaaggccacagatgcccagctgtgcctggagagcagccccaaggaaaatgccagcatctttgtgcacagcccccacgccctgatgctgcaggatgtgaaggccatcgtgacccacagcatccacagcgccatccacagcatcggcggcatccaggtgctcttccccctgtttgcccagctggacaaccggcagctgaatgacagccaggtggagaccaccgtgtgtgccaccctgctggccttcctggtggagctgctgaagagctctgtggccatgcaggagcagatgctgggcggcaagggcttcctggtgattggctacctgctggagaagagcagccgggtgcacatcaccagggctgtgctggagcagttcctgagctttgccaagtacctggatggcctgagccacggggcccccctgctgaagcagctgtgtgaccacatcctcttcaacccagccatctggatccacaccccagccaaggtgcagctgagcctgtacacctacctgtctgctgagttcatcggcacagccaccatctacaccaccatcagaagagtgggcaccgtgctgcagctgatgcacaccctgaagtactactactgggtgatcaacccagctgacagcagcggcatcacccccaagggcctggatggcccccggcccagccagaaggagatcatcagcctgcgggccttcatgctgctcttcctgaagcagctgatcctgaaggacagaggagtgaaggaggatgagctgcagagcatcctgaactacctgctgaccatgcatgaagatgagaacatccatgatgtgctgcagctgctggtggccctgatgtctgagcacccagcctccatgatcccagcctttgaccagagaaatggcatccgggtcatctacaagctgctggccagcaagtctgagagcatctgggtgcaggccctgaaggtgctgggctacttcctgaagcacctgggccacaagaggaaggtggagatcatgcacacccacagcctcttcaccctgctgggggagcggctgatgctgcacaccaacacagtgacagtgaccacctacaacaccctgtatgagatcctgacagagcaggtgtgcacccaggtggtgcacaagccccaccctgagccagacagcacagtgaagatccagaaccccatgatcctgaaggtggtggccaccctgctgaagaacagcacccccagcgctgagctgatggaggtgagaagactcttcctgagtgacatgatcaagctgttcagcaacagcagagaaaatcgccgctgcctgctgcagtgcagcgtgtggcaggactggatgttcagcctgggctacatcaaccccaagaacagcgaggagcagaagatcacagagatggtgtacaacatcttccgcatcctgctgtaccacgccatcaagtatgagtggggcggctggagggtgtgggtggacaccctgagcatcgcccacagcaaggtgacctatgaggcccacaaggagtacctggccaagatgtatgaggagtaccagaggcaggaggaggagaacatcaagaagggcaagaagggaaatgtgtccaccatcagcggcctgagcagccagaccaccggggccaagggcggcatggagatccgggagattgaggacctgagccagagccagagccctgagagcgagacagactaccctgtgtccacagacacccgggacctgctgatgagcaccaaggtgtctgatgacatcctgggcaacagcgaccggcccggcagcggcgtgcacgtggaggtgcatgacctgctggtggacatcaaggccgagaaggtggaggccacagaggtgaagctggatgacatggacctgagccctgagaccctggtgggcggagaaaatggagccctggtggaggtggagagcctgctggacaacgtgtacagcgctgctgtggagaagctgcagaacaacgtgcacggctctgtgggcatcatcaagaagaatgaggagaaggacaatggccccctcatcaccctggctgatgagaaggaggacctgcccaacagcagcaccagcttcctgtttgacaagatccccaagcaggaggagaagctgctgcctgagctgagcagcaaccacatcatccccaacatccaggacacccaggtgcacctgggcgtgtctgatgacctgggcctgctggcccacatgactggatctgtggacctgacctgcaccagcagcatcatcgaggagaaggagttcaagatccacaccaccagtgatggcatgagcagcatcagcgagcgggacctggccagcagcaccaagggcctggagtatgcagagatgacagccaccaccctggagacagagagcagcagcagcaagatcgtgcccaacattgatgctggcagcatcatcagtgacacagagaggagtgatgatggcaaggagagcggcaaggagatcaggaagatccagaccaccaccaccacccaggccgtgcagggccgcagcatcacccagcaggaccgggacctgcgggtggacctgggcttccggggcatgcccatgacagaggagcagaggcggcagttcagccctggccccaggaccaccatgttccgcatccctgagttcaagtggagccccatgcaccagaggctgctgacagacctgctgtttgccctggagacagatgtgcacgtgtggaggagccacagcaccaagtctgtgatggactttgtgaacagcaatgaaaacatcatctttgtgcacaacaccatccacctgatcagccagatggtggacaacatcatcatcgcctgtggcggcatcctgcccctgctgtctgctgccaccagccccaccgtgtccaagacagagctggagaacatcgaggtgacccagggcatgtctgctgagacagctgtgaccttcctgagccggctgatggccatggtggatgtgctggtgtttgccagcagcctgaacttcagcgagattgaggccgagaagaacatgagcagcggcggcctgatgaggcagtgcctgcggctggtgtgctgcgtggccgtgaggaactgcctggagtgccggcagaggcagagggaccggggcaacaagagcagccacggcagcagcaagccccaggaggtgccccagagcgtgacagccacagctgccagcaagacccccctggagaatgtgcccggcaacctgagccccatcaaggaccctgaccggctgctgcaggatgtggacatcaaccggctgcgggctgtggtgttcagagatgtggatgacagcaagcaggcccagttcctggccctggccgtggtgtacttcatctctgtgctgatggtgtccaagtacagagacatcctggagccccagcgggagaccaccaggacaggcagccagcccggcaggaacatccggcaggagatcaacagccccaccagcacagtggtggtgatccccagcatcccccaccccagcctgaaccacggcttcctggccaagctgatccctgagcagagctttggccacagcttctacaaggagaccccagctgccttcccagacaccatcaaggagaaggagacccccaccccaggagaggacatccaggtggagagcagcatcccccacacagattctggaattggagaggagcaggtggccagcatcctgaatggagctgagctggagaccagcactggaccagatgccatgtctgagctgctgagcaccctgagcagcgaggtgaagaagagccaggagagcctgacagagaaccccagcgagaccctgaagccagccaccagcatcagcagcatcagccagaccaagggcatcaacgtgaaggagatcctgaagagcctggtggccgcccctgtggagattgctgaatgtggccctgagcccatcccctacccagaccctgccctgaagcgggagacccaggccatcctgcccatgcagttccacagctttgacagatctgtggtggtgcctgtgaagaagcccccacctggcagcctggccgtgaccaccgtgggcgccaccacagctggcagcggcctgcccaccggcagcaccagcaacatctttgctgccactggagccacccccaagtccatgatcaacaccaccggggctgtggacagcggcagcagcagcagcagcagcagcagcagctttgtgaatggagccaccagcaagaacctgcctgctgtgcagacagtggcccccatgcctgaggacagcgctgagaacatgagcatcacagccaagctggagcgggccctggagaaggtggcccccctgctgcgggagatctttgtggactttgcccccttcctgagcaggaccctgctgggcagccacggccaggagctgctgattgagggcctggtgtgcatgaagagcagcacctctgtggtggagctggtgatgctgctgtgcagccaggagtggcagaacagcatccagaagaatgccggcctggccttcatcgagctgatcaatgaaggccgcctgctgtgccacgccatgaaggaccacatcgtgcgggtggccaatgaagctgagttcatcctgaaccggcagagagcagaagatgtgcacaagcatgctgagtttgagagccagtgtgcccagtatgctgctgaccggcgggaggaggagaagatgtgtgaccacctgatctctgctgccaagcaccgggaccacgtgacagccaaccagctgaagcagaagatcctgaacatcctgaccaacaagcatggagcctggggcgctgtgagccacagccagctgcatgacttctggaggctggactactgggaggatgacctgcggaggagaagaagatttgtgagaaatgccttcggcagcacccatgctgaggccctgctgaaggccgccattgaatatggaacagaagaagatgtggtgaagagcaagaagaccttccgcagccaggccatcgtgaaccagaatgctgagacagagctgatgctggagggagatgatgatgctgtgtccctgctgcaggagaaggagattgacaacctggccggccctgtggtgctgagcaccccagcccagctgattgcccctgtggtggtggccaagggcaccctgagcatcaccaccacagagatctactttgaggtggatgaagatgattctgccttcaagaagattgacaccaaggtgctggcctacacagagggcctgcacggcaagtggatgttcagcgagatccgggctgtgttcagccgccgctacctgctgcagaacacagccctggaggtgttcatggccaacagaacatctgtgatgttcaacttcccagaccaggccaccgtgaagaaggtggtgtacagcctgccccgggtgggcgtgggcaccagctatggcctgccccaggcccggcgcatcagcctggccaccccccggcagctgtacaagagcagcaacatgacccagcgctggcagaggcgggagatcagcaactttgagtacctgatgttcctgaacaccatcgccggccgcacctacaatgacctgaaccagtaccctgtgttcccctgggtgctgaccaactatgaaagtgaggagctggacctgaccctgcccggcaacttccgggacctgagcaagcccatcggggccctgaaccccaagagagctgtgttctatgcagagagatatgagacctgggaggatgaccagagccccccctaccactacaacacccactacagcacagccaccagcaccctgtcctggctggtgcgcatcgagcccttcaccaccttcttcctgaatgccaatgatggcaagtttgaccacccagacaggaccttcagctctgtggcccgctcctggaggaccagccagagggacaccagtgatgtgaaggagctgatccctgagttctactacctgcctgagatgtttgtgaacagcaatggctacaacctgggcgtgagagaagatgaggtggtggtgaatgatgtggacctgcccccctgggccaagaagccagaagattttgtgcgcatcaacaggatggccctggagagcgagtttgtgtcctgccagctgcaccagtggattgacctgatcttcggctacaagcagaggggccctgaggccgtgcgggccctgaatgtgttccactacctgacctatgagggctctgtgaacctggacagcatcacagatcctgtgctgcgggaggccatggaggcccagatccagaactttggccagacccccagccagctgctgattgagccccaccccccaagaagcagcgccatgcacctgtgcttcctgccccagagccccctgatgttcaaggaccagatgcagcaggacgtcatcatggtgctgaagttccccagcaacagccctgtgacccacgtggccgccaacaccctgccccacctgaccatcccagctgtggtgacagtgacctgcagccggctgtttgctgtgaaccgctggcacaacacagtgggcctgcggggggcccctggctacagcctggaccaggcccaccacctgcccatcgagatggaccccctgattgccaacaacagcggcgtgaacaagaggcagatcacagacctggtggaccagagcatccagatcaatgcccactgctttgtggtgacagctgacaaccgctacatcctgatctgtggcttctgggacaagagcttccgggtgtacagcacagaaacaggcaagctgacccagatcgtgtttggccactgggatgtggtgacctgcctggcccggtctgagagctacatcggcggggactgctacatcgtgtctggcagcagagatgccaccctgctgctgtggtactggagcggccgccaccacatcatcggggacaaccccaacagcagtgactacccagcccccagggctgtgctgactggacatgaccacgaggtggtgtgtgtgtctgtgtgtgccgagctgggcctggtgatcagcggggccaaggagggcccctgcctggtgcacaccatcaccggggacctgctgcgggccctggagggccctgagaactgcctcttccccaggctcatctctgtgtcctctgagggccactgcatcatctactatgagcggggccgcttcagcaacttcagcatcaacgggaagctgctggcccagatggagatcaatgacagcacccgggccatcctgctgagcagtgatggccagaacctggtgactggaggagacaatggagtggtggaggtgtggcaggcctgtgacttcaagcagctgtacatctacccaggctgtgatgctggcatccgggccatggacctgagccatgaccagaggaccctcatcaccggcatggccagcggcagcatcgtggccttcaacatcgacttcaaccgctggcactatgagcaccagaaccgctactag

SEQ ID NO: 161517 - DNA, 1575 bp, Artificial Sequence
  Description of Artificial Sequence: Synthetic coding sequence
atgtttgtgaacagcaatggctacaacctgggcgtgcgggaggatgaggtggtggtgaatgatgtggacctgcccccctgggccaagaagccagaggactttgtgcgcatcaacaggatggccctggagagcgagtttgtgtcctgccagctgcaccagtggattgacctgatcttcggctacaagcagaggggccctgaggccgtgcgggccctgaatgtgttccactacctgacctatgagggctctgtgaacctggacagcatcacagatcctgtgctgcgggagatccctgaggcctacttcatccgggacccccacaccttcctgctgaccaaggacttcatcaaggccatggaggcccagatccagaactttggccagacccccagccagctgctgattgagccccaccccccaagaagcagcgccatgcacctgtgcttcctgccccagagccccctgatgttcaaggaccagatgcagcaggacgtcatcatggtgctgaagttccccagcaacagccctgtgacccacgtggccgccaacaccctgccccacctgaccatcccagctgtggtgacagtgacctgcagccggctgtttgctgtgaaccgctggcacaacacagtgggcctgcggggggcccctggctacagcctggaccaggcccaccacctgcccatcgagatggaccccctgattgccaacaacagcggcgtgaacaagaggcagatcacagacctggtggaccagagcatccagatcaatgcccactgctttgtggtgacagctgacaaccgctacatcctgatctgtggcttctgggacaagagcttccgggtgtacagcacagaaacaggcaagctgacccagatcgtgtttggccactgggatgtggtgacctgcctggcccggtctgagagctacatcggcggggactgctacatcgtgtctggcagcagagatgccaccctgctgctgtggtactggagcggccgccaccacatcatcggggacaaccccaacagcagtgactacccagcccccagggctgtgctgactggacatgaccacgaggtggtgtgtgtgtctgtgtgtgccgagctgggcctggtgatcagcggggccaaggagggcccctgcctggtgcacaccatcaccggggacctgctgcgggccctggagggccctgagaactgcctcttccccaggctcatctctgtgtcctctgagggccactgcatcatctactatgagcggggccgcttcagcaacttcagcatcaacgggaagctgctggcccagatggagatcaatgacagcacccgggccatcctgctgagcagtgatggccagaacctggtgactggaggagacaatggagtggtggaggtgtggcaggcctgtgacttcaagcagctgtacatctacccaggctgtgatgctggcatccgggccatggacctgagccatgaccagaggaccctcatcaccggcatggccagcggcagcatcgtggccttcaacatcgacttcaaccgctggcactatgagcaccagaaccgctactag

SEQ ID NO: 161518 - DNA, 8832 bp, Artificial Sequence
  Description of Artificial Sequence: Synthetic coding sequence
atggccagcgagaagccaggccctggccctggcctggagccccagcctgtgggcctgattgctgtgggcgctgctgggggcggcggcggcggcagcggcggcggcggcactggaggcagcggcatgggagagctgcggggggccagcggcagcggctctgtgatgctgcctgctggcatgatcaaccccagcgtgcccatccggaacatccgcatgaagtttgctgtgctgattggcctcatccaggtgggggaggtgagcaacagagacatcgtggagaccgtgctgaacctgctggtgggcggggagtttgacctggagatgaacttcatcatccaggatgctgagagcatcacctgcatgacagagctgctggagcactgtgatgtgacctgccaggccgagatctggagcatgttcaccgccatcctgaggaagtctgtgaggaacctgcagaccagcacagaggtgggcctcatcgagcaggtgctgctgaagatgtctgctgtggatgacatgattgctgacctgctggtggacatgctgggcgtgctggccagctacagcatcaccgtgaaggagctgaagctgctcttctccatgctgcggggggagagcggcatctggcccaggcatgctgtgaagctgctgtctgtgctgaaccagatgccccagagacatggccctgacaccttcttcaacttccctggctgcagcgctgctgccatcgccctgccccccatcgccaagtggccctaccagaatggcttcaccctgaacacctggttcaggatggaccccctgaacaacatcaacgtggacaaggacaagccctacctgtactgcttccgcaccagcaaaggagtgggctacagcgcccactttgtgggcaactgcctgattgtgaccagcctgaagagcaagggcaagggcttccagcactgtgtgaagtatgacttccagcccaggaagtggtacatgatcagcatcgtgcacatctacaaccgctggaggaacagcgagatccgctgctacgtgaatggccagctggtgtcctatggagacatggcctggcacgtgaacaccaatgacagctatgacaagtgcttcctgggcagcagcgagacagcagatgccaacagagtcttctgtggccagctgggcgctgtgtatgtgttcagcgaggccctgaacccagcccagatctttgccatccaccagctgggccctggctacaagagcaccttcaagttcaagtctgagagtgacatccacctggccgagcaccacaagcaggtgctgtatgatggcaagctggccagcagcatcgccttcacctacaatgccaaggccacagatgcccagctgtgcctggagagcagccccaaggaaaatgccagcatctttgtgcacagcccccacgccctgatgctgcaggatgtgaaggccatcgtgacccacagcatccacagcgccatccacagcatcggcggcatccaggtgctcttccccctgtttgcccagctggacaaccggcagctgaatgacagccaggtggagaccaccgtgtgtgccaccctgctggccttcctggtggagctgctgaagagctctgtggccatgcaggagcagatgctgggcggcaagggcttcctggtgattggctacctgctggagaagagcagccgggtgcacatcaccagggctgtgctggagcagttcctgagctttgccaagtacctggatggcctgagccacggggcccccctgctgaagcagctgtgtgaccacatcctcttcaacccagccatctggatccacaccccagccaaggtgcagctgagcctgtacacctacctgtctgctgagttcatcggcacagccaccatctacaccaccatcagaagagtgggcaccgtgctgcagctgatgcacaccctgaagtactactactgggtgatcaacccagctgacagcagcggcatcacccccaagggcctggatggcccccggcccagccagaaggagatcatcagcctgcgggccttcatgctgctcttcctgaagcagctgatcctgaaggacagaggagtgaaggaggatgagctgcagagcatcctgaactacctgctgaccatgcatgaagatgagaacatccatgatgtgctgcagctgctggtggccctgatgtctgagcacccagcctccatgatcccagcctttgaccagagaaatggcatccgggtcatctacaagctgctggccagcaagtctgagagcatctgggtgcaggccctgaaggtgctgggctacttcctgaagcacctgggccacaagaggaaggtggagatcatgcacacccacagcctcttcaccctgctgggggagcggctgatgctgcacaccaacacagtgacagtgaccacctacaacaccctgtatgagatcctgacagagcaggtgtgcacccaggtggtgcacaagccccaccctgagccagacagcacagtgaagatccagaaccccatgatcctgaaggtggtggccaccctgctgaagaacagcacccccagcgctgagctgatggaggtgagaagactcttcctgagtgacatgatcaagctgttcagcaacagcagagaaaatcgccgctgcctgctgcagtgcagcgtgtggcaggactggatgttcagcctgggctacatcaaccccaagaacagcgaggagcagaagatcacagagatggtgtacaacatcttccgcatcctgctgtaccacgccatcaagtatgagtggggcggctggagggtgtgggtggacaccctgagcatcgcccacagcaaggtgacctatgaggcccacaaggagtacctggccaagatgtatgaggagtaccagaggcaggaggaggagaacatcaagaagggcaagaagggaaatgtgtccaccatcagcggcctgagcagccagaccaccggggccaagggcggcatggagatccgggagattgaggacctgagccagagccagagccctgagagcgagacagactaccctgtgtccacagacacccgggacctgctgatgagcaccaaggtgtctgatgacatcctgggcaacagcgaccggcccggcagcggcgtgcacgtggaggtgcatgacctgctggtggacatcaaggccgagaaggtggaggccacagaggtgaagctggatgacatggacctgagccctgagaccctggtgggcggagaaaatggagccctggtggaggtggagagcctgctggacaacgtgtacagcgctgctgtggagaagctgcagaacaacgtgcacggctctgtgggcatcatcaagaagaatgaggagaaggacaatggccccctcatcaccctggctgatgagaaggaggacctgcccaacagcagcaccagcttcctgtttgacaagatccccaagcaggaggagaagctgctgcctgagctgagcagcaaccacatcatccccaacatccaggacacccaggtgcacctgggcgtgtctgatgacctgggcctgctggcccacatgactggatctgtggacctgacctgcaccagcagcatcatcgaggagaaggagttcaagatccacaccaccagtgatggcatgagcagcatcagcgagcgggacctggccagcagcaccaagggcctggagtatgcagagatgacagccaccaccctggagacagagagcagcagcagcaagatcgtgcccaacattgatgctggcagcatcatcagtgacacagagaggagtgatgatggcaaggagagcggcaaggagatcaggaagatccagaccaccaccaccacccaggccgtgcagggccgcagcatcacccagcaggaccgggacctgcgggtggacctgggcttccggggcatgcccatgacagaggagcagaggcggcagttcagccctggccccaggaccaccatgttccgcatccctgagttcaagtggagccccatgcaccagaggctgctgacagacctgctgtttgccctggagacagatgtgcacgtgtggaggagccacagcaccaagtctgtgatggactttgtgaacagcaatgaaaacatcatctttgtgcacaacaccatccacctgatcagccagatggtggacaacatcatcatcgcctgtggcggcatcctgcccctgctgtctgctgccaccagccccaccacagagctggagaacatcgaggtgacccagggcatgtctgctgagacagctgtgaccttcctgagccggctgatggccatggtggatgtgctggtgtttgccagcagcctgaacttcagcgagattgaagctgagaagaacatgagcagcggcggcctgatgaggcagtgcctgcggctggtgtgctgcgtggccgtgaggaactgcctggagtgccggcagaggcagagggaccggggcaacaagagcagccacggcagcagcaagccccaggaggtgccccagagcgtgacagccacagctgccagcaagacccccctggagaatgtgcccggcaacctgagccccatcaaggaccctgaccggctgctgcaggatgtggacatcaaccggctgcgggctgtggtgttcagagatgtggatgacagcaagcaggcccagttcctggccctggccgtggtgtacttcatctctgtgctgatggtgtccaagtacagagacatcctggagccccagcgggagaccaccaggacaggcagccagcctggaagaaacatccggcaggagatcaacagccccaccagcacagtggtggtgatccccagcatcccccaccccagcctgaaccacggcttcctggccaagctgatccctgagcagagctttggccacagcttctacaaggagaccccagctgccttcccagacaccatcaaggagaaggagacccccaccccaggagaggacatccaggtggagagcagcatcccccacacagacagcggcatcggggaggagcaggtggccagcatcctgaatggagctgagctggagaccagcacaggcccagatgccatgtctgagctgctgagcaccctgagcagcgaggtgaagaagagccaggagagcctgacagagaaccccagcgagaccctgaagccagccaccagcatcagcagcatcagccagaccaagggcatcaacgtgaaggagatcctgaagagcctggtggccgcccctgtggagattgctgaatgtggccctgagcccatcccctacccagaccctgccctgaagcgggagacccaggccatcctgcccatgcagttccacagctttgacagatctgtggtggtgcctgtgaagaagcccccacctggcagcctggccgtgaccaccgtgggcgccaccacagctggcagcggcctgcccaccggcagcaccagcaacatctttgctgccaccggggccacccccaagtccatgatcaacaccactggagctgtggacagcggcagcagcagcagcagcagcagcagcagctttgtgaatggagccaccagcaagaacctgcctgctgtgcagacagtggcccccatgccagaagattctgctgagaacatgagcatcacagccaagctggagcgggccctggagaaggtggcccccctgctgcgggagatctttgtggactttgcccccttcctgagcaggaccctgctgggcagccacggccaggagctgctgattgagggcctggtgtgcatgaagagcagcacctctgtggtggagctggtgatgctgctgtgcagccaggagtggcagaacagcatccagaagaatgccggcctggccttcatcgagctgatcaatgaaggccgcctgctgtgccacgccatgaaggaccacatcgtgcgggtggccaatgaggccgagttcatcctgaaccggcagagagcagaagatgtgcacaagcacgccgagtttgagagccagtgtgcccagtatgctgctgacagaagagaggaggagaagatgtgtgaccacctgatctctgctgccaagcaccgggaccacgtgacagccaaccagctgaagcagaagatcctgaacatcctgaccaacaagcacggggcctggggcgctgtgagccacagccagctgcatgacttctggaggctggactactgggaggatgacctgcggaggagaagaagatttgtgagaaatgccttcggcagcacccacgccgaggccctgctgaaggccgccatcgagtatggaacagaggaggatgtggtgaagagcaagaagaccttccgcagccaggccatcgtgaaccagaatgctgagacagagctgatgctggagggagatgatgatgctgtgtccctgctgcaggagaaggagattgacaacctggccggccctgtggtgctgagcaccccagcccagctgattgcccctgtggtggtggccaagggcaccctgagcatcaccaccacagagatctactttgaggtggatgaagatgacagcgccttcaagaagattgacaccaaggtgctggcctacacagagggcctgcacggcaagtggatgttttctgagatccgggctgtgttcagccgccgctacctgctgcagaacacagccctggaggtgttcatggccaacagaacatctgtgatgttcaacttcccagaccaggccaccgtgaagaaggtggtgtacagcctgccccgggtgggcgtgggcaccagctatggcctgccccaggcccggcgcatcagcctggccaccccccggcagctgtacaagagcagcaacatgacccagcgctggcagaggcgggagatcagcaactttgagtacctgatgttcctgaacaccatcgccggccgcacctacaatgacctgaaccagtaccctgtgttcccctgggtgctgaccaactatgagagcgaggagctggacctgaccctgcccggcaacttccgggacctgagcaagcccatcggggccctgaaccccaagagagctgtgttctacgccgagagatatgagacctgggaggatgaccagagccccccctaccactacaacacccactacagcacagccaccagcaccctgtcctggctggtgagaattgagcccttcaccaccttcttcctgaatgccaatgatggcaagtttgaccacccagacaggaccttcagctctgtggcccgctcctggaggaccagccagagggacaccagtgatgtgaaggagctgatccctgagttctactacctgcctgagatgtttgtgaacagcaatggctacaacctgggcgtgcgggaggatgaggtggtggtgaatgatgtggacctgcccccctgggccaagaagccagaggactttgtgcgcatcaacaggatggccctggagagcgagtttgtgtcctgccagctgcaccagtggattgacctgatcttcggctacaagcagaggggccctgaggccgtgcgggccctgaatgtgttccactacctgacctatgagggctctgtgaacctggacagcatcacagatcctgtgctgcgggaggccatggaggcccagatccagaactttggccagacccccagccagctgctgattgagccccacccccccaggagcagcgccatgcacctgtgcttcctgccccagagccccctgatgttcaaggaccagatgcagcaggatgtgatcatggtgctgaagttccccagcaacagccctgtgacccacgtggccgccaacaccctgccccacctgaccatcccagctgtggtgacagtgacctgcagccggctgtttgctgtgaaccgctggcacaacacagtgggcctgcggggggcccctggctacagcctggaccaggcccaccacctgcccatcgagatggaccccctcatcgccaacaacagcggcgtgaacaagaggcagatcacagacctggtggaccagagcatccagatcaatgcccactgctttgtggtgacagctgacaaccgctacatcctgatctgtggcttctgggacaagagcttccgggtgtacagcacagagaccgggaagctgacccagatcgtgtttggccactgggatgtggtgacctgcctggcccggtctgagagctacatcggcggggactgctacatcgtgtctggcagcagagatgccaccctgctgctgtggtactggagcggccgccaccacatcattggagacaaccccaacagcagtgactacccagcccccagggctgtgctgaccggccatgaccacgaggtggtgtgtgtgtctgtgtgtgccgagctgggcctggtgatcagcggggccaaggagggcccctgcctggtgcacaccatcactggagacctgctgcgggccctggagggccctgagaactgcctcttccccaggctcatctctgtgagcagcgagggccactgcatcatctactatgaaagaggccgcttcagcaacttcagcatcaatggcaagctgctggcccagatggagatcaatgacagcacccgggccatcctgctgagcagtgatggccagaacctggtgactggaggagacaacggggtggtggaggtgtggcaggcctgtgacttcaagcagctgtacatctacccaggctgtgatgctggcatccgggccatggacctgagccatgaccagaggaccctcatcaccggcatggccagcggcagcatcgtggccttcaacatcgacttcaaccgctggcactatgagcaccagaaccgctactag

SEQ ID NO: 161519 - DNA, 8841 bp, Artificial Sequence
  Description of Artificial Sequence: Synthetic coding sequence
atggccagcgagaagccaggccctggccctggcctggagccccagcctgtgggcctgattgctgtgggcgctgctgggggcggcggcggcggcagcggcggcggcggcactggaggcagcggcatgggagagctgcggggggccagcggcagcggctctgtgatgctgcctgctggcatgatcaaccccagcgtgcccatccggaacatccgcatgaagtttgctgtgctgattggcctcatccaggtgggggaggtgagcaacagagacatcgtggagaccgtgctgaacctgctggtgggcggggagtttgacctggagatgaacttcatcatccaggatgctgagagcatcacctgcatgacagagctgctggagcactgtgatgtgacctgccaggccgagatctggagcatgttcaccgccatcctgaggaagtctgtgaggaacctgcagaccagcacagaggtgggcctcatcgagcaggtgctgctgaagatgtctgctgtggatgacatgattgctgacctgctggtggacatgctgggcgtgctggccagctacagcatcaccgtgaaggagctgaagctgctcttctccatgctgcggggggagagcggcatctggcccaggcatgctgtgaagctgctgtctgtgctgaaccagatgccccagagacatggccctgacaccttcttcaacttccctggctgcagcgctgctgccatcgccctgccccccatcgccaagtggccctaccagaatggcttcaccctgaacacctggttcaggatggaccccctgaacaacatcaacgtggacaaggacaagccctacctgtactgcttccgcaccagcaaaggagtgggctacagcgcccactttgtgggcaactgcctgattgtgaccagcctgaagagcaagggcaagggcttccagcactgtgtgaagtatgacttccagcccaggaagtggtacatgatcagcatcgtgcacatctacaaccgctggaggaacagcgagatccgctgctacgtgaatggccagctggtgtcctatggagacatggcctggcacgtgaacaccaatgacagctatgacaagtgcttcctgggcagcagcgagacagcagatgccaacagagtcttctgtggccagctgggcgctgtgtatgtgttcagcgaggccctgaacccagcccagatctttgccatccaccagctgggccctggctacaagagcaccttcaagttcaagtctgagagtgacatccacctggccgagcaccacaagcaggtgctgtatgatggcaagctggccagcagcatcgccttcacctacaatgccaaggccacagatgcccagctgtgcctggagagcagccccaaggaaaatgccagcatctttgtgcacagcccccacgccctgatgctgcaggatgtgaaggccatcgtgacccacagcatccacagcgccatccacagcatcggcggcatccaggtgctcttccccctgtttgcccagctggacaaccggcagctgaatgacagccaggtggagaccaccgtgtgtgccaccctgctggccttcctggtggagctgctgaagagctctgtggccatgcaggagcagatgctgggcggcaagggcttcctggtgattggctacctgctggagaagagcagccgggtgcacatcaccagggctgtgctggagcagttcctgagctttgccaagtacctggatggcctgagccacggggcccccctgctgaagcagctgtgtgaccacatcctcttcaacccagccatctggatccacaccccagccaaggtgcagctgagcctgtacacctacctgtctgctgagttcatcggcacagccaccatctacaccaccatcagaagagtgggcaccgtgctgcagctgatgcacaccctgaagtactactactgggtgatcaacccagctgacagcagcggcatcacccccaagggcctggatggcccccggcccagccagaaggagatcatcagcctgcgggccttcatgctgctcttcctgaagcagctgatcctgaaggacagaggagtgaaggaggatgagctgcagagcatcctgaactacctgctgaccatgcatgaagatgagaacatccatgatgtgctgcagctgctggtggccctgatgtctgagcacccagcctccatgatcccagcctttgaccagagaaatggcatccgggtcatctacaagctgctggccagcaagtctgagagcatctgggtgcaggccctgaaggtgctgggctacttcctgaagcacctgggccacaagaggaaggtggagatcatgcacacccacagcctcttcaccctgctgggggagcggctgatgctgcacaccaacacagtgacagtgaccacctacaacaccctgtatgagatcctgacagagcaggtgtgcacccaggtggtgcacaagccccaccctgagccagacagcacagtgaagatccagaaccccatgatcctgaaggtggtggccaccctgctgaagaacagcacccccagcgctgagctgatggaggtgagaagactcttcctgagtgacatgatcaagctgttcagcaacagcagagaaaatcgccgctgcctgctgcagtgcagcgtgtggcaggactggatgttcagcctgggctacatcaaccccaagaacagcgaggagcagaagatcacagagatggtgtacaacatcttccgcatcctgctgtaccacgccatcaagtatgagtggggcggctggagggtgtgggtggacaccctgagcatcgcccacagcaaggtgacctatgaggcccacaaggagtacctggccaagatgtatgaggagtaccagaggcaggaggaggagaacatcaagaagggcaagaagggaaatgtgtccaccatcagcggcctgagcagccagaccaccggggccaagggcggcatggagatccgggagattgaggacctgagccagagccagagccctgagagcgagacagactaccctgtgtccacagacacccgggacctgctgatgagcaccaaggtgtctgatgacatcctgggcaacagcgaccggcccggcagcggcgtgcacgtggaggtgcatgacctgctggtggacatcaaggccgagaaggtggaggccacagaggtgaagctggatgacatggacctgagccctgagaccctggtgggcggagaaaatggagccctggtggaggtggagagcctgctggacaacgtgtacagcgctgctgtggagaagctgcagaacaacgtgcacggctctgtgggcatcatcaagaagaatgaggagaaggacaatggccccctcatcaccctggctgatgagaaggaggacctgcccaacagcagcaccagcttcctgtttgacaagatccccaagcaggaggagaagctgctgcctgagctgagcagcaaccacatcatccccaacatccaggacacccaggtgcacctgggcgtgtctgatgacctgggcctgctggcccacatgactggatctgtggacctgacctgcaccagcagcatcatcgaggagaaggagttcaagatccacaccaccagtgatggcatgagcagcatcagcgagcgggacctggccagcagcaccaagggcctggagtatgcagagatgacagccaccaccctggagacagagagcagcagcagcaagatcgtgcccaacattgatgctggcagcatcatcagtgacacagagaggagtgatgatggcaaggagagcggcaaggagatcaggaagatccagaccaccaccaccacccaggccgtgcagggccgcagcatcacccagcaggaccgggacctgcgggtggacctgggcttccggggcatgcccatgacagaggagcagaggcggcagttcagccctggccccaggaccaccatgttccgcatccctgagttcaagtggagccccatgcaccagaggctgctgacagacctgctgtttgccctggagacagatgtgcacgtgtggaggagccacagcaccaagtctgtgatggactttgtgaacagcaatgaaaacatcatctttgtgcacaacaccatccacctgatcagccagatggtggacaacatcatcatcgcctgtggcggcatcctgcccctgctgtctgctgccaccagccccaccggcagcaagacagagctggagaacatcgaggtgacccagggcatgtctgctgagacagctgtgaccttcctgagccggctgatggccatggtggatgtgctggtgtttgccagcagcctgaacttcagcgagattgaggccgagaagaacatgagcagcggcggcctgatgaggcagtgcctgcggctggtgtgctgcgtggccgtgaggaactgcctggagtgccggcagaggcagagggaccggggcaacaagagcagccacggcagcagcaagccccaggaggtgccccagagcgtgacagccacagctgccagcaagacccccctggagaatgtgcccggcaacctgagccccatcaaggaccctgaccggctgctgcaggatgtggacatcaaccggctgcgggctgtggtgttcagagatgtggatgacagcaagcaggcccagttcctggccctggccgtggtgtacttcatctctgtgctgatggtgtccaagtacagagacatcctggagccccagcgggagaccaccaggacaggcagccagcccggcaggaacatccggcaggagatcaacagccccaccagcacagtggtggtgatccccagcatcccccaccccagcctgaaccacggcttcctggccaagctgatccctgagcagagctttggccacagcttctacaaggagaccccagctgccttcccagacaccatcaaggagaaggagacccccaccccaggagaggacatccaggtggagagcagcatcccccacacagattctggaattggagaggagcaggtggccagcatcctgaatggagctgagctggagaccagcactggaccagatgccatgtctgagctgctgagcaccctgagcagcgaggtgaagaagagccaggagagcctgacagagaaccccagcgagaccctgaagccagccaccagcatcagcagcatcagccagaccaagggcatcaacgtgaaggagatcctgaagagcctggtggccgcccctgtggagattgctgaatgtggccctgagcccatcccctacccagaccctgccctgaagcgggagacccaggccatcctgcccatgcagttccacagctttgacagatctgtggtggtgcctgtgaagaagcccccacctggcagcctggccgtgaccaccgtgggcgccaccacagctggcagcggcctgcccaccggcagcaccagcaacatctttgctgccactggagccacccccaagtccatgatcaacaccaccggggctgtggacagcggcagcagcagcagcagcagcagcagcagctttgtgaatggagccaccagcaagaacctgcctgctgtgcagacagtggcccccatgcctgaggacagcgctgagaacatgagcatcacagccaagctggagcgggccctggagaaggtggcccccctgctgcgggagatctttgtggactttgcccccttcctgagcaggaccctgctgggcagccacggccaggagctgctgattgagggcctggtgtgcatgaagagcagcacctctgtggtggagctggtgatgctgctgtgcagccaggagtggcagaacagcatccagaagaatgccggcctggccttcatcgagctgatcaatgaaggccgcctgctgtgccacgccatgaaggaccacatcgtgcgggtggccaatgaagctgagttcatcctgaaccggcagagagcagaagatgtgcacaagcatgctgagtttgagagccagtgtgcccagtatgctgctgaccggcgggaggaggagaagatgtgtgaccacctgatctctgctgccaagcaccgggaccacgtgacagccaaccagctgaagcagaagatcctgaacatcctgaccaacaagcatggagcctggggcgctgtgagccacagccagctgcatgacttctggaggctggactactgggaggatgacctgcggaggagaagaagatttgtgagaaatgccttcggcagcacccatgctgaggccctgctgaaggccgccattgaatatggaacagaagaagatgtggtgaagagcaagaagaccttccgcagccaggccatcgtgaaccagaatgctgagacagagctgatgctggagggagatgatgatgctgtgtccctgctgcaggagaaggagattgacaacctggccggccctgtggtgctgagcaccccagcccagctgattgcccctgtggtggtggccaagggcaccctgagcatcaccaccacagagatctactttgaggtggatgaagatgattctgccttcaagaagattgacaccaaggtgctggcctacacagagggcctgcacggcaagtggatgttcagcgagatccgggctgtgttcagccgccgctacctgctgcagaacacagccctggaggtgttcatggccaacagaacatctgtgatgttcaacttcccagaccaggccaccgtgaagaaggtggtgtacagcctgccccgggtgggcgtgggcaccagctatggcctgccccaggcccggcgcatcagcctggccaccccccggcagctgtacaagagcagcaacatgacccagcgctggcagaggcgggagatcagcaactttgagtacctgatgttcctgaacaccatcgccggccgcacctacaatgacctgaaccagtaccctgtgttcccctgggtgctgaccaactatgaaagtgaggagctggacctgaccctgcccggcaacttccgggacctgagcaagcccatcggggccctgaaccccaagagagctgtgttctatgcagagagatatgagacctgggaggatgaccagagccccccctaccactacaacacccactacagcacagccaccagcaccctgtcctggctggtgcgcatcgagcccttcaccaccttcttcctgaatgccaatgatggcaagtttgaccacccagacaggaccttcagctctgtggcccgctcctggaggaccagccagagggacaccagtgatgtgaaggagctgatccctgagttctactacctgcctgagatgtttgtgaacagcaatggctacaacctgggcgtgagagaagatgaggtggtggtgaatgatgtggacctgcccccctgggccaagaagccagaagattttgtgcgcatcaacaggatggccctggagagcgagtttgtgtcctgccagctgcaccagtggattgacctgatcttcggctacaagcagaggggccctgaggccgtgcgggccctgaatgtgttccactacctgacctatgagggctctgtgaacctggacagcatcacagatcctgtgctgcgggaggccatggaggcccagatccagaactttggccagacccccagccagctgctgattgagccccaccccccaagaagcagcgccatgcacctgtgcttcctgccccagagccccctgatgttcaaggaccagatgcagcaggacgtcatcatggtgctgaagttccccagcaacagccctgtgacccacgtggccgccaacaccctgccccacctgaccatcccagctgtggtgacagtgacctgcagccggctgtttgctgtgaaccgctggcacaacacagtgggcctgcggggggcccctggctacagcctggaccaggcccaccacctgcccatcgagatggaccccctgattgccaacaacagcggcgtgaacaagaggcagatcacagacctggtggaccagagcatccagatcaatgcccactgctttgtggtgacagctgacaaccgctacatcctgatctgtggcttctgggacaagagcttccgggtgtacagcacagaaacaggcaagctgacccagatcgtgtttggccactgggatgtggtgacctgcctggcccggtctgagagctacatcggcggggactgctacatcgtgtctggcagcagagatgccaccctgctgctgtggtactggagcggccgccaccacatcatcggggacaaccccaacagcagtgactacccagcccccagggctgtgctgactggacatgaccacgaggtggtgtgtgtgtctgtgtgtgccgagctgggcctggtgatcagcggggccaaggagggcccctgcctggtgcacaccatcaccggggacctgctgcgggccctggagggccctgagaactgcctcttccccaggctcatctctgtgtcctctgagggccactgcatcatctactatgagcggggccgcttcagcaacttcagcatcaacgggaagctgctggcccagatggagatcaatgacagcacccgggccatcctgctgagcagtgatggccagaacctggtgactggaggagacaatggagtggtggaggtgtggcaggcctgtgacttcaagcagctgtacatctacccaggctgtgatgctggcatccgggccatggacctgagccatgaccagaggaccctcatcaccggcatggccagcggcagcatcgtggccttcaacatcgacttcaaccgctggcactatgagcaccagaaccgctactag

SEQ ID NO: 161520 - DNA, 1575 bp, Artificial Sequence; identical to SEQ ID NO: 161517
  Description of Artificial Sequence: Synthetic coding sequence

SEQ ID NO: 161521 - DNA, 4728 bp, Artificial Sequence
  Description of Artificial Sequence: Synthetic coding sequence
atgcaccagaggctgctgacagacctgctgtttgccctggagacagatgtgcacgtgtggaggagccacagcaccaagtctgtgatggactttgtgaacagcaatgaaaacatcatctttgtgcacaacaccatccacctgatcagccagatggtggacaacatcatcatcgcctgtggcggcatcctgcccctgctgtctgctgccaccagccccaccacagagctggagaacatcgaggtgacccagggcatgtctgctgagacagctgtgaccttcctgagccggctgatggccatggtggatgtgctggtgtttgccagcagcctgaacttcagcgagattgaagctgagaagaacatgagcagcggcggcctgatgaggcagtgcctgcggctggtgtgctgcgtggccgtgaggaactgcctggagtgccggcagaggcagagggaccggggcaacaagagcagccacggcagcagcaagccccaggaggtgccccagagcgtgacagccacagctgccagcaagacccccctggagaatgtgcccggcaacctgagccccatcaaggaccctgaccggctgctgcaggatgtggacatcaaccggctgcgggctgtggtgttcagagatgtggatgacagcaagcaggcccagttcctggccctggccgtggtgtacttcatctctgtgctgatggtgtccaagtacagagacatcctggagccccagcgggagaccaccaggacaggcagccagcctggaagaaacatccggcaggagatcaacagccccaccagcacagagaccccagctgccttcccagacaccatcaaggagaaggagacccccaccccaggagaggacatccaggtggagagcagcatcccccacacagacagcggcatcggggaggagcaggtggccagcatcctgaatggagctgagctggagaccagcacaggcccagatgccatgtctgagctgctgagcaccctgagcagcgaggtgaagaagagccaggagagcctgacagagaaccccagcgagaccctgaagccagccaccagcatcagcagcatcagccagaccaagggcatcaacgtgaaggagatcctgaagagcctggtggccgcccctgtggagattgctgaatgtggccctgagcccatcccctacccagaccctgccctgaagcgggagacccaggccatcctgcccatgcagttccacagctttgacagatctgtggtggtgcctgtgaagaagcccccacctggcagcctggccgtgaccaccgtgggcgccaccacagctggcagcggcctgcccaccggcagcaccagcaacatctttgctgccaccggggccacccccaagtccatgatcaacaccactggagctgtggacagcggcagcagcagcagcagcagcagcagcagctttgtgaatggagccaccagcaagaacctgcctgctgtgcagacagtggcccccatgccagaagattctgctgagaacatgagcatcacagccaagctggagcgggccctggagaaggtggcccccctgctgcgggagatctttgtggactttgcccccttcctgagcaggaccctgctgggcagccacggccaggagctgctgattgagggcctggtgtgcatgaagagcagcacctctgtggtggagctggtgatgctgctgtgcagccaggagtggcagaacagcatccagaagaatgccggcctggccttcatcgagctgatcaatgaaggccgcctgctgtgccacgccatgaaggaccacatcgtgcgggtggccaatgaggccgagttcatcctgaaccggcagagagcagaagatgtgcacaagcacgccgagtttgagagccagtgtgcccagtatgctgctgacagaagagaggaggagaagatgtgtgaccacctgatctctgctgccaagcaccgggaccacgtgacagccaaccagctgaagcagaagatcctgaacatcctgaccaacaagcacggggcctggggcgctgtgagccacagccagctgcatgacttctggaggctggactactgggaggatgacctgcggaggagaagaagatttgtgagaaatgccttcggcagcacccacgccgaggccctgctgaaggccgccatcgagtatggaacagaggaggatgtggtgaagagcaagaagaccttccgcagccaggccatcgtgaaccagaatgctgagacagagctgatgctggagggagatgatgatgctgtgtccctgctgcaggagaaggagattgacaacctggccggccctgtggtgctgagcaccccagcccagctgattgcccctgtggtggtggccaagggcaccctgagcatcaccaccacagagatctactttgaggtggatgaagatgacagcgccttcaagaagattgacaccaaggtgctggcctacacagagggcctgcacggcaagtggatgttttctgagatccgggctgtgttcagccgccgctacctgctgcagaacacagccctggaggtgttcatggccaacagaacatctgtgatgttcaacttcccagaccaggccaccgtgaagaaggtggtgtacagcctgccccgggtgggcgtgggcaccagctatggcctgccccaggcccggcgcatcagcctggccaccccccggcagctgtacaagagcagcaacatgacccagcgctggcagaggcgggagatcagcaactttgagtacctgatgttcctgaacaccatcgccggccgcacctacaatgacctgaaccagtaccctgtgttcccctgggtgctgaccaactatgagagcgaggagctggacctgaccctgcccggcaacttccgggacctgagcaagcccatcggggccctgaaccccaagagagctgtgttctacgccgagagatatgagacctgggaggatgaccagagccccccctaccactacaacacccactacagcacagccaccagcaccctgtcctggctggtgagaattgagcccttcaccaccttcttcctgaatgccaatgatggcaagtttgaccacccagacaggaccttcagctctgtggcccgctcctggaggaccagccagagggacaccagtgatgtgaaggagctgatccctgagttctactacctgcctgagatgtttgtgaacagcaatggctacaacctgggcgtgcgggaggatgaggtggtggtgaatgatgtggacctgcccccctgggccaagaagccagaggactttgtgcgcatcaacaggatggccctggagagcgagtttgtgtcctgccagctgcaccagtggattgacctgatcttcggctacaagcagaggggccctgaggccgtgcgggccctgaatgtgttccactacctgacctatgagggctctgtgaacctggacagcatcacagatcctgtgctgcgggaggccatggaggcccagatccagaactttggccagacccccagccagctgctgattgagccccacccccccaggagcagcgccatgcacctgtgcttcctgccccagagccccctgatgttcaaggaccagatgcagcaggatgtgatcatggtgctgaagttccccagcaacagccctgtgacccacgtggccgccaacaccctgccccacctgaccatcccagctgtggtgacagtgacctgcagccggctgtttgctgtgaaccgctggcacaacacagtgggcctgcggggggcccctggctacagcctggaccaggcccaccacctgcccatcgagatggaccccctcatcgccaacaacagcggcgtgaacaagaggcagatcacagacctggtggaccagagcatccagatcaatgcccactgctttgtggtgacagctgacaaccgctacatcctgatctgtggcttctgggacaagagcttccgggtgtacagcacagagaccgggaagctgacccagatcgtgtttggccactgggatgtggtgacctgcctggcccggtctgagagctacatcggcggggactgctacatcgtgtctggcagcagagatgccaccctgctgctgtggtactggagcggccgccaccacatcattggagacaaccccaacagcagtgaatgtgactacccagcccccagggctgtgctgaccggccatgaccacgaggtggtgtgtgtgtctgtgtgtgccgagctgggcctggtgatcagcggggccaaggagggcccctgcctggtgcacaccatcactggagacctgctgcgggccctggagggccctgagaactgcctcttccccaggctcatctctgtgagcagcgagggccactgcatcatctactatgaaagaggccgcttcagcaacttcagcatcaatggcaagctgctggcccagatggagatcaatgacagcacccgggccatcctgctgagcagtgatggccagaacctggtgactggaggagacaacggggtggtggaggtgtggcaggcctgtgacttcaagcagctgtacatctacccaggctgtgatgctggcatccgggccatggacctgagccatgaccagaggaccctcatcaccggcatggccagcggcagcatcgtggccttcaacatcgacttcaaccgctggcactatgagcaccagaaccgctactag

SEQ ID NO: 161522 - DNA, 2220 bp, Artificial Sequence
  Description of Artificial Sequence: Synthetic coding sequence
atgttttctgagatccgggctgtgttcagccgccgctacctgctgcagaacacagccctggaggtgttcatggccaacagaacatctgtgatgttcaacttcccagaccaggccaccgtgaagaaggtggtgtacagcctgccccgggtgggcgtgggcaccagctatggcctgccccaggcccggcgcatcagcctggccaccccccggcagctgtacaagagcagcaacatgacccagcgctggcagaggcgggagatcagcaactttgagtacctgatgttcctgaacaccatcgccggccgcacctacaatgacctgaaccagtaccctgtgttcccctgggtgctgaccaactatgagagcgaggagctggacctgaccctgcccggcaacttccgggacctgagcaagcccatcggggccctgaaccccaagagagctgtgttctacgccgagagatatgagacctgggaggatgaccagagccccccctaccactacaacacccactacagcacagccaccagcaccctgtcctggctggtgagaattgagcccttcaccaccttcttcctgaatgccaatgatggcaagtttgaccacccagacaggaccttcagctctgtggcccgctcctggaggaccagccagagggacaccagtgatgtgaaggagctgatccctgagttctactacctgcctgagatgtttgtgaacagcaatggctacaacctgggcgtgcgggaggatgaggtggtggtgaatgatgtggacctgcccccctgggccaagaagccagaggactttgtgcgcatcaacaggatggccctggagagcgagtttgtgtcctgccagctgcaccagtggattgacctgatcttcggctacaagcagaggggccctgaggccgtgcgggccctgaatgtgttccactacctgacctatgagggctctgtgaacctggacagcatcacagatcctgtgctgcgggaggccatggaggcccagatccagaactttggccagacccccagccagctgctgattgagccccacccccccaggagcagcgccatgcacctgtgcttcctgccccagagccccctgatgttcaaggaccagatgcagcaggatgtgatcatggtgctgaagttccccagcaacagccctgtgacccacgtggccgccaacaccctgccccacctgaccatcccagctgtggtgacagtgacctgcagccggctgtttgctgtgaaccgctggcacaacacagtgggcctgcggggggcccctggctacagcctggaccaggcccaccacctgcccatcgagatggaccccctcatcgccaacaacagcggcgtgaacaagaggcagatcacagacctggtggaccagagcatccagatcaatgcccactgctttgtggtgacagctgacaaccgctacatcctgatctgtggcttctgggacaagagcttccgggtgtacagcacagagaccgggaagctgacccagatcgtgtttggccactgggatgtggtgacctgcctggcccggtctgagagctacatcggcggggactgctacatcgtgtctggcagcagagatgccaccctgctgctgtggtactggagcggccgccaccacatcattggagacaaccccaacagcagtgactacccagcccccagggctgtgctgaccggccatgaccacgaggtggtgtgtgtgtctgtgtgtgccgagctgggcctggtgatcagcggggccaaggagggcccctgcctggtgcacaccatcactggagacctgctgcgggccctggagggccctgagaactgcctcttccccaggctcatctctgtgagcagcgagggccactgcatcatctactatgaaagaggccgcttcagcaacttcagcatcaatggcaagctgctggcccagatggagatcaatgacagcacccgggccatcctgctgagcagtgatggccagaacctggtgactggaggagacaacggggtggtggaggtgtggcaggcctgtgacttcaagcagctgtacatctacccaggctgtgatgctggcatccgggccatggacctgagccatgaccagaggaccctcatcaccggcatggccagcggcagcatcgtggccttcaacatcgacttcaaccgctggcactatgagcaccagaaccgctactag

SEQ ID NO: 161523 - DNA, 8841 bp, Artificial Sequence; identical to SEQ ID NO: 161516
  Description of Artificial Sequence: Synthetic coding sequence

SEQ ID NO: 161524 - DNA, 834 bp, Artificial Sequence
  Description of Artificial Sequence: Synthetic coding sequence
atgttttctgagatccgggctgtgttcagccgccgctacctgctgcagaacacagccctggaggtgttcatggccaacagaacatctgtgatgttcaacttcccagaccaggccaccgtgaagaaggtggtgtacagcctgccccgggtgggcgtgggcaccagctatggcctgccccaggcccggcgcatcagcctggccaccccccggcagctgtacaagagcagcaacatgacccagcgctggcagaggcgggagatcagcaactttgagtacctgatgttcctgaacaccatcgccggccgcacctacaatgacctgaaccagtaccctgtgttcccctgggtgctgaccaactatgagagcgaggagctggacctgaccctgcccggcaacttccgggacctgagcaagcccatcggggccctgaaccccaagagagctgtgttctacgccgagagatatgagacctgggaggatgaccagagccccccctaccactacaacacccactacagcacagccaccagcaccctgtcctggctggtgagaattgagcccttcaccaccttcttcctgaatgccaatgatggcaagtttgaccacccagacaggaccttcagctctgtggcccgctcctggaggaccagccagagggacaccagtgatgtgaaggagctgatccctgagttctactacctgcctgagatgtttgtgaacagcaatggctacaacctgggcgtgcgggaggatgaggtggtggtgaatgatgtggacctgcccccctgggccaagaacctgaagaccctgtgtggcagcacaggctggccctag

SEQ ID NO: 161525 - DNA, 7815 bp, Artificial Sequence
  Description of Artificial Sequence: Synthetic coding sequence
atggccagccgggagcggctgtttgagctgtggatgctgtactgcaccaagaaggaccctgactacctgaagctgtggctggacacctttgtgtcctcctatgagcagttcctggatgtggactttgagaagctgcccaccagggtggatgacatgcctcctggcatcagcctgctgcctgacaacatcctgcaggtgctgcgcatccagctgctgcagtgtgtgcagaagatggctgatggcctggaggagcagcagcaggccctgagcatcctgctggtgaagttcttcatcatcctgtgcaggaacctgagcaatgtggaggagatcggcacctgcagctacatcaactacgtgatcaccatgaccaccctgtacatccagcagctgaagagcaagaagaaggagaaggagatggctgaccagacctgcatcgaggagtttgtgattcatgccctggccttctgtgagagcctgtatgacccctacagaaactggaggcaccgcatcagcggccgcatcctgagcacagtggagaagagccggcagaagtacaagccagccagcctgactgtggagtttgtgcccttcttctaccagtgcttccaggagagcgagcacctgaaggagagcctgaagtgctgcctgctgcacctgtttggagccatcgtggccggcggccagagaaatgccctgcaggccatcagccctgccaccatggaggtgctgatgagggtgctggccgactgtgacagctgggaggatggagaccctgaggaggtgggcaggaaggccgagctgaccctgaagtgcctgacagaggtggtgcacatcctgctgagcagcaacagcgaccagaggcaggtggagaccagcaccatcctggagaactacttcaagctgctgaacagcgaccacagcgccctgcccaaccagaggaggagccggcagtgggagaaccgcttcatcgccctgcagatcaagatgctgaacaccatcacagccatgctggactgcacagacaggcctgtgctgcaggccatcttcctgaacagcaactgctttgagcacctgatccggctgctgcagaactgcaaggtgttccagggccagctggactgcctggccatcagcaccatccaggccctgacagctgtgatgaacaagagccctgctgccaaggaggtgttcaaggagagaattggctacacccacatgctggaggtgctgaagagcctgggccagccccccctggagctgctgaaggagctgatgaacatggctgtggagggggaccacacctctgtgggcatcctgggcatcagcaatgtgcagcccctgctgctgctgatccagtggctgcctgagctgcagagccatgacctgcagatcttcatcagtgactggctgaagaggatctgctgcatcaaccggcagagcaggaccacctgtgtgaatgccaacatgggcatccgcatcatcgagaccctggacctgcacagcagcctgcaccagacctgtgctgaaaatctcatcgccatccacggcagcctgggcagccagagcgtgtcctctgaggagatccggcggctgctgcggctgctgcgggtggatgagagcgagagcgtgcacccctacgtgacccctgtgacccgggccatcctgaccatggccaggaagctgagcctggagagcgccctgcagtacttcaacctgagccacagcatggccggcatctctgtgccccccatccagaagtggccaggcagcgccttctccttcagcgcctggttctgcctggaccaggaccagctgaccctgggcatcgccaacaagggcggcaagaggaagcagctgtacagcttcttcaccggcagcggcatgggctttgaggccttcatcacccacagcggcatgctggtggtggccgtgtgcaccaagcgggagtatgccaccgtgatgctgcctgaccacagcttctgtgacagcctgtggcacaacatcaccgtggtgcacatgcctgggaagaggcccttcggccagagctttgtgtacatctatgacaatggccagcagaaggtgtctgcccccctgcgcttccctgccatgaatgagcccttcaccagctgctgcatcggcagcgctggccagaggaccaccaccccaccacccagccagatcccagacccccccttcagcagccccatcaccccccacaggaccagctttggaggcatcctgagcagcgcctcctggggcggcaccatcgagaagagcaagctgatcaccaagctgatctctgctggcacccaggacagcgagtggggctgccccaccagcctggagggccagctgggcagcgtcatcatcttctatgagcccctgcagcccccccaggtgaaggccctgtacctggccggccccaactgcctgagcccctggaagtgccaggagagtgacatggctgacctgcccggcaacatcctgctgtactacacagccaaggcctgcaagaacagcatctgcctggacctgagcaccaactgcctgcacggccgcctgactggaaacaaggtggtgaactgggacatcaaggacatcatcaactgcattggaggcctgaatgtgctcttccccctgctggagcagatcagccacttcagcgagggccagatccctgaggagaagaatgaaagcacagtgcctgagagcgtgacccctgtggagggggactggctggtgtggaccagcaccaaggccagcgagagccggctggagaggaacctggtggccaccttcatcctgattgtgaagcacttcatccagaggcaccccatcaaccagggcaacctgatccacagccatggagtggccaccctgggcgccctgctgcagaaggtgcccagcaccctgatggatgtgaatgtgctgatggctgtgcagctgctgattgagcaggtgtccctggagaagaacatgcagctgctgcagcagatgtaccagtacctgctgtttgacttccgcatctggaacagaggagacttccccttcagaattggccacatccagtacctgagcaccatcatcaaggacagcagaagagtcttcaggaagaagtatggagtgcagttcctgctggacaccctgcgcatctactatggaaatggctgcaagtacaatgagctgagcctggatgacatccgcaccatccgcaccagcctgtatggcctcatcaagtacttcctgtgcaagggcggcagccatgaggagatccagagcatcatgggctacatcgccgccaccaatgaggaggagcagctgtttggcatcctggatgtgctcttcagcctgctgcggaccagccccacccggggccagctgttcctgctgctgtttgagcctggaaatgctgacatcctgtatgccctgctgctgaaccagaagtacagcgaccggctgcgggagatcatcttcaagatcatggagcagatgctgaagtgcaccaacgtgtatgaaagaagcaagcagcacatccggctgcgggaggtgggctacagcggcctgggcctgctgctgaatgaggccctggtgaacaccagcctcatcaagaacctgacccaccagatcatcaacacagaccccgtcatcaacttcaaggacctgctgtctgtggtgtacatcagccaccgggcccacatcaacgtgcgggtggccatctgcaggaaggtgctgcagatcctgcagttccagccagatgctgcccaccagatcagccagcaggtgggctggcaggacaccctggtgcggctcttcctgaaggccaagtttgaaaatggaaacaccctgcacaagcacagcagagctgtgctgatgaaggacaatgacaagaacatgagcacagaggacaccaagaagaacagtgatgagaagacagatgaggagaagatcaccagctttgccagcgccaacgtgtccagtgaccagtggagcctggaggacagacacagcctggacagcaacacccccctcttccctgaggacagctctgtgggggagctgtccttcaagtctgagaaccaggaggagttctggcacagcaaccccagccacctgagcctggacctgagcggcatcgacagctgtgagatgtctgacagcggcagccaggtgcctgacagcctgcccagcacccccagccctgtggagagcaccaagagcttctctgtgcacagcgaccgggagagcagcatcaccaatgacatgggcttcagtgatgacttcagcctgctggagagccaggagcgctgtgaggaggagctgctgcagctgctgacccacatcctgaactacgtgatgtgcaagggcctggagaagagtgatgatgacacctggattgagcggggccaggtgttcagcgccctgagcaagccaggcatcagcagcgagctgctgcggcccagtgatgagatcaagctgaccctgctgcagaagatgctggagtgggccatcagtgaaaatcgggaggccaagaccaaccctgtgacagcagaaaatgccttccggctggtgctgatcatccaggacttcctgcagagcgagggcctggtgaacagcaacatgtggacagagaagctgctggaggacatgatgctgctgtttgactgcctgtctgtgtgctacagcgagagccctgtgtgggtgaagctgagccagatccagatccagctgctgctgggcttcatcggccggggcaacctgcaggtgtgtgccatggccagcgccaagctgaacaccctgctgcagaccaaggtgattgagaaccaggatgaggcctgctacatcctgggcaagctggagcacgtgctgagccagagcatcaaggagcagacagagatctacagcttcctgatccccctggtgaggaccctggtgtccaagatctatgagctgctcttcatgaacctgcacctgcccagcctgcccttcaccaacggcagcagcagcttctttgaggacttccaggagtactgcaacagcaatgagtggcaggtgtacatcgagaagtacatcgtgccctacatgaagcagtatgaggcccacaccttctatgatggccacgagaacatggccctgtactggaaggactgctatgaggccctgatggtgaacatgcacaagagggaccgggagggcggggagagcaagctgaagttccaggagctgtttgtggagcccttcaacaggaaggcccggcaggagaacctgcgctacaacaacatgctgaagcagctgagcagccagcagctggccaccctgcggcgctggaaggccatccagctgtacctgacctgtgagcggggcccctgggccaagaggaagcagaaccccatccactggaagctggccaacgtggagaactacagcaggatgaggctgaagctggtgcccaactacaacttcaagacccatgaggaggccagcgccctgcgggacaacctgggcatccagcacagccagcccagcagtgacaccctgctgctggaggtggtgaagcaggtgaaggtgtctgacatggtggaggacaagctggacctgcctgaggaggacatcacagcccgggtgaatgtggatgagaaggaggagcaggaccagaaggagaagctggtgctgatggaggactgtgagctgatcaccatcattgatgtgattcctggccgcctggagatcaccacccagcacatctacttctatgatggcagcattgagaaggaggatggagtgggctttgacttcaagtggccccacagccagatccgggagatccacctgcggcgctacaacctgcggcgcagcgccctggagatcttccacgtggaccagagcaactacttcctgaacttcaagaaggaggtgaggaacaagatctacagccggctgctgagcctgcacagccccaacagctactacggcagccgcagcccccaggagctgttcaaggccagcggcctgacccagaagtgggtgaaccgggagatcagcaactttgactacctgatccagatcaacaccatggccggccgcacctacaatgacctggcccagtaccctgtgttcccctggatcctgcaggactacaccagcgaggagctggacctgaacaacccagctgtgttccgggacctgagcaagcccatcggcgtggtgaatgagaagaatgccaaggccatgagggagaagtatgaaaattttgaggaccccatgggcaccatcgacaagttccactacggcacccactacagcaacagcgctggggtgatgcactacctgatccgggtggagcccttcaccaccctgcacatccagctgcagagcggccgctttgactgtgccgaccggcagttccacagcatcccagccacctggcaggccctgatggacaacccctatgatgtgaaggagctgatccctgagttcttctacttccctgagttcctggagaaccagaaccagttcaacctgggccgcctgcagatcagcaaggagctggtgaatgatgtgatcctgcccaagtgggccaagtctgctgaggacttcatctacaagcacaggaaggccctggagagtgaatatgtgtctgcccacctgcacgagtggattgacctgatcttcggctacaagcagaggggccctgctgctgtggaggccctgaatgtgttctactactgcagctatgagggcgctgtggacctggatgccctgacagatgagaaggagaggaaggccctggagggcatgatcaacaactttggccagaccccctgccagctgctgaagatcaccatctccatgaactacgtgattggcacccacggctggctgccctatgacaggaacatcagcaactacttcaccttcatcaaggaccagacagtgaccaaccccaagacccagaggagcatcaatggcagctttgcccctggcctggagatcaccagcaagctgtttgtggtgtcccatgatgccaagctgctcttctctgctggctactgggacaacagcatccaggtgatgagcctgaccaagggcaagatcatcagccacatcatccgccacatggacatcgtgacctgcctggccacagactactgcggcatccacctgatcagcggcagccgggacaccacctgcatgatctggcagatcacccagcagggcggcgtgcctgtgggcctggccagcaagcccttccagatcctgtatggccacaccaatgaggtgctgtctgtgggcatcagcacagagctggacatggctgtgtctggcagcagagatggcaccgtcatcatccacaccatccccaacctggccatctcctgggagggccacatcgtggtgtacagcagcacagaggagaagaccaccctgaaggacaagaatgccctgcacctgttcagcatcaatggcaagtacctgggcagccagatcctgaaggagcaggtgtctgacatctgcatcatcggggagcacatcgtgacaggcagcatccagggcttcctgagcatccgggacctgcacagcctgaacctgagcatcaaccccctggccatgaggctgcccatccactgtgtgtgtgtgaccaaggagtacagccacatcctggtgggcctggaggatggcaagctgattgtggtgggcgtgggcaagccagctgagatgaggagcggccagctgagcaggaagttctggggcagcagcaagaggctgagccagatctctgctggggagacagagtacaacacccaggacagcaagtag

SEQ ID NO: 161526 - DNA, 8085 bp, Artificial Sequence
  Description of Artificial Sequence: Synthetic coding sequence
atggccagccgggagcggctgtttgagctgtggatgctgtactgcaccaagaaggaccctgactacctgaagctgtggctggacacctttgtgtcctcctatgagcagttcctggatgtggactttgagaagctgcccaccagggtggatgacatgcctcctggcatcagcctgctgcctgacaacatcctgcaggtgctgcgcatccagctgctgcagtgtgtgcagaagatggctgatggcctggaggagcagcagcaggccctgagcatcctgctggtgaagttcttcatcatcctgtgcaggaacctgagcaatgtggaggagatcggcacctgcagctacatcaactacgtgatcaccatgaccaccctgtacatccagcagctgaagagcaagaagaaggagaaggagatggctgaccagacctgcatcgaggagtttgtgattcatgccctggccttctgtgagagcctgtatgacccctacagaaactggaggcaccgcatcagcggccgcatcctgagcacagtggagaagagccggcagaagtacaagccagccagcctgactgtggagtttgtgcccttcttctaccagtgcttccaggagagcgagcacctgaaggagagcctgaagtgctgcctgctgcacctgtttggagccatcgtggccggcggccagagaaatgccctgcaggccatcagccctgccaccatggaggtgctgatgagggtgctggccgactgtgacagctgggaggatggagaccctgaggaggtgggcaggaaggccgagctgaccctgaagtgcctgacagaggtggtgcacatcctgctgagcagcaacagcgaccagaggcaggtggagaccagcaccatcctggagaactacttcaagctgctgaacagcgaccacagcgccctgcccaaccagaggaggagccggcagtgggagaaccgcttcatcgccctgcagatcaagatgctgaacaccatcacagccatgctggactgcacagacaggcctgtgctgcaggccatcttcctgaacagcaactgctttgagcacctgatccggctgctgcagaactgcaaggtgttccagggccagctggactgcctggccatcagcaccatccaggccctgacagctgtgatgaacaagagccctgctgccaaggaggtgttcaaggagagaattggctacacccacatgctggaggtgctgaagagcctgggccagccccccctggagctgctgaaggagctgatgaacatggctgtggagggggaccacacctctgtgggcatcctgggcatcagcaatgtgcagcccctgctgctgctgatccagtggctgcctgagctgcagagccatgacctgcagatcttcatcagtgactggctgaagaggatctgctgcatcaaccggcagagcaggaccacctgtgtgaatgccaacatgggcatccgcatcatcgagaccctggacctgcacagcagcctgcaccagacctgtgctgaaaatctcatcgccatccacggcagcctgggcagccagagcgtgtcctctgaggagatccggcggctgctgcggctgctgcgggtggatgagagcgagagcgtgcacccctacgtgacccctgtgacccgggccatcctgaccatggccaggaagctgagcctggagagcgccctgcagtacttcaacctgagccacagcatggccggcatctctgtgccccccatccagaagtggccaggcagcgccttctccttcagcgcctggttctgcctggaccaggaccagctgaccctgggcatcgccaacaagggcggcaagaggaagcagctgtacagcttcttcaccggcagcggcatgggctttgaggccttcatcacccacagcggcatgctggtggtggccgtgtgcaccaagcgggagtatgccaccgtgatgctgcctgaccacagcttctgtgacagcctgtggcacaacatcaccgtggtgcacatgcctgggaagaggcccttcggccagagctttgtgtacatctatgacaatggccagcagaaggtgtctgcccccctgcgcttccctgccatgaatgagcccttcaccagctgctgcatcggcagcgctggccagaggaccaccaccccaccacccagccagatcccagacccccccttcagcagccccatcaccccccacaggaccagctttggaggcatcctgagcagcgcctcctggggcggcaccatcgagaagagcaagctgatcaccaagctgatctctgctggcacccaggacagcgagtggggctgccccaccagcctggagggccagctgggcagcgtcatcatcttctatgagcccctgcagcccccccaggtgaaggccctgtacctggccggccccaactgcctgagcccctggaagtgccaggagagtgacatggctgacctgcccggcaacatcctgctgtactacacagccaaggcctgcaagaacagcatctgcctggacctgagcaccaactgcctgcacggccgcctgactggaaacaaggtggtgaactgggacatcaaggacatcatcaactgcattggaggcctgaatgtgctcttccccctgctggagcagatcagccacttcagcgagggccagatccctgaggagaagaatgaaagcacagtgcctgagagcgtgacccctgtggagggggactggctggtgtggaccagcaccaaggccagcgagagccggctggagaggaacctggtggccaccttcatcctgattgtgaagcacttcatccagaggcaccccatcaaccagggcaacctgatccacagccatggagtggccaccctgggcgccctgctgcagaaggtgcccagcaccctgatggatgtgaatgtgctgatggctgtgcagctgctgattgagcaggtgtccctggagaagaacatgcagctgctgcagcagatgtaccagtacctgctgtttgacttccgcatctggaacagaggagacttccccttcagaattggccacatccagtacctgagcaccatcatcaaggacagcagaagagtcttcaggaagaagtatggagtgcagttcctgctggacaccctgcgcatctactatggaaatggctgcaagtacaatgagctgagcctggatgacatccgcaccatccgcaccagcctgtatggcctcatcaagtacttcctgtgcaagggcggcagccatgaggagatccagagcatcatgggctacatcgccgccaccaatgaggaggagcagctgtttggcatcctggatgtgctcttcagcctgctgcggaccagccccacccggggccagctgttcctgctgctgtttgagcctggaaatgctgacatcctgtatgccctgctgctgaaccagaagtacagcgaccggctgcgggagatcatcttcaagatcatggagcagatgctgaagtgcaccaacgtgtatgaaagaagcaagcagcacatccggctgcgggaggtgggctacagcggcctgggcctgctgctgaatgaggccctggtgaacaccagcctcatcaagaacctgacccaccagatcatcaacacagaccccgtcatcaacttcaaggacctgctgtctgtggtgtacatcagccaccgggcccacatcaacgtgcgggtggccatctgcaggaaggtgctgcagatcctgcagttccagccagatgctgcccaccagatcagccagcaggtgggctggcaggacaccctggtgcggctcttcctgaaggccaagtttgaaaatggaaacaccctgcacaagcacagcagagctgtgctgatgaaggacaatgacaagaacatgagcacagaggacaccaagaagaacagtgatgagaagacagatgaggagaagatcaccagctttgccagcgccaacgtgtccagtgaccagtggagcctggaggacagacacagcctggacagcaacacccccctcttccctgaggacagctctgtgggggagctgtccttcaagtctgagaaccaggaggagttctggcacagcaaccccagccacctgagcctggacctgagcggcatcgacagctgtgagatgtctgacagcggcagccaggtgcctgacagcctgcccagcacccccagccctgtggagagcaccaagagcttctctgtgcacagcgaccgggagagcagcatcaccaatgacatgggcttcagtgatgacttcagcctgctggagagccaggagcgctgtgaggaggagctgctgcagctgctgacccacatcctgaactacgtgatgtgcaagggcctggagaagagtgatgatgacacctggattgagcggggccaggtgttcagcgccctgagcaagccaggcatcagcagcgagctgctgcggcccagtgatgagatcaagctgaccctgctgcagaagatgctggagtgggccatcagtgaaaatcgggaggccaagaccaaccctgtgacagcagaaaatgccttccggctggtgctgatcatccaggacttcctgcagagcgagggcctggtgaacagcaacatgtggacagagaagctgctggaggacatgatgctgctgtttgactgcctgtctgtgtgctacagcgagagccctgtgtgggtgaagctgagccagatccagatccagctgctgctgggcttcatcggccggggcaacctgcaggtgtgtgccatggccagcgccaagctgaacaccctgctgcagaccaaggtgattgagaaccaggatgaggcctgctacatcctgggcaagctggagcacgtgctgagccagagcatcaaggagcagacagagatctacagcttcctgatccccctggtgaggaccctggtgtccaagatctatgagctgctcttcatgaacctgcacctgcccagcctgcccttcaccaacggcagcagcagcttctttgaggacttccaggagtactgcaacagcaatgagtggcaggtgtacatcgagaagtacatcgtgccctacatgaagcagtatgaggcccacaccttctatgatggccacgagaacatggccctgtactggaaggactgctatgaggccctgatggtgaacatgcacaagagggaccgggagggcggggagagcaagctgaagttccaggagctgtttgtggagcccttcaacaggaaggcccggcaggagaacctgcgctacaacaacatgctgaagcagctgagcagccagcagctggccaccctgcggcgctggaaggccatccagctgtacctgacctgtgagcggggcccctgggccaagaggaagcagaaccccatccactggaagctggccaacgtggagaactacagcaggatgaggctgaagctggtgcccaactacaacttcaagacccatgaggaggccagcgccctgcgggacaacctgggcatccagcacagccagcccagcagtgacaccctgctgctggaggtggtgaagcaggtgaaggtgtctgacatggtggaggacaagctggacctgcctgaggaggacatcacagcccgggtgaatgtggatgagaaggaggagcaggaccagaaggagaagctggtgctgatggaggactgtgagctgatcaccatcattgatgtgattcctggccgcctggagatcaccacccagcacatctacttctatgatggcagcattgagaaggaggatggagtgggctttgacttcaagtggccccacagccagatccgggagatccacctgcggcgctacaacctgcggcgcagcgccctggagatcttccacgtggaccagagcaactacttcctgaacttcaagaaggaggtgaggaacaagatctacagccggctgctgagcctgcacagccccaacagctactacggcagccgcagcccccaggagctgttcaaggccagcggcctgacccagaagtgggtgaaccgggagatcagcaactttgactacctgatccagatcaacaccatggccggccgcacctacaatgacctggcccagtaccctgtgttcccctggatcctgcaggactacaccagcgaggagctggacctgaacaacccagctgtgttccgggacctgagcaagcccatcggcgtggtgaatgagaagaatgccaaggccatgagggagaagtatgaaaattttgaggaccccatgggcaccatcgacaagttccactacggcacccactacagcaacagcgctggggtgatgcactacctgatccgggtggagcccttcaccaccctgcacatccagctgcagagcggccgctttgactgtgccgaccggcagttccacagcatcccagccacctggcaggccctgatggacaacccctatgatgtgaaggagctgatccctgagttcttctacttccctgagttcctggagaaccagaaccagttcaacctgggccgcctgcagatcagcaaggagctggtgaatgatgtgatcctgcccaagtgggccaagtctgctgaggacttcatctacaagcacaggaaggccctggagagtgaatatgtgtctgcccacctgcacgagtggattgacctgatcttcggctacaagcagaggggccctgctgctgtggaggccctgaatgtgttctactactgcagctatgagggcgctgtggacctggatgccctgacagatgagaaggagaggaaggccctggagggcatgatcaacaactttggccagaccccctgccagctgctgaaggagccccaccccccccggctgtctgctgaggaggccgtgcagaagcccaccaagattgacaccagcaccctgaacctcttccagcacctgcctgagctgaagagcttcttcatcgagggcatcagtgatggcatccccctgctgaaggccaccatccccaagaaccagtaccgctccttcatgagccagggcagccctgagctgctgatcaccatctccatgaactacgtgattggcacccacggctggctgccctatgacaggaacatcagcaactacttcaccttcatcaaggaccagacagtgaccaaccccaagacccagaggagcatcaatggcagctttgcccctggcctggagatcaccagcaagctgtttgtggtgtcccatgatgccaagctgctcttctctgctggctactgggacaacagcatccaggtgatgagcctgaccaagggcaagatcatcagccacatcatccgccacatggacatcgtgacctgcctggccacagactactgcggcatccacctgatcagcggcagccgggacaccacctgcatgatctggcagatcacccagcagggcggcgtgcctgtgggcctggccagcaagcccttccagatcctgtatggccacaccaatgaggtgctgtctgtgggcatcagcacagagctggacatggctgtgtctggcagcagagatggcaccgtcatcatccacaccatccagaagggccagtacatgaggaccctgcggcccccctgtgagagcagcctcttcctgaccatccccaacctggccatctcctgggagggccacatcgtggtgtacagcagcacagaggagaagaccaccctgaaggacaagaatgccctgcacctgttcagcatcaatggcaagtacctgggcagccagatcctgaaggagcaggtgtctgacatctgcatcatcggggagcacatcgtgacaggcagcatccagggcttcctgagcatccgggacctgcacagcctgaacctgagcatcaaccccctggccatgaggctgcccatccactgtgtgtgtgtgaccaaggagtacagccacatcctggtgggcctggaggatggcaagctgattgtggtgggcgtgggcaagccagctgagatgaggagcggccagctgagcaggaagttctggggcagcagcaagaggctgagccagatctctgctggggagacagagtacaacacccaggacagcaagtag

SEQ ID NO: 161527 - DNA, 7713 bp, Artificial Sequence
  Description of Artificial Sequence: Synthetic coding sequence
atggccgccagcgagcggctgtatgagctgtggctgctgtactatgcccagaaggacctgggctacctgcagcagtggctgaaggcctttgtgggcgccttcaagaagagcatcagcctgagcagcctggagccccggcggcctgaggaggccggggctgaggtgcccctgctgcccctggatgagctgcacgtgctggccgagcagctgcaccaggccgacctggagcaggccctgctgctgctgaagctgttcatcatcctgtgcaggaacctggagaacattgaagctggccggggccaggtgctggtgccccgggtgctggccctgctgaccaagctggtggccgagctgaagggctgccccccaccccagggccggggcacccagctggagaatgtggccctgcacgccctgctgctgtgtgagggcctgtttgacccctaccagacctggaggcggcagaggtctggagaggtgatcagcagcaaggagaagagcaagtacaagttccccccagctgccctgccccaggagttcagcgccttcttccaggagagcctgcagaatgctgaccacctgccccccatcctgctgctgcggctcatccacctgttctgtgctgtgctggccggcggcaaggaaaatggccagatggctgtgtctgatggctctgtgaagggcctgctgtctgtggtgcggggctggagccggggccctgccccagacccctgcctggtgcccctggccctggaggccctggtgggcgctgtgcacgtgctgcacgccagccgggccccaccccggggccctgagctgcgggccctgctggagagctacttccacgtgctgaatgctgactggccagctggcctgagcagcggccctgaggaggccctggtgaccctgcgggtgtccatgctggatgccatccccatgatgctggcctgtgaggacaggcctgtgctgcaggccaccttcctgagcaacaactgctttgagcacctgaccaggctcatccagaacagcaagctgtacctgcagagccgggcccctcctgagggggacagcgacctggccacccggctgctgacagagccagatgtgcagaaggtgctggaccaggacacagatgccatcgctgtgcacgtggtgcgggtgctgacctgcatcatgtctgacagccccagcgccaaggaggtgttcaaggagcgcatcggctacccccacctgcaggaggtgctgcagagccacggcccccccacccaccggctgctgcaggagctgctgaacatggctgtggagggggaccacagcatgtgccccccaccacccatcagaaatgagcagcctgtgctggtgctggcccagtggctgcccagcctgcccacagctgagctgcggctcttcctggcccagaggctgcgctggctgtgtgacagctgcccagccagccgggccacctgtgtgcaggccggcctggtgggctgcctgctggagaccctgagcacaggcctggccctggaggcccgctgccaggagcagctgctggccctgctgcaggccctgggccgggtgtccatccggcccatggagctgcggcacctgctgcggcccaggcctggcctggacagcgagcctggaggagctgaggccggcaaggcccggcatgctggggccgtcatccgcaccctgagcggcatggcccggcaccagggccctgcccgggccctgcgctactttgacctgacccccagcatggccggcatcatggtgccccctgtgcagcgctggccaggccctggcttcaccttccacgcctggctgtgcctgcaccccatggacacagcccccaccccagcccccacccggcccctgcagaggaagcagctgtacagcttcttcaccagcagcggcagcggctttgaggccttcttcaccgctgctggcaccctggtggtggccgtgtgcaccaggaaggagtacctgaccatgagcctgcctgaggtgtcctttgctgacagcgcctggcactgtgtggccatcgtgcacgtgcccggccggcggcccttcagccagaacctggtgcacgtgtacaaggatggccacctggtgaagacagcccccctgcgctgccccagcctgtctgagcccttcagcagctgctgcatcggcagcgctggctaccgcaccaccaccaccaccaccggcctgcccaccccacctgtgcctgccaccctggcctacacccacccagccctgaccaggagccagagcgtgcctgccagcacaggcctgggctggggcagcggcctggtggcccccctgcaggagggcagcattgacagcaccctggccggcacccaggacacccgctggggcagccccaccagcctggagggggagctgggcgctgtggccatcttccacgaggccctgcaggccacagccctgcggaccctgtgcaccctgggccccaatgaaacagcccccttcaagccagagggggagctgcacgagctgagcacccggctgctgctgcactacagcccccaggcctgcaagaacaacatctgcctggacctgagccccagccacggcctggatggccgcctgaccggccaccgggtggagacctgggatgtgaaggatgtggtgaactgtgtgggcggcatgggcgccctgctgcccctgctggagcgggtggccgcccagcccaaggaggccgaggccggccctgctgagacccatgacctggtgggccctgagctgaccagcggccacaacacccagggcctggtgctgcccctgggcaagagcagcgaggagaggatggagagaaatgctgtggccgccttcctgctgatgctgaggaacttcctgcagggccacatggtgaaccaggagagcctggtgcagtgccagggccctgccatcatcggggccctgctgaggaaggtgcccagctgggccatggacatgaatgtgctgatgtctgcccagctgctgatggagcaggtggccgctgagggcagcggccccctgctgtacctgctgtaccagcacctgctcttcaacttccacctgtggaccctgagtgactttgctgtgcggctgggccacatccagtacatgagcagcatcgtgcgggagcaccggcagaagctgaggaagaagtatggagtgcagttcatcctggatgccctgcggacccactacagcccccagcgggagcggcccctggccgcagatgacctgaggacagtgcagaccagcctgctgggcctggcccgggagttcctggtgcgcagcctgtctgcagatgatgtgcaggtgacccagaccatgctgtccttcctggccgccactggagatgatggccagatcctgcggcggctgcagcagaatgaaaggctgcctgagaggagccggcagaggctgcggctgagagaatgtggcctgcagggcctggtggcctgcctgcctgagggcaccgtgagcccccagctgtgccagggcctgtacaagctgttcctgggcgccggcagcggcaacacagctgggggcggcggcagcagcggcaccctgaccccagccagccagcccggcacccccagccccctggatggcccccggcccttccctgctgcccctggccgccacagcagcagcctgagcaatgtgctggaggatggcagcctgcctgagcccaccatctctggagatgacaccagcaacaccagcaacccccagcagaccagcgaggaggagctgtgcaacctgctgaccaacgtgctcttctctgtgacctggaggggcgtggagggcagtgatgaggccgcctggagggagcggggccaggtgttttctgtgctgacccagctgggcgccagcgccaccctggtgcggcccccagactgcatcaagaggagcctgctggagatgatgctggagagcgccctgacagacatcaaggaggcccctgtgggcgtgctggccagcctgacccagcaggccctgtggctgctgcggctgctgcaggacttcctgtgtgccgagggccacggcaaccaggagctgtggagcgagaagctgtttgagggcgtgtgcagcctgctggaccggctgggcgcctggccccacctggccaacggcacagctgacctgcgggagatggcccagatcggcctgcggctggtgctgggctacatcctgctggaggacccccagctgcacgcccaggcctacgtgcggctgcacatgctgctgcagacagctgtgcctgcccggcgggaggaggcctgctacgtgctgagcaagctggaggccgccctgggccgggtgctgaacaccagcagcctggagagcgccacagatgaagctggcagccccctggccgctgctgctgctgctgctgctgctgagcgctgctcctggctggtgcccctggtgaggaccctgctggaccgggcctatgagcccctgggcctgcagtggggcctgcccagcctgccccccaccaacggcagccccaccttctttgaggacttccaggccttctgtgccaccccagagtggaggcacttcatcgacaagcaggtgcagcccaccatgagccagtttgagatggacacctacgccaagagccatgacctgatgagcggcttctggaatgcctgctatgacatgctgatgagcagcggccagaggcggcagtgggagcgggcccagagcagaagagccttccaggagctggtgctggagcccgcccagaggcgggcccggctggagggcctgcgctacacagctgtgctgaagcagcaggccacccagcacagcatggccctgctgcactggggcgccctgtggaggcagctggccagcccctgtggggcctgggccctgcgggacacccccatcccccgctggaagctgagcagcgctgagacctacagcaggatgaggctgaagctggtgcccaaccaccactttgacccccacctggaggccagcgccctgcgggacaacctgggggaggtgcccctgacccccacagaggaggccagcctgcccctggccgtgaccaaggaggccaaggtgtccaccccacctgagctgctgcaggaggaccagctgggggaggatgagctggccgagctggagacccccatggaggccgctgagctggatgagcagcgggagaagctggtgctgtctgctgagtgccagctggtgacagtggtggccgtggtgcccggcctgctggaggtgaccacccagaatgtgtacttctatgatggcagcacagagcgggtggagacagaggagggcatcggctatgacttcagaagacccctggcccagctgcgggaggtgcacctgcggcgcttcaacctgcggcgcagcgccctggagctgttcttcatcgaccaggccaactacttcctgaacttcccctgcaaggtgggcaccacccctgtgagcagccccagccagaccccccggccccagcccggccccatccccccccacacccaggtgaggaaccaggtgtacagctggctgctgcggctgcggccccccagccagggctacctgagcagccgcagcccccaggagatgctgcgggccagcggcctgacccagaagtgggtgcagcgggagatcagcaactttgagtacctgatgcagctgaacaccatcgccggccgcacctacaatgacctgagccagtaccctgtgttcccctgggtgctgcaggactatgtgagccccaccctggacctgagcaacccagctgtgttccgggacctgagcaagcccatcggcgtggtgaaccccaagcacgcccagctggtgcgggagaagtatgagagctttgaagatcctgctggcaccatcgacaagttccactacggcacccactacagcaatgctgctggggtgatgcactacctgatccgggtggagcccttcaccagcctgcacgtgcagctgcagagcggccgctttgactgcagcgaccggcagttccacagcgtggccgccgcctggcaggcccggctggagagccctgcagatgtgaaggagctgatccctgagttcttctacttcccagacttcctggagaaccagaatggatttgacctgggctgcctgcagctgaccaatgagaaggtgggagatgtggtgctgcccccctgggccagcagccctgaggacttcatccagcagcaccggcaggccctggagagtgaatatgtgtctgcccacctgcacgagtggattgacctgatcttcggctacaagcagaggggccctgctgctgaggaggccctgaatgtgttctactactgcacctatgaaggagctgtggacctggaccacgtgacagatgagcgggagaggaaggccctggagggcatcatcagcaactttggccagaccccctgccagctgctgaaggagccccaccccacccggctgtctgctgaggaggccgcccaccggctggcccggctggacaccaacagccccagcatcttccagcacctggatgagctgaaggccttctttgctgaggtggtgtctgatggagtgcccctggtgctggccctggtgccccaccggcagccccacagcttcatcacccagggcagcccagacctgctggtgacagtgtctgccagcggcctgctgggcacccacagctggctgccctatgacaggaacatcagcaactacttctccttcagcaaggaccccaccatgggcagccacaagacccagaggctgctgagcggcccctgggtgcccggcagcggcgtgtctggccaggccctggccgtggccccagatggcaagctgctcttcagcggcggccactgggatggcagcctgcgggtgacagccctgccccggggcaagctgctgagccagctgagctgccacctggatgtggtgacctgcctggccctggacacctgtggcatctacctgatcagcggcagccgggacaccacctgcatggtgtggaggctgctgcaccagggcggcctgtctgtgggcctggcccccaagcctgtgcaggtgctgtatggccacggggctgctgtgtcctgtgtggccatcagcacagagctggacatggctgtgtctggctctgaagatggcaccgtcatcatccacacagtgagaagaggccagtttgtggccgccctgcggcccctgggcgccaccttccctggccccatcttccacctggccctgggcagcgagggccagatcgtggtgcagagcagcgcctgggagaggcctggggcccaggtgacctacagcctgcacctgtacagcgtgaatggcaagctgcgggccagcctgcccctggccgagcagcccacagccctgactgtgacagaagattttgtgctgctgggcacagcccagtgtgccctgcacatcctgcagctgaacaccctgctgcctgctgccccacccctgcccatgaaggtggccatccgctctgtggccgtgaccaaggagaggagccacgtgctggtgggcctggaggatggcaagctgattgtggtggtggccggccagcccagcgaggtgcgcagcagccagtttgccaggaagctgtggaggagcagccgccgcatcagccaggtgtcctctggagaaacagagtacaaccccacagaggccaggtag

SEQ ID NO: 161528 - DNA, 1848 bp, Artificial Sequence
  Description of Artificial Sequence: Synthetic coding sequence
atggagcccgccctgggccctggggtgcagaaggacctgggctacctgcagcagtggctgaaggcctttgtgggcgccttcaagaagagcatcagcctgagcagcctggagcccaggaggcctgaggaggccggggctgaggtgcccctgctgcccctggatgagctgcacgtgctggccgagcagctgcaccaggccgacctggagcaggccctgctgctgctgaagctgttcatcatcctgtgcaggaacctggagaacatcgaggccggccggggccaggtgctggtgccccgggtgctggccctgctgaccaagctggtggccgagctgaagggctgccccccaccccagggccggggcacccagctggagaatgtggccctgcacgccctgctgctgtgtgagggcctgtttgacccctaccagacctggaggcggcagaggtctggagaggtgatcagcagcaaggagaagagcaagtacaagtttcctcctgctgccctgccccaggagttcagcgccttcttccaggagagcctgcagaatgctgaccacctgccccccatcctgctgctgcggctcatccacctgttctgtgctgtgctggccggcggcaaggaaaatggccagatggctgtgtctgatggctctgtgaagggcctgctgtctgtggtgcggggctggagccggggccctgccccagacccctgcctggtgcccctggccctggaggccctggtgggcgctgtgcacgtgctgcacgccagccgggccccaccccggggccctgagctgcgggccctgctggagagctacttccacgtgctgaatgctgactggccagctggcctgagcagcggccctgaggaggccctggtgaccctgcgggtgtccatgctggatgccatccccatgatgctggcctgtgaagatagacctgtgctgcaggccaccttcctgagcaacaactgctttgagcacctgaccaggctcatccagaacagcaaggtgctggaccaggacacagatgccatcgctgtgcacgtggtgcgggtgctgacctgcatcatgtctgacagccccagcgccaaggaggtgttcaaggagcgcatcggctacccccacctgcaggaggtgctgcagagccacggcccccccacccaccggctgctgcaggagctgctgaacatggctgtggagggggaccacagcatgtgccccccaccacccatcagaaatgagcagcctgtgctggtgctggcccagtggctgcccagcctgcccacagctgagctgcggctcttcctggcccagaggctgcgctggctgtgtgacagctgcccagccagccgggccacctgtgtgcaggccggcctggtgggctgcctgctggagaccctgagcacaggcctggccctggaggcccgctgccaggagcagctgctggccctgctgcaggccctgggccgggtgtccatccggcccatggagctgcggcacctgctgcggcccaggcctggcctggacagcgagcctggaggagctgaggccggcaaggcccggcatgctggggccgtcatccgcaccctgagcggcatggcccggcaccagggccctgcccgggccctgcgctactttgacctgacccccagcatggccggcatcatggtgccccctgtgcagcgctggccaggccctggcttcaccttccacgcctggctgtgcctgcaccccatggacacagcccccaccccagccccacccaccctgcccagcagcggcatcggcggccgctgctaccccctgcgggactggagggctgaggtgccccccctggccggctag

SEQ ID NO: 161529 - DNA, 3012 bp, Artificial Sequence
  Description of Artificial Sequence: Synthetic coding sequence
atgagccagtttgagatggacacctacgccaagagccatgacctgatgagcggcttctggaatgcctgctatgacatgctgatgagcagcggccagaggcggcagtgggagcgggcccagagccggcgggccttccaggagctggtgctggagcccgcccagaggcgggcccggctggagggcctgcgctacacagctgtgctgaagcagcaggccacccagcacagcatggccctgctgcactggggcgccctgtggaggcagctggccagcccctgtggggcctgggccctgcgggacacccccatcccccgctggaagctgagcagcgctgagacctacagcaggatgaggctgaagctggtgcccaaccaccactttgacccccacctggaggccagcgccctgcgggacaacctgggggaggtgcccctgacccccacagaggaggccagcctgcccctggccgtgaccaaggaggccaaggtgtccaccccacctgagctgctgcaggaggaccagctgggagaagatgagctggccgagctggagacccccatggaggccgctgagctggatgagcagcgggagaagctggtgctgtctgctgagtgccagctggtgacagtggtggccgtggtgcccggcctgctggaggtgaccacccagaatgtgtacttctatgatggcagcacagagcgggtggagacagaggagggcatcggctatgacttccggcggcccctggcccagctgcgggaggtgcacctgcggcgcttcaacctgcggcgcagcgccctggagctgttcttcatcgaccaggccaactacttcctgaacttcccctgcaaggtgggcaccacccctgtgagcagccccagccagaccccccggccccagcccggccccatccccccccacacccaggtgaggaaccaggtgtacagctggctgctgcggctgcggccccccagccagggctacctgagcagccgcagcccccaggagatgctgcgggccagcggcctgacccagaagtgggtgcagcgggagatcagcaactttgagtacctgatgcagctgaacaccatcgccggccgcacctacaatgacctgagccagtaccctgtgttcccctgggtgctgcaggactatgtgagccccaccctggacctgagcaacccagctgtgttccgggacctgagcaagcccatcggcgtggtgaaccccaagcacgcccagctggtgcgggagaagtatgagagctttgaggaccctgctggcaccatcgacaagttccactacggcacccactacagcaatgctgctggggtgatgcactacctgatccgggtggagcccttcaccagcctgcacgtgcagctgcagagcggccgctttgactgcagcgaccggcagttccacagcgtggccgccgcctggcaggcccggctggagagccctgcagatgtgaaggagctgatccctgagttcttctacttcccagacttcctggagaaccagaatggatttgacctgggctgcctgcagctgaccaatgagaaggtgggagatgtggtgctgcccccctgggccagcagccctgaggacttcatccagcagcaccggcaggccctggagagtgaatatgtgtctgcccacctgcacgagtggattgacctgatcttcggctacaagcagaggggccctgctgctgaggaggccctgaatgtgttctactactgcacctatgagggcgctgtggacctggaccacgtgacagatgagcgggagaggaaggccctggagggcatcatcagcaactttggccagaccccctgccagctgctgaaggagccccaccccacccggctgtctgctgaggaggccgcccaccggctggcccggctggacaccaacagccccagcatcttccagcacctggatgagctgaaggccttctttgctgaggtgacagtgtctgccagcggcctgctgggcacccacagctggctgccctatgacaggaacatcagcaactacttctccttcagcaaggaccccaccatgggcagccacaagacccagaggctgctgagcggcccctgggtgcccggcagcggcgtgtctggccaggccctggccgtggccccagatggcaagctgctcttcagcggcggccactgggatggcagcctgcgggtgacagccctgccccggggcaagctgctgagccagctgagctgccacctggatgtggtgacctgcctggccctggacacctgtggcatctacctgatcagcggcagccgggacaccacctgcatggtgtggaggctgctgcaccagggcggcctgtctgtgggcctggcccccaagcctgtgcaggtgctgtatggccatggagctgctgtgtcctgtgtggccatcagcacagagctggacatggctgtgtctggctctgaagatggcaccgtcatcatccacacagtgcggcggggccagtttgtggccgccctgcggcccctgggcgccaccttccctggccccatcttccacctggccctgggcagcgagggccagatcgtggtgcagagcagcgcctgggagaggcctggggcccaggtgacctacagcctgcacctgtacagcgtgaatggcaagctgcgggccagcctgcccctggccgagcagcccacagccctgactgtgacagaggactttgtgctgctgggcacagcccagtgtgccctgcacatcctgcagctgaacaccctgctgcctgctgccccacccctgcccatgaaggtggccatccgctctgtggccgtgaccaaggagaggagccacgtgctggtgggcctggaggatggcaagctgattgtggtggtggccggccagcccagcgaggtgcgcagcagccagtttgccaggaagctgtggaggagcagccgccgcatcagccaggtgagcagcggggagacagagtacaaccccacagaggccaggtag

SEQ ID NO: 161530 - DNA, 2094 bp, Artificial Sequence
  Description of Artificial Sequence: Synthetic coding sequence
atgctgcgggccagcggcctgacccagaagtgggtgcagcgggagatcagcaactttgagtacctgatgcagctgaacaccatcgccggccgcacctacaatgacctgagccagtaccctgtgttcccctgggtgctgcaggactatgtgagccccaccctggacctgagcaacccagctgtgttccgggacctgagcaagcccatcggcgtggtgaaccccaagcacgcccagctggtgcgggagaagtatgagagctttgaggaccctgctggcaccatcgacaagttccactacggcacccactacagcaatgctgctggggtgatgcactacctgatccgggtggagcccttcaccagcctgcacgtgcagctgcagagcggccgctttgactgcagcgaccggcagttccacagcgtggccgccgcctggcaggcccggctggagagccctgcagatgtgaaggagctgatccctgagttcttctacttcccagacttcctggagaaccagaatggatttgacctgggctgcctgcagctgaccaatgagaaggtgggagatgtggtgctgcccccctgggccagcagccctgaggacttcatccagcagcaccggcaggccctggagagtgaatatgtgtctgcccacctgcacgagtggattgacctgatcttcggctacaagcagaggggccctgctgctgaggaggccctgaatgtgttctactactgcacctatgagggcgctgtggacctggaccacgtgacagatgagcgggagaggaaggccctggagggcatcatcagcaactttggccagaccccctgccagctgctgaaggagccccaccccacccggctgtctgctgaggaggccgcccaccggctggcccggctggacaccaacagccccagcatcttccagcacctggatgagctgaaggccttctttgctgaggtggtgtctgatggagtgcccctggtgctggccctggtgccccaccggcagccccacagcttcatcacccagggcagcccagacctgctggtgacagtgtctgccagcggcctgctgggcacccacagctggctgccctatgacaggaacatcagcaactacttctccttcagcaaggaccccaccatgggcagccacaagacccagaggctgctgagcggcccctgggtgcccggcagcggcgtgtctggccaggccctggccgtggccccagatggcaagctgctcttcagcggcggccactgggatggcagcctgcgggtgacagccctgccccggggcaagctgctgagccagctgagctgccacctggatgtggtgacctgcctggccctggacacctgtggcatctacctgatcagcggcagccgggacaccacctgcatggtgtggaggctgctgcaccagggcggcctgtctgtgggcctggcccccaagcctgtgcaggtgctgtatggccatggagctgctgtgtcctgtgtggccatcagcacagagctggacatggctgtgtctggctctgaagatggcaccgtcatcatccacacagtgcggcggggccagtttgtggccgccctgcggcccctgggcgccaccttccctggccccatcttccacctggccctgggcagcgagggccagatcgtggtgcagagcagcgcctgggagaggcctggggcccaggtgacctacagcctgcacctgtacagcgtgaatggcaagctgcgggccagcctgcccctggccgagcagcccacagccctgactgtgacagaggactttgtgctgctgggcacagcccagtgtgccctgcacatcctgcagctgaacaccctgctgcctgctgccccacccctgcccatgaaggtggccatccgctctgtggccgtgaccaaggagaggagccacgtgctggtgggcctggaggatggcaagctgattgtggtggtggccggccagcccagcgaggtgcgcagcagccagtttgccaggaagctgtggaggagcagccgccgcatcagccaggtgagcagcggggagacagagtacaaccccacagaggccaggtag

SEQ ID NO: 161531 - DNA, 8265 bp, Artificial Sequence
  Description of Artificial Sequence: Synthetic coding sequence
atggccgccagcgagcggctgtatgagctgtggctgctgtactatgcccagaaggacctgggctacctgcagcagtggctgaaggcctttgtgggcgccttcaagaagagcatcagcctgagcagcctggagccccggcggcctgaggaggccggggctgaggtgcccctgctgcccctggatgagctgcacgtgctggccgagcagctgcaccaggccgacctggagcaggccctgctgctgctgaagctgttcatcatcctgtgcaggaacctggagaacattgaagctggccggggccaggtgctggtgccccgggtgctggccctgctgaccaagctggtggccgagctgaagggctgccccccaccccagggccggggcacccagctggagaatgtggccctgcacgccctgctgctgtgtgagggcctgtttgacccctaccagacctggaggcggcagaggtctggagaggtgatcagcagcaaggagaagagcaagtacaagttccccccagctgccctgccccaggagttcagcgccttcttccaggagagcctgcagaatgctgaccacctgccccccatcctgctgctgcggctcatccacctgttctgtgctgtgctggccggcggcaaggaaaatggccagatggctgtgtctgatggctctgtgaagggcctgctgtctgtggtgcggggctggagccggggccctgccccagacccctgcctggtgcccctggccctggaggccctggtgggcgctgtgcacgtgctgcacgccagccgggccccaccccggggccctgagctgcgggccctgctggagagctacttccacgtgctgaatgctgactggccagctggcctgagcagcggccctgaggaggccctggtgaccctgcgggtgtccatgctggatgccatccccatgatgctggcctgtgaggacaggcctgtgctgcaggccaccttcctgagcaacaactgctttgagcacctgaccaggctcatccagaacagcaagctgtacctgcagagccgggcccctcctgagggggacagcgacctggccacccggctgctgacagagccagatgtgcagaaggtgctggaccaggacacagatgccatcgctgtgcacgtggtgcgggtgctgacctgcatcatgtctgacagccccagcgccaaggaggtgttcaaggagcgcatcggctacccccacctgcaggaggtgctgcagagccacggcccccccacccaccggctgctgcaggagctgctgaacatggctgtggagggggaccacagcatgtgccccccaccacccatcagaaatgagcagcctgtgctggtgctggcccagtggctgcccagcctgcccacagctgagctgcggctcttcctggcccagaggctgcgctggctgtgtgacagctgcccagccagccgggccacctgtgtgcaggccggcctggtgggctgcctgctggagaccctgagcacaggcctggccctggaggcccgctgccaggagcagctgctggccctgctgcaggccctgggccgggtgtccatccggcccatggagctgcggcacctgctgcggcccaggcctggcctggacagcgagcctggaggagctgaggccggcaaggcccggcatgctggggccgtcatccgcaccctgagcggcatggcccggcaccagggccctgcccgggccctgcgctactttgacctgacccccagcatggccggcatcatggtgccccctgtgcagcgctggccaggccctggcttcaccttccacgcctggctgtgcctgcaccccatggacacagcccccaccccagcccccacccggcccctgcagaggaagcagctgtacagcttcttcaccagcagcggcagcggctttgaggccttcttcaccgctgctggcaccctggtggtggccgtgtgcaccaggaaggagtacctgaccatgagcctgcctgaggtgtcctttgctgacagcgcctggcactgtgtggccatcgtgcacgtgcccggccggcggcccttcagccagaacctggtgcacgtgtacaaggatggccacctggtgaagacagcccccctgcgctgccccagcctgtctgagcccttcagcagctgctgcatcggcagcgctggctaccgcaccaccaccaccaccaccggcctgcccaccccacctgtgcctgccaccctggcctacacccacccagccctgaccaggagccagagcgtgcctgccagcacaggcctgggctggggcagcggcctggtggcccccctgcaggagggcagcattgacagcaccctggccggcacccaggacacccgctggggcagccccaccagcctggagggggagctgggcgctgtggccatcttccacgaggccctgcaggccacagccctgcggaccctgtgcaccctgggccccaatgaaacagcccccttcaagccagagggggagctgcacgagctgagcacccggctgctgctgcactacagcccccaggcctgcaagaacaacatctgcctggacctgagccccagccacggcctggatggccgcctgaccggccaccgggtggagacctgggatgtgaaggatgtggtgaactgtgtgggcggcatgggcgccctgctgcccctgctggagcgggtggccgcccagcccaaggaggccgaggccggccctgctgagacccatgacctggtgggccctgagctgaccagcggccacaacacccagggcctggtgctgcccctgggcaagagcagcgaggagaggatggagagaaatgctgtggccgccttcctgctgatgctgaggaacttcctgcagggccacatggtgaaccaggagagcctggtgcagtgccagggccctgccatcatcggggccctgctgaggaaggtgcccagctgggccatggacatgaatgtgctgatgtctgcccagctgctgatggagcaggtggccgctgagggcagcggccccctgctgtacctgctgtaccagcacctgctcttcaacttccacctgtggaccctgagtgactttgctgtgcggctgggccacatccagtacatgagcagcatcgtgcgggagcaccggcagaagctgaggaagaagtatggagtgcagttcatcctggatgccctgcggacccactacagcccccagcgggagcggcccctggccgcagatgacctgaggacagtgcagaccagcctgctgggcctggcccgggagttcctggtgcgcagcctgtctgcagatgatgtgcaggtgacccagaccatgctgtccttcctggccgccactggagatgatggccaggccgtgggcgccctggacctgctgctggccctgctgcacggcagcctggtgcaggagagcctggccgtgttcctgctggagcccggcaacctggaggtgctgctggccctgctggtgcggcccggcagcctgcccctgctgcctgacagagtgtgcaagatcctgcggcggctgcagcagaatgaaaggctgcctgagaggagccggcagaggctgcggctgcgggagtgtggcctgcagggcctggtggcctgcctgcctgagggcaccgtgagcccccagctgtgccagggcctgtacaagctgttcctgggcgctgactgcctgaacctgagtgacctgctggccgtggtgcagctgagcctgcaggccgacctgtctgtgcggctggacatctgccggcagctgttccacctgatctacggccagccagatgtggtgcggctgctggcccggcaggccggctggcaggatgtgctgacccggctgtatgtgctggaggccgccacagctggcagccccccacccagcagccctgagagccccaccagccccaagccagccccacccaagccacccacagagagccctgctgagcccagtgatgtgttcctgcccagcgaggccccctgcccagaccctgatggcttctaccacgccctgagccccttctgcaccccatttgacctgggcctggagaggagctctgtgggcagcggcaacacagctgggggcggcggcagcagcggcaccctgaccccagccagccagcccggcacccccagccccctggatggcccccggcccttccctgctgcccctggccgccacagcagcagcctgagcaatgtgctggaggatggcagcctgcctgagcccaccatctctggagatgacaccagcaacaccagcaacccccagcagaccagcgaggaggagctgtgcaacctgctgaccaacgtgctcttctctgtgacctggaggggcgtggagggcagtgatgaggccgcctggagggagcggggccaggtgttttctgtgctgacccagctgggcgccagcgccaccctggtgcggcccccagactgcatcaagaggagcctgctggagatgatgctggagagcgccctgacagacatcaaggaggcccctgtgggcgtgctggccagcctgacccagcaggccctgtggctgctgcggctgctgcaggacttcctgtgtgccgagggccacggcaaccaggagctgtggagcgagaagctgtttgagggcgtgtgcagcctgctggaccggctgggcgcctggccccacctggccaacggcacagctgacctgcgggagatggcccagatcggcctgcggctggtgctgggctacatcctgctggaggacccccagctgcacgcccaggcctacgtgcggctgcacatgctgctgcagacagctgtgcctgcccggcgggaggaggcctgctacgtgctgagcaagctggaggccgccctgggccgggtgctgaacaccagcagcctggagagcgccacagatgaagctggcagccccctggccgctgctgctgctgctgctgctgctgagcgctgctcctggctggtgcccctggtgaggaccctgctggaccgggcctatgagcccctgggcctgcagtggggcctgcccagcctgccccccaccaacggcagccccaccttctttgaggacttccaggccttctgtgccaccccagagtggaggcacttcatcgacaagcaggtgcagcccaccatgagccagtttgagatggacacctacgccaagagccatgacctgatgagcggcttctggaatgcctgctatgacatgctgatgagcagcggccagaggcggcagtgggagcgggcccagagcagaagagccttccaggagctggtgctggagcccgcccagaggcgggcccggctggagggcctgcgctacacagctgtgctgaagcagcaggccacccagcacagcatggccctgctgcactggggcgccctgtggaggcagctggccagcccctgtggggcctgggccctgcgggacacccccatcccccgctggaagctgagcagcgctgagacctacagcaggatgaggctgaagctggtgcccaaccaccactttgacccccacctggaggccagcgccctgcgggacaacctgggggaggtgcccctgacccccacagaggaggccagcctgcccctggccgtgaccaaggaggccaaggtgtccaccccacctgagctgctgcaggaggaccagctgggggaggatgagctggccgagctggagacccccatggaggccgctgagctggatgagcagcgggagaagctggtgctgtctgctgagtgccagctggtgacagtggtggccgtggtgcccggcctgctggaggtgaccacccagaatgtgtacttctatgatggcagcacagagcgggtggagacagaggagggcatcggctatgacttcagaagacccctggcccagctgcgggaggtgcacctgcggcgcttcaacctgcggcgcagcgccctggagctgttcttcatcgaccaggccaactacttcctgaacttcccctgcaaggtgggcaccacccctgtgagcagccccagccagaccccccggccccagcccggccccatccccccccacacccaggtgaggaaccaggtgtacagctggctgctgcggctgcggccccccagccagggctacctgagcagccgcagcccccaggagatgctgcgggccagcggcctgacccagaagtgggtgcagcgggagatcagcaactttgagtacctgatgcagctgaacaccatcgccggccgcacctacaatgacctgagccagtaccctgtgttcccctgggtgctgcaggactatgtgagccccaccctggacctgagcaacccagctgtgttccgggacctgagcaagcccatcggcgtggtgaaccccaagcacgcccagctggtgcgggagaagtatgagagctttgaagatcctgctggcaccatcgacaagttccactacggcacccactacagcaatgctgctggggtgatgcactacctgatccgggtggagcccttcaccagcctgcacgtgcagctgcagagcggccgctttgactgcagcgaccggcagttccacagcgtggccgccgcctggcaggcccggctggagagccctgcagatgtgaaggagctgatccctgagttcttctacttcccagacttcctggagaaccagaatggatttgacctgggctgcctgcagctgaccaatgagaaggtgggagatgtggtgctgcccccctgggccagcagccctgaggacttcatccagcagcaccggcaggccctggagagtgaatatgtgtctgcccacctgcacgagtggattgacctgatcttcggctacaagcagaggggccctgctgctgaggaggccctgaatgtgttctactactgcacctatgaaggagctgtggacctggaccacgtgacagatgagcgggagaggaaggccctggagggcatcatcagcaactttggccagaccccctgccagctgctgaaggagccccaccccacccggctgtctgctgaggaggccgcccaccggctggcccggctggacaccaacagccccagcatcttccagcacctggatgagctgaaggccttctttgctgaggtggtgtctgatggagtgcccctggtgctggccctggtgccccaccggcagccccacagcttcatcacccagggcagcccagacctgctggtgacagtgtctgccagcggcctgctgggcacccacagctggctgccctatgacaggaacatcagcaactacttctccttcagcaaggaccccaccatgggcagccacaagacccagaggctgctgagcggcccctgggtgcccggcagcggcgtgtctggccaggccctggccgtggccccagatggcaagctgctcttcagcggcggccactgggatggcagcctgcgggtgacagccctgccccggggcaagctgctgagccagctgagctgccacctggatgtggtgacctgcctggccctggacacctgtggcatctacctgatcagcggcagccgggacaccacctgcatggtgtggaggctgctgcaccagggcggcctgtctgtgggcctggcccccaagcctgtgcaggtgctgtatggccacggggctgctgtgtcctgtgtggccatcagcacagagctggacatggctgtgtctggctctgaagatggcaccgtcatcatccacacagtgagaagaggccagtttgtggccgccctgcggcccctgggcgccaccttccctggccccatcttccacctggccctgggcagcgagggccagatcgtggtgcagagcagcgcctgggagaggcctggggcccaggtgacctacagcctgcacctgtacagcgtgaatggcaagctgcgggccagcctgcccctggccgagcagcccacagccctgactgtgacagaagattttgtgctgctgggcacagcccagtgtgccctgcacatcctgcagctgaacaccctgctgcctgctgccccacccctgcccatgaaggtggccatccgctctgtggccgtgaccaaggagaggagccacgtgctggtgggcctggaggatggcaagctgattgtggtggtggccggccagcccagcgaggtgcgcagcagccagtttgccaggaagctgtggaggagcagccgccgcatcagccaggtgtcctctggagaaacagagtacaaccccacagaggccaggtag

SEQ ID NO: 161532 - DNA, 7116 bp, Artificial Sequence
  Description of Artificial Sequence: Synthetic coding sequence
atggccgcccctgagagcggccctgccctgagccctggaacagctgagggggaggaggagaccatcctgtatgacctgctggtgaacacagagtggcccccagagacagaggtgcagccccggggcaaccagaagcacggggccagcttcatcatcaccaaggccatccgggaccggctgctcttcctgcggcagtacatctggtacagccctgcccccttcctgctgcctgatggcctggtgcggctggtgaacaagcagatcaactggcacctggtgctggccagcaatggcaagctgctggccgctgtgcaggaccagtgtgtggagatccgcagcgccaaggatgacttcaccagcatcatcggcaagtgccaggtgcccaaggaccccaagccccagtggaggagagtggcctggagctatgactgcaccctgctggcctatgcagagagcactggaacagtgcgggtgtttgacctgatgggcagcgagctgtttgtgatcagccctgccagcagcttcatcggggacctgtcctatgccatcgccggcctcatcttcctggagtacaaggccagcgcccagtggagcgctgagctgctggtgatcaactacagaggagagctgcggagctacctggtgtctgtgggcaccaaccagagctaccaggagagccactgcttctccttcagcagccactacccccacggcatcaacacagccatctaccaccctggccaccggctgctgctggtgggcggctgtgaaacagctgaggtgggcatgagcaaggccagcagctgtggcctgagcgcctggagggtgctgagcggcagcccctactacaagcaggtgaccaatggaggagatggagtgacagctgtgcccaagaccctgggcctgctgaggatgctgtctgtgaagttctacagccggcagggccaggagcaggacggcatcttcaagatgagcctgagcccagatggcatgctgctggccgccatccacttcagcggcaagctgagcatctgggccatccccagcctgaagcagcagggcgagtggggccagaatgagcagcccggctatgatgacctgaacccagactggaggctgagcacagagaagaggaagaagatcaaggacaaggagagcttctaccccctgattgatgtgaactggtgggccgacagcgctgtgaccctggcccgctgcagcggggccctgactgtgtcctctgtgaagaccctgaagaacctgctgggcaagagctgtgagtggtttgagcccagcccccaggtgacagccacccatgatggcggcttcctgagcctggagtgtgagatcaagctggcccccaagaggagccggctggagaccagggctggggaggaggatgaaggagaagaagattctgacagcgactatgagatcagcgccaaggcccgctacttcggctacatcaagcagggcctgtacctggtgacagagatggagagatttgccccacccaggaagaggcccaggaccatcaccaagaactaccgcctggtgtccctgcggagcaccaccccagaggagctgtaccagaggaagattgagagcgaggagtatgaggaggccctgagcctggcccacacctacggcctggacacagacctggtgtaccagaggcagtggaggaagtctgctgtgaatgtggccagcatccagaactacctgagcaagatcaagaagaggtcctgggtgctgcatgaatgtctggagcgggtgcctgaaaatgtggatgctgccaaggagctgctgcagtatggcctgaagggcacagacctggaggccctgctggccatcggcaaaggagcagatgatggccgcttcaccctgcccggggagattgatattgacagcatctcctatgaggagctgagccccccagatgaggagcccgccaagaacaagaaggagaaggagctgaagaagaggcaggagctgctgaagctggtgaacttcagcaagctgaccctggagcagaaggagctgtgccgctgcaggaggaagctgctgacctacctggaccggctggccacctatgaggagatcctgggcgtgccccacgccagcgagcagagatatgatgctgagttcttcaagaagttcaggaaccagaacatcgtgctgagcgcccggacctacgcccaggagagcaatgtgcaggccctggagatcctcttcacctaccacggcagtgacctgctgccccaccggctggccatcctgagcaacttccctgagaccaccagcccccatgagtacagcgtgctgctgcctgaggcctgcttcaacggggacagcctgatgatcatcccctggcatgagcacaagcaccgggccaaggactggtgtgaggagctggcctgcaggatggtggtggagcccaacctgcaggatgaaagtgagttcctgtatgctgcccagcctgagctgctgcgcttcaggatgacccagctgactgtggagaaggtgatggactggtaccagaccagggctgaggagattgagcactacgcccggcaggtggactgtgccctgagcctcatccggctgggcatggagaggaacatccctggcctgctggtgctgtgtgacaacctggtgaccctggagaccctggtgtatgaggcccgctgtgatgtgaccctgaccctgaaggagctgcagcagatgaaggacatcgagaagctgcggctgctgatgaacagctgcagcgaggacaagtatgtgaccagcgcctaccagtggatggtgcccttcctgcaccgctgtgagaagcagagccctggggtggccaatgagctgctgaaggagtacctggtgaccctggccaagggggacctgaagttccccctgaagatcttccagcacagcaagccagacctgcagcagaagatcatcccagaccaggaccagctgatggccatcgccctggagtgcatctacacctgtgaaagaaatgaccagctgtgcctgtgctatgacctgctggagtgcctgcctgagcggggctatggagacaagacagaggccaccaccaagctgcatgacatggtggaccagctggagcagatcctgtctgtgtctgagctgctggagaagcacggcctggagaagcccatcagctttgtgaagaacacccagagcagcagcgaggaggccaggaagctgatggtgcggctgaccaggcacactggaaggaagcagccccctgtgtctgagagccactggaggaccctgctgcaggacatgctgaccatgcagcagaatgtgtacacctgcctggacagtgatgcctgctatgagatcttcacagagagcctgctgtgcagcagccggctggagaacatccacctggccggccagatgatgcactgcagcgcctgcagtgaaaatcctcctgctggcatcgcccacaagggcaagccccactacagagtgtcctatgagaagagcattgacctggtgctggccgccagccgggagtacttcaacagcagcaccaacctgacagacagctgcatggacctggcccgctgctgcctgcagctgatcacagaccggcccccagccatccaggaggagctggacctgatccaggccgtgggctgcctggaggagtttggagtgaagatcctgcccctgcaggtgcggctgtgcccagaccgcatcagcctcatcaaggagtgcatcagccagagccccacctgctacaagcagagcaccaagctgctgggcctggccgagctgctgcgggtggccggggagaaccctgaggagcggcggggccaggtgctgatcctgctggtggagcaggccctgcgcttccatgactacaaggccgcctccatgcactgccaggagctgatggccaccggctaccccaagtcctgggatgtgtgcagccagctgggccagagcgagggctaccaggacctggccacccggcaggagctgatggcctttgccctgacccactgcccccccagcagcattgagctgctgctggccgccagcagcagcctgcagacagagatcctgtaccagagggtgaacttccagatccaccatgaaggaggagagaacatcagcgccagccccctgaccagcaaggctgtgcaggaggatgaggtgggcgtgcccggcagcaacagcgctgacctgctgcgctggaccacagccaccaccatgaaggtgctgagcaacaccaccaccaccaccaaggctgtgctgcaggccgtgtctgatggccagtggtggaagaagagcctgacctacctgcggcccctgcagggccagaagtgtggcggggcctaccagatcggcaccacagccaatgaagacctggagaagcagggctgccaccccttctatgagagcgtcatcagcaacccctttgtggccgagagcgagggcacctatgacacctaccagcacgtgcctgtggagagctttgctgaggtgctgctgaggacaggcaagctggccgaggccaagaacaagggggaggtgttccccaccacagaggtgctgctgcagctggccagcgaggccctgcccaatgacatgaccctggccctggcctacctgctggccctgccccaggtgctggatgccaaccgctgctttgagaagcagagccccagcgccctgagcctgcagctggccgcctactactacagcctgcagatctatgcccggctggccccctgcttccgggacaagtgccaccccctgtacagagctgaccccaaggagctgatcaagatggtgaccaggcatgtgaccaggcatgagcacgaggcctggccagaagatctcatcagcctgaccaagcagctgcactgctacaatgaaaggctgctggacttcacccaggcccagatcctgcagggcctgaggaaaggagtggatgtgcagcgcttcaccgcagatgaccagtacaagcgggagaccatcctgggcctggccgagaccctggaggagagcgtgtacagcatcgccatcagcctggcccagcgctacagcgtgagccgctgggaggtgttcatgacccacctggagttcctgttcacagacagcggcctgagcaccctggagattgagaacagagcccaggacctgcacctgtttgagaccctgaagacagatcctgaggccttccaccagcacatggtgaagtacatctaccccaccatcggcggctttgaccacgagcggctgcagtactacttcaccctgctggagaactgtggctgtgccgacctgggcaactgtgccatcaagccagagacccacatccggctgctgaagaagttcaaggtggtggccagcggcctgaactacaagaagctgacagatgagaacatgagccccctggaggccctggagcctgtgctgagcagccagaacatcctgagcatcagcaagctggtgcccaagatccctgagaaggatggccagatgctgagccccagcagcctgtacaccatctggctgcagaagctgttctggacaggagacccccacctgatcaagcaggtgcccggcagcagccctgagtggctgcacgcctatgatgtgtgcatgaagtactttgaccggctgcaccctggggacctgatcaccgtggtggatgctgtgaccttcagccccaaggctgtgaccaagctgtctgtggaggccaggaaggagatgaccaggaaggccatcaagacagtgaagcacttcatcgagaagcccaggaagagaaattctgaagatgaggcccaggaggccaaggacagcaaggtgacctacgccgacaccctgaaccacctggagaagagcctggcccacctggagaccctgagccacagcttcatcctgagcctgaagaacagcgagcaggagaccctgcagaagtacagccacctgtatgacctgagccgctctgagaaggagaagctgcatgatgaagctgtggccatctgcctggatggccagcccctggccatgatccagcagctgctggaggtggccgtgggccccctggacatcagccccaaggacatcgtgcagagcgccatcatgaagatcatcagcgccctgagcggcggcagcgctgacctgggcggcccccgggaccccctgaaggtgctggagggcgtggtggccgctgtgcacgcctctgtggacaagggggaggagctggtgtccccagaggacctgctggagtggctgcggcccttctgtgctgatgatgcctggcctgtgcggccccgcatccacgtgctgcagatcctgggccagagcttccacctgacagaggaggacagcaagctgctggtgttcttcagaacagaggccatcctgaaggcctcctggccccagaggcaggtggacattgctgacattgaaaatgaggagaaccgctactgcctcttcatggagctgctggagagcagccaccatgaagctgagttccagcacctggtgctgctgctgcaggcctggccacccatgaagtcagaatatgtgatcaccaacaacccctgggtgcggctggccaccgtgatgctgacccgctgcaccatggagaacaaggagggcctgggcaatgaggtgctgaagatgtgccgcagcctgtacaacaccaagcagatgctgcctgctgagggcgtgaaggagctgtgcctgctgctgctgaaccagagcctgctgctgcccagcctgaagctgctgctggagagcagagatgagcacctgcacgagatggccctggagcagatcacagctgtgaccaccgtgaatgacagcaactgtgaccaggagctgctgagcctgctgctggatgccaagctgctggtgaagtgtgtgtccacccccttctacccccgcatcgtggaccacctgctggccagcctgcagcagggccgctgggatgctgaggagctgggccgccacctgcgggaggccggccatgaagctgaggccggcagcctgctgctggccgtgcggggcacccaccaggccttccgcaccttcagcacagccctgcgggccgcccagcactgggtgtag

SEQ ID NO: 161533 - DNA, 6756 bp, Artificial Sequence
  Description of Artificial Sequence: Synthetic coding sequence
atggccgcccctgagagcggccctgccctgagccctggaacagctgagggggaggaggagaccatcctgtatgacctgctggtgaacacagagtggcccccagagacagaggtgcagccccggggcaaccagaagcacggggccagcttcatcatcaccaaggccatccgggaccggctgctcttcctgcggcagtacatctggtacagccctgcccccttcctgctgcctgatggcctggtgcggctggtgaacaagcagatcaactggcacctggtgctggccagcaatggcaagctgctggccgctgtgcaggaccagtgtgtggagatccgcagcgccaaggatgacttcaccagcatcatcggcaagtgccaggtgcccaaggaccccaagccccagtggaggagagtggcctggagctatgactgcaccctgctggcctatgcagagagcactggaacagtgcgggtgtttgacctgatgggcagcgagctgtttgtgatcagccctgccagcagcttcatcggggacctgtcctatgccatcgccggcctcatcttcctggagtacaaggccagcgcccagtggagcgctgagctgctggtgatcaactacagaggagagctgcggagctacctggtgtctgtgggcaccaaccagagctaccaggagagccactgcttctccttcagcagccactacccccacggcatcaacacagccatctaccaccctggccaccggctgctgctggtgggcggctgtgaaacagctgaggtgggcatgagcaaggccagcagctgtggcctgagcgcctggagggtgctgagcggcagcccctactacaagcaggtgaccaatggaggagatggagtgacagctgtgcccaagaccctgggcctgctgaggatgctgtctgtgaagttctacagccggcagggccaggagcaggacggcatcttcaagatgagcctgagcccagatggcatgctgctggccgccatccacttcagcggcaagctgagcatctgggccatccccagcctgaagcagcagggcgagtggggccagaatgagcagcccggctatgatgacctgaacccagactggaggctgagcacagagaagaggaagaagatcaaggacaaggagagcttctaccccctgattgatgtgaactggtgggccgacagcgctgtgaccctggcccgctgcagcggggccctgactgtgtcctctgtgaagaccctgaagaacctgctgggcaagagctgtgagtggtttgagcccagcccccaggtgacagccacccatgatggcggcttcctgagcctggagtgtgagatcaagctggcccccaagaggagccggctggagaccagggctggggaggaggatgaaggagaagaagattctgacagcgactatgagatcagcgccaaggcccgctacttcggctacatcaagcagggcctgtacctggtgacagagatggagagatttgccccacccaggaagaggcccaggaccatcaccaagaactaccgcctggtgtccctgcggagcaccaccccagaggagctgtaccagaggaagattgagagcgaggagtatgaggaggccctgagcctggcccacacctacggcctggacacagacctggtgtaccagaggcagtggaggaagtctgctgtgaatgtggccagcatccagaactacctgagcaagatcaagaagaggtcctgggtgctgcatgaatgtctggagcgggtgcctgaaaatgtggatgctgccaaggagctgctgcagtatggcctgaagggcacagacctggaggccctgctggccatcggcaaaggagcagatgatggccgcttcaccctgcccggggagattgatattgacagcatctcctatgaggagctgagccccccagatgaggagcccgccaagaacaagaaggagaaggagctgaagaagaggcaggagctgctgaagctggtgaacttcagcaagctgaccctggagcagaaggagctgtgccgctgcaggaggaagctgctgacctacctggaccggctggccacctatgaggagatcctgggcgtgccccacgccagcgagcagagatatgatgctgagttcttcaagaagttcaggaaccagaacatcgtgctgagcgcccggacctacgcccaggagagcaatgtgcaggccctggagatcctcttcacctaccacggcagtgacctgctgccccaccggctggccatcctgagcaacttccctgagaccaccagcccccatgagtacagcgtgctgctgcctgaggcctgcttcaacggggacagcctgatgatcatcccctggcatgagcacaagcaccgggccaaggactggtgtgaggagctggcctgcaggatggtggtggagcccaacctgcaggatgaaagtgagttcctgtatgctgcccagcctgagctgctgcgcttcaggatgacccagctgactgtggagaaggtgatggactggtaccagaccagggctgaggagattgagcactacgcccggcagctgcagcagaagatcatcccagaccaggaccagctgatggccatcgccctggagtgcatctacacctgtgaaagaaatgaccagctgtgcctgtgctatgacctgctggagtgcctgcctgagcggggctatggagacaagacagaggccaccaccaagctgcatgacatggtggaccagctggagcagatcctgtctgtgtctgagctgctggagaagcacggcctggagaagcccatcagctttgtgaagaacacccagagcagcagcgaggaggccaggaagctgatggtgcggctgaccaggcacactggaaggaagcagccccctgtgtctgagagccactggaggaccctgctgcaggacatgctgaccatgcagcagaatgtgtacacctgcctggacagtgatgcctgctatgagatcttcacagagagcctgctgtgcagcagccggctggagaacatccacctggccggccagatgatgcactgcagcgcctgcagtgaaaatcctcctgctggcatcgcccacaagggcaagccccactacagagtgtcctatgagaagagcattgacctggtgctggccgccagccgggagtacttcaacagcagcaccaacctgacagacagctgcatggacctggcccgctgctgcctgcagctgatcacagaccggcccccagccatccaggaggagctggacctgatccaggccgtgggctgcctggaggagtttggagtgaagatcctgcccctgcaggtgcggctgtgcccagaccgcatcagcctcatcaaggagtgcatcagccagagccccacctgctacaagcagagcaccaagctgctgggcctggccgagctgctgcgggtggccggggagaaccctgaggagcggcggggccaggtgctgatcctgctggtggagcaggccctgcgcttccatgactacaaggccgcctccatgcactgccaggagctgatggccaccggctaccccaagtcctgggatgtgtgcagccagctgggccagagcgagggctaccaggacctggccacccggcaggagctgatggcctttgccctgacccactgcccccccagcagcattgagctgctgctggccgccagcagcagcctgcagacagagatcctgtaccagagggtgaacttccagatccaccatgaaggaggagagaacatcagcgccagccccctgaccagcaaggctgtgcaggaggatgaggtgggcgtgcccggcagcaacagcgctgacctgctgcgctggaccacagccaccaccatgaaggtgctgagcaacaccaccaccaccaccaaggctgtgctgcaggccgtgtctgatggccagtggtggaagaagagcctgacctacctgcggcccctgcagggccagaagtgtggcggggcctaccagatcggcaccacagccaatgaagacctggagaagcagggctgccaccccttctatgagagcgtcatcagcaacccctttgtggccgagagcgagggcacctatgacacctaccagcacgtgcctgtggagagctttgctgaggtgctgctgaggacaggcaagctggccgaggccaagaacaagggggaggtgttccccaccacagaggtgctgctgcagctggccagcgaggccctgcccaatgacatgaccctggccctggcctacctgctggccctgccccaggtgctggatgccaaccgctgctttgagaagcagagccccagcgccctgagcctgcagctggccgcctactactacagcctgcagatctatgcccggctggccccctgcttccgggacaagtgccaccccctgtacagagctgaccccaaggagctgatcaagatggtgaccaggcatgtgaccaggcatgagcacgaggcctggccagaagatctcatcagcctgaccaagcagctgcactgctacaatgaaaggctgctggacttcacccaggcccagatcctgcagggcctgaggaaaggagtggatgtgcagcgcttcaccgcagatgaccagtacaagcgggagaccatcctgggcctggccgagaccctggaggagagcgtgtacagcatcgccatcagcctggcccagcgctacagcgtgagccgctgggaggtgttcatgacccacctggagttcctgttcacagacagcggcctgagcaccctggagattgagaacagagcccaggacctgcacctgtttgagaccctgaagacagatcctgaggccttccaccagcacatggtgaagtacatctaccccaccatcggcggctttgaccacgagcggctgcagtactacttcaccctgctggagaactgtggctgtgccgacctgggcaactgtgccatcaagccagagacccacatccggctgctgaagaagttcaaggtggtggccagcggcctgaactacaagaagctgacagatgagaacatgagccccctggaggccctggagcctgtgctgagcagccagaacatcctgagcatcagcaagctggtgcccaagatccctgagaaggatggccagatgctgagccccagcagcctgtacaccatctggctgcagaagctgttctggacaggagacccccacctgatcaagcaggtgcccggcagcagccctgagtggctgcacgcctatgatgtgtgcatgaagtactttgaccggctgcaccctggggacctgatcaccgtggtggatgctgtgaccttcagccccaaggctgtgaccaagctgtctgtggaggccaggaaggagatgaccaggaaggccatcaagacagtgaagcacttcatcgagaagcccaggaagagaaattctgaagatgaggcccaggaggccaaggacagcaaggtgacctacgccgacaccctgaaccacctggagaagagcctggcccacctggagaccctgagccacagcttcatcctgagcctgaagaacagcgagcaggagaccctgcagaagtacagccacctgtatgacctgagccgctctgagaaggagaagctgcatgatgaagctgtggccatctgcctggatggccagcccctggccatgatccagcagctgctggaggtggccgtgggccccctggacatcagccccaaggacatcgtgcagagcgccatcatgaagatcatcagcgccctgagcggcggcagcgctgacctgggcggcccccgggaccccctgaaggtgctggagggcgtggtggccgctgtgcacgcctctgtggacaagggggaggagctggtgtccccagaggacctgctggagtggctgcggcccttctgtgctgatgatgcctggcctgtgcggccccgcatccacgtgctgcagatcctgggccagagcttccacctgacagaggaggacagcaagctgctggtgttcttcagaacagaggccatcctgaaggcctcctggccccagaggcaggtggacattgctgacattgaaaatgaggagaaccgctactgcctcttcatggagctgctggagagcagccaccatgaagctgagttccagcacctggtgctgctgctgcaggcctggccacccatgaagtcagaatatgtgatcaccaacaacccctgggtgcggctggccaccgtgatgctgacccgctgcaccatggagaacaaggagggcctgggcaatgaggtgctgaagatgtgccgcagcctgtacaacaccaagcagatgctgcctgctgagggcgtgaaggagctgtgcctgctgctgctgaaccagagcctgctgctgcccagcctgaagctgctgctggagagcagagatgagcacctgcacgagatggccctggagcagatcacagctgtgaccaccgtgaatgacagcaactgtgaccaggagctgctgagcctgctgctggatgccaagctgctggtgaagtgtgtgtccacccccttctacccccgcatcgtggaccacctgctggccagcctgcagcagggccgctgggatgctgaggagctgggccgccacctgcgggaggccggccatgaagctgaggccggcagcctgctgctggccgtgcggggcacccaccaggccttccgcaccttcagcacagccctgcgggccgcccagcactgggtgtag

SEQ ID NO: 161534 - DNA, 10662 bp, Artificial Sequence
  Description of Artificial Sequence: Synthetic coding sequence
atggtggtgtctgctggcccctggagcagcgagaaggccgagatgaacatcctggagatcaatgagaccctgcggccccagctggccgagaagaagcagcagttcaggaacctgaaggagaagtgcttcctgacccagctggccggcttcctggccaaccggcagaagaagtacaagtatgaggagtgcaaggacctgatcaagttcatgctgagaaatgaaaggcagttcaaggaggagaagctggccgagcagctgaagcaggccgaggagctgcggcagtacaaggtgctggtgcacagccaggagcgggagctgacccagctgcgggagaagctgcgggagggcagagatgccagccgcagcctgtatgagcacctgcaggccctgctgaccccagatgagccagacaagagccagggccaggacctgcaggagcagctggccgagggctgccgcctggcccagcacctggtgcagaagctgagcccagaaaatgatgaagatgaagatgaagatgtgcaggtggaggaggccgagaaggtgctggagagcagcgccccccgggaggtgcagaaggccgaggagagcaaggtgcctgaggacagcctggaggagtgtgccatcacctgcagcaacagccacggcccctgtgacagcaaccagccccacaagaacatcaagatcacctttgaagaagatgaggtgaacagcaccctggtggtggaccgggagagcagccatgatgagtgccaggatgccctgaacatcctgcctgtgcccggccccaccagcagcgccaccaacgtgtccatggtggtgtctgctggccccctgagcagcgagaaggccgagatgaacatcctggagatcaatgagaagctgcggccccagctggccgagaagaagcagcagttcaggaacctgaaggagaagtgcttcctgacccagctgagcggcttcctggccaaccagcagaagaagtacaagtatgaggagtgcaaggacctgatcaagttcatgctgagaaatgaaaggcagttcaaggaggagaagctggccgagcagctgaagcaggccgaggagctgcggcagtacaaggtgctggtgcacgcccaggagcgggagctgacccagctgaaggagaagctgcgggagggcagagatgccagccgcagcctgaatgagcacctgcaggccctgctgaccccctatgagccagacaagagccagggccaggacctgcaggagcagctggccgagggctgccgcctggcccagcacctggtgcagaagctgagcccagaaaatgacaatgatgatgatgaagatgtgcaggtggaggtggccgagaaggtgcagaagagcagcgccccccgggagatgcagaaggccgaggagaaggaggtgcctgaggacagcctggaggagtgtgccatcacctacagcaacagccacggcagctatgacagcaaccagccccacaggaagaccaagatcacctttgaggaggacaaggtggacagcaccctcatcggcagcagcagccacgtggagtgggaggatgctgtgcacatcatcccagaaaatgaaagtgatgatgaggaggaggaggagaagggccctgtgagccccaggaacctgcaggagagcgaggaggaggaggtgccccaggagagctgggatgagggctacagcaccctgagcatccccccagagatgctggccagctaccagagctacagcagcaccttccacagcctggaggagcagcaggtgtgcatggctgtggacatcggccgccaccgctgggaccaggtgaagaaggaggaccaggaggccaccggcccccggctgagccgggagctgctggatgagaaggagcctgaggtgctgcaggacagcctggaccgctgctacagcacccccagcggctacctggagctgcctgacctgggccagccctacagcagcgctgtgtacagcctggaggagcagtacctgggcctggccctggatgtggaccgcatcaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagagaagaggccgccgcagcaagaaggagaggagaagaggaaggaaggagggggaggaggaccagaaccccccctgcccccggctgagccgggagctgctggatgagaagggccctgaggtgctgcaggacagcctggaccgctgctacagcaccccatctggctgcctggagctgacagacagctgccagccctacagaagtgccttctacgtgctggagcagcagagggtgggctttgctgtggacatggatgaaattgagaagtaccaggaggtggaggaggaccaggaccccagctgcccccggctgagccgggagctgctggatgagaaggagcctgaggtgctgcaggacagcctggaccgctgctacagcacccccagcggctacctggagctgcctgacctgggccagccctacagcagcgctgtgtacagcctggaggagcagtacctgggcctggccctggatgtggaccgcatcaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagagaagaggccgccgcagcaagaaggagaggagaagaggaaggaaggagggggaggaggaccagaaccccccctgcccccggctgagccgggagctgctggatgagaagggccctgaggtgctgcaggacagcctggaccgctgctacagcaccccatctggctgcctggagctgacagacagctgccagccctacagaagtgccttctacgtgctggagcagcagagggtgggctttgctgtggacatggatgaaattgagaagtaccaggaggtggaggaggaccaggaccccagctgcccccggctgagccgggagctgctggatgagaaggagcctgaggtgctgcaggacagcctggaccgctgctacagcacccccagcggctacctggagctgcctgacctgggccagccctacagcagcgctgtgtacagcctggaggagcagtacctgggcctggccctggatgtggaccgcatcaagaaggatgaggaggaggaggaggaccaggaccccccctgcccccggctgagccgggagctgctggaggtggtggcccctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagagaagaggccgccgcagcaagaaggagaggagaagaggaaggaaggagggggaggaggaccagaaccccccctgcccccggctgagccgggagctgctggatgagaagggccctgaggtgctgcaggacagcctggaccgctgctacagcaccccatctggctgcctggagctgacagacagctgccagccctacagaagtgccttctacgtgctggagcagcagagggtgggcatggctgtggacatggatgaaattgagaagtaccaggaggtggaggaggaccaggaccccagctgcccccggctgagccgggagctgctggatgagaaggagcctgaggtgctgcaggacagcctgaaccgctgctacagcacccccagcggctacctggagctgcctgacctgggccagccctacagcagcgctgtgtacagcctggaggagcagtacctgggcctggccctggatgtggaccgcatcaagaaggaccaggaggaggaggaggatgaggaccaggaccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaaccacgtgggcttcagcctggatgtgggggagattgagaagaagggcaagggcaagaagagaagaggccgccgcagcaagaaggagaggagaagaggaaggaaggagggggaggaggaccagaaccccccctgcccccggctgagccgggagctgctggatgagaagggccctgaggtgctgcaggacagcctggaccgctgctacagcaccccatctggctgcctggagctgacagacagctgccagccctacagaagtgccttctacgtgctggagcagcagcacgtgggcctggccgtggacatggatgaaattgagaagtaccaggaggtggaggaggaccaggaccccagctgcccccggctgagccgggagctgctggatgagaaggagcctgaggtgctgcaggacagcctggaccgctgctacagcacccccagcggctacctggagctgcctgacctgggccagccctacagcagcgctgtgtacagcctggaggagcagtacctgggcctggccctggatgtggaccgcatcaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaaccacgtgggcttcagcctggatgtgggggagattgagaagaagggcaagggcaagaagagaagaggccgccgcagcaagaaggagaggagaagaggaaggaaggagggggaggaggaccagaaccccccctgcccccggctgagccgggagctgctggatgagaagggccctgaggtgctgcaggacagcctggaccgctgctacagcaccccatctggctgcctggagctgacagacagctgccagccctacagaagtgccttctacgtgctggagcagcagcacgtgggcctggccgtggacatggatgaaattgagaagtaccaggaggtggaggaggaccaggaccccagctgcccccggctgagccgggagctgctggatgagaaggagcctgaggtgctgcaggacagcctggaccgctgctacagcacccccagcggctacctggagctgcctgacctgggccagccctacagcagcgctgtgtacagcctggaggagcagtacctgggcctggccctggatgtggaccgcatcaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaaccacgtgggcttcagcctggatgtgggggagattgagaagaagggcaagggcaagaagagaagaggccgccgcagcaagaaggagaggagaagaggaaggaaggagggggaggaggaccagaaccccccctgcccccggctgagccgggagctgctggatgagaagggccctgaggtgctgcaggacagcctggaccgctgctacagcaccccatctggctgcctggagctgacagacagctgccagccctacagaagtgccttctacgtgctggagcagcagcacgtgggcctggccgtggacatggatgaaattgagaagtaccaggaggtggaggaggaccaggaccccagctgcccccggctgagccgggagctgctggatgagaaggagcctgaggtgctgcaggacagcctggaccgctgctacagcacccccagcggctacctggagctgcctgacctgggccagccctacagcagcgctgtgtacagcctggaggagcagtacctgggcctggccctggatgtggaccgcatcaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaaccacgtgggcttcagcctggatgtgggggagattgagaagaagggcaagggcaagaagagaagaggccgccgcagcaagaaggagaggagaagaggaaggaaggagggggaggaggaccagaaccccccctgcccccggctgagccgggagctgctggatgagaagggccctgaggtgctgcaggacagcctggaccgctgctacagcaccccatctggctgcctggagctgacagacagctgccagccctacagaagtgccttctacgtgctggagcagcagcacgtgggcctggccgtggacatggatgaaattgagaagtaccaggaggtggaggaggaccaggaccccagctgcccccggctgagccgggagctgctggatgagaaggagcctgaggtgctgcaggacagcctggaccgctgctacagcacccccagcggctacctggagctgcctgacctgggccagccctacagcagcgctgtgtacagcctggaggagcagtacctgggcctggccctggatgtggaccgcatcaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaaccacgtgggcttcagcctggatgtgggggagattgagaagaagggcaagggcaagaagagaagaggccgccgcagcaagaaggagaggagaagaggaaggaaggagggggaggaggaccagaaccccccctgcccccggctgagccgggagctgctggatgagaagggccctgaggtgctgcaggacagcctggaccgctgctacagcaccccatctggctgcctggagctgacagacagctgccagccctacagaagtgccttctacgtgctggagcagcagcacgtgggcctggccgtggacatggatgaaattgagaagtaccaggaggtggaggaggaccaggaccccagctgcccccggctgagccgggagctgctggatgagaaggagcctgaggtgctgcaggacagcctggaccgctgctacagcacccccagcggctacctggagctgcctgacctgggccagccctacagcagcgctgtgtacagcctggaggagcagtacctgggcctggccctggatgtggaccgcatcaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagagaagaggccgccgcagcaagaaggagaggagaagaggaaggaaggagggggaggaggaccagaaccccccctgcccccggctgagccgggagctgctggatgagaagggccctgaggtgctgcaggacagcctggaccgctgctacagcaccccatctggctgcctggagctgacagacagctgccagccctacagaagtgccttctacgtgctggagcagcagcacgtgggcctggccgtggacatggatgaaattgagaagtaccaggaggtggaggaggaccaggaccccagctgcccccggctgagccgggagctgctggatgagaaggagcctgaggtgctgcaggacagcctggaccgctgctacagcacccccagcggctacctggagctgcctgacctgggccagccctacagcagcgctgtgtacagcctggaggagcagtacctgggcctggccctggatgtggaccgcatcaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagagaagaggccgccgcagcaagaaggagaggagaagaggaaggaaggagggggaggaggaccagaaccccccctgcccccggctgagccgggagctgctggatgagaagggccccaaggtgctgcaggacagcctggaccgctgctacagcaccccatctggctgcctggagctgtgtgacagctgccagccctacagaagtgccttctacgtgctggagcagcagagggtgggcctggccgtggacatggatgaaattgagaagtaccaggaggtggaggaggaccaggaccccagctgcccccggctgagccgggagctgctggatgagaagggccctgaggtgctgcaggacagcctggaccgctgctacagcacccccagcggctgcctggagctgtgtgacagctgccagccctaccgcagcgccttctacatcctggagcagcagagggtgggcctggccgtggacatggatgaaattgagaagtaccaggaggtggaggaggaccaggaccccagctgcccccggctgagccgggagctgctggatgagaaggagcctgaggtgctgcaggacagcctggaccgctgctacagcaccccatctggctacctggagctgcctgacctgggccagccctacagcagcgctgtgtacagcctggaggagcagtacctgggcctggccctggatgtggaccgcatcaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagaggcggggcagaagaagcaagaaggagcggcggcggggcaggaaggagggggaggaggaccagaaccccccctgcccccggctgagccgggagctgctggatgagaagggccctgaggtgctgcaggacagcctggaccgctgctacagcacccccagcggctgcctggagctgtgtgacagctgccagccctaccgcagcgccttctacgtgctggagcagcagcacgtgggcctggccgtggacatggatgaaattgagaagtaccaggaggtggaggaggaccaggaccccagctgcccccggctgagccgggagctgctggatgagaaggagcctgaggtgctgcaggacagcctggaccgctgctacagcaccccatctggctacctggagctgcctgacctgggccagccctacagcagcgctgtgtacagcctggaggagcagtacctgggcctggccctggatgtggacaagattgagaagaagggcaagggcaagaagagaagaggccgccgcagcaagaaggagaggagaagaggaaggaaggagggggaggaggaccagaaccccccctgcccccggctgaatggagtgctgatggaggtggaggagcgggaggtgctgcaggacagcctggaccgctgctacagcacccccagcatgtactttgagctgcctgacagcttccagcactacagatctgtgttctacagctttgaggagcagcacatcagctttgccctgtatgtggacaaccgcttcttcaccctgactgtgaccagcctgcacctggtgttccagatgggcgtcatcttcccccagtag

SEQ ID NO: 161535 - DNA, 900 bp, Artificial Sequence
  Description of Artificial Sequence: Synthetic coding sequence
atggtggtgtctgctggccccctgagcagcgagaaggccgagatgaacatcctggagatcaatgagaagctgcggccccagctggccgagaagaagcagcagttcaggaacctgaaggagaagtgcttcctgacccagctgagcggcttcctggccaaccagcagaagaagtacaagtatgaggagtgcaaggacctgatcaagttcatgctgagaaatgaaaggcagttcaaggaggagaagctggccgagcagctgaagcaggccgaggagctgcggcagtacaaggtgctggtgcacgcccaggagcgggagctgacccagctgaaggagaagctgcgggagggcagagatgccagccgcagcctgaatgagcacctgcaggccctgctgaccccctatgagccagacaagagccagggccaggacctgcaggagcagctggccgagggctgccgcctggcccagcacctggtgcagaagctgagcccagaaaatgacaatgatgatgatgaagatgtgcaggtggaggtggccgagaaggtgcagaagagcagcgccccccgggagatgcagaaggccgaggagaaggaggtgcctgaggacagcctggaggagtgtgccatcacctacagcaacagccacggcagctatgacagcaaccagccccacaggaagaccaagatcacctttgaggaggacaaggtggacagcaccctgattggcagcagcagccacgtggagtgggaggatgctgtgcacatcatcccagaaaatgaaagtgatgatgaggaggaggaggagaagggccctgtgagccccaggacctctgtgggcagcagcgagaagggcggcccccggggcaacagaagccaggcccagcagggcgccgccggctag

SEQ ID NO: 161536 - DNA, 2010 bp, Artificial Sequence
  Description of Artificial Sequence: Synthetic coding sequence
atggtggtgtctgctggccccctgagcagcgagaaggccgagatgaacatcctggagatcaatgagaagctgcggccccagctggccgagaagaagcagcagttcaggaacctgaaggagaagtgcttcctgacccagctgagcggcttcctggccaaccagcagaagaagtacaagtatgaggagtgcaaggacctgatcaagttcatgctgagaaatgaaaggcagttcaaggaggagaagctggccgagcagctgaagcaggccgaggagctgcggcagtacaaggtgctggtgcacgcccaggagcgggagctgacccagctgaaggagaagctgcgggagggcagagatgccagccgcagcctgaatgagcacctgcaggccctgctgaccccctatgagccagacaagagccagggccaggacctgcaggagcagctggccgagggctgccgcctggcccagcacctggtgcagaagctgagcccagaaaatgacaatgatgatgatgaagatgtgcaggtggaggtggccgagaaggtgcagaagagcagcgccccccgggagatgcagaaggccgaggagaaggaggtgcctgaggacagcctggaggagtgtgccatcacctacagcaacagccacggcagctatgacagcaaccagccccacaggaagaccaagatcacctttgaggaggacaaggtggacagcaccctgattggcagcagcagccacgtggagtgggaggatgctgtgcacatcatcccagaaaatgaaagtgatgatgaggaggaggaggagaagggccctgtgagccccaggaacctgcaggagagcgaggaggaggaggtgccccaggagagctgggatgagggctacagcaccctgagcatccccccagagatgctggccagctaccagagctacagcagcaccttccacagcctggaggagcagcaggtgtgcatggctgtggacatcggccgccaccgctgggaccaggtgaagaaggaggaccaggaggccaccggccccagccgggagctgctggatgagaagggccctgaggtgttccaggacagccaggaccgctgctacagcaccccatctggctgcctggagctgacagacagctgccagccctacagaagtgccttctacatcctggagcagcagagggtgggcctggccatcgacatggatgaaattgagaagtaccaggaggtggaggaggaccaggaccccagctgcccccggctgagccgggagctgctggatgagaaggagcctgaggtgctgcaggacagcctggaccgctgctacagcacccccagcggctacctggagctgcctgacctgggccagccctacagcagcgctgtgtacagcctggaggagcagtacctgggcctggccctggatgtggaccgcatcaagaaggaccaggaggaggaggaggaccagggccccccctgcccccggctgagccgggagctgctggatgagaagggccctgaggtgctgcaggacagcctggaccgctgctacagcaccccatctggctgcctggagctgacagacagctgccagccctacagaagtgccttctacgtgctggagcagcagcacgtgggcctggccgtggacatggatgaaattgagaagaagggcaagggcaagaagagaagaggccgccgcagcaagaaggagaggagaagaggaaggaaggagggggaggaggaccagaaccccccctgcccccggctgaatggagtgctgatggaggtggaggagcgggaggtgctgcaggacagcctggaccgctgctacagcacccccagcatgtactttgagctgcctgacagcttccagcactacagatctgtgttctacagctttgaggagcagcacatcagctttgccctgtatgtggacaaccgcttcttcaccctgactgtgaccagcctgcacctggtgttccagatgggcgtcatcttcccccagtag

SEQ ID NO: 161537 - DNA, 2022 bp, Artificial Sequence
  Description of Artificial Sequence: Synthetic coding sequence
atggtggtgtctgctggcccctggagcagcgagaaggccgagatgaacatcctggagatcaatgagaccctgcggccccagctggccgagaagaagcagcagttcaggaacctgaaggagaagtgcttcctgacccagctggccggcttcctggccaaccggcagaagaagtacaagtatgaggagtgcaaggacctgatcaagttcatgctgagaaatgaaaggcagttcaaggaggagaagctggccgagcagctgaagcaggccgaggagctgcggcagtacaaggtgctggtgcacagccaggagcgggagctgacccagctgcgggagaagctgcgggagggcagagatgccagccgcagcctgtatgagcacctgcaggccctgctgaccccagatgagccagacaagagccagggccaggacctgcaggagcagctggccgagggctgccgcctggcccagcacctggtgcagaagctgagcccagaaaatgatgaagatgaagatgaagatgtgcaggtggaggaggccgagaaggtgctggagagcagcgccccccgggaggtgcagaaggccgaggagagcaaggtgcctgaggacagcctggaggagtgtgccatcacctgcagcaacagccacggcccctgtgacagcaaccagccccacaagaacatcaagatcacctttgaagaagatgaggtgaacagcaccctggtggtggaccgggagagcagccatgatgagtgccaggatgccctgaacatcctgcctgaaaatgaaagtgatgatgaggaggaggaggagaagggccctgtgagccccaggaacctgcaggagagcgaggaggaggaggtgccccaggagagctgggatgagggctacagcaccctgagcatccccccagagatgctggccagctaccagagctacagcagcaccttccacagcctggaggagcagcaggtgtgcatggctgtggacatcggccgccaccgctgggaccaggtgaagaaggaggaccaggaggccaccggcccccggctgagccgggagctgctggatgagaagggccctgaggtgctgcaggacagcctggaccgctgctacagcaccccatctggctgcctggagctgacagacagctgccagccctacagaagtgccttctacgtgctggagcagcagagggtgggctttgctgtggacatggatgaaattgagaagtaccaggaggtggaggaggaccaggaccccagctgcccccggctgagccgggagctgctggatgagaaggagcctgaggtgctgcaggacagcctggaccgctgctacagcacccccagcggctacctggagctgcctgacctgggccagccctacagcagcgctgtgtacagcctggaggagcagtacctgggcctggccctggatgtggaccgcatcaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagagaagaggccgccgcagcaagaaggagaggagaagaggaaggaaggagggggaggaggaccagaaccccccctgcccccggctgaatggagtgctgatggaggtggaggagcgggaggtgctgcaggacagcctggaccgctgctacagcacccccagcatgtactttgagctgcctgacagcttccagcactacagatctgtgttctacagctttgaggagcagcacatcagctttgccctgtatgtggacaaccgcttcttcaccctgactgtgaccagcctgcacctggtgttccagatgggcgtcatcttcccccagtag

SEQ ID NO: 161538 - DNA, 519 bp, Artificial Sequence
  Description of Artificial Sequence: Synthetic coding sequence
atggctgtggacatcggccgccaccgctgggaccaggtgaagaaggaggaccaggaggccaccggccccagccgggagctgctggatgagaagggccctgaggtgttccaggacagccaggaccgctgctacagcacccccagcggctgcctggagctgacagacagctgccagccctaccgcagcgccttctacatcctggagcagcagagggtgggcctggccatcgacatggatgaaattgagaagtaccaggaggtggaggaggaccaggaccccagctgcccccggctgagccgggagctgctggatgagaaggagcctgaggtgctgcaggacagcctggaccgctgctacagcaccccatctggctacctggagctgcctgacctgggccagccctacagcagcgctgtgtacagcctggaggagcagtacctgggcctggccctggatgtggaccgcatcaagaaggaccaggaggaggaggaggaccagggccccccctgccccaggtag

SEQ ID NO: 161539 - DNA, 2295 bp, Artificial Sequence
  Description of Artificial Sequence: Synthetic coding sequence
atgttcagcaacagcacaggccgcctgcccggccagcccacagaggagatccagcagtacaaggtgctggtgcacagccaggagcgggagctgacccagctgcgggagaagctgcgggagggcagagatgccagccgcagcctgtatgagcacctgcaggccctgctgaccccagatgagccagacaagagccagggccaggacctgcaggagcagctggccgagggctgccgcctggcccagcacctggtgcagaagctgagcccagaaaatgatgaagatgaagatgaagatgtgcaggtggaggaggccgagaaggtgctggagagcagcgccccccgggaggtgcagaaggccgaggagagcaaggtgcctgaggacagcctggaggagtgtgccatcacctgcagcaacagccacggcccctgtgacagcaaccagccccacaagaacatcaagatcacctttgaggaggatgaggtgaacagcaccctggtggtggaccgggagagcagccatgatgagtgccaggatgccctgaacatcctgcctgtgcccggccccaccagcagcgccaccaacgtgtccatggtggtgtctgctggccccctgagcagcgagaaggccgagatgaacatcctggagatcaatgagaagctgcggccccagctggccgagaagaagcagcagttcaggaacctgaaggagaagtgcttcctgacccagctgagcggcttcctggccaaccagcagaagaagtacaagtatgaggagtgcaaggacctgatcaagttcatgctgagaaatgaaaggcagttcaaggaggagaagctggccgagcagctgaagcaggccgaggagctgcggcagtacaaggtgctggtgcacgcccaggagcgggagctgacccagctgaaggagaagctgcgggagggcagagatgccagccgcagcctgaatgagcacctgcaggccctgctgaccccctatgagccagacaagagccagggccaggacctgcaggagcagctggccgagggctgccgcctggcccagcacctggtgcagaagctgagcccagaaaatgacaatgatgatgatgaagatgtgcaggtggaggtggccgagaaggtgcagaagagcagcgccccccgggagatgcagaaggccgaggagaaggaggtgcctgaggacagcctggaggagtgtgccatcacctacagcaacagccacggcagctatgacagcaaccagccccacaggaagaccaagatcacctttgaggaggacaaggtggacagcaccctgattggcagcagcagccacgtggagtgggaggatgctgtgcacatcatcccagaaaatgaaagtgatgatgaggaggaggaggagaagggccctgtgagccccaggaacctgcaggagagcgaggaggaggaggtgccccaggagagctgggatgagggctacagcaccctgagcatccccccagagatgctggccagctaccagagctacagcagcaccttccacagcctggaggagcagcaggtgtgcatggctgtggacatcggccgccaccgctgggaccaggtgaagaaggaggaccaggaggccaccggcccccggctgagccgggagctgctggatgagaagggccctgaggtgctgcaggacagcctggaccgctgctacagcaccccatctggctgcctggagctgacagacagctgccagccctacagaagtgccttctacgtgctggagcagcagcacgtgggcctggccgtggacatggatgaaattgagaagtaccaggaggtggaggaggaccaggaccccagctgcccccggctgagccgggagctgctggatgagaaggagcctgaggtgctgcaggacagcctggaccgctgctacagcacccccagcggctacctggagctgcctgacctgggccagccctacagcagcgctgtgtacagcctggaggagcagtacctgggcctggccctggatgtggaccgcatcaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagagaagaggccgctag

SEQ ID NO: 161540 - DNA, 105 bp, Artificial Sequence
  Description of Artificial Sequence: Synthetic coding sequence
attggcagcagcagccacgtggagtgggaggatgctgtgcacatcatcccagaaaatgaaagtgatgatgaggaggaggaggagaagggccctgtgagcccctag

SEQ ID NO: 161541 - DNA, 2517 bp, Artificial Sequence
  Description of Artificial Sequence: Synthetic coding sequence
atggtggtgtctgctggcccctggagcagcgagaaggccgagatgaacatcctggagatcaatgagaagctgcggccccagctggccgagaacaagcagcagttcaggaacctgaaggagcgctgcttcctgacccagctggccggcttcctggccaaccggcagaagaagtacaagtatgaggagtgcaaggacctgatcaagttcatgctgagaaatgaaaggcagttcaaggaggagaagctggccgagcagctgaagcaggccgaggagctgcggcagtacaaggtgctggtgcacagccaggagcgggagctgacccagctgcgggagaagctgcgggagggcagagatgccagccgcagcctgaatgagcacctgcaggccctgctgaccccagatgagccagacaagagccagggccaggacctgcaggagcagctggccgagggctgccgcctggcccagcacctggtgcagaagctgagcccagaaaatgatgaagatgaagatgaagatgtgcaggtggaggaggatgagaaggtgctggagagcagcgccccccgggaggtgcagaaggccgaggagagcaaggtgcctgaggacagcctggaggagtgtgccatcacctgcagcaacagccacggcccctgtgacagcatccagccccacaagaacatcaagatcacctttgaggaggacaaggtgaacagcagcctggtggtggaccgggagagcagccatgatggctgccaggatgccctgaacatcctgcctgtgcccggccccaccagcagcgccaccaacgtgtccatggtggtgtctgctggccccctgagcagcgagaaggccgagatgaacatcctggagatcaatgagaagctgtgcccccagctggccgagaagaagcagcagttccgcagcctgaaggagaagtgctttgtgacccaggtggcctgcttcctggccaagcagcagaacaagtacaagtatgaggagtgcaaggacctgatcaagtccatgctgagaaatgaaaggcagttcaaggaggagaagctggccgagcagctgaagcaggccgaggagctgcggcagtacaaggtgctggtgcacagccaggagcgggagctgacccagctgcgggagaagctgcgggagggcagagatgccagccgcagcctgaatgagcacctgcaggccctgctgaccccagatgagccagacaagagccagggccaggacctgcaggagcagctggccgagggctgccgcctggcccagcacctggtgcagaagctgagcccagaaaatgacaatgatgatgatgaagatgtgcaggtggaggtggccgagaaggtgcagaagagcagcagcccccgggagatgcagaaggccgaggagaaggaggtgcctgaggacagcctggaggagtgtgccatcacctgcagcaacagccacggcccctatgacagcaaccagccccacaggaagcccaagagccacctgaggaagaccaagagcacccagctgagcctggcccaccccctgatgctgaatggaaggatgctgtacaccctgagccagaagatgaaggtgatgatgaggaagaggaagaagaagggccagtgcctgcccggcatctgccgcagcctgaagaggaggaagagccccaggagccctggcatgaaggtgatccggctgagccagttcctgctgaagggccaccgctgggaccaggtgaagaaggaggaccaggaggccaccggcccccggctgagccgggagctgctggatgagaaggagcctgaggtgctgcaggacagcctggaccgctgctacagcaccccatctgtgtacctgggcctgacagacagctgccagccctacagaagtgccttctacgtgctggagcagcagagaattggcctggccgtggacatggatgaaattgagaagtaccaggaggtggaggaggaccaggaccccagctgcccccggctgagccgggagctgctggccgagaaggagcctgaggtgctgcaggacagcctggaccgctgctacagcacccccagcggctacctggagctgcctgacctgggccagccctacagatctgctgtgtacagcctggaggagcagtacctgggcctggccctggatgtggaccgcatcaagaaggaccaggaggaggaggaggaccagggccccccctgcccccggctgagccgggagctgctggaggtggtggagcctgaggtgctgcaggacagcctggatgtgatccagctgctgcctgtggtgctgaacagcctgaccccagccagccccacagaggtgcccttcatgcactggaggaagaacatgctggccttcctgctgacctgggagaagctgaagagaagaggccggggcaggaaggagggggaggaggaccagaggaggaaggaggagggggaggagaagaagggcaagaagatcaagacccaccacgcccctggcagcgctgcctgctag

SEQ ID NO: 161542 - DNA, 2373 bp, Artificial Sequence
  Description of Artificial Sequence: Synthetic coding sequence
atgttcagcaacagcacaggccgcctgcccggccagcccacagaggagatccagcagtacaaggtgctggtgcacagccaggagcgggagctgacccagctgcgggagaagctgcgggagggcagagatgccagccgcagcctgaatgagcacctgcaggccctgctgaccccagatgagccagacaagagccagggccaggacctgcaggagcagctggccgagggctgccgcctggcccagcacctggtgcagaagctgagcccagaaaatgatgaagatgaagatgaagatgtgcaggtggaggaggatgagaaggtgctggagagcagcgccccccgggaggtgcagaaggccgaggagagcaaggtgcctgaggacagcctggaggagtgtgccatcacctgcagcaacagccacggcccctgtgacagcatccagccccacaagaacatcaagatcacctttgaggaggacaaggtgaacagcagcctggtggtggaccgggagagcagccatgatggctgccaggatgccctgaacatcctgcctgtgcccggccccaccagcagcgccaccaacgtgtccatggtggtgtctgctggccccctgagcagcgagaaggccgagatgaacatcctggagatcaatgagaagctgtgcccccagctggccgagaagaagcagcagttccgcagcctgaaggagaagtgctttgtgacccaggtggcctgcttcctggccaagcagcagaacaagtacaagtatgaggagtgcaaggacctgatcaagtccatgctgagaaatgaaaggcagttcaaggaggagaagctggccgagcagctgaagcaggccgaggagctgcggcagtacaaggtgctggtgcacagccaggagcgggagctgacccagctgcgggagaagctgcgggagggcagagatgccagccgcagcctgaatgagcacctgcaggccctgctgaccccagatgagccagacaagagccagggccaggacctgcaggagcagctggccgagggctgccgcctggcccagcacctggtgcagaagctgagcccagaaaatgacaatgatgatgatgaagatgtgcaggtggaggtggccgagaaggtgcagaagagcagcagcccccgggagatgcagaaggccgaggagaaggaggtgcctgaggacagcctggaggagtgtgccatcacctgcagcaacagccacggcccctatgacagcaaccagccccacaggaagaccaagatcacctttgaggaggacaaggtggacagcaccctgattggcagcagcagccacgtggagtgggaggatgctgtgcacatcatcccagaaaatgaaagtgatgatgaggaggaggaggagaagggccctgtgagccccaggaacctgcaggagagcgaggaggaggaggtgccccaggagagctgggatgagggctacagcaccctgagcatccccccagagcggctggccagctaccagagctacagcagcaccttccacagcctggaggagcagcaggtgtgcatggctgtggacatcggccgccaccgctgggaccaggtgaagaaggaggaccaggaggccaccggcccccggctgagccgggagctgctggatgagaaggagcctgaggtgctgcaggacagcctggaccgctgctacagcaccccatctgtgtacctgggcctgacagacagctgccagccctacagaagtgccttctacgtgctggagcagcagagaattggcctggccgtggacatggatgaaattgagaagtaccaggaggtggaggaggaccaggaccccagctgcccccggctgagccgggagctgctggccgagaaggagcctgaggtgctgcaggacagcctggaccgctgctacagcacccccagcggctacctggagctgcctgacctgggccagccctacagatctgctgtgtacagcctggaggagcagtacctgggcctggccctggatgtggaccgcatcaagaaggaccaggaggaggaggaggaccagggccccccctgcccccggctgagccgggagctgctggaggtggtggagcctgaggtgctgcaggacagcctggatgtgatccagctgctgcctgtggtgctgaacagcctgaccccagccagccccacagaggtgcccttcatgcactggaggaagaacatgctggccttcctgctgacctgggagaagctgaagagaagaggccggggcaggaaggagggggaggaggaccagaggaggaaggaggagggggaggagaagaagggcaagaagatcaagacccaccacgcccctggcagcgctgcctgctag

SEQ ID NO: 161543 - DNA, 258 bp, Artificial Sequence
  Description of Artificial Sequence: Synthetic coding sequence
gagatgcagaaggccgaggagaaggaggtgcctgaggacagcctggaggagtgtgccatcacctgcagcaacagccacggcccctatgacagcaaccagccccacaggaagaccaagatcacctttgaggaggacaaggtggacagcaccctcatcggcagcagcagccacgtggagtgggaggatgctgtgcacatcatcccagaaaatgaaagtgatgatgaggaggaggaggagaagggccctgtgagcccctag

SEQ ID NO: 161544 - DNA, 1101 bp, Artificial Sequence
  Description of Artificial Sequence: Synthetic coding sequence
ctggccagctaccagagctacagcagcaccttccacagcctggaggagcagcaggtgtgcatggctgtggacatcggccgccaccgctgggaccaggtgaagaaggaggaccaggaggccaccggcccccggctgagccgggagctgctggatgagaaggagcctgaggtgctgcaggacagcctggaccgctgctacagcacccccagcgtgtacctgggcctgacagacagctgccagccctaccgcagcgccttctacgtgctggagcagcagagaattggcctggccgtggacatggatgaaattgagaagtaccaggaggtggaggaggaccaggaccccagctgcccccggctgagccgggagctgctggccgagaaggagcctgaggtgctgcaggacagcctggaccgctgctacagcaccccatctggctacctggagctgcctgacctgggccagccctacagatctgctgtgtacagcctggaggagcagtacctgggcctggccctggatgtggaccgcatcaagaaggaccaggaggaggaggaggaccagggccccccctgcccccggctgagccgggagctgctggaggtggtggagcctgaggtgctgcaggacagcctgtgctacagcacccccagcagctgcctggagcagcctgacagctgccagccctacggcagcagcttctacgccctggaggagaagcacgtgggcttcagcctggatgtgggggagattgagaagaagggcaagggcaagaagaggcggggcagaagaagcaagaagaagagaagaagaggaaggaaggagggggaggaggaccagaaccccccctgcccccggctgagctctgtgctgatggaggtggaggtgcctgaggtgctgcaggacagcctggaccgctactacagcacccccagcatgtactttgagctgcctgacagcttccagcactaccgcagcgtcttctacagctttgaggagcagcacatcagctttgccctggacatggacaaccgcttcttcaccctgactgtgcgcagcctgcacctggtgttccagatgggcgtcatcttcccccagtag

SEQ ID NO: 161545 - DNA, 2598 bp, Artificial Sequence
  Description of Artificial Sequence: Synthetic coding sequence
atggtggtgtctgctggcccctggagcagcgagaaggccgagatgaacatcctggagatcaatgagaagctgcggccccagctggccgagaacaagcagcagttcaggaacctgaaggagcgctgcttcctgacccagctggccggcttcctggccaaccggcagaagaagtacaagtatgaggagtgcaaggacctgatcaagttcatgctgagaaatgaaaggcagttcaaggaggagaagctggccgagcagctgaagcaggccgaggagctgcggcagtacaaggtgctggtgcacagccaggagcgggagctgacccagctgcgggagaagctgcgggagggcagagatgccagccgcagcctgaatgagcacctgcaggccctgctgaccccagatgagccagacaagagccagggccaggacctgcaggagcagctggccgagggctgccgcctggcccagcacctggtgcagaagctgagcccagaaaatgatgaagatgaagatgaagatgtgcaggtggaggaggatgagaaggtgctggagagcagcgccccccgggaggtgcagaaggccgaggagagcaaggtgcctgaggacagcctggaggagtgtgccatcacctgcagcaacagccacggcccctgtgacagcatccagccccacaagaacatcaagatcacctttgaggaggacaaggtgaacagcagcctggtggtggaccgggagagcagccatgatggctgccaggatgccctgaacatcctgcctgtgcccggccccaccagcagcgccaccaacgtgtccatggtggtgtctgctggccccctgagcagcgagaaggccgagatgaacatcctggagatcaatgagaagctgtgcccccagctggccgagaagaagcagcagttccgcagcctgaaggagaagtgctttgtgacccaggtggcctgcttcctggccaagcagcagaacaagtacaagtatgaggagtgcaaggacctgatcaagtccatgctgagaaatgaaaggcagttcaaggaggagaagctggccgagcagctgaagcaggccgaggagctgcggcagtacaaggtgctggtgcacagccaggagcgggagctgacccagctgcgggagaagctgcgggagggcagagatgccagccgcagcctgaatgagcacctgcaggccctgctgaccccagatgagccagacaagagccagggccaggacctgcaggagcagctggccgagggctgccgcctggcccagcacctggtgcagaagctgagcccagaaaatgacaatgatgatgatgaagatgtgcaggtggaggtggccgagaaggtgcagaagagcagcagcccccgggagatgcagaaggccgaggagaaggaggtgcctgaggacagcctggaggagtgtgccatcacctgcagcaacagccacggcccctatgacagcaaccagccccacaggaagaccaagatcacctttgaggaggacaaggtggacagcaccctcatcggcagcagcagccacgtggagtgggaggatgctgtgcacatcatcccagaaaatgaaagtgatgatgaggaggaggaggagaagggccctgtgagccccaggaacctgcaggagagcgaggaggaggaggtgccccaggagagctgggatgagggctacagcaccctgagcatccccccagagcggctggccagctaccagagctacagcagcaccttccacagcctggaggagcagcaggtgtgcatggctgtggacatcggccgccaccgctgggaccaggtgaagaaggaggaccaggaggccaccggcccccggctgagccgggagctgctggatgagaaggagcctgaggtgctgcaggacagcctggaccgctgctacagcacccccagcgtgtacctgggcctgacagacagctgccagccctaccgcagcgccttctacgtgctggagcagcagagaattggcctggccgtggacatggatgaaattgagaagtaccaggaggtggaggaggaccaggaccccagctgcccccggctgagccgggagctgctggccgagaaggagcctgaggtgctgcaggacagcctggaccgctgctacagcaccccatctggctacctggagctgcctgacctgggccagccctacagatctgctgtgtacagcctggaggagcagtacctgggcctggccctggatgtggaccgcatcaagaaggaccaggaggaggaggaggaccagggccccccctgcccccggctgagccgggagctgctggaggtggtggagcctgaggtgctgcaggacagcctggatgtgatccagctgctgcctgtggtgctgaacagcctgaccccagccagccccacagaggtgcccttcatgcactggaggaagaacatgctggccttcctgctgacctgggagaagctgaagaggcggggccggggcaggaaggagggggaggaggaccagaggaggaaggaggagggggaggagaagaagggcaagaagatcaagacccaccacgcccctggcagcgctgcctgctag

SEQ ID NO: 161546 - DNA, 2373 bp, Artificial Sequence
  Description of Artificial Sequence: Synthetic coding sequence
atgttcagcaacagcacaggccgcctgcccggccagcccacagaggagatccagcagtacaaggtgctggtgcacagccaggagcgggagctgacccagctgcgggagaagctgcgggagggcagagatgccagccgcagcctgaatgagcacctgcaggccctgctgaccccagatgagccagacaagagccagggccaggacctgcaggagcagctggccgagggctgccgcctggcccagcagctggtgcagaagctgagcccagaaaatgatgaagatgaagatgaagatgtgcaggtggaggaggatgagaaggtgctggagagcagcgccccccgggaggtgcagaaggccgaggagagcaaggtgcctgaggacagcctggaggagtgtgccatcacctgcagcaacagccacggcccctgtgacagcaaccagccccacaagaacatcaagatcacctttgaggaggacaaggtgaacagcagcctggtggtggaccgggagtacagccatgatgagtgccaggatgccctgaacatcctgcctgtgcccggccccaccagcagcgccaccaacgtgtccatggtggtgtctgctggccccctgagcagcgagaaggccgagatgaacatcctggagatcaatgagaagctgcggccccagctggccgagaagaagcagcagttccgcagcctgaaggagaagtgctttgtgacccaggtggcctgcttcctggccaagcagcagaacaagtacaagtatgaggagtgcaaggacctgatcaagtccatgctgagaaatgagctgcagttcaaggaggagaagctggccgagcagctgaagcaggccgaggagctgcggcagtacaaggtgctggtgcacagccaggagcgggagctgacccagctgcgggagaagctgcgggagggcagagatgccagccgcagcctgaatgagcacctgcaggccctgctgaccccagatgagccagacaagagccagggccaggacctgcaggagcagctggccgagggctgccgcctggcccagcacctggtgcagaagctgagcccagaaaatgacaatgatgatgatgaagatgtgcaggtggaggtggccgagaaggtgcagaagagcagcagcccccgggagatgcagaaggccgaggagaaggaggtgcctgaggacagcctggaggagtgtgccatcacctgcagcaacagccacggcccctatgacagcaaccagccccacaggaagaccaagatcacctttgaggaggacaaggtggacagcaccctgattggcagcagcagccacgtggagtgggaggatgctgtgcacatcatcccagaaaatgaaagtgatgatgaggaggaggaggagaagggccctgtgagccccaggaacctgcaggagagcgaggaggaggaggtgccccaggagagctgggatgagggctacagcaccctgagcatccccccagagcggctggccagctaccagagctacagcagcaccttccacagcctggaggagcagcaggtgtgcatggctgtggacatcggccgccaccgctgggaccaggtgaagaaggaggaccaggaggccaccggcccccggctgagccgggagctgctggccgagaaggagcctgaggtgctgcaggacagcctggaccgctgctacagcaccccatctgtgtacctgggcctgacagacagctgccagccctacagaagtgccttctacgtgctggagcagcagagggtgggcctggccgtggacatggatgaaattgagaagtaccaggaggtggaggaggaccaggaccccagctgcccccggctgagccgggagctgctggccgagaaggagcctgaggtgctgcaggacagcctggaccgctgctacagcacccccagcggctacctggagctgcctgacctgggccagccctacagatctgctgtgtacagcctggaggagcagtacctgggcctggccctggatgtggaccgcatcaagaaggaccaggaggaggaggaggaccagggccccccctgcccccggctgagccgggagctgctggaggtggtggagcctgaggtgctgcaggacagcctggatgtgatccagctgctgcctgtggtgctgaacagcctgaccccagccagccccacagaggtgcccttcatgcactggaggaagaacatgctggccttcctgctgacctgggagaagctgaagagaagaggccggggcaggaaggagggggaggaggaccagaggaggaaggaggagggggaggagaagaagggcaagaagatcaagacccaccacgcccctggcagcacagcctgctag

SEQ ID NO: 161547 - DNA, 234 bp, Artificial Sequence
  Description of Artificial Sequence: Synthetic coding sequence
atggatgaaattgagaagtaccaggaggtggaggaggaccaggaccccagctgcccccggctgagccgggagctgctggccgagaaggagcctgaggtgctgcaggacagcctggaccgctgctacagcacccccagcggctacctggagctgcctgacctgggccagccctacagatctgctgtgtacagcctggaggagcagtacctgggcctggccctggatgtggactag

SEQ ID NO: 161548 - DNA, 234 bp, Artificial Sequence
  Description of Artificial Sequence: Synthetic coding sequence
atggatgaaattgagaagtaccaggaggtggaggaggaccaggaccccagctgcccccggctgagccgggagctgctggccgagaaggagcctgaggtgctgcaggacagcctggaccgctggtacagcacccccagcggctacctggagctgcctgacctgggccagccctacagatctgctgtgtacagcctggaggagcagtacctgggcctggccctggatgtggactag

SEQ ID NO: 161549 - DNA, 234 bp, Artificial Sequence; identical to SEQ ID NO: 161547
  Description of Artificial Sequence: Synthetic coding sequence

SEQ ID NO: 161550 - DNA, 207 bp, Artificial Sequence
  Description of Artificial Sequence: Synthetic coding sequence
gagatgcagaaggccgaggagaaggaggtgcctgaggacagcctggaggagtgtgccatcacctgcagcaacagccacggcccctatgacagcaaccagccccacaggaagaccaagatcacctttgaggaggacaaggtggacagcaccctcatcggcagcagcagccacgtggagtgggaggatgctgtgcacatcatcccctag

SEQ ID NO: 161551 - DNA, 9996 bp, Artificial Sequence
  Description of Artificial Sequence: Synthetic coding sequence
atggtggtgtctgctggcccctggagcagcgagaaggccgagatgaacatcctggagatcaatgagaagctgcggccccagctggccgagaacaagcagcagttcaggaacctgaaggagcgctgcttcctgacccagctggccggcttcctggccaaccggcagaagaagtacaagtatgaggagtgcaaggacctgatcaagttcatgctgagaaatgaaaggcagttcaaggaggagaagctggccgagcagctgaagcaggccgaggagctgcggcagtacaaggtgctggtgcacagccaggagcgggagctgacccagctgcgggagaagctgcgggagggcagagatgccagccgcagcctgaatgagcacctgcaggccctgctgaccccagatgagccagacaagagccagggccaggacctgcaggagcagctggccgagggctgccgcctggcccagcagctggtgcagaagctgagcccagaaaatgatgaagatgaagatgaagatgtgcaggtggaggaggatgagaaggtgctggagagcagcgccccccgggaggtgcagaaggccgaggagagcaaggtgcctgaggacagcctggaggagtgtgccatcacctgcagcaacagccacggcccctgtgacagcaaccagccccacaagaacatcaagatcacctttgaggaggacaaggtgaacagcacagtggtggtggacaggaagagcagccatgatgagtgccaggatgccctgaacatcctgcctgtgcccggccccaccagcagcgccaccaacgtgtccatggtggtgtctgctggccccctgagcagcgagaaggccgagatgaacatcctggagatcaatgagaagctgcggccccagctggccgagaagaagcagcagttccgcagcctgaaggagaagtgctttgtgacccagctggccggcttcctggccaagcagcagaacaagtacaagtatgaggagtgcaaggacctgatcaagtccatgctgagaaatgagctgcagttcaaggaggagaagctggccgagcagctgaagcaggccgaggagctgcggcagtacaaggtgctggtgcacagccaggagcgggagctgacccagctgcgggagaagctgcgggagggcagagatgccagccgcagcctgaatgagcacctgcaggccctgctgaccccagatgagccagacaagagccagggccaggacctgcaggagcagctggccgagggctgccgcctggcccagcacctggtgcagaagctgagcccagaaaatgatgaagatgaagatgaagatgtgcaggtggaggaggatgagaaggtgctggagagcagcagcccccgggagatgcagaaggccgaggagagcaaggtgcctgaggacagcctggaggagtgtgccatcacctgcagcaacagccacggcccctgtgacagcaaccagccccacaagaacatcaagatcacctttgaggaggacaaggtgaacagcagcctggtggtggaccgggagtacagccatgatgagtgccaggatgccctgaacatcctgcctgtgcccggccccaccagcagcgccaccaacgtgtccatggtggtgtctgctggccccctgagcagcgagaaggccgagatgaacatcctggagatcaatgagaagctgcggccccagctggccgagaagaagcagcagttccgcagcctgaaggagaagtgctttgtgacccaggtggcctgcttcctggccaagcagcagaacaagtacaagtatgaggagtgcaaggacctgatcaagtccatgctgagaaatgagctgcagttcaaggaggagaagctggccgagcagctgaagcaggccgaggagctgcggcagtacaaggtgctggtgcacagccaggagcgggagctgacccagctgcgggagaagctgcgggagggcagagatgccagccgcagcctgaatgagcacctgcaggccctgctgaccccagatgagccagacaagagccagggccaggacctgcaggagcagctggccgagggctgccgcctggcccagcacctggtgcagaagctgagcccagaaaatgacaatgatgatgatgaagatgtgcaggtggaggtggccgagaaggtgcagaagagcagcagcccccgggagatgcagaaggccgaggagaaggaggtgcctgaggacagcctggaggagtgtgccatcacctgcagcaacagccacggcccctatgacagcaaccagccccacaggaagaccaagatcacctttgaggaggacaaggtggacagcaccctgattggcagcagcagccacgtggagtgggaggatgctgtgcacatcatcccagaaaatgaaagtgatgatgaggaggaggaggagaagggccctgtgagccccaggaacctgcaggagagcgaggaggaggaggtgccccaggagagctgggatgagggctacagcaccctgagcatccccccagagcggctggccagctaccagagctacagcagcaccttccacagcctggaggagcagcaggtgtgcatggctgtggacatcggcagcgagtacagcatcgtgaaggtgatcaagctgcagttcatggcccagagccaggccatgcctgtgcccacctggacagactgccacgacatcgagctgaaggccggccaccgctgggaccaggtgaagaaggaggaccaggaggccaccggcccccggctgagccgggagctgctggccgagaaggagcctgaggtgctgcaggacagcctggaccgctgctacagcacccccagcgtgtacctgggcctgacagacagctgccagccctaccgcagcgccttctacgtgctggagcagcagagggtgggcctggccgtggacatggatgaaattgagaagtaccaggaggtggaggaggaccaggaccccagctgcccccggctgagccgggagctgctggccgagaaggagcctgaggtgctgcaggacagcctggaccgctggtacagcaccccatctggctacctggagctgcctgacctgggccagccctacagatctgctgtgtacagcctggaggagcagtacctgggcctggccctggatgtggaccgcatcaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctaccgcagcagcttctacgccctggaggagaagcacgtgggcttcagcctggatgtgggggagattgagaagaagggcaagggcaagaagaggcggggcagaagaagcaagaagaagagaagaagaggaaggaaggagggggaggaggaccagaaccccccctgcccccggctgagccgggagctgctggccgagaaggagcctgaggtgctgcaggacagcctggaccgctggtacagcacccccagcgtgtacctgggcctgacagacccctgccagccctaccgcagcgccttctacgtgctggagcagcagagggtgggcctggccgtggacatggatgaaattgagaagtaccaggaggtggaggaggaccaggaccccagctgcccccggctgagccgggagctgctggccgagaaggagcctgaggtgctgcaggacagcctggaccgctggtacagcaccccatctggctacctggagctgcctgacctgggccagccctacagatctgctgtgtacagcctggaggagcagtacctgggcctggccctggatgtggaccgcatcaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctaccgcagcagcttctacgccctggaggagaagcacgtgggcttcagcctggatgtgggggagattgagaagaagggcaagggcaagaagaggcggggcagaagaagcaagaagaagagaagaagaggaaggaaggagggggaggaggaccagaaccccccctgcccccggctgagccgggagctgctggccgagaaggagcctgaggtgctgcaggacagcctggaccgctggtacagcacccccagcgtgtacctgggcctgacagacccctgccagccctaccgcagcgccttctacgtgctggagcagcagagggtgggcctggccgtggacatggatgaaattgagaagtaccaggaggtggaggaggaccaggaccccagctgcccccggctgagccgggagctgctggccgagaaggagcctgaggtgctgcaggacagcctggaccgctggtacagcaccccatctggctacctggagctgcctgacctgggccagccctacagatctgctgtgtacagcctggaggagcagtacctgggcctggccctggatgtggaccgcatcaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctaccgcagcagcttctacgccctggaggagaagcacgtgggcttcagcctggatgtgggggagattgagaagaagggcaagggcaagaagaggcggggcagaagaagcaagaagaagagaagaagaggaaggaaggagggggaggaggaccagaaccccccctgcccccggctgagccgggagctgctggccgagaaggagcctgaggtgctgcaggacagcctggaccgctggtacagcacccccagcgtgtacctgggcctgacagacccctgccagccctaccgcagcgccttctacgtgctggagcagcagagggtgggcctggccgtggacatggatgaaattgagaagtaccaggaggtggaggaggaccaggaccccagctgcccccggctgagccgggagctgctggccgagaaggagcctgaggtgctgcaggacagcctggaccgctggtacagcaccccatctggctacctggagctgcctgacctgggccagccctacagatctgctgtgtacagcctggaggagcagtacctgggcctggccctggatgtggaccgcatcaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctaccgcagcagcttctacgccctggaggagaagcacgtgggcttcagcctggatgtgggggagattgagaagaagggcaagggcaagaagaggcggggcagaagaagcaagaagaagagaagaagaggaaggaaggagggggaggaggaccagaaccccccctgcccccggctgagccgggagctgctggccgagaaggagcctgaggtgctgcaggacagcctggaccgctggtacagcacccccagcgtgtacctgggcctgacagacccctgccagccctaccgcagcgccttctacgtgctggagcagcagagggtgggcctggccgtggacatggatgaaattgagaagtaccaggaggtggaggaggaccaggaccccagctgcccccggctgagccgggagctgctggccgagaaggagcctgaggtgctgcaggacagcctggaccgctggtacagcaccccatctggctacctggagctgcctgacctgggccagccctacagatctgctgtgtacagcctggaggagcagtacctgggcctggccctggatgtggacaagattgagaagtaccaggaggtggaggaggaccaggaccccagctgcccccggctgagccgggagctgctggccgagaaggagcctgaggtgctgcaggacagcctggaccgctggtacagcacccccagcgtgtacctgggcctgacagacccctgccagccctaccgcagcgccttctacgtgctggagcagcagagggtgggcctggccgtggacatggatgaaattgagaagtaccaggaggtggaggaggaccaggaccccagctgcccccggctgagccgggagctgctggccgagaaggagcctgaggtgctgcaggacagcctggaccgctgctacagcaccccatctggctacctggagctgcctgacctgggccagccctacagatctgctgtgtacagcctggaggagcagtacctgggcctggccctggatgtggaccgcatcaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctaccgcagcagcttctacgccctggaggagaagcacgtgggcttcagcctggatgtgggggagattgagaagtaccaggaggtggaggaggaccaggaccccagctgcccccggctgagccgggagctgctggccgagaaggagcctgaggtgctgcaggacagcctggaccgctggtacagcaccccatctgtgtacctgggcctgacagacccctgccagccctacagaagtgccttctacgtgctggagcagcagagggtgggcctggccgtggacatggatgaaattgagaagtaccaggaggtggaggaggaccaggaccccagctgcccccggctgagccgggagctgctggccgagaaggagcctgaggtgctgcaggacagcctggaccgctgctacagcacccccagcggctacctggagctgcctgacctgggccagccctacagatctgctgtgtacagcctggaggagcagtacctgggcctggccctggatgtggaccgcatcaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctaccgcagcagcttctacgccctggaggagaagcacgtgggcttcagcctggatgtgggggagattgagaagaagggcaagggcaagaagagaagaggccgccgcagcaagaagaagagaagaagaggaaggaaggagggggaggaggaccagaaccccccctgcccccggctgagccgggagctgctggccgagaaggagcctgaggtgctgcaggacagcctggaccgctggtacagcaccccatctgtgtacctgggcctgacagacccctgccagccctacagaagtgccttctacgtgctggagcagcagagggtgggcctggccgtggacatggatgaaattgagaagtaccaggaggtggaggaggaccaggaccccagctgcccccggctgagccgggagctgctggccgagaaggagcctgaggtgctgcaggacagcctggaccgctggtacagcacccccagcggctacctggagctgcctgacctgggccagccctacagatctgctgtgtacagcctggaggagcagtacctgggcctggccctggatgtggaccgcatcaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctaccgcagcagcttctacgccctggaggagaagcacgtgggcttcagcctggatgtgggggagattgagaagaagggcaagggcaagaagagaagaggccgccgcagcaagaagaagagaagaagaggaaggaaggagggggaggaggaccagaaccccccctgcccccggctgagccgggagctgctggccgagaaggagcctgaggtgctgcaggacagcctggaccgctggtacagcaccccatctgtgtacctgggcctgacagacccctgccagccctacagaagtgccttctacgtgctggagcagcagagggtgggcctggccgtggacatggatgaaattgagaagtaccaggaggtggaggaggaccaggaccccagctgcccccggctgagccgggagctgctggccgagaaggagcctgaggtgctgcaggacagcctggaccgctgctacagcacccccagcggctacctggagctgcctgacctgggccagccctacagatctgctgtgtacagcctggaggagcagtacctgggcctggccctggatgtggaccgcatcaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctaccgcagcagcttctacgccctggaggagaagcacgtgggcttcagcctggatgtgggggagattgagaagaagggcaagggcaagaagagaagaggccgccgcagcaagaagaagagaagaagaggaaggaaggagggggaggaggaccagaaccccccctgcccccggctgagccgggagctgctggccgagaaggagcctgaggtgctgcaggacagcctggaccgctggtacagcaccccatctgtgtacctgggcctgacagacccctgccagccctgccgcagcgccttctacgtgctggagcagcagagggtgggcctggccgtggacatggatgaaattgagaagtaccaggaggtggaggaggaccaggaccccagctgcccccggctgagccgggagctgctggccgagaaggagcctgaggtgctgcaggacagcctggaccgctgctacagcacccccagcggctacctggagctgcctgacctgggccagccctacagatctgctgtgtacagcctggaggagcagtacctgggcctggccctggatgtggaccgcatcaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctaccgcagcagcttctacgccctggaggagaagcacgtgggcttcagcctggatgtgggggagattgagaagaagggcaagggcaagaagagaagaggccgccgcagcaagaagaagagaagaagaggaaggaaggagggggaggaggaccagaaccccccctgcccccggctgaacagcgtgctgatggaggtggaggagcctgaggtgctgcaggacagcctggaccgctgctacagcacccccagcatgtactttgagctgcctgacagcttccagcactacagatctgtgttctacagctttgaggagcagcacatcacctttgccctggacatggacaacagcttcttcaccctgactgtgaccagcctgcacctggtgttccagatgggcgtcatcttcccccagtag

SEQ ID NO: 161552 - DNA, 234 bp, Artificial Sequence; identical to SEQ ID NO: 161547
  Description of Artificial Sequence: Synthetic coding sequence

SEQ ID NO: 161553 - DNA, 2517 bp, Artificial Sequence
  Description of Artificial Sequence: Synthetic coding sequence
atggtggtgtctgctggcccctggagcagcgagaaggccgagatgaacatcctggagatcaatgagaagctgcggccccagctggccgagaacaagcagcagttcaggaacctgaaggagcgctgcttcctgacccagctggccggcttcctggccaaccggcagaagaagtacaagtatgaggagtgcaaggacctgatcaagttcatgctgagaaatgaaaggcagttcaaggaggagaagctggccgagcagctgaagcaggccgaggagctgcggcagtacaaggtgctggtgcacagccaggagcgggagctgacccagctgcgggagaagctgcgggagggcagagatgccagccgcagcctgaatgagcacctgcaggccctgctgaccccagatgagccagacaagagccagggccaggacctgcaggagcagctggccgagggctgccgcctggcccagcagctggtgcagaagctgagcccagaaaatgatgaagatgaagatgaagatgtgcaggtggaggaggatgagaaggtgctggagagcagcgccccccgggaggtgcagaaggccgaggagagcaaggtgcctgaggacagcctggaggagtgtgccatcacctgcagcaacagccacggcccctgtgacagcaaccagccccacaagaacatcaagatcacctttgaggaggacaaggtgaacagcagcctggtggtggaccgggagtacagccatgatgagtgccaggatgccctgaacatcctgcctgtgcccggccccaccagcagcgccaccaacgtgtccatggtggtgtctgctggccccctgagcagcgagaaggccgagatgaacatcctggagatcaatgagaagctgcggccccagctggccgagaagaagcagcagttccgcagcctgaaggagaagtgctttgtgacccaggtggcctgcttcctggccaagcagcagaacaagtacaagtatgaggagtgcaaggacctgatcaagtccatgctgagaaatgagctgcagttcaaggaggagaagctggccgagcagctgaagcaggccgaggagctgcggcagtacaaggtgctggtgcacagccaggagcgggagctgacccagctgcgggagaagctgcgggagggcagagatgccagccgcagcctgaatgagcacctgcaggccctgctgaccccagatgagccagacaagagccagggccaggacctgcaggagcagctggccgagggctgccgcctggcccagcacctggtgcagaagctgagcccagaaaatgacaatgatgatgatgaagatgtgcaggtggaggtggccgagaaggtgcagaagagcagcagcccccgggagatgcagaaggccgaggagaaggaggtgcctgaggacagcctggaggagtgtgccatcacctgcagcaacagccacggcccctatgacagcaaccagccccacaggaagcccaagagccacctgaggaagaccaagagcacccagctgagcctggcccaccccctgatgctgaatggaaggatgctgtacaccctgagccagaagatgaaggtgatgatgaggaagaggaagaagaagggccagtgcctgcccggcatctgccgcagcctgaagaggaggaagagccccaggagccctggcatgaaggtgatccggctgagccagttcctgctgaagggccaccgctgggaccaggtgaagaaggaggaccaggaggccaccggcccccggctgagccgggagctgctggccgagaaggagcctgaggtgctgcaggacagcctggaccgctgctacagcaccccatctgtgtacctgggcctgacagacagctgccagccctacagaagtgccttctacgtgctggagcagcagagggtgggcctggccgtggacatggatgaaattgagaagtaccaggaggtggaggaggaccaggaccccagctgcccccggctgagccgggagctgctggccgagaaggagcctgaggtgctgcaggacagcctggaccgctgctacagcacccccagcggctacctggagctgcctgacctgggccagccctacagatctgctgtgtacagcctggaggagcagtacctgggcctggccctggatgtggaccgcatcaagaaggaccaggaggaggaggaggaccagggccccccctgcccccggctgagccgggagctgctggaggtggtggagcctgaggtgctgcaggacagcctggatgtgatccagctgctgcctgtggtgctgaacagcctgaccccagccagccccacagaggtgcccttcatgcactggaggaagaacatgctggccttcctgctgacctgggagaagctgaagagaagaggccggggcaggaaggagggggaggaggaccagaggaggaaggaggagggggaggagaagaagggcaagaagatcaagacccaccacgcccctggcagcacagcctgctag

SEQ ID NO: 161554 - DNA, 288 bp, Artificial Sequence
  Description of Artificial Sequence: Synthetic coding sequence
attgctgagattgagaagtaccaggaggtggaggaggaccaggaccccagctgcccccggctgagccgggagctgctggccgagaaggagcctgaggtgctgcaggacagcctggaccgctggtacagcacccccagcggctacctggagctgcctgacctgggccagccctacagatctgctgtgtacagcctggaggagcagtacctgggcctggccctggatgtggacaagattgagaagtaccaggaggtggaggaggaccaggaccccagctgccccaggtag

SEQ ID NO: 161555 - DNA, 234 bp, Artificial Sequence; identical to SEQ ID NO: 161547
  Description of Artificial Sequence: Synthetic coding sequence

SEQ ID NO: 161556 - DNA, 2784 bp, Artificial Sequence
  Description of Artificial Sequence: Synthetic coding sequence
tgagatctcatcaagtccatgctgagaaatgaaaggcagttcaaggaggagaagctggccgagcagctgaagcaggccgaggagctgcggcagtacaaggtgctggtgcacgcccaggagcgggagctgacccagctgcgggagaagctgcgggagggcagagatgccagccgcagcctgaatgagcacctgcaggccctgctgaccccagatgagccagacaagagccagggccaggacctgcaggagcagctggccgagggctgccgcctggcccagcacctggtgcagaagctgagcccagaaaatgacaatgatgatgatgaagatgtgcaggtggaggtggccgagaaggtgcagaagagcagcgccccccgggagatgcagaaggccgaggagaaggaggtgcctgaggacagcctggaggagtgtgccatcacctgcagcaacagccacggcccctatgacagcaaccagccccacaggaagaccaagatcacctttgaggaggacaaggtggacagcaccctcatcggcagcagcagccacgtggagtgggaggatgctgtgcacatcatcccagaaaatgaaagtgatgatgaggaggaggaggagaagggccctgtgagccccaggaacctgcaggagagcgaggaggaggaggtgccccaggagagctgggatgagggctacagcaccctgagcatccccccagagatgctggccagctacaagagctacagcagcaccttccacagcctggaggagcagcaggtgtgcatggctgtggacatcggccgccaccgctgggaccaggtgaagaaggaggaccacgaggccaccggcccccggctgagccgggagctgctggatgagaagggccctgaggtgctgcaggacagcctggaccgctgctacagcacccccagcggctgcctggagctgacagacagctgccagccctaccgcagcgccttctacgtgctggagcagcagagggtgggcctggccgtgaacatggatgaaattgagaagtaccaggaggtggaggaggaccaggaccccagctgcccccggctgagccgggagctgctggatgagaaggagcctgaggtgctgcaggacagcctgggccgctgctacagcaccccatctggctacctggagctgcctgacctgggccagccctacagcagcgctgtgtacagcctggaggagcagtacctgggcctggccctggatgtggaccgcatcaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagaggcggggcagaagaagcaagaaggagcggcggcggggcaggaaggagggggaggaggaccagaaccccccctgcccccggctgagccgggagctgctggatgagaagggccctgaggtgctgcaggacagcctggaccgctgctacagcacccccagcggctgcctggagctgacagacagctgccagccctaccgcagcgccttctacatcctggagcagcagagggtgggcctggccgtggacatggatgaaattgagaagtaccaggaggtggaggaggaccaggaccccagctgcccccggctgtctggagagctgctggatgagaaggagcctgaggtgctgcaggagagcctggaccgctgctacagcaccccatctggctgcctggagctgacagacagctgccagccctacagaagtgccttctacatcctggagcagcagagggtgggcctggccgtggacatggatgaaattgagaagtaccaggaggtggaggaggaccaggaccccagctgcccccggctgagccgggagctgctggatgagaaggagcctgaggtgctgcaggacagcctgggccgctgctacagcacccccagcggctacctggagctgcctgacctgggccagccctacagcagcgctgtgtacagcctggaggagcagtacctgggcctggccctggatgtggaccgcatcaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagagaagaggccgccgcagcaagaaggagaggagaagaggaaggaaggagggggaggaggaccagaaccccccctgcccccggctgaacagcatgctgatggaggtggaggagcctgaggtgctgcaggacagcctggacatctgctacagcacccccagcatgtactttgagctgcctgacagcttccagcactacagatctgtgttctacagctttgaggaggagcacatcagctttgccctgtatgtggacaaccgcttcttcaccctgactgtgaccagcctgcacctggtgttccagatgggcgtcatcttcccccagtag

SEQ ID NO: 161557 - DNA, 2766 bp, Artificial Sequence
  Description of Artificial Sequence: Synthetic coding sequence
atgctgagaaatgaaaggcagttcaaggaggagaagctggccgagcagctgaagcaggccgaggagctgcggcagtacaaggtgctggtgcacgcccaggagcgggagctgacccagctgcgggagaagctgcgggagggcagagatgccagccgcagcctgaatgagcacctgcaggccctgctgaccccagatgagccagacaagagccagggccaggacctgcaggagcagctggccgagggctgccgcctggcccagcacctggtgcagaagctgagcccagaaaatgacaatgatgatgatgaagatgtgcaggtggaggtggccgagaaggtgcagaagagcagcgccccccgggagatgcagaaggccgaggagaaggaggtgcctgaggacagcctggaggagtgtgccatcacctgcagcaacagccacggcccctatgacagcaaccagccccacaggaagaccaagatcacctttgaggaggacaaggtggacagcaccctcatcggcagcagcagccacgtggagtgggaggatgctgtgcacatcatcccagaaaatgaaagtgatgatgaggaggaggaggagaagggccctgtgagccccaggaacctgcaggagagcgaggaggaggaggtgccccaggagagctgggatgagggctacagcaccctgagcatccccccagagatgctggccagctacaagagctacagcagcaccttccacagcctggaggagcagcaggtgtgcatggctgtggacatcggccgccaccgctgggaccaggtgaagaaggaggaccacgaggccaccggcccccggctgagccgggagctgctggatgagaagggccctgaggtgctgcaggacagcctggaccgctgctacagcacccccagcggctgcctggagctgacagacagctgccagccctaccgcagcgccttctacgtgctggagcagcagagggtgggcctggccgtgaacatggatgaaattgagaagtaccaggaggtggaggaggaccaggaccccagctgcccccggctgagccgggagctgctggatgagaaggagcctgaggtgctgcaggacagcctgggccgctgctacagcaccccatctggctacctggagctgcctgacctgggccagccctacagcagcgctgtgtacagcctggaggagcagtacctgggcctggccctggatgtggaccgcatcaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagaggcggggcagaagaagcaagaaggagcggcggcggggcaggaaggagggggaggaggaccagaaccccccctgcccccggctgagccgggagctgctggatgagaagggccctgaggtgctgcaggacagcctggaccgctgctacagcacccccagcggctgcctggagctgacagacagctgccagccctaccgcagcgccttctacatcctggagcagcagagggtgggcctggccgtggacatggatgaaattgagaagtaccaggaggtggaggaggaccaggaccccagctgcccccggctgtctggagagctgctggatgagaaggagcctgaggtgctgcaggagagcctggaccgctgctacagcaccccatctggctgcctggagctgacagacagctgccagccctacagaagtgccttctacatcctggagcagcagagggtgggcctggccgtggacatggatgaaattgagaagtaccaggaggtggaggaggaccaggaccccagctgcccccggctgagccgggagctgctggatgagaaggagcctgaggtgctgcaggacagcctgggccgctgctacagcacccccagcggctacctggagctgcctgacctgggccagccctacagcagcgctgtgtacagcctggaggagcagtacctgggcctggccctggatgtggaccgcatcaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagagaagaggccgccgcagcaagaaggagaggagaagaggaaggaaggagggggaggaggaccagaaccccccctgcccccggctgaacagcatgctgatggaggtggaggagcctgaggtgctgcaggacagcctggacatctgctacagcacccccagcatgtactttgagctgcctgacagcttccagcactacagatctgtgttctacagctttgaggaggagcacatcagctttgccctgtatgtggacaaccgcttcttcaccctgactgtgaccagcctgcacctggtgttccagatgggcgtcatcttcccccagtag

SEQ ID NO: 161558 - DNA, 810 bp, Artificial Sequence
  Description of Artificial Sequence: Synthetic coding sequence
atggatgaaattgagaagtaccaggaggtggaggaggaccaggaccccagctgcccccggctgagccgggagctgctggatgagaaggagcctgaggtgctgcaggacagcctgggccgctgctacagcacccccagcggctacctggagctgcctgacctgggccagccctacagcagcgctgtgtacagcctggaggagcagtacctgggcctggccctggatgtggaccgcatcaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagagaagaggccgccgcagcaagaaggagaggagaagaggaaggaaggagggggaggaggaccagaaccccccctgcccccggctgaacagcatgctgatggaggtggaggagcctgaggtgctgcaggacagcctggacatctgctacagcacccccagcatgtactttgagctgcctgacagcttccagcactacagatctgtgttctacagctttgaggaggagcacatcagctttgccctgtatgtggacaaccgcttcttcaccctgactgtgaccagcctgcacctggtgttccagatgggcgtcatcttcccccagtag

SEQ ID NO: 161559 - DNA, 1539 bp, Artificial Sequence
  Description of Artificial Sequence: Synthetic coding sequence
tgatatgaggagtgcaaggacctgatcaagtccatgctgagaaatgaaaggcagttcaaggaggagaagctggccgagcagctgaagcaggccgaggagctgcggcagtacaaggtgctggtgcacgcccaggagcgggagctgacccagctgcgggagaagctgcgggagggcagagatgccagccgcagcctgaatgagcacctgcaggccctgctgaccccagatgagccagacaagagccagggccaggacctgcaggagcagctggccgagggctgccgcctggcccagcacctggtgcagaagctgagcccagaaaatgacaatgatgatgatgaagatgtgcaggtggaggtggccgagaaggtgcagaagagcagcgccccccgggagatgcagaaggccgaggagaaggaggtgcctgaggacagcctggaggagtgtgccatcacctgcagcaacagccacggcccctatgacagcaaccagccccacaggaagaccaagatcacctttgaggaggacaaggtggacagcaccctgattggcagcagcagccacgtggagtgggaggatgctgtgcacatcatcccagaaaatgaaagtgatgatgaggaggaggaggagaagggccctgtgagccccaggaacctgcaggagagcgaggaggaggaggtgccccaggagagctgggatgagggctacagcaccctgagcatccccccagagatgctggccagctacaagagctacagcagcaccttccacagcctggaggagcagcaggtgtgcatggctgtggacatcggccgccaccgctgggaccaggtgaagaaggaggaccacgaggccaccggcccccggctgagccgggagctgctggatgagaagggccctgaggtgctgcaggacagcctggaccgctgctacagcaccccatctggctgcctggagctgacagacagctgccagccctacagaagtgccttctacgtgctggagcagcagagggtgggcctggccgtgaacatggatgaaattgagaagtaccaggaggtggaggaggaccaggaccccagctgcccccggctgagccgggagctgctggatgagaaggagcctgaggtgctgcaggacagcctgggccgctgctacagcacccccagcggctacctggagctgcctgacctgggccagccctacagcagcgctgtgtacagcctggaggagcagtacctgggcctggccctggatgtggaccgcatcaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagagaagaggccgccgctcctag

SEQ ID NO: 161560 - DNA, 567 bp, Artificial Sequence
  Description of Artificial Sequence: Synthetic coding sequence
atggatgaaattgagaagtaccaggaggtggaggaggaccaggaccccagctgcccccggctgagccgggagctgctggatgagaaggagcctgaggtgctgcaggacagcctgggccgctgctacagcacccccagcggctacctggagctgcctgacctgggccagccctacagcagcgctgtgtacagcctggaggagcagtacctgggcctggccctggatgtggaccgcatcaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagagaagaggccgccgcagcaagaaggagaggagaagaggaaggaaggagggggaggaggaccagaaccccccctgcccctag

SEQ ID NO: 161561 - DNA, 1539 bp, Artificial Sequence; identical to SEQ ID NO: 161559
  Description of Artificial Sequence: Synthetic coding sequence

SEQ ID NO: 161562 - DNA, 1539 bp, Artificial Sequence; identical to SEQ ID NO: 161559
  Description of Artificial Sequence: Synthetic coding sequence

SEQ ID NO: 161563 - DNA, 753 bp, Artificial Sequence
  Description of Artificial Sequence: Synthetic coding sequence
gagattgagaagtaccaggaggtggaggaggaccaggaccccagctgcccccggctgagccgggagctgctggatgagaaggagcctgaggtgctgcaggacagcctgggccgctgctacagcacccccagcggctacctggagctgcctgacctgggccagccctacagcagcgctgtgtacagcctggaggagcagtacctgggcctggccctggatgtggaccgcatcaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagagaagaggccgccgcagcaagaaggagaggagaagaggaaggaaggagggggaggaggaccagaaccccccctgcccccggctgtctggagagctgctggatgagaaggagcctgaggtgctgcaggagagcctggaccgctgctacagcaccccatctggctgcctggagctgacagacagctgccagccctacagaagtgccttctacatcctggagcagcagagggtgggcctggccgtggacatggatggagagtacctgtccatgtag

SEQ ID NO: 161564 - DNA, 1539 bp, Artificial Sequence; identical to SEQ ID NO: 161559
  Description of Artificial Sequence: Synthetic coding sequence

SEQ ID NO: 161565 - DNA, 1539 bp, Artificial Sequence; identical to SEQ ID NO: 161559
  Description of Artificial Sequence: Synthetic coding sequence

SEQ ID NO: 161566 - DNA, 1539 bp, Artificial Sequence; identical to SEQ ID NO: 161559
  Description of Artificial Sequence: Synthetic coding sequence

SEQ ID NO: 161567 - DNA, 1539 bp, Artificial Sequence; identical to SEQ ID NO: 161559
  Description of Artificial Sequence: Synthetic coding sequence

SEQ ID NO: 161568 - DNA, 2013 bp, Artificial Sequence
  Description of Artificial Sequence: Synthetic coding sequence
atggtggtgtctgctggccccctgagcagcgagaaggccgagatgaacatcctggagatcaatgagaagctgcggccccagctggccgagaagaagcagcagttcaggaacctgaaggagaagtgcttcctgacccagctggccggcttcctggccaaccggcagaagaagtacaagtatgaggagtgcaaggacctgatcaagttcatgctgagaaatgaaaggcagttcaaggaggagaagctggccgagcagctgaagcaggccgaggagctgcggcagtacaaggtgctggtgcacgcccaggagcgggagctgacccagctgcgggagaagctgcgggagggcagagatgccagccgcagcctgaatgagcacctgcaggccctgctgaccccagatgagccagacaagagccagggccaggacctgcaggagcagctggccgagggctgccgcctgacccagcacctggtgcagaagctgagcccagaaaatgacaatgatgatgatgaagatgtgcaggtggaggtggccgagaaggtgcagaagagcagcgccccccgggagatgcagaaggccgaggagaaggaggtgcctgaggacagcctggaggagtgtgccatcacctgcagcaacagccacggcccctatgacagcaaccagccccacaagaagaccaagatcacctttgaggaggacaaggtggacagcaccctgattggcagcagcagccacgtggagtgggaggatgctgtgcacatcatcccagaaaatgaaagtgatgatgaggaggaggaggagaagggccctgtgagccccaggaacctgcaggagagcgaggaggaggaggtgccccaggagagctgggatgagggctacagcaccctgagcatccccccagagatgctggccagctaccagagctacagcagcaccttccacagcctggaggagcagcaggtgtgcatggctgtggacatcggccgccaccgctgggaccaggtgaagaaggaggaccaggaggccaccggcccccggctgagccgggagctgctggatgagaaggagcctgaggtgctgcaggacagcctggaccgctgctacagcaccccatctggctgcctggagctgacagacagctgccagccctacagaagtgccttctacgtgctggagcagcagagggtgggcctggccatcgacatggatgaaattgagaagtaccaggaggtggaggaggaccaggaccccagctgcccccggctgagccgggagctgctggatgagaaggagcctgaggtgctgcaggacagcctggaccgctgctacagcacccccagcgactacctggagctgcctgacctgggccagccctacagcagcgctgtgtacagcctggaggagcagtacctgggcctggccctggatgtggaccgcatcaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagagaagaggccgccgcagcaagaagaagagaagaagaggaaggaaggagggggaggatgacaaccccccctgcccccggctgtatggagtgctgatggaggtggaggagcctgaggtgctgcaggacagcctggaccgctgctacagcacccccagcatgtactttgagcagcctgacagcttccagcactaccgcagcgtcttctacagctttgaggaggagcacatcagctttgccctgtatgtggacaaccgcttcttcaccctgactgtgaccagcctgcacctggtgttccagatgggcgtcatcttcccccagtag

SEQ ID NO: 161569 - DNA, 2013 bp, Artificial Sequence; identical to SEQ ID NO: 161568
  Description of Artificial Sequence: Synthetic coding sequence

SEQ ID NO: 161570 - DNA, 2013 bp, Artificial Sequence
  Description of Artificial Sequence: Synthetic coding sequence
atggtggtgtctgctggccccctgagcagcgagaaggccgagatgaacatcctggagatcaatgagaagctgcggccccagctggccgagaagaagcagcagttcaggaacctgaaggagaagtgcttcctgacccagctggccggcttcctggccaaccggcagaagaagtacaagtatgaggagtgcaaggacctgatcaagttcatgctgagaaatgaaaggcagttcaaggaggagaagctggccgagcagctgaagcaggccgaggagctgcggcagtacaaggtgctggtgcacgcccaggagcgggagctgacccagctgcgggagaagctgcgggagggcagagatgccagccgcagcctgaatgagcacctgcaggccctgctgaccccagatgagccagacaagagccagggccaggacctgcaggagcagctggccgagggctgccgcctgacccagcacctggtgcagaagctgagcccagaaaatgacaatgatgatgatgaagatgtgcaggtggaggtggccgagaaggtgcagaagagcagcgccccccgggagatgcagaaggccgaggagaaggaggtgcctgaggacagcctggaggagtgtgccatcacctgcagcaacagccacggcccctatgacagcaaccagccccacaagaagaccaagatcacctttgaggaggacaaggtggacagcaccctgattggcagcagcagccacgtggagtgggaggatgctgtgcacatcatcccagaaaatgaaagtgatgatgaggaggaggaggagaagggccctgtgagccccaggaacctgcaggagagcgaggaggaggaggtgccccaggagagctgggatgagggctacagcaccctgagcatccccccagagatgctggccagctaccagagctacagcagcaccttccacagcctggaggagcagcaggtgtgcatggctgtggacatcggccgccaccgctgggaccaggtgaagaaggaggaccaggaggccaccggcccccggctgagccgggagctgctggatgagaaggagcctgaggtgctgcaggacagcctggaccgctgctacagcaccccatctggctgcctggagctgacagacagctgccagccctacagaagtgccttctacgtgctggagcagcagagggtgggcctggccatcgacatggatgaaattgagaagtaccaggaggtggaggaggaccaggaccccagctgcccccggctgagccgggagctgctggatgagaaggagcctgaggtgctgcaggacagcctggaccgctgctacagcacccccagcgactacctggagctgcctgacctgggccagccctacagcagcgctgtgtacagcctggaggagcagtacctgggcctggccctggatgtggaccgcatcaagaaggaccaggaggaggaggaggaccagggccccccctgcccccggctgagccgggagctgctggaggtggtggagcctgaggtgctgcaggacagcctggaccgctactacagcacccccagcagctgcctggagcagcctgacagctgccagccctacggcagcagcttctacgccctggaggagaagcacgtgggcttcagcctggatgtgggggagattgagaagaagggcaagggcaagaagagaagaggccgccgcagcaagaagaagagaagaagaggaaggaaggagggggaggatgacaaccccccctgcccccggctgaatggagtgctgatggaggtggaggagcctgaggtgctgcaggacagcctggaccgctgctacagcacccagagcatgtactttgagctgcctgacagcttccagcactaccgcagcgtcttctacagctttgaggaggagcacatcagctttgccctgtatgtggacaaccgcttcttcaccctgactgtgaccagcctgcacctggtgttccagatgggcgtcatcttcccccagtag

SEQ ID NO: 161571 - DNA, 2013 bp, Artificial Sequence; identical to SEQ ID NO: 161570
  Description of Artificial Sequence: Synthetic coding sequence

SEQ ID NO: 161572 - DNA, 2526 bp, Artificial Sequence
  Description of Artificial Sequence: Synthetic coding sequence
atggtggtgtctgctggcccctggagcagcgagaaggccgagatgaacatcctggagatcaatgagaagctgcggccccagctggccgagaacaagcagcagtttggaaacctgaaggagcgctgctttgtgacccagctggccggcttcctggccaaccagcagaagaagtacaactatgaggagtgcaaggacctgatcaagttcatgctgagaaatgaaaggcagttcaaggaggagaagctggccgagcagctgaagcaggccgaggagctgcggcagtacaaggtgctggtgcacagccaggagcgggagctgacccagctgcgggagaagctgcgggagggcagagatgccagccgcagcctgaatgagcacctgcaggccctgctgaccctggatgagccagacaagagccagggccaggacctgcaggagcagctggccgagggctgccgcctggcccagcacctggtgcagaagctgagcccagaaaatgatgaagatgaagatgaagatgtgcaggtggaggaggccgagaaggtgcagaagagcagcgccccccgggaggtgcagaagacagaggagagcaaggtgcctgaggacagcctggaggagtgtgccatcacctgcagcaacagccacggcccctgtgacagcaaccagccccacaagaacatcaagatcacctttgaagaagatgaggtgaacagcaccctggtggtggaccgggagagcagccatgatgagtgccaggatgccctgaacatcctgcctgtgcccggccccaccagcagcgccaccaacgtgtccatggtggtgtctgctggccccctgagcagcgagaaggccgagatgaacatcctggagatcaatgagaagctgcacccccagctggccgagaagaagcagcagttcaggaacctgaaggagcgctgctttgtgacccagctggccggcttcctggccaaccagcagaagaagtacaagtatgaggagtgcaaggacctgatcaagtccatgctgagaaatgaaaggcagttcaaggaggagaagctggccgagcagctgaagcaggccgaggagctgcggcagtacaaggtgctggtgcacgcccaggagcgggagctgacccagctgcgggagaagctgcgggagggcagagatgccagccgcagcctgaatgagcacctgcaggccctgctgaccccagatgagccagacaagagccagggccaggacctgcaggagcagctggccgagggctgccgcctggcccagcacctggtgcagaagctgagcccagaaaatgacaatgatgatgatgaagatgtgcaggtggagctggccgagaaggtgcagaagagcagcgccccccgggagatgcagaaggccgaggagaaggaggtgcctgaggacagccaggaggagtgtgccatcacctacagcaacagccacggcccctatgacagcaaccagccccacaggaagaccaagatcacctttgaggaggacaaggtggacagcaccctcatcggcagcagcagccacgtggagtgggaggatgctgtgcacatcatcccagaaaatgaaagtgatgatgaggaggaggaggagaagggccctgtgagccccaggaacctgcaggagagcgaggaggaggaggtgccccaggagagctgggatgagggctacagcaccctgagcatccccccagagatgctggccagctaccagagctacagcagcaccttccacagcctggaggagcagcaggtgtgcatggctgtggacatcggccgccaccgctgggaccaggtgaagaaggaggaccaggaggccaccggcccccggctgagccgggagctgctggatgagaagggccctgaggtgctgcaggacagcctggaccgctgctacagcacccccagcggctgcctggagctgacagacagctgccagccctaccgcagcgccttctacgtgctggagcagcagagggtgggcctggccgtggacatggatgaaattgagaagtaccaggaggtggaggaggaccaggaccccagctgcccccggctgagccgggagctgctggatgagaaggagcctgaggtgctgcaggacagcctggaccgctgctacagcaccccatctggctacctggagctgcctgacctgggccagccctacagcagcgctgtgtacagcctggaggagcagtacctgggcctggccctggatgtggacaggaccaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagaggcggggcagaagaagctag

SEQ ID NO: 161573 - DNA, 13866 bp, Artificial Sequence
  Description of Artificial Sequence: Synthetic coding sequence
atggtggtgtctgctggcccctggagcagcgagaaggccgagatgaacatcctggagatcaatgagaagctgcggccccagctggccgagaacaagcagcagtttggaaacctgaaggagcgctgctttgtgacccagctggccggcttcctggccaaccagcagaagaagtacaactatgaggagtgcaaggacctgatcaagttcatgctgagaaatgaaaggcagttcaaggaggagaagctggccgagcagctgaagcaggccgaggagctgcggcagtacaaggtgctggtgcacagccaggagcgggagctgacccagctgcgggagaagctgcgggagggcagagatgccagccgcagcctgaatgagcacctgcaggccctgctgaccctggatgagccagacaagagccagggccaggacctgcaggagcagctggccgagggctgccgcctggcccagcacctggtgcagaagctgagcccagaaaatgatgaagatgaagatgaagatgtgcaggtggaggaggccgagaaggtgcagaagagcagcgccccccgggaggtgcagaagacagaggagagcaaggtgcctgaggacagcctggaggagtgtgccatcacctgcagcaacagccacggcccctgtgacagcaaccagccccacaagaacatcaagatcacctttgaagaagatgaggtgaacagcaccctggtggtggaccgggagagcagccatgatgagtgccaggatgccctgaacatcctgcctgtgcccggccccaccagcagcgccaccaacgtgtccatggtggtgtctgctggccccctgagcagcgagaaggccgagatgaacatcctggagatcaatgagaagctgcacccccagctggccgagaagaagcagcagttcaggaacctgaaggagcgctgctttgtgacccagctggccggcttcctggccaaccagcagaagaagtacaagtatgaggagtgcaaggacctgatcaagtccatgctgagaaatgaaaggcagttcaaggaggagaagctggccgagcagctgaagcaggccgaggagctgcggcagtacaaggtgctggtgcacgcccaggagcgggagctgacccagctgcgggagaagctgcgggagggcagagatgccagccgcagcctgaatgagcacctgcaggccctgctgaccccagatgagccagacaagagccagggccaggacctgcaggagcagctggccgagggctgccgcctggcccagcacctggtgcagaagctgagcccagaaaatgacaatgatgatgatgaagatgtgcaggtggagctggccgagaaggtgcagaagagcagcgccccccgggagatgcagaaggccgaggagaaggaggtgcctgaggacagccaggaggagtgtgccatcacctacagcaacagccacggcccctatgacagcaaccagccccacaggaagaccaagatcacctttgaggaggacaaggtggacagcaccctcatcggcagcagcagccacgtggagtgggaggatgctgtgcacatcatcccagaaaatgaaagtgatgatgaggaggaggaggagaagggccctgtgagccccaggaacctgcaggagagcgaggaggaggaggtgccccaggagagctgggatgagggctacagcaccctgagcatccccccagagatgctggccagctaccagagctacagcagcaccttccacagcctggaggagcagcaggtgtgcatggctgtggacatcggccgccaccgctgggaccaggtgaagaaggaggaccaggaggccaccggcccccggctgagccgggagctgctggatgagaagggccctgaggtgctgcaggacagcctggaccgctgctacagcacccccagcggctgcctggagctgacagacagctgccagccctaccgcagcgccttctacgtgctggagcagcagagaattggcctggccgtggacatggatgaaattgagaagtaccaggaggtggaggaggaccaggaccccagctgcccccggctgagccgggagctgctggatgagaaggagcctgaggtgctgcaggacagcctggaccgctgctacagcaccccatctggctacctggagctgcctgacctgggccagccctacagcagcgctgtgtacagcctggaggagcagtacctgggcctggccctggatgtggacaggaccaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagaggcggggcagaagaagcaagaaggagcggcggcggggcaggaaggagggggaggaggaccagaaccccccctgcccccggctgagccgggagctgctggatgagaagggccctgaggtgctgcaggacagcctggacaggagctacagcacccccagcggctgcctggagctgacagacagctgccagccctaccgcagcgccttctacgtgctggagcagcagagggtgggcctggccgtggacatggatgaaattgagaagtaccaggaggtggaggaggaccaggaccccagctgcccccggctgagccgggagctgctggatgagaaggagcctgaggtgctgcaggacagcctggaccgctgctacagcaccccatctggctacctggagctgcctgacctgggccagccctacagcagcgctgtgtacagcctggaggagcagtacctgggcctggccctggatgtggacaggaccaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagaggcggggcagaagaagcaagaaggagcggcggcggggcaggaaggagggggaggaggaccagaaccccccctgcccccggctgagccgggagctgctggatgagaagggccctgaggtgctgcaggacagcctggaccgctgctacagcacccccagcggctgcctggagctgacagacagctgccagccctaccgcagcgccttctacgtgctggagcagcagagggtgggcctggccgtggacatggatgaaattgagaagtaccaggaggtggaggaggaccaggaccccagctgcccccggctgagccgggagctgctggatgagaaggagcctgaggtgctgcaggacagcctggaccgctgctacagcaccccatctggctacctggagctgcctgacctgggccagccctacagcagcgctgtgtacagcctggaggagcagtacctgggcctggccctggatgtggacaggaccaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagaggcggggcagaagaagcaagaaggagcggcggcggggcaggaaggagggggaggaggaccagaaccccccctgcccccggctgagccgggagctgctggatgagaagggccctgaggtgctgcaggacagcctggacaggagctacagcacccccagcggctgcctggagctgacagacagctgccagccctaccgcagcgccttctacgtgctggagcagcagagggtgggcctggccgtggacatggatgaaattgagaagtaccaggaggtggaggaggaccaggaccccagctgcccccggctgagccgggagctgctggatgagaaggagcctgaggtgctgcaggacagcctggaccgctgctacagcaccccatctggctacctggagctgcctgacctgggccagccctacagcagcgctgtgtacagcctggaggagcagtacctgggcctggccctggatgtggacaggaccaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagaggcggggcagaagaagcaagaaggagcggcggcggggcaggaaggagggggaggaggaccagaaccccccctgcccccggctgagccgggagctgctggatgagaagggccctgaggtgctgcaggacagcctggaccgctgctacagcacccccagcggctgcctggagctgacagacagctgccagccctaccgcagcgccttctacgtgctggagcagcagagggtgggcctggccgtggacatggatgaaattgagaagtaccaggaggtggaggaggaccaggaccccagctgcccccggctgagccgggagctgctggatgagaaggagcctgaggtgctgcaggacagcctggaccgctgctacagcaccccatctggctacctggagctgcctgacctgggccagccctacagcagcgctgtgtacagcctggaggagcagtacctgggcctggccctggatgtggacaggaccaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagaggcggggcagaagaagcaagaaggagcggcggcggggcaggaaggagggggaggaggaccagaaccccccctgcccccggctgagccgggagctgctggatgagaagggccctgaggtgctgcaggacagcctggacaggagctacagcacccccagcggctgcctggagctgacagacagctgccagccctaccgcagcgccttctacgtgctggagcagcagagggtgggcctggccgtggacatggatgaaattgagaagtaccaggaggtggaggaggaccaggaccccagctgcccccggctgagccgggagctgctggatgagaaggagcctgaggtgctgcaggacagcctggaccgctgctacagcaccccatctggctacctggagctgcctgacctgggccagccctacagcagcgctgtgtacagcctggaggagcagtacctgggcctggccctggatgtggacaggaccaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagaggcggggcagaagaagcaagaaggagcggcggcggggcaggaaggagggggaggaggaccagaaccccccctgcccccggctgagccgggagctgctggatgagaagggccctgaggtgctgcaggacagcctggacaggagctacagcacccccagcggctgcctggagctgacagacagctgccagccctaccgcagcgccttctacgtgctggagcagcagagggtgggcctggccgtggacatggatgaaattgagaagtaccaggaggtggaggaggaccaggaccccagctgcccccggctgagccgggagctgctggatgagaaggagcctgaggtgctgcaggacagcctggaccgctgctacagcaccccatctggctacctggagctgcctgacctgggccagccctacagcagcgctgtgtacagcctggaggagcagtacctgggcctggccctggatgtggacaggaccaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagaggcggggcagaagaagcaagaaggagcggcggcggggcaggaaggagggggaggaggaccagaaccccccctgcccccggctgagccgggagctgctggatgagaagggccctgaggtgctgcaggacagcctggacaggagctacagcacccccagcggctgcctggagctgacagacagctgccagccctaccgcagcgccttctacgtgctggagcagcagagggtgggcctggccgtggacatggatgaaattgagaagtaccaggaggtggaggaggaccaggaccccagctgcccccggctgagccgggagctgctggatgagaaggagcctgaggtgctgcaggacagcctggaccgctgctacagcaccccatctggctacctggagctgcctgacctgggccagccctacagcagcgctgtgtacagcctggaggagcagtacctgggcctggccctggatgtggacaggaccaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagaggcggggcagaagaagcaagaaggagcggcggcggggcaggaaggagggggaggaggaccagaaccccccctgcccccggctgagccgggagctgctggatgagaagggccctgaggtgctgcaggacagcctggacaggagctacagcacccccagcggctgcctggagctgacagacagctgccagccctaccgcagcgccttctacgtgctggagcagcagagggtgggcctggccgtggacatggatgaaattgagaagtaccaggaggtggaggaggaccaggaccccagctgcccccggctgagccgggagctgctggatgagaaggagcctgaggtgctgcaggacagcctggaccgctgctacagcaccccatctggctacctggagctgcctgacctgggccagccctacagcagcgctgtgtacagcctggaggagcagtacctgggcctggccctggatgtggacaggaccaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagaggcggggcagaagaagcaagaaggagcggcggcggggcaggaaggagggggaggaggaccagaaccccccctgcccccggctgagccgggagctgctggatgagaaggagcctgaggtgctgcaggacagcctggaccgctgctacagcacccccagcggctacctggagctgcctgacctgggccagccctacagcagcgctgtgtacagcctggaggagcagtacctgggcctggccctggatgtggacaggaccaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagagaagaggccgccgcagcaagaaggagaggagaagaggaaggaaggagggggaggaggaccagaaccccccctgcccccggctgagccgggagctgctggatgagaaggagcctgaggtgctgcaggacagcctggaccgctgctacagcaccccatctggctacctggagctgcctgacctgggccagccctacagcagcgctgtgtacagcctggaggagcagtacctgggcctggccctggatgtggacaggaccaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagaggcggggcagaagaagcaagaaggagcggcggcggggcaggaaggagggggaggaggaccagaaccccccctgcccccggctgagccgggagctgctggatgagaaggagcctgaggtgctgcaggacagcctggaccgctgctacagcacccccagcggctacctggagctgcctgacctgggccagccctacagcagcgctgtgtacagcctggaggagcagtacctgggcctggccctggatgtggacaggaccaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagagaagaggccgccgcagcaagaaggagaggagaagaggaaggaaggagggggaggaggaccagaaccccccctgcccccggctgagccgggagctgctggatgagaagggccctgaggtgctgcaggacagcctggaccgctgctacagcaccccatctggctgcctggagctgacagacagctgccagccctacagaagtgccttctacgtgctggagcagcagagggtgggcctggccgtggacatggatgaaattgagaagtaccaggaggtggaggaggaccaggaccccagctgcccccggctgagccgggagctgctggatgagaaggagcctgaggtgctgcaggacagcctggaccgctgctacagcacccccagcggctacctggagctgcctgacctgggccagccctacagcagcgctgtgtacagcctggaggagcagtacctgggcctggccctggatgtggacaggaccaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagagaagaggccgccgcagcaagaaggagaggagaagaggaaggaaggagggggaggaggaccagaaccccccctgcccccggctgagccgggagctgctggatgagaagggccctgaggtgctgcaggacagcctggaccgctgctacagcaccccatctggctgcctggagctgacagacagctgccagccctacagaagtgccttctacgtgctggagcagcagagggtgggcctggccgtggacatggatgaaattgagaagtaccaggaggtggaggaggaccaggaccccagctgcccccggctgagccgggagctgctggatgagaaggagcctgaggtgctgcaggacagcctggaccgctgctacagcacccccagcggctacctggagctgcctgacctgggccagccctacagcagcgctgtgtacagcctggaggagcagtacctgggcctggccctggatgtggacaggaccaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagagaagaggccgccgcagcaagaaggagaggagaagaggaaggaaggagggggaggaggaccagaaccccccctgcccccggctgagccgggagctgctggatgagaagggccctgaggtgctgcaggacagcctggaccgctgctacagcaccccatctggctgcctggagctgacagacagctgccagccctacagaagtgccttctacgtgctggagcagcagagggtgggcctggccgtggacatggatgaaattgagaagtaccaggaggtggaggaggaccaggaccccagctgcccccggctgagccgggagctgctggatgagaaggagcctgaggtgctgcaggacagcctggaccgctgctacagcacccccagcggctacctggagctgcctgacctgggccagccctacagcagcgctgtgtacagcctggaggagcagtacctgggcctggccctggatgtggacaggaccaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagagaagaggccgccgcagcaagaaggagaggagaagaggaaggaaggagggggaggaggaccagaccccaccctgcccccggctgagccgggagctgctggatgagaagggccctgaggtgctgcaggacagcctggaccgctgctacagcaccccatctggctgcctggagctgacagacagctgccagccctacagaagtgccttctacgtgctggagcagcagagggtgggcctggccgtggacatggatgaaattgagaagtaccaggaggtggaggaggaccaggaccccagctgcccccggctgagccgggagctgctggatgagaaggagcctgaggtgctgcaggacagcctggaccgctgctacagcacccccagcggctacctggagctgcctgacctgggccagccctacagcagcgctgtgtacagcctggaggagcagtacctgggcctggccctggatgtggacaggaccaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagagaagaggccgccgcagcaagaaggagaggagaagaggaaggaaggagggggaggaggaccagaaccccccctgcccccggctgagccgggagctgctggatgagaagggccctgaggtgctgcaggacagcctggaccgctgctacagcaccccatctggctgcctggagctgacagacagctgccagccctacagaagtgccttctacgtgctggagcagcagagggtgggcctggccgtggacatggatgaaattgagaagtaccaggaggtggaggaggaccaggaccccagctgcccccggctgagccgggagctgctggatgagaaggagcctgaggtgctgcaggacagcctggaccgctgctacagcacccccagcggctacctggagctgcctgacctgggccagccctacagcagcgctgtgtacagcctggaggagcagtacctgggcctggccctggatgtggacaggaccaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagagaagaggccgccgcagcaagaagaagagaagaagaggaaggaaggagggggaggaggaccagaaccccccctgcccccggctgaatggagtgctgatggaggtggaggagcctgaggtgctgcaggacagcctggatggctgctacagcacccccagcatgtactttgagctgcctgacagcttccagcactacagatctgtgttctacagctttgaggagcagcacatcagctttgccctgtatgtggacaaccgcttcttcaccctgactgtgaccagcctgcacctggtgttccagatgggcgtcatcttcccccagtag

SEQ ID NO: 161574 - DNA, 780 bp, Artificial Sequence
  Description of Artificial Sequence: Synthetic coding sequence
atggtggtgtctgctggcccctggagcagcgagaaggccgagatgaacatcctggagatcaatgagaagctgcggccccagctggccgagaacaagcagcagtttggaaacctgaaggagcgctgctttgtgacccagctggccggcttcctggccaaccagcagaagaagtacaactatgaggagtgcaaggacctgatcaagttcatgctgagaaatgaaaggcagttcaaggaggagaagctggccgagcagctgaagcaggccgaggagctgcggcagtacaaggtgctggtgcacagccaggagcgggagctgacccagctgcgggagaagctgcgggagggcagagatgccagccgcagcctgaatgagcacctgcaggccctgctgaccctggatgagccagacaagagccagggccaggacctgcaggagcagctggccgagggctgccgcctggcccagcacctggtgcagaagctgagcccagaaaatgatgaagatgaagatgaagatgtgcaggtggaggaggccgagaaggtgcagaagagcagcgccccccgggaggtgcagaagacagaggagagcaaggtgcctgaggacagcctggaggagtgtgccatcacctgcagcaacagccacggcccctgtgacagcaaccagccccacaagaacatcaagatcacctttgaagaagatgaggtgaacagcaccctggtggtggaccgggagagcagccatgatgagtgccaggatgccctgaacatcctgccctag

SEQ ID NO: 161575 - DNA, 456 bp, Artificial Sequence
  Description of Artificial Sequence: Synthetic coding sequence
ctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagaggcggggcagaagaagcaagaaggagcggcggcggggcaggaaggagggggaggaggaccagaccccaccctgcccccggctgagccgggagctgctggatgagaagggccctgaggtgctgcaggacagcctggaccgctgctacagcacccccagcggctgcctggagctgacagacagctgccagccctaccgcagcgccttctacgtgctggagcagcagagggtgggcctggccgtggacatggactag

SEQ ID NO: 161576 - DNA, 456 bp, Artificial Sequence
  Description of Artificial Sequence: Synthetic coding sequence
ctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagaggcggggcagaagaagcaagaaggagcggcggcggggcaggaaggagggggaggaggaccagaaccccccctgcccccggctgagccgggagctgctggatgagaagggccctgaggtgctgcaggacagcctggaccgctgctacagcacccccagcggctgcctggagctgacagacagctgccagccctaccgcagcgccttctacgtgctggagcagcagagggtgggcctggccgtggacatggactag

SEQ ID NO: 161577 - DNA, 456 bp, Artificial Sequence
  Description of Artificial Sequence: Synthetic coding sequence
ctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagaggcggggcagaagaagcaagaaggagcggcggcggggcaggaaggagggggaggaggaccagaaccccccctgcccccggctgagccgggagctgctggatgagaagggccctgaggtgctgcaggacagcctggacaggagctacagcacccccagcggctgcctggagctgacagacagctgccagccctaccgcagcgccttctacgtgctggagcagcagagggtgggcctggccgtggacatggactag

SEQ ID NO: 161578 - DNA, 456 bp, Artificial Sequence; identical to SEQ ID NO: 161576
  Description of Artificial Sequence: Synthetic coding sequence

SEQ ID NO: 161579 - DNA, 2016 bp, Artificial Sequence
  Description of Artificial Sequence: Synthetic coding sequence
atggtggtgtctgctggccccctgagcagcgagaaggccgagatgaacatcctggagatcaatgagaagctgcacccccagctggccgagaagaagcagcagttcaggaacctgaaggagcgctgctttgtgacccagctggccggcttcctggccaaccagcagaagaagtacaagtatgaggagtgcaaggacctgatcaagtccatgctgagaaatgaaaggcagttcaaggaggagaagctggccgagcagctgaagcaggccgaggagctgcggcagtacaaggtgctggtgcacgcccaggagcgggagctgacccagctgcgggagaagctgcgggagggcagagatgccagccgcagcctgaatgagcacctgcaggccctgctgaccccagatgagccagacaagagccagggccaggacctgcaggagcagctggccgagggctgccgcctggcccagcacctggtgcagaagctgagcccagaaaatgacaatgatgatgatgaagatgtgcaggtggagctggccgagaaggtgcagaagagcagcgccccccgggagatgcagaaggccgaggagaaggaggtgcctgaggacagccaggaggagtgtgccatcacctacagcaacagccacggcccctatgacagcaaccagccccacaggaagaccaagatcacctttgaggaggacaaggtggacagcaccctgattggcagcagcagccacgtggagtgggaggatgctgtgcacatcatcccagaaaatgaaagtgatgatgaggaggaggaggagaagggccctgtgagccccaggaacctgcaggagagcgaggaggaggaggtgccccaggagagctgggatgagggctacagcaccctgagcatccccccagagatgctggccagctaccagagctacagcagcaccttccacagcctggaggagcagcaggtgtgcatggctgtggacatcggccgccaccgctgggaccaggtgaagaaggaggaccaggaggccaccggcccccggctgagccgggagctgctggatgagaagggccctgaggtgctgcaggacagcctggaccgctgctacagcaccccatctggctgcctggagctgacagacagctgccagccctacagaagtgccttctacgtgctggagcagcagagggtgggcctggccgtggacatggatgaaattgagaagtaccaggaggtggaggaggaccaggaccccagctgcccccggctgagccgggagctgctggatgagaaggagcctgaggtgctgcaggacagcctggaccgctgctacagcacccccagcggctacctggagctgcctgacctgggccagccctacagcagcgctgtgtacagcctggaggagcagtacctgggcctggccctggatgtggacaggaccaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagagaagaggccgccgcagcaagaagaagagaagaagaggaaggaaggagggggaggaggaccagaaccccccctgcccccggctgaatggagtgctgatggaggtggaggagcctgaggtgctgcaggacagcctggatggctgctacagcacccccagcatgtactttgagctgcctgacagcttccagcactacagatctgtgttctacagctttgaggagcagcacatcagctttgccctgtatgtggacaaccgcttcttcaccctgactgtgaccagcctgcacctggtgttccagatgggcgtcatcttcccccagtag

SEQ ID NO: 161580 - DNA, 474 bp, Artificial Sequence
  Description of Artificial Sequence: Synthetic coding sequence
ctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagaggcggggcagaagaagcaagaaggagcggcggcggggcaggaaggagggggaggaggaccagaaccccccctgcccccggctgagccgggagctgctggatgagaagggccctgaggtgctgcaggacagcctggaccgctgctacagcacccccagcggctgcctggagctgacagacagctgccagccctaccgcagcgccttctacgtgctggagcagcagagggtgggcctggccgtggacatggatggagagtacctgtccatgtag

SEQ ID NO: 161581 - DNA, 681 bp, Artificial Sequence
  Description of Artificial Sequence: Synthetic coding sequence
ctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagaggcggggcagaagaagcaagaaggagcggcggcggggcaggaaggagggggaggaggaccagaaccccccctgcccccggctgagccgggagctgctggatgagaagggccctgaggtgctgcaggacagcctggaccgctgctacagcacccccagcggctgcctggagctgacagacagctgccagccctaccgcagcgccttctacgtgctggagcagcagagggtgggcctggccgtggacatggatgaaattgagaagtaccaggaggtggaggaggaccaggaccccagctgcccccggctgagccgggagctgctggatgagaaggagcctgaggtgctgcaggacagcctggaccgctgctacagcaccccatctggctacctggagctgcctgacctgggccagccctacagcagcgctgtgtacagcctggaggagcagtacctgggcctggccctggatgtggactag

SEQ ID NO: 161582 - DNA, 810 bp, Artificial Sequence
  Description of Artificial Sequence: Synthetic coding sequence
atggatgaaattgagaagtaccaggaggtggaggaggaccaggaccccagctgcccccggctgagccgggagctgctggatgagaaggagcctgaggtgctgcaggacagcctggaccgctgctacagcacccccagcggctacctggagctgcctgacctgggccagccctacagcagcgctgtgtacagcctggaggagcagtacctgggcctggccctggatgtggacaggaccaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagagaagaggccgccgcagcaagaagaagagaagaagaggaaggaaggagggggaggaggaccagaaccccccctgcccccggctgaatggagtgctgatggaggtggaggagcctgaggtgctgcaggacagcctggatggctgctacagcacccccagcatgtactttgagctgcctgacagcttccagcactacagatctgtgttctacagctttgaggagcagcacatcagctttgccctgtatgtggacaaccgcttcttcaccctgactgtgaccagcctgcacctggtgttccagatgggcgtcatcttcccccagtag

SEQ ID NO: 161583 - DNA, 474 bp, Artificial Sequence; identical to SEQ ID NO: 161580
  Description of Artificial Sequence: Synthetic coding sequence

SEQ ID NO: 161584 - DNA, 525 bp, Artificial Sequence
  Description of Artificial Sequence: Synthetic coding sequence
ctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagaggcggggcagaagaagcaagaagaagagaagaagaggaaggaaggagggggaggaggaccagaaccccccctgcccccggctgaatggagtgctgatggaggtggaggagcctgaggtgctgcaggacagcctggatggctgctacagcacccccagcatgtactttgagctgcctgacagcttccagcactaccgcagcgtcttctacagctttgaggagcagcacatcagctttgccctgtatgtggacaaccgcttcttcaccctgactgtgaccagcctgcacctggtgttccagatgggcgtcatcttcccccagtag

SEQ ID NO: 161585 - DNA, 456 bp, Artificial Sequence; identical to SEQ ID NO: 161577
  Description of Artificial Sequence: Synthetic coding sequence

SEQ ID NO: 161586 - DNA, 759 bp, Artificial Sequence
  Description of Artificial Sequence: Synthetic coding sequence
atggatgaaattgagaagtaccaggaggtggaggaggaccaggaccccagctgcccccggctgagccgggagctgctggatgagaaggagcctgaggtgctgcaggacagcctggaccgctgctacagcacccccagcggctacctggagctgcctgacctgggccagccctacagcagcgctgtgtacagcctggaggagcagtacctgggcctggccctggatgtggacaggaccaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagagaagaggccgccgcagcaagaaggagaggagaagaggaaggaaggagggggaggaggaccagaaccccccctgcccccggctgagccgggagctgctggatgagaagggccctgaggtgctgcaggacagcctggaccgctgctacagcaccccatctggctgcctggagctgacagacagctgccagccctacagaagtgccttctacgtgctggagcagcagagggtgggcctggccgtggacatggatggagagtacctgtccatgtag

SEQ ID NO: 161587 - DNA, 1734 bp, Artificial Sequence
  Description of Artificial Sequence: Synthetic coding sequence
atggtggtgtctgctggcccctggagcggggagaaggccgagatgaacatcctggagatcaacaagaagagccggccccagctggccgagaacaagcagcagttcaggaacctgaagcagaagtgcctggtgacccaggtggcctacttcctggccaaccggcagaacaactatgactatgaggactgcaaggacctgatcaagtccatgctgagagatgagcggctgctgacagaggagaagctggccgaggagctgggccaggccgaggagctgcggcagtacaaggtgctggtgcacagccaggagcgggagctgacccagctgcgggagaagctgcaggagggcagagatgccagccgcagcctgaaccagcacctgcaggccctgctgaccccagatgagccagacaacagccagggccgggacctgcgggagcagctggccgagggctgccgcctggcccagcacctggtgcagaagctgagcccagaaaatgatgatgatgaagatgaagatgtgaaggtggaggaggccgagaaggtgcaggagctgtatgccccccgggaggtgcagaaggccgaggagaaggaggtgcctgaggacagcctggaggagtgtgccatcacctgcagcaacagccaccacccctgtgagagcaaccagccctacggcaacacccgcatcacctttgaggaggaccaggtggacagcaccctgattgacagcagcagccatgatgagtggctggatgctgtgtgcatcatcccagaaaatgaaagtgaccacgagcaggaggaggagaagggccctgtgagccccaggaacctgcaggagagcgaggaggaggaggccccccaggagagctgggatgaaggagactggaccctgagcatccccccagacatgtctgccagctaccagagcgacaggagcaccttccacagcgtggaggagcagcaggtgggcctggccctggacatcggccgccactggtgtgaccaggtgaagaaggaggaccaggaggccaccagcccccggctgagccgggagctgctggatgagaaggagcctgaggtgctgcaggacagcctggaccgcttctacagcaccccatttgagtacctggagctgcctgacctgtgccagccctacagaagtgacttctacagcctgcaggagcagcacctgggcctggccctggacctggacaggatgaagaaggaccaggaggaggaggaggaccagggccccccctgcccccggctgagccgggagctgcctgaggtggtggagcctgaggacctgcaggacagcctggaccgctggtacagcacccccttctcctacccagagctgcctgacagctgccagccctacggcagctgcttctacagcctggaggaggagcacgtgggcttcagcctggatgtggatgaaattgagaagtaccaggagggggaggaggaccagaagccaccctgcccccggctgaatgaggtgctgatggaggccgaggagcctgaggtgctgcaggacagcctggaccgctgctacagcaccaccagcacctacttccagctgcacgccagcttccagcagtacagaagtgccttctacagctttgaggagcaggatgtgtccctggccctggatgtggacaaccgcttcttcaccctgaccgtcatccgccaccacctggccttccagatgggcgtcatcttcccccactag

SEQ ID NO: 161588 - DNA, 1902 bp, Artificial Sequence
  Description of Artificial Sequence: Synthetic coding sequence
atgcccctgacccccaccgtgcagggcttccagtggaccctgcggggcccagatgtggagaccagcccctttggagcccccagggctgccagccacggcgtgggccgccaccaggagctgcgggaccccaccgtgcccggccccaccagcagcgccaccaacgtgtccatggtggtgtctgctggcccctggagcggggagaaggccgagatgaacatcctggagatcaacaagaagagccggccccagctggccgagaacaagcagcagttcaggaacctgaagcagaagtgcctggtgacccaggtggcctacttcctggccaaccggcagaacaactatgactatgaggactgcaaggacctgatcaagtccatgctgagagatgagcggctgctgacagaggagaagctggccgaggagctgggccaggccgaggagctgcggcagtacaaggtgctggtgcacagccaggagcgggagctgacccagctgcgggagaagctgcaggagggcagagatgccagccgcagcctgaaccagcacctgcaggccctgctgaccccagatgagccagacaacagccagggccgggacctgcgggagcagctggccgagggctgccgcctggcccagcacctggtgcagaagctgagcccagaaaatgatgatgatgaagatgaagatgtgaaggtggaggaggccgagaaggtgcaggagctgtatgccccccgggaggtgcagaaggccgaggagaaggaggtgcctgaggacagcctggaggagtgtgccatcacctgcagcaacagccaccacccctgtgagagcaaccagccctacggcaacacccgcatcacctttgaggaggaccaggtggacagcaccctgattgacagcagcagccatgatgagtggctggatgctgtgtgcatcatcccagaaaatgaaagtgaccacgagcaggaggaggagaagggccctgtgagccccaggaacctgcaggagagcgaggaggaggaggccccccaggagagctgggatgaaggagactggaccctgagcatccccccagacatgtctgccagctaccagagcgacaggagcaccttccacagcgtggaggagcagcaggtgggcctggccctggacatcggccgccactggtgtgaccaggtgaagaaggaggaccaggaggccaccagcccccggctgagccgggagctgctggatgagaaggagcctgaggtgctgcaggacagcctggaccgcttctacagcaccccatttgagtacctggagctgcctgacctgtgccagccctacagaagtgacttctacagcctgcaggagcagcacctgggcctggccctggacctggacaggatgaagaaggaccaggaggaggaggaggaccagggccccccctgcccccggctgagccgggagctgcctgaggtggtggagcctgaggacctgcaggacagcctggaccgctggtacagcacccccttctcctacccagagctgcctgacagctgccagccctacggcagctgcttctacagcctggaggaggagcacgtgggcttcagcctggatgtggatgaaattgagaagtaccaggagggggaggaggaccagaagccaccctgcccccggctgaatgaggtgctgatggaggccgaggagcctgaggtgctgcaggacagcctggaccgctgctacagcaccaccagcacctacttccagctgcacgccagcttccagcagtacagaagtgccttctacagctttgaggagcaggatgtgtccctggccctggatgtggacaaccgcttcttcaccctgaccgtcatccgccaccacctggccttccagatgggcgtcatcttcccccactag

SEQ ID NO: 161589 - DNA, 1866 bp, Artificial Sequence
  Description of Artificial Sequence: Synthetic coding sequence
atgcccctgacccccaccgtgcagggcttccagtggaccctgcggggcccagatgtggagaccagcccctttggagcccccagggctgccagccacggcgtgggccgccaccaggagctgcgggaccccaccgtgcccggccccaccagcagcgccaccaacgtgtccatggtggtgtctgctggcccctggagcggggagaaggccgagatgaacatcctggagatcaacaagaagagccggccccagctggccgagaacaagcagcagttcaggaacctgaagcagaagtgcctggtgacccaggtggcctacttcctggccaaccggcagaacaactatgactatgaggactgcaaggacctgatcaagtccatgctgagagatgagcggctgctgacagaggagaagctggccgaggagctgggccaggccgaggagctgcggcagtacaaggtgctggtgcacagccaggagcgggagctgacccagctgcgggagaagctgcaggagggcagagatgccagccgcagcctgaaccagcacctgcaggccctgctgaccccagatgagccagacaacagccagggccgggacctgcgggagcagctggccgagggctgccgcctggcccagcacctggtgcagaagctgagcccagaaaatgatgatgatgaagatgaagatgtgaaggtggaggaggccgagaaggtgcaggagctgtatgccccccgggaggtgcagaaggccgaggagaaggaggtgcctgaggacagcctggaggagtgtgccatcacctgcagcaacagccaccacccctgtgagagcaaccagccctacggcaacacccgcatcacctttgaggaggaccaggtggacagcaccctgattgacagcagcagccatgatgagtggctggatgctgtgtgcatcatcccagaaaatgaaagtgaccacgagcaggaggaggagaagggccctgtgagccccaggagcagcggccgcttctgctgcctgatctctgtgggctacatcttctgccacccctgcccagcctggctgatccggaacctgcaggagagcgaggaggaggaggccccccaggagagctgggatgagggccactggtgtgaccaggtgaagaaggaggaccaggaggccaccagcccccggctgagccgggagctgctggatgagaaggagcctgaggtgctgcaggacagcctggaccgcttctacagcaccccatttgagtacctggagctgcctgacctgtgccagccctacagaagtgacttctacagcctgcaggagcagcacctgggcctggccctggacctggacaggatgaagaaggaccaggaggaggaggaggaccagggccccccctgcccccggctgagccgggagctgcctgaggtggtggagcctgaggacctgcaggacagcctggaccgctggtacagcacccccttctcctacccagagctgcctgacagctgccagccctacggcagctgcttctacagcctggaggaggagcacgtgggcttcagcctggatgtggatgaaattgagaagtaccaggagggggaggaggaccagaagccaccctgcccccggctgaatgaggtgctgatggaggccgaggagcctgaggtgctgcaggacagcctggaccgctgctacagcaccaccagcacctacttccagctgcacgccagcttccagcagtacagaagtgccttctacagctttgaggagcaggatgtgtccctggccctggatgtggacaaccgcttcttcaccctgaccgtcatccgccaccacctggccttccagatgggcgtcatcttcccccactag

SEQ ID NO: 161590 - DNA, 1062 bp, Artificial Sequence
  Description of Artificial Sequence: Synthetic coding sequence
atggtggtgtctgctggcccctggagcggggagaaggccgagatgaacatcctggagatcaacaagaagagccggccccagctggccgagaacaagcagcagttcaggaacctgaagcagaagtgcctggtgacccaggtggcctacttcctggccaaccggcagaacaactatgactatgaggactgcaaggacctgatcaagtccatgctgagagatgagcggctgctgacagaggagaagctggccgaggagctgggccaggccgaggagctgcggcagtacaaggtgctggtgcacagccaggagcgggagctgacccagctgcgggagaagctgcaggagggcagagatgccagccgcagcctgaaccagcacctgcaggccctgctgaccccagatgagccagacaacagccagggccgggacctgcgggagcagctggccgagggctgccgcctggcccagcacctggtgcagaagctgagcccagaaaatgatgatgatgaagatgaagatgtgaaggtggaggaggccgagaaggtgcaggagctgtatgccccccgggaggtgcagaaggccgaggagaaggaggtgcctgaggacagcctggaggagtgtgccatcacctgcagcaacagccaccacccctgtgagagcaaccagccctacggcaacacccgcatcacctttgaggaggaccaggtggacagcaccctgattgacagcagcagccatgatgagtggctggatgctgtgtgcatcatcccagaaaatgaaagtgaccacgagcaggaggaggagaagggccctgtgagccccaggaacctgcaggagagcgaggaggaggaggccccccaggagagctgggatgaaggagactggaccctgagcatccccccagacatgtctgccagctaccagagcgacaggagcaccttccacagcgtggaggagcagcaggtgggcctggccctggacatcggccgccactggtgtgaccaggagaagggcggcccccggggccacaagagccaggcccagcagggcgccgccggctag

SEQ ID NO: 161591 - DNA, 1668 bp, Artificial Sequence
  Description of Artificial Sequence: Synthetic coding sequence
atggtggtgtctgctggcccctggagcggggagaaggccgagatgaacatcctggagatcaacaagaagagccggccccagctggccgagaacaagcagcagttcaggaacctgaagcagaagtgcctggtgacccaggtggcctacttcctggccaaccggcagaacaactatgactatgaggactgcaaggacctgatcaagtccatgctgagagatgagcggctgctgacagaggagaagctggccgaggagctgggccaggccgaggagctgcggcagtacaaggtgctggtgcacagccaggagcgggagctgacccagctgcgggagaagctgcaggagggcagagatgccagccgcagcctgaaccagcacctgcaggccctgctgaccccagatgagccagacaacagccagggccgggacctgcgggagcagctggccgagggctgccgcctggcccagcacctggtgcagaagctgagcccagaaaatgatgatgatgaagatgaagatgtgaaggtggaggaggccgagaaggtgcaggagctgtatgccccccgggaggtgcagaaggccgaggagaaggaggtgcctgaggacagcctggaggagtgtgccatcacctgcagcaacagccaccacccctgtgagagcaaccagccctacggcaacacccgcatcacctttgaggaggaccaggtggacagcaccctgattgacagcagcagccatgatgagtggctggatgctgtgtgcatcatcccagaaaatgaaagtgaccacgagcaggaggaggagaagggccctgtgagccccaggaacctgcaggagagcgaggaggaggaggccccccaggagagctgggatgaaggagactggaccctgagcatccccccagacatgtctgccagctaccagagcgacaggagcaccttccacagcgtggaggagcagcaggtgggcctggccctggacatcggccgccactggtgtgaccaggtgaagaaggaggaccaggaggccaccagcccccggctgagccgggagctgctggatgagaaggagcctgaggtgctgcaggacagcctggaccgcttctacagcaccccatttgagtacctggagctgcctgacctgtgccagccctacagaagtgacttctacagcctgcaggagcagcacctgggcctggccctggacctggacaggatgaagaaggaccaggaggaggaggaggaccagggccccccctgcccccggctgagccgggagctgcctgaggtggtggagcctgaggacctgcaggacagcctggaccgctggtacagcacccccttctcctacccagagctgcctgacagctgccagccctacggcagctgcttctacagcctggaggaggagcacgtgggcttcagcctggatgtggatgaaattgagaagtaccaggagggggaggaggaccagaagccaccctgcccccggctgaatgaggtgctgatggaggccgaggagcctgaggtgctgcaggacagcctggaccgctgctacagcaccaccagcacctacttccagctgcacgccagcttccagcagtacagaagtgccttctacagctttgaggagcaggatgtgtccctggccctggatgtggacaactag

SEQ ID NO: 161592 - DNA, 1692 bp, Artificial Sequence
  Description of Artificial Sequence: Synthetic coding sequence
atgcccctgacccccaccgtgcagggcttccagtggaccctgcggggcccagatgtggagaccagcccctttggagcccccagggctgccagccacggcgtgggccgccaccaggagctgcgggaccccacagattatgaggactgcaaggacctgatcaagtccatgctgagagatgagcggctgctgacagaggagaagctggccgaggagctgggccaggccgaggagctgcggcagtacaaggtgctggtgcacagccaggagcgggagctgacccagctgcgggagaagctgcaggagggcagagatgccagccgcagcctgaaccagcacctgcaggccctgctgaccccagatgagccagacaacagccagggccgggacctgcgggagcagctggccgagggctgccgcctggcccagcacctggtgcagaagctgagcccagaaaatgatgatgatgaagatgaagatgtgaaggtggaggaggccgagaaggtgcaggagctgtatgccccccgggaggtgcagaaggccgaggagaaggaggtgcctgaggacagcctggaggagtgtgccatcacctgcagcaacagccaccacccctgtgagagcaaccagccctacggcaacacccgcatcacctttgaggaggaccaggtggacagcaccctgattgacagcagcagccatgatgagtggctggatgctgtgtgcatcatcccagaaaatgaaagtgaccacgagcaggaggaggagaagggccctgtgagccccaggaacctgcaggagagcgaggaggaggaggccccccaggagagctgggatgaaggagactggaccctgagcatccccccagacatgtctgccagctaccagagcgacaggagcaccttccacagcgtggaggagcagcaggtgggcctggccctggacatcggccgccactggtgtgaccaggtgaagaaggaggaccaggaggccaccagcccccggctgagccgggagctgctggatgagaaggagcctgaggtgctgcaggacagcctggaccgcttctacagcaccccatttgagtacctggagctgcctgacctgtgccagccctacagaagtgacttctacagcctgcaggagcagcacctgggcctggccctggacctggacaggatgaagaaggaccaggaggaggaggaggaccagggccccccctgcccccggctgagccgggagctgcctgaggtggtggagcctgaggacctgcaggacagcctggaccgctggtacagcacccccttctcctacccagagctgcctgacagctgccagccctacggcagctgcttctacagcctggaggaggagcacgtgggcttcagcctggatgtggatgaaattgagaagtaccaggagggggaggaggaccagaagccaccctgcccccggctgaatgaggtgctgatggaggccgaggagcctgaggtgctgcaggacagcctggaccgctgctacagcaccaccagcacctacttccagctgcacgccagcttccagcagtacagaagtgccttctacagctttgaggagcaggatgtgtccctggccctggatgtggacaaccgcttcttcaccctgaccgtcatccgccaccacctggccttccagatgggcgtcatcttcccccactag

SEQ ID NO: 161593 - DNA, 1917 bp, Artificial Sequence
  Description of Artificial Sequence: Synthetic coding sequence
atggtggtgtctgctgaccccctgagcagcgagagagctgagatgaacatcctggagatcaaccaggagctgcggagccagctggccgagagcaaccagcagttccgggacctgaaggagaagttcctgatcacccaggccacagcctacagcctggccaaccagctgaagaagtacaagtgtgaggagtacaaggacatcatcgacagcgtgctgagagatgagctgcagagcatggagaagctggccgagaagctgcggcaggccgaggagctgcggcagtacaaggccctggtgcacagccaggccaaggagctgacccagctgcgggagaagctgcgggagggcagagatgccagccgctggctgaacaagcacctgaagaccctgctgaccccagatgatcctgacaagagccagggccaggacctgcgggagcagctggccgagggccaccggctggccgagcacctggtgcacaagctgagcccagaaaatgatgaagatgaagatgaagatgaagatgacaaggatgaggaggtggagaaggtgcaggagagccctgccccccgggaggtgcagaagacagaggagaaggaggtgccccaggacagcctggaggagtgtgctgtgacctgcagcaacagccacaaccccagcaacagcaaccagccccacaggagcaccaagatcaccttcaaggagcacgaggtggacagcgccctggtggtggagagcgagcacccccatgatgaggaggaggaggccctgaacatccccccagagaaccagaatgaccacgaggaggaggagggcaaggcccctgtgcccccaagacaccacgacaagagcaacagctaccgccaccgggaggtgtccttcctggccctggatgagcagaaggtgtgcagcgcccaggatgtggcccgggactacagcaaccccaagtgggatgagaccagcctgggcttcctggagaagcagagcgacctggaggaggtgaagggccaggagaccgtggccccccggctgagccggggccccctgcgggtggacaagcatgagatcccccaggagagcctggatggctgctgcctgacccccagcatcctgcctgacctgacccccagctaccacccctactggagcaccctgtacagctttgaggacaagcaggtgtccctggccctggtggacaagatcaagaaggaccaggaggagattgaggaccagagccccccctgcccccggctgagccaggagctgcctgaggtgaaggagcaggaggtgcctgaggacagcgtgaatgaggtgtacctgaccccatctgtgcaccatgatgtgtctgactgccaccagccctacagcagcaccctgagcagcctggaggaccagctggcctgcagcgccctggatgtggccagccccacagaagctgcctgcccccagggcacctggagcggggacctgagccaccaccagagcgaggtgcaggtgtcccaggcccagctggagcccagcaccctggtgcccagctgcctgcggctgcagctggaccagggcttccactgtggaaatggcctggcccagaggggcctgagcagcaccacctgcagcttcagcgccaatgctgacagcggcaaccagtggcccttccaggagctggtgctggagcccagcctgggcatgaagaaccccccccagctggaggatgatgccctggagggcagcgccagcaacacccagggccggcaggtgacaggccgcatccgggccagcctggtgctgatcctgaagaccatcagaagaaggctgcccttcagcaagtggaggctggccttccgctttgctggcccccatgctgagagcgctgagatccccaacacagctggccgcacccagaggatggccggctag

SEQ ID NO: 161594 - DNA, 1917 bp, Artificial Sequence; identical to SEQ ID NO: 161593
  Description of Artificial Sequence: Synthetic coding sequence

SEQ ID NO: 161595 - DNA, 1722 bp, Artificial Sequence
  Description of Artificial Sequence: Synthetic coding sequence
atggtggtgtctgctgaccccctgagcagcgagagagctgagatgaacatcctggagatcaaccaggagctgcggagccagctggccgagagcaaccagcagttccgggacctgaaggagaagttcctgatcacccaggccacagcctacagcctggccaaccagctgaagaagtacaagtgtgaggagtacaaggacatcatcgacagcgtgctgagagatgagctgcagagcatggagaagctggccgagaagctgcggcaggccgaggagctgcggcagtacaaggccctggtgcacagccaggccaaggagctgacccagctgcgggagaagctgcgggagggcagagatgccagccgctggctgaacaagcacctgaagaccctgctgaccccagatgatcctgacaagagccagggccaggacctgcgggagcagctggccgagggccaccggctggccgagcacctggtgcacaagctgagcccagaaaatgatgaagatgaagatgaagatgaagatgacaaggatgaggaggtggagaaggtgcaggagagccctgccccccgggaggtgcagaagacagaggagaaggaggtgccccaggacagcctggaggagtgtgctgtgacctgcagcaacagccacaaccccagcaacagcaaccagccccacaggagcaccaagatcaccttcaaggagcacgaggtggacagcgccctggtggtggagagcgagcacccccatgatgaggaggaggaggccctgaacatccccccagagaaccagaatgaccacgaggaggaggagggcaaggcccctgtgcccccaagaaaccggcagagcctggagcccggggagctgaccaacctgcgggacttcctgatcagccctgtggtgagccacgtggccaaccctggccaccacgacaagagcaacagctaccgccaccgggaggtgtccttcctggccctggatgagcagaaggtgtgcagcgcccaggatgtggcccgggactacagcaaccccaagtgggatgagaccagcctgggcttcctggagaagcagagcgacctggaggaggtgaagggccaggagaccgtggccccccggctgagccggggccccctgcgggtggacaagcatgagatcccccaggagagcctggatggctgctgcctgacccccagcatcctgcctgacctgacccccagctaccacccctactggagcaccctgtacagctttgaggacaagcaggtgtccctggccctggtggacaagatcaagaaggaccaggaggagattgaggaccagagccccccctgcccccggctgagccaggagctgcctgaggtgaaggagcaggaggtgcctgaagattctgtgaatgaggtgtacctgacccccagcgtgcaccatgatgtgtctgactgccaccagccctacagcagcaccctgagcagcctggaggaccagctggcctgcagcgccctggatgtggccagccccacagaggccgcctgcccccagggcacctggagcggggacctgagccaccaccagagcgaggtgcaggtgtcccaggcccagctggagcccagcaccctggtgcccagctgcctgcggctgcagctggaccagggcttccactgtggaaatggcctggcccagaggggcctgagcagcaccacctgcagcttcagcgccaatgcctag

SEQ ID NO: 161596 - DNA, 372 bp, Artificial Sequence
  Description of Artificial Sequence: Synthetic coding sequence
atggtggtgtctgctgaccccctgagcagcgagagagctgagatgaacatcctggagatcaaccaggagctgcggagccagctggccgagagcaaccagcagttccgggacctgaaggagaagttcctgatcacccaggccacagcctacagcctggccaaccagctgaagaagtacagctgcctgaagtacagaaaccacctgcccccagagcgctgccggcggctgaagaagaggaagagcctgcggacccactggagaaatgtgctgagcctggtgcagatcgtgaccaccctgctgacccccaccagcctgaccggggcccccaagagccacctgaggaacaccaagagcaccctgctgtggctgtag

SEQ ID NO: 161597 - DNA, 2004 bp, Artificial Sequence
  Description of Artificial Sequence: Synthetic coding sequence
atggtggtgtctgctgaccccctgagcagcgagagagctgagatgaacatcctggagatcaaccaggagctgcggagccagctggccgagagcaaccagcagttccgggacctgaaggagaagttcctgatcacccaggccacagcctacagcctggccaaccagctgaagaagtacaagtgtgaggagtacaaggacatcatcgacagcgtgctgagagatgagctgcagagcatggagaagctggccgagaagctgcggcaggccgaggagctgcggcagtacaaggccctggtgcacagccaggccaaggagctgacccagctgcgggagaagctgcgggagggcagagatgccagccgctggctgaacaagcacctgaagaccctgctgaccccagatgatcctgacaagagccagggccaggacctgcgggagcagctggccgagggccaccggctggccgagcacctggtgcacaagctgagcccagaaaatgatgaagatgaagatgaagatgaagatgacaaggatgaggaggtggagaaggtgcaggagagccctgccccccgggaggtgcagaagacagaggagaaggaggtgccccaggacagcctggaggagtgtgctgtgacctgcagcaacagccacaaccccagcaacagcaaccagccccacaggagcaccaagatcaccttcaaggagcacgaggtggacagcgccctggtggtggagagcgagcacccccatgatgaggaggaggaggccctgaacatccccccagagaaccagaatgaccacgaggaggaggagggcaaggcccctgtgcccccaagaaaccggcagagcctggagcccggggagctgaccaacctgcgggacttcctgatcagccctgtggtgagccacgtggccaaccctggccaccacgacaagagcaacagctaccgccaccgggaggtgtccttcctggccctggatgagcagaaggtgtgcagcgcccaggatgtggcccgggactacagcaaccccaagtgggatgagaccagcctgggcttcctggagaagcagagcgacctggaggaggtgaagggccaggagaccgtggccccccggctgagccggggccccctgcgggtggacaagcatgagatcccccaggagagcctggatggctgctgcctgacccccagcatcctgcctgacctgacccccagctaccacccctactggagcaccctgtacagctttgaggacaagcaggtgtccctggccctggtggacaagatcaagaaggaccaggaggagattgaggaccagagccccccctgcccccggctgagccaggagctgcctgaggtgaaggagcaggaggtgcctgaagattctgtgaatgaggtgtacctgacccccagcgtgcaccatgatgtgtctgactgccaccagccctacagcagcaccctgagcagcctggaggaccagctggcctgcagcgccctggatgtggccagccccacagaggccgcctgcccccagggcacctggagcggggacctgagccaccacaggtctgaggtgcagatcagccaggcccagctggagcccagcaccctggtgcccagctgcctgcggctgcagctggaccagggcttccactgtggaaatggcctggcccagaggggcctgagcagcaccacctgcagcttcagcgccaatgctgacagcggcaaccagtggcccttccaggagctggtgctggagcccagcctgggcatgaagaaccccccccagctggaggatgatgccctggagggcagcgccagcaacacccagggccggcaggtgacaggccgcatccgggccagcctggtgctgatcctgaagaccatcagaagaaggctgcccttcagcaagtggaggctggccttccgctttgctggcccccacgccgagagcgctgagatccccaacacagctgagaggatgcagaggatgattggatag

SEQ ID NO: 161598 - DNA, 1722 bp, Artificial Sequence
  Description of Artificial Sequence: Synthetic coding sequence
atggtggtgtctgctgaccccctgagcagcgagagagctgagatgaacatcctggagatcaaccaggagctgcggagccagctggccgagagcaaccagcagttccgggacctgaaggagaagttcctgatcacccaggccacagcctacagcctggccaaccagctgaagaagtacaagtgtgaggagtacaaggacatcatcgacagcgtgctgagagatgagctgcagagcatggagaagctggccgagaagctgcggcaggccgaggagctgcggcagtacaaggccctggtgcacagccaggccaaggagctgacccagctgcgggagaagctgcgggagggcagagatgccagccgctggctgaacaagcacctgaagaccctgctgaccccagatgatcctgacaagagccagggccaggacctgcgggagcagctggccgagggccaccggctggccgagcacctggtgcacaagctgagcccagaaaatgatgaagatgaagatgaagatgaagatgacaaggatgaggaggtggagaaggtgcaggagagccctgccccccgggaggtgcagaagacagaggagaaggaggtgccccaggacagcctggaggagtgtgctgtgacctgcagcaacagccacaaccccagcaacagcaaccagccccacaggagcaccaagatcaccttcaaggagcacgaggtggacagcgccctggtggtggagagcgagcacccccatgatgaggaggaggaggccctgaacatccccccagagaaccagaatgaccacgaggaggaggagggcaaggcccctgtgcccccaagaaaccggcagagcctggagcccggggagctgaccaacctgcgggacttcctgatcagccctgtggtgagccacgtggccaaccctggccaccacgacaagagcaacagctaccgccaccgggaggtgtccttcctggccctggatgagcagaaggtgtgcagcgcccaggatgtggcccgggactacagcaaccccaagtgggatgagaccagcctgggcttcctggagaagcagagcgacctggaggaggtgaagggccaggagaccgtggccccccggctgagccggggccccctgcgggtggacaagcatgagatcccccaggagagcctggatggctgctgcctgacccccagcatcctgcctgacctgacccccagctaccacccctactggagcaccctgtacagctttgaggacaagcaggtgtccctggccctggtggacaagatcaagaaggaccaggaggagattgaggaccagagccccccctgcccccggctgagccaggagctgcctgaggtgaaggagcaggaggtgcctgaagattctgtgaatgaggtgtacctgacccccagcgtgcaccatgatgtgtctgactgccaccagccctacagcagcaccctgagcagcctggaggaccagctggcctgcagcgccctggatgtggccagccccacagaggccgcctgcccccagggcacctggagcggggacctgagccaccacaggtctgaggtgcagatcagccaggcccagctggagcccagcaccctggtgcccagctgcctgcggctgcagctggaccagggcttccactgtggaaatggcctggcccagaggggcctgagcagcaccacctgcagcttcagcgccaatgcctag

SEQ ID NO: 161599 - DNA, 1917 bp, Artificial Sequence
  Description of Artificial Sequence: Synthetic coding sequence
atggtggtgtctgctgaccccctgagcagcgagagagctgagatgaacatcctggagatcaaccaggagctgcggagccagctggccgagagcaaccagcagttccgggacctgaaggagaagttcctgatcacccaggccacagcctacagcctggccaaccagctgaagaagtacaagtgtgaggagtacaaggacatcatcgacagcgtgctgagagatgagctgcagagcatggagaagctggccgagaagctgcggcaggccgaggagctgcggcagtacaaggccctggtgcacagccaggccaaggagctgacccagctgcgggagaagctgcgggagggcagagatgccagccgctggctgaacaagcacctgaagaccctgctgaccccagatgatcctgacaagagccagggccaggacctgcgggagcagctggccgagggccaccggctggccgagcacctggtgcacaagctgagcccagaaaatgatgaagatgaagatgaagatgaagatgacaaggatgaggaggtggagaaggtgcaggagagccctgccccccgggaggtgcagaagacagaggagaaggaggtgccccaggacagcctggaggagtgtgctgtgacctgcagcaacagccacaaccccagcaacagcaaccagccccacaggagcaccaagatcaccttcaaggagcacgaggtggacagcgccctggtggtggagagcgagcacccccatgatgaggaggaggaggccctgaacatccccccagagaaccagaatgaccacgaggaggaggagggcaaggcccctgtgcccccaagacaccacgacaagagcaacagctaccgccaccgggaggtgtccttcctggccctggatgagcagaaggtgtgcagcgcccaggatgtggcccgggactacagcaaccccaagtgggatgagaccagcctgggcttcctggagaagcagagcgacctggaggaggtgaagggccaggagaccgtggccccccggctgagccggggccccctgcgggtggacaagcatgagatcccccaggagagcctggatggctgctgcctgacccccagcatcctgcctgacctgacccccagctaccacccctactggagcaccctgtacagctttgaggacaagcaggtgtccctggccctggtggacaagatcaagaaggaccaggaggagattgaggaccagagccccccctgcccccggctgagccaggagctgcctgaggtgaaggagcaggaggtgcctgaggacagcgtgaatgaggtgtacctgaccccatctgtgcaccatgatgtgtctgactgccaccagccctacagcagcaccctgagcagcctggaggaccagctggcctgcagcgccctggatgtggccagccccacagaagctgcctgcccccagggcacctggagcggggacctgagccaccacaggtctgaggtgcagatcagccaggcccagctggagcccagcaccctggtgcccagctgcctgcggctgcagctggaccagggcttccactgtggaaatggcctggcccagaggggcctgagcagcaccacctgcagcttcagcgccaatgctgacagcggcaaccagtggcccttccaggagctggtgctggagcccagcctgggcatgaagaaccccccccagctggaggatgatgccctggagggcagcgccagcaacacccagggccggcaggtgacaggccgcatccgggccagcctggtgctgatcctgaagaccatcagaagaaggctgcccttcagcaagtggaggctggccttccgctttgctggcccccatgctgagagcgctgagatccccaacacagctgagaggatgcagaggatgattggatag

SEQ ID NO: 161600 - DNA, 1917 bp, Artificial Sequence; identical to SEQ ID NO: 161599
  Description of Artificial Sequence: Synthetic coding sequence

SEQ ID NO: 161601 - DNA, 624 bp, Artificial Sequence
  Description of Artificial Sequence: Synthetic coding sequence
atgctggccagctacaagagctacagcagcaccttccacagcctggaggagcagcaggtgtgcatggctgtggacatcggccgccaccgctgggaccaggtgaagaaggaggaccaggaggccaccggcccccggctgagccgggagctgctggatgagaagggccctgaggtgctgcaggacagcctgtaccgctgctacagcaccccatctggctgcctggagctgacagacagctgccagccctacagaagtgccttctacgtgctggagcagcagagggtgggcctggccgtggacatggatgaaattgagaagtaccaggaggtggaggaggaccagggccgctgggaggaggaccagaaccccccctgcccccggctgaatggagtgctgatggaggtggaggagcctgaggtgctgcaggacagcctggatggctgctacagcacccccagcatgtactttgagctgcctgacagcttccagcactacagatctgtgttctacagctttgaggagcagcacatcagctttgccctgtatgtggacaaccgcttcttcaccctgactgtgaccagcctgcacctggtgttccagatggaggtgatcttcccccagtag

SEQ ID NO: 161602 - DNA, 1830 bp, Artificial Sequence
  Description of Artificial Sequence: Synthetic coding sequence
cctgtgcccggccccaccagcagcgccaccaacgtgtccatggtggtgtctgctggccccctgagcagcgagaaggccgagatgaacatcctggagatcaatgagaagctgcggccccagctggccgagaagaagcagcagttcaggaacctgaaggagaagtgcttcctgacccagctgagcggcttcctggccaaccagcagaacaagtacaagtatgaggagtgcaaggacctgatcaagttcatgctgagaaatgaaaggcagttcaaggaggagaagctggccgagcagctgaagcaggccgaggagctgcggcagtacaaggtgctggtgcacgcccaggagcgggagctgacccagctgcgggagaagctgcgggagggcagagatgccagccgcagcctgaatgagcacctgcaggccctgctgaccccagatgagccagacaagagccagggccaggacctgcaggagcagctggccgagggctgccgcctggcccagcacctggtgcagaagctgagcccagaaaatgacaatgatgacaatgaagatgtgcaggtggaggtggccgagaaggtgcagaagagcagcgccccccgggagatgcagaaggccgaggagaaggaggtgcctgaggacagcctggaggagtgtgccatcacctacagcaacagccacggcccctatgacagcaaccagccccacaggaagaccaagatcacctttgaggaggacaaggtggacagcaccctcatcggcagcagcagccacgtggagagagaagatgctgtgcacatcatcccagaaaatgaaagtgatgatgaggaggaggaggagaagggccctgtgagccccaggaacctgcaggagagcgaggaggaggaggtgccccaggagagctgggatgagggctacagcacccccagcatccccccagagatgctggccagctacaagagctacagcagcaccttccacagcctggaggagcagcaggtgtgcatggctgtggacatcggccgccaccgctgggaccaggtgaagaaggaggaccaggaggccaccggcccccggctgagccgggagctgctggatgagaagggccctgaggtgctgcaggacagcctgtaccgctgctacagcacccccagcggctacctggagctgcctgacctgggccagccctacagcagcgctgtgtacagcctggaggagcagtacctgggcctggccctggacctggaccgcatcaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagagaagaggccgccgcagcaagaaggagaggagaagaggaaggaaggagggggaggaggaccagaaccccccctgcccccggctgaatggagtgctgatggaggtggaggagcctgaggtgctgcaggacagcctggatggctgctacagcacccccagcatgtactttgagctgcctgacagcttccagcactacagatctgtgttctacagctttgaggagcagcacatcagctttgccctgtatgtggacaaccgcttcttcaccctgactgtgaccagcctgcacctggtgttccagatggaggtgatcttcccccagtag

SEQ ID NO: 161603 - DNA, 2052 bp, Artificial Sequence
  Description of Artificial Sequence: Synthetic coding sequence
tgaccaggccccaccagcagcgccaccaacgtgtccatggtggtgtctgctggccccctgagcagcgagaaggccgagatgaacatcctggagatcaatgagaagctgcggccccagctggccgagaagaagcagcagttcaggaacctgaaggagaagtgcttcctgacccagctgagcggcttcctggccaaccagcagaacaagtacaagtatgaggagtgcaaggacctgatcaagttcatgctgagaaatgaaaggcagttcaaggaggagaagctggccgagcagctgaagcaggccgaggagctgcggcagtacaaggtgctggtgcacgcccaggagcgggagctgacccagctgcgggagaagctgcgggagggcagagatgccagccgcagcctgaatgagcacctgcaggccctgctgaccccagatgagccagacaagagccagggccaggacctgcaggagcagctggccgagggctgccgcctggcccagcacctggtgcagaagctgagcccagaaaatgacaatgatgacaatgaagatgtgcaggtggaggtggccgagaaggtgcagaagagcagcgccccccgggagatgcagaaggccgaggagaaggaggtgcctgaggacagcctggaggagtgtgccatcacctacagcaacagccacggcccctatgacagcaaccagccccacaggaagaccaagatcacctttgaggaggacaaggtggacagcaccctgattggcagcagcagccacgtggagcgggaggatgctgtgcacatcatcccagaaaatgaaagtgatgatgaggaggaggaggagaagggccctgtgagccccaggaacctgcaggagagcgaggaggaggaggtgccccaggagagctgggatgagggctacagcacccccagcatccccccagagatgctggccagctacaagagctacagcagcaccttccacagcctggaggagcagcaggtgtgcatggctgtggacatcggccgccaccgctgggaccaggtgaagaaggaggaccaggaggccaccggcccccggctgagccgggagctgctggatgagaagggccctgaggtgctgcaggacagcctgtaccgctgctacagcaccccatctggctgcctggagctgacagacagctgccagccctacagaagtgccttctacgtgctggagcagcagagggtgggcctggccgtggacatggatgaaattgagaagtaccaggaggtggaggaggaccaggaccccagctgcccccggctgagccgggagctgctggatgagaaggagcctgaggtgctgcaggacagcctgggccgctggtacagcacccccagcggctacctggagctgcctgacctgggccagccctacagcagcgctgtgtacagcctggaggagcagtacctgggcctggccctggacctggaccgcatcaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagagaagaggccgccgcagcaagaaggagaggagaagaggaaggaaggagggggaggaggaccagaaccccccctgcccccggctgaatggagtgctgatggaggtggaggagcctgaggtgctgcaggacagcctggatggctgctacagcacccccagcatgtactttgagctgcctgacagcttccagcactacagatctgtgttctacagctttgaggagcagcacatcagctttgccctgtatgtggacaaccgcttcttcaccctgactgtgaccagcctgcacctggtgttccagatggaggtgatcttcccccagtag

SEQ ID NO: 161604 - DNA, 1824 bp, Artificial Sequence
  Description of Artificial Sequence: Synthetic coding sequence
cctgtgcccggccccaccagcagcgccaccaacgtgtccatggtggtgtctgctggccccctgagcagcgagaaggccgagatgaacatcctggagatcaatgagaagctgcggccccagctggccgagaagaagcagcagttcaggaacctgaaggagaagtgcttcctgacccagctgagcggcttcctggccaaccagcagaacaagtacaagtatgaggagtgcaaggacctgatcaagttcatgctgagaaatgaaaggcagttcaaggaggagaagctggccgagcagctgaagcaggccgaggagctgcggcagtacaaggtgctggtgcacgcccaggagcgggagctgacccagctgcgggagaagctgcgggagggcagagatgccagccgcagcctgaatgagcacctgcaggccctgctgaccccagatgagccagacaagagccagggccaggacctgcaggagcagctggccgagggctgccgcctggcccagcacctggtgcagaagctgagcccagaaaatgacaatgatgacaatgaagatgtgcaggtggaggtggccgagaaggtgcagaagagcagcgccccccgggagatgcagaaggccgaggagaaggaggtgcctgaggacagcctggaggagtgtgccatcacctacagcaacagccacggcccctatgacagcaaccagccccacaggaagaccaagatcacctttgaggaggacaaggtggacagcaccctcatcggcagcagcagccacgtggagagagaagatgctgtgcacatcatcccagaaaatgaaagtgatgatgaggaggaggaggagaagggccctgtgagccccaggaacctgcaggagagcgaggaggaggaggtgccccaggagagctgggatgagggctacagcacccccagcatccccccagagatgctggccagctacaagagctacagcagcaccttccacagcctggaggagcagcaggtgtgcatggctgtggacatcggccgccaccgctgggaccaggtgaagaaggaggaccaggaggccaccggcccccggctgagccgggagctgctggatgagaagggccctgaggtgctgcaggacagcctgtaccgctgctacagcacccccagcggctgcctggagctgacagacagctgccagccctaccgcagcgccttctacgtgctggagcagcagagggtgggcctggccgtggacatggatgaaattgagaagtaccaggaggtggaggaggaccaggaccccagctgcccccggctgagccgggagctgctggatgagaaggagcctgaggtgctgcaggacagcctgggccgctggtacagcaccccatctggctacctggagctgcctgacctgggccagccctacagcagcgctgtgtacagcctggaggagcagtacctgggcctggccctggacctggaccgcatcaagaaggaccaggaggaggaggaggaccagggccccccctgcccccggctgagccgggagctgctggaggtggtggagcctgaggtgctgcaggacagcctggatgtgatccagctgctgcctgtggtgctgaacagcctgaccccagccagccccatggaggtgcccttcatgcactggaggaagaacatgctggccttcctgctgacctgggagaagctgaagaggcggggccggggcaggaaggagggggaggaggaccagaggaggaaggaggagggggaggagaagaagggcaagaagatcaagacccaccacgcccctggcagcacagcctgctag

SEQ ID NO: 161605 - DNA, 396 bp, Artificial Sequence
  Description of Artificial Sequence: Synthetic coding sequence
atggctgatgtggtggtgggcaaggacaagggcggggagcagaggctcatcagcctgcccctgagccgcatccgggtcatcatgaagagcagccctgaggtgagcagcatcaaccaggaggccctggtgctgacagccaaggccacagagctgtttgtgcagtgcctggccacctacagctacagacatggcagcggcaaggagaagaaggtgctgacctacagcgacctggccaacacagcccagcagagcgagaccttccagttcctggccgacatcctgcccaagaagatcctggccagcaagtacctgaagatgctgaaggaggagaagcgggaggaggatgaagaaaatgacaatgacaatgaaagtgaccatgatgaagctgacagctag

SEQ ID NO: 161606 - DNA, 582 bp, Artificial Sequence; identical to SEQ ID NO: 154255
  Description of Artificial Sequence: Synthetic coding sequence

SEQ ID NO: 161607 - DNA, 582 bp, Artificial Sequence; identical to SEQ ID NO: 154255
  Description of Artificial Sequence: Synthetic coding sequence

SEQ ID NO: 161608 - DNA, 582 bp, Artificial Sequence; identical to SEQ ID NO: 154255
  Description of Artificial Sequence: Synthetic coding sequence

SEQ ID NO: 161609 - DNA, 582 bp, Artificial Sequence; identical to SEQ ID NO: 154255
  Description of Artificial Sequence: Synthetic coding sequence

SEQ ID NO: 161610 - DNA, 3966 bp, Artificial Sequence
  Description of Artificial Sequence: Synthetic coding sequence
atgggcgccccctttgtgtgggccctgggcctgctgatgctgcagatgctgctgtttgtggccggggagcagggcacccaggacatcacagatgccagcgagcggggcctgcacatgcagaagctgggcagcggctctgtgcaggccgccctggccgagctggtggccctgccctgcctcttcaccctgcagccccggcccagcgctgccagagatgccccccgcatcaagtggaccaaggtgaggacagccagcggccagaggcaggacctgcccatcctggtggccaaggacaacgtggtgcgggtggccaagtcctggcagggccgggtgtccctgcccagctaccccaggagaagagccaatgccaccctgctgctgggccccctgcgggccagtgacagcggcctgtaccgctgccaggtggtgcggggcattgaagatgagcaggacctggtgcccctggaggtgactggagtggtgttccactaccgcagcgcccgggacagatatgccctgacctttgctgaggcccaggaggcctgccgcctgagcagcgccatcatcgccgcccccaggcacctgcaggccgcctttgaagatggctttgacaactgtgatgctggctggctgagtgacagaacagtgcgctaccccatcacccagagcaggcctggctgctacggggacaggagcagcctgcccggggtgcgctcctatggaagaagaaacccccaggagctgtatgatgtgtactgctttgcccgggagctgggcggggaggtgttctacgtgggccctgcccggcggctgaccctggccggggcccgggcccagtgccggcggcagggcgccgccctggcctctgtgggccagctgcacctggcctggcatgagggcctggaccagtgtgaccccggctggctggctgatggctctgtgcgctaccccatccagacccccaggagaagatgtggcggccctgcccctggggtgaggacagtgtacagatttgccaacagaacaggcttccccagccctgctgagagatttgatgcctactgcttccgggcccaccaccccaccagccagcacggggacctggagacccccagcagtggagatgaaggagagatcctgtctgctgagggcccccctgtgcgggagctggagcccaccctggaggaggaggaggtggtgaccccagacttccaggagcccctggtgtcctctggagaggaggagaccctcatcctggaggagaagcaggagagccagcagaccctgagccccacccctggggaccccatgctggcctcctggcccactggagaggtgtggctgagcacagtggcccccagccccagcgacatgggcgccggcacagctgccagcagccacacagaggtggcccccacagaccccatgcccaggagaagaggccgcttcaagggcctgaatggccgctacttccagcagcaggagcctgagcccggcctgcagggcggcatggaggccagcgcccagccccccaccagcgaggccgctgtgaaccagatggagccccccctggccatggctgtgacagagatgctgggcagcggccagagccgcagcccctgggccgacctgaccaatgaggtggacatgcctggagctggcagcgctgggggcaagagcagccctgagccctggctgtggccacccaccatggtgcccccatccatcagcggccacagccgggcccctgtgctggagctggagaaggccgagggccccagcgcccggcctgccaccccagacctcttctggagccccctggaggccaccgtgtctgcccccagccctgccccctgggaggccttccctgtggccaccagcccagacctgcccatgatggccatgctgcggggccccaaggagtggatgctgccccaccccacccccatcagcacagaggccaacagagtggaggcccacggggaggccacagccacagccccacccagccctgctgctgagaccaaggtgtacagcctgcccctgagcctgacccccaccggccagggcggggaggccatgcccaccaccccagagagccccagggctgacttccgggagaccggggagaccagccctgcccaggtgaacaaggccgagcacagcagcagcagcccctggcccagcgtgaacagaaatgtggccgtgggctttgtgcccacagaaacagccacagagcccaccggcctgcggggcatccctggcagcgagagcggcgtgtttgacacagctgagagccccaccagcggcctgcaggccaccgtggatgaggtgcaggacccctggcccagcgtgtacagcaagggcctggatgccagcagccccagcgcccccctgggcagccctggggtcttcctggtgcccaaggtgacccccaacctggagccctgggtggccacagatgagggccccaccgtgaaccccatggacagcacagtgaccccagcccccagtgatgccagcggcatctgggagcccggcagccaggtgtttgaggaggccgagagcaccaccctgagcccccaggtggccctggacaccagcatcgtgacccccctgaccaccctggagcagggcgacaaggtgggcgtgcctgccatgagcaccctgggcagcagcagcagccagccccaccctgagcctgaggaccaggtggagacccagggcaccagcggggcctctgtgcccccccaccagagcagccccctgggcaagccagctgtgcccccaggcacccccacagctgcctctgtgggggagagcgcctctgtgagcagcggggagcccaccgtgccctgggaccccagcagcaccctgctgcctgtgaccctgggcattgaagattttgagctggaggtgctggccggcagccctggggtggagagcttctgggaggaggtggccagcggggaggagcccgccctgcccggcacccccatgaatgctggagctgaggaggtgcacagcgacccctgtgagaacaacccctgcctgcatggaggcacctgcaatgccaacggcaccatgtatggctgcagctgtgaccagggctttgctggggagaactgtgaaattgatattgatgactgcctgtgcagcccctgtgaaaatggaggcacctgcattgatgaggtgaatggatttgtgtgcctgtgcctgcccagctatggaggcagcttctgtgagaaggacacagagggctgtgaccggggctggcacaagttccagggccactgctaccgctactttgcccaccggcgggcctgggaggatgctgagaaggactgcagaagaagaagtggccacctgacctctgtgcacagccctgaggagcacagcttcatcaacagctttggacatgagaacacctggattggcctgaatgacagaattgtggagcgggacttccagtggacagacaacacaggcctgcagtttgagaactggagggagaaccagcctgacaacttctttgctggaggagaggactgtgtggtgatggtggcccacgagagcggccgctggaatgatgtgccctgcaactacaacctgccctacgtgtgcaagaagggcaccgtgctgtgtggccccccacctgctgtggagaatgccagcctgattggagccaggaaggccaagtacaacgtgcacgccaccgtgcgctaccagtgcaatgaaggatttgcccagcaccacgtggccaccatccgctgccgcagcaatggcaagtgggaccggccccagatcgtgtgcaccaagcccaggaggagccacaggatgagaagacaccaccaccaccaccagcaccaccaccagcaccaccaccacaagagcaggaaggagaggaggaagcacaagaagcaccccacagaggactgggagaaggatgagggcaacttctgctag

SEQ ID NO: 161611 - DNA, 2319 bp, Artificial Sequence
  Description of Artificial Sequence: Synthetic coding sequence
atgcctggggccggcagcgctgggggcaagagcagccctgagccctggctgtggccacccaccatggtgccccccagcatcagcggccacagccgggcccctgtgctggagctggagaaggccgagggccccagcgcccggcctgccaccccagacctcttctggagccccctggaggccaccgtgtctgcccccagccctgccccctgggaggccttccctgtggccaccagcccagacctgcccatgatggccatgctgcggggccccaaggagtggatgctgccccaccccacccccatcagcacagaggccaacagagtggaggcccatggagaggccacagccacagccccacccagccctgctgctgagaccaaggtgtacagcctgcccctgagcctgacccccaccggccagggcggggaggccatgcccaccaccccagagagccccagggctgacttccgggagactggagagaccagccctgcccaggtgaacaaggccgagcacagcagcagcagcccctggcccagcgtgaacagaaatgtggccgtgggctttgtgcccacagaaacagccacagagcccaccggcctgcggggcatccctggcagcgagagcggcgtgtttgacacagctgagagccccaccagcggcctgcaggccaccgtggatgaggtgcaggacccctggcccagcgtgtacagcaagggcctggatgccagcagccccagcgcccccctgggcagccctggggtcttcctggtgcccaaggtgacccccaacctggagccctgggtggccacagatgagggccccaccgtgaaccccatggacagcacagtgaccccagcccccagtgatgccagcggcatctgggagcccggcagccaggtgtttgaggaggccgagagcaccaccctgagcccccaggtggccctggacaccagcatcgtgacccccctgaccaccctggagcagggcgacaaggtgggcgtgcctgccatgagcaccctgggcagcagcagcagccagccccaccctgagcctgaggaccaggtggagacccagggcaccagcggggcctctgtgcccccccaccagagcagccccctgggcaagccagctgtgcccccaggcacccccacagctgcctctgtgggggagagcgcctctgtgtcctctggagagcccaccgtgccctgggaccccagcagcaccctgctgcctgtgaccctgggcatcgaggactttgagctggaggtgctggccggcagccctggggtggagagcttctgggaggaggtggccagcggggaggagcccgccctgcccggcacccccatgaatgctggagctgaggaggtgcacagcgacccctgtgagaacaacccctgcctgcacggcggcacctgcaatgccaacggcaccatgtatggctgcagctgtgaccagggctttgctggggagaactgtgaaattgatattgatgactgcctgtgcagcccctgtgaaaatggaggcacctgcattgatgaggtgaatggatttgtgtgcctgtgcctgcccagctatggaggcagcttctgtgagaaggacacagagggctgtgaccggggctggcacaagttccagggccactgctaccgctactttgcccacagaagagcctgggaggatgctgagaaggactgcagaagaagaagtggccacctgacctctgtgcacagccctgaggagcacagcttcatcaacagctttggacatgagaacacctggattggcctgaatgaccgcatcgtggagcgggacttccagtggacagacaacacaggcctgcagtttgagaactggagggagaaccagcctgacaacttctttgctggaggagaggactgtgtggtgatggtggcccatgaaagtggccgctggaatgatgtgccctgcaactacaacctgccctacgtgtgcaagaagggcaccgtgctgtgtggccccccacctgctgtggagaatgccagcctcatcggggccaggaaggccaagtacaacgtgcacgccaccgtgcgctaccagtgcaatgaaggatttgcccagcaccacgtggccaccatccgctgccgcagcaatggcaagtgggaccggccccagatcgtgtgcaccaagccccggcgcagccacaggatgaggaggcaccaccaccaccaccagcaccaccaccagcaccaccaccacaagagcaggaaggagaggaggaagcacaagaagcaccccacagaggactgggagaaggatgagggcaacttctgctag

SEQ ID NO: 161612 - DNA, 4008 bp, Artificial Sequence
  Description of Artificial Sequence: Synthetic coding sequence
cggcccccaagagatgccagcgagctgggcgcccggagcaggatgggcgccccctttgtgtgggccctgggcctgctgatgctgcagatgctgctgtttgtggccggggagcagggcacccaggacatcacagatgccagcgagcggggcctgcacatgcagaagctgggcagcggctctgtgcaggccgccctggccgagctggtggccctgccctgcctcttcaccctgcagccccggcccagcgctgccagagatgccccccgcatcaagtggaccaaggtgaggacagccagcggccagaggcaggacctgcccatcctggtggccaaggacaacgtggtgcgggtggccaagtcctggcagggccgggtgtccctgcccagctaccccaggagaagagccaatgccaccctgctgctgggccccctgcgggccagtgacagcggcctgtaccgctgccaggtggtgcggggcattgaagatgagcaggacctggtgcccctggaggtgactggagtggtgttccactaccgcagcgcccgggacagatatgccctgacctttgctgaggcccaggaggcctgccgcctgagcagcgccatcatcgccgcccccaggcacctgcaggccgcctttgaagatggctttgacaactgtgatgctggctggctgagtgacagaacagtgcgctaccccatcacccagagcaggcctggctgctacggggacaggagcagcctgcccggggtgcgctcctatggaagaagaaacccccaggagctgtatgatgtgtactgctttgcccgggagctgggcggggaggtgttctacgtgggccctgcccggcggctgaccctggccggggcccgggcccagtgccggcggcagggcgccgccctggcctctgtgggccagctgcacctggcctggcatgagggcctggaccagtgtgaccccggctggctggctgatggctctgtgcgctaccccatccagacccccaggagaagatgtggcggccctgcccctggggtgaggacagtgtacagatttgccaacagaacaggcttccccagccctgctgagagatttgatgcctactgcttccgggcccaccaccccaccagccagcacggggacctggagacccccagcagtggagatgaaggagagatcctgtctgctgagggcccccctgtgcgggagctggagcccaccctggaggaggaggaggtggtgaccccagacttccaggagcccctggtgtcctctggagaggaggagaccctcatcctggaggagaagcaggagagccagcagaccctgagccccacccctggggaccccatgctggcctcctggcccactggagaggtgtggctgagcacagtggcccccagccccagcgacatgggcgccggcacagctgccagcagccacacagaggtggcccccacagaccccatgcccaggagaagaggccgcttcaagggcctgaatggccgctacttccagcagcaggagcctgagcccggcctgcagggcggcatggaggccagcgcccagccccccaccagcgaggccgctgtgaaccagatggagccccccctggccatggctgtgacagagatgctgggcagcggccagagccgcagcccctgggccgacctgaccaatgaggtggacatgcctggagctggcagcgctgggggcaagagcagccctgagccctggctgtggccacccaccatggtgcccccatccatcagcggccacagccgggcccctgtgctggagctggagaaggccgagggccccagcgcccggcctgccaccccagacctcttctggagccccctggaggccaccgtgtctgcccccagccctgccccctgggaggccttccctgtggccaccagcccagacctgcccatgatggccatgctgcggggccccaaggagtggatgctgccccaccccacccccatcagcacagaggccaacagagtggaggcccacggggaggccacagccacagccccacccagccctgctgctgagaccaaggtgtacagcctgcccctgagcctgacccccaccggccagggcggggaggccatgcccaccaccccagagagccccagggctgacttccgggagaccggggagaccagccctgcccaggtgaacaaggccgagcacagcagcagcagcccctggcccagcgtgaacagaaatgtggccgtgggctttgtgcccacagaaacagccacagagcccaccggcctgcggggcatccctggcagcgagagcggcgtgtttgacacagctgagagccccaccagcggcctgcaggccaccgtggatgaggtgcaggacccctggcccagcgtgtacagcaagggcctggatgccagcagccccagcgcccccctgggcagccctggggtcttcctggtgcccaaggtgacccccaacctggagccctgggtggccacagatgagggccccaccgtgaaccccatggacagcacagtgaccccagcccccagtgatgccagcggcatctgggagcccggcagccaggtgtttgaggaggccgagagcaccaccctgagcccccaggtggccctggacaccagcatcgtgacccccctgaccaccctggagcagggcgacaaggtgggcgtgcctgccatgagcaccctgggcagcagcagcagccagccccaccctgagcctgaggaccaggtggagacccagggcaccagcggggcctctgtgcccccccaccagagcagccccctgggcaagccagctgtgcccccaggcacccccacagctgcctctgtgggggagagcgcctctgtgagcagcggggagcccaccgtgccctgggaccccagcagcaccctgctgcctgtgaccctgggcattgaagattttgagctggaggtgctggccggcagccctggggtggagagcttctgggaggaggtggccagcggggaggagcccgccctgcccggcacccccatgaatgctggagctgaggaggtgcacagcgacccctgtgagaacaacccctgcctgcatggaggcacctgcaatgccaacggcaccatgtatggctgcagctgtgaccagggctttgctggggagaactgtgaaattgatattgatgactgcctgtgcagcccctgtgaaaatggaggcacctgcattgatgaggtgaatggatttgtgtgcctgtgcctgcccagctatggaggcagcttctgtgagaaggacacagagggctgtgaccggggctggcacaagttccagggccactgctaccgctactttgcccaccggcgggcctgggaggatgctgagaaggactgcagaagaagaagtggccacctgacctctgtgcacagccctgaggagcacagcttcatcaacagctttggacatgagaacacctggattggcctgaatgacagaattgtggagcgggacttccagtggacagacaacacaggcctgcagtttgagaactggagggagaaccagcctgacaacttctttgctggaggagaggactgtgtggtgatggtggcccacgagagcggccgctggaatgatgtgccctgcaactacaacctgccctacgtgtgcaagaagggcaccgtgctgtgtggccccccacctgctgtggagaatgccagcctgattggagccaggaaggccaagtacaacgtgcacgccaccgtgcgctaccagtgcaatgaaggatttgcccagcaccacgtggccaccatccgctgccgcagcaatggcaagtgggaccggccccagatcgtgtgcaccaagcccaggaggagccacaggatgagaagacaccaccaccaccaccagcaccaccaccagcaccaccaccacaagagcaggaaggagaggaggaagcacaagaagcaccccacagaggactgggagaaggatgagggcaacttctgctag

SEQ ID NO: 161613 - DNA, 2190 bp, Artificial Sequence
  Description of Artificial Sequence: Synthetic coding sequence
atgagctgctgtgacctggccgctgctggccagctgggcaaggccagcatcatggccagtgactgtgagcccgccctgaaccaggccgagggcaggaaccccaccctggagcgctacctgggcgccctgcgggaggccaagaatgacagcgagcagtttgctgccctgctgctggtgaccaaggctgtgaaggccggggacattgatgccaagacccggcggcgcatctttgatgctgtgggcttcaccttccccaaccggctgctgaccaccaaggaggccccagatggctgcccagaccacgtgctgcgggccctgggcgtggccctgctggcctgcttctgcagcgaccctgagctggccgcccacccccaggtgctgaacaagatccccatcctgagcaccttcctgacagcccggggggaccctgatgatgctgcccggcgctccatgattgatgacacctaccagtgcctgacagctgtggccggcaccccccggggccccaggcacctgattgctgggggcaccgtgtctgccctgtgccaggcctacctgggccacggctacggctttgaccaggccctggccctgctggtgggcctgctggccgctgctgagacccagtgctggaaggaggccgagccagacctgctggccgtgctgcggggcctgtctgaggacttccagaaggcagaagatgccagcaagtttgagctgtgccagctgctgcccctcttcctgccccccaccaccgtgcccccagagtgctacagagacctgcaggccggcctggcccgcatcctgggcagcaagctgagctcctggcagaggaacccagccctgaagctggccgcccggctggcccacgcctgtggcagtgactggatcccagctggcagcagcggcagcaagttcctggccctgctggtgaacctggcctgtgtggaggtgcggctggccctggaggagactggaacagaggtgaaggaggatgtggtgacagcctgctacgccctgatggagctgggcatccaggagtgcacccgctgtgagcagagcctgctgaaggagccccagaaggtgcagctggtgtctgtgatgaaggaggccatcggggccgtcatccactacctgctgcaggtgggcagcgagaagcagaaggagccctttgtgtttgcctctgtgcgcatcctgggcgcctggctggccgaggagaccagcagcctgaggaaggaggtgtgccagctgctgcccttcctggtgcgctatgccaagaccctgtatgaggaggccgaggaggccaatgacctgagccagcaggtggccaacctggccatcagccccaccaccccaggccccacctggccaggagatgccctgcggctgctgctgcccggctggtgccacctgactgtggaggatggcccccgggagatcctgatcaaggagggcgcccccagcctgctgtgcaagtacttcctgcagcagtgggagctgaccagccctggccatgacacctctgtgctgcctgattctgtggagatcggcctgcagacctgctgccacatcttcctgaacctggtggtgacagcccctggcctcatcaagagagatgcctgcttcaccagcctgatgaacaccctgatgaccagcctgcctgccctggtgcagcagcagggccgcctgctgctggccgccaacgtggccaccctgggcctgctgatggcccggctgctgagcaccagccctgccctgcagggcaccccagccagccggggcttctttgctgctgccatcctcttcctgagccagagccacgtggcccgggccaccccaggcagtgaccaggccgtgctggccctgagcccagaatatgagggcatctgggccgacctgcaggagctgtggttcctgggcatgcaggccttcaccggctgtgtgcccctgctgccctggctggccccagctgccctgcggagccgctggccccaggagctgctgcagctgctgggctctgtgagccccaacagcgtgaagccagagatggtggccgcctaccagggcgtgctggtggagctggcccgggccaaccggctgtgccgggaggccatgaggctgcaggccggggaggagacagccagccactacaggatggccgccctggagcagtgcctgtctgagccctag

SEQ ID NO: 161614 - DNA, 2190 bp, Artificial Sequence; identical to SEQ ID NO: 161613
  Description of Artificial Sequence: Synthetic coding sequence

SEQ ID NO: 161615 - DNA, 2139 bp, Artificial Sequence
  Description of Artificial Sequence: Synthetic coding sequence
atggccagtgactgtgagcccgccctgaaccaggccgagggcaggaaccccaccctggagcgctacctgggcgccctgcgggaggccaagaatgattctgagcagtttgctgccctgctgctggtgaccaaggctgtgaaggccggggacattgatgccaagacccggcggcgcatctttgatgctgtgggcttcaccttccccaaccggctgctgaccaccaaggaggccccagatggctgcccagaccacgtgctgcgggccctgggcgtggccctgctggcctgcttctgcagcgaccctgagctggccgcccacccccaggtgctgaacaagatccccatcctgagcaccttcctgacagcccggggggaccctgatgatgctgcccggcgctccatgattgatgacacctaccagtgcctgacagctgtggccggcaccccccggggccccaggcacctgattgctgggggcaccgtgtctgccctgtgccaggcctacctgggccacggctacggctttgaccaggccctggccctgctggtgggcctgctggccgctgctgagacccagtgctggaaggaggccgagccagacctgctggccgtgctgcggggcctgtctgaggacttccagaaggccgaggatgccagcaagtttgagctgtgccagctgctgcccctcttcctgccccccaccaccgtgcccccagagtgctacagagacctgcaggccggcctggcccgcatcctgggcagcaagctgagctcctggcagagaaatcctgccctgaagctggccgcccggctggcccacgcctgtggcagtgactggatcccagctggcagcagcggcagcaagttcctggccctgctggtgaacctggcctgtgtggaggtgcggctggccctggaggagaccggcacagaggtgaaggaggatgtggtgacagcctgctacgccctgatggagctgggcatccaggagtgcacccgctgtgagcagagcctgctgaaggagccccagaaggtgcagctggtgtctgtgatgaaggaggccatcggggctgtgatccactacctgctgcaggtgggcagcgagaagcagaaggagccctttgtgtttgcctctgtgcgcatcctgggcgcctggctggccgaggagaccagcagcctgaggaaggaggtgtgccagctgctgcccttcctggtgcgctatgccaagaccctgtatgaggaggccgaggaggccaatgacctgagccagcaggtggccaacctggccatcagccccaccaccccaggccccacctggccaggagatgccctgcggctgctgctgcccggctggtgccacctgactgtggaggatggcccccgggagatcctgatcaaggagggcgcccccagcctgctgtgcaagtacttcctgcagcagtgggagctgaccagccctggccatgacacctctgtgctgcctgacagcgtggagatcggcctgcagacctgctgccacatcttcctgaacctggtggtgacagcccctggcctcatcaagagagatgcctgcttcaccagcctgatgaacaccctgatgaccagcctgcctgccctggtgcagcagcagggccgcctgctgctggccgccaacgtggccaccctgggcctgctgatggcccggctgctgagcaccagccctgccctgcagggcaccccagccagccggggcttctttgctgctgccatcctcttcctgagccagagccacgtggcccgggccaccccaggcagtgaccaggccgtgctggccctgagcccagaatatgagggcatctgggccgacctgcaggagctgtggttcctgggcatgcaggccttcaccggctgtgtgcccctgctgccctggctggccccagctgccctgcggagccgctggccccaggagctgctgcagctgctgggctctgtgagccccaacagcgtgaagccagagatggtggccgcctaccagggcgtgctggtggagctggcccgggccaaccggctgtgccgggaggccatgaggctgcaggccggggaggagacagccagccactacaggatggccgccctggagcagtgcctgtctgagccctag

SEQ ID NO: 161616 - DNA, 531 bp, Artificial Sequence
  Description of Artificial Sequence: Synthetic coding sequence
atgccccacagcttccgctacctggccgccctgcagggcaccccagccagccggggcttctttgctgctgccatcctcttcctgagccagagccacgtggcccgggccaccccaggcagtgaccaggccgtgctggccctgagcccagaatatgagggcatctgggccgacctgcaggagctgtggttcctgggcatgcaggccttcaccggctgtgtgcccctgctgccctggctggccccagctgccctgcggagccgctggccccaggagctgctgcagctgctgggcagccagccccagctgtgccaggccagagatggcggccgcctgagcggctgccctggaggagctggggccggccagcctgctgtgcctgggggccatgaagctgctgggggcagaggagatggccagcccctgccccacggctgcctgggcgctgtgcctgtgcgggccctgcggggcgtgcaccggggccagacccagggccgggcagagcgggagggcggccgccgccacctgccctag

SEQ ID NO: 161617 - DNA, 582 bp, Artificial Sequence
  Description of Artificial Sequence: Synthetic coding sequence
tgaagcagcctgaggaaggaggtgtgccagctgctgcccttcctggtgcgctatgccaagaccctgtatgaggaggccgaggaggccaatgacctgagccagcaggtggccaacctggccatcagccccaccaccccaggccccacctggccaggagatgccctgcggctgctgctgcccggctggtgccacctgactgtggaggatggcccccgggagatcctgatcaaggagggcgcccccagcctgctgtgcaagtacttcctgcagcagtgggagctgaccagccctggccatgacacctctgtgctgcctgattctgtggagatcggcctgcagacctgctgccacatcttcctgaacctggtggtgacagcccctggcctcatcaagagagatgcctgcttcaccagcctgatgaacaccctgatgaccagcctgcctgccctggtgcagcagcagggccgcctgctgctggccgccaacgtggccaccctgggcctgctgatggcccggctgctgagcaccagccctggcagcatcagcagccagctgcccggggctgagcacatgccctgctag

SEQ ID NO: 161618 - DNA, 735 bp, Artificial Sequence
  Description of Artificial Sequence: Synthetic coding sequence
atggccagtgactgtgagcccgccctgaaccaggccgagggcaggaaccccaccctggagcgctacctgggcgccctgcgggaggccaagaatgattctgagcagtttgctgccctgctgctggtgaccaaggctgtgaaggccggggacattgatgccaagacccggcggcgcatctttgatgctgtgggcttcaccttccccaaccggctgctgaccaccaaggaggccccagatggctgcccagaccacgtgctgcgggccctgggcgtggccctgctggcctgcttctgcagcgaccctgagctggccgcccacccccaggtgctgaacaagatccccatcctgagcaccttcctgacagcccggggggaccctgatgatgctgcccggcgctccatgattgatgacacctaccagtgcctgacagctgtggccggcaccccccggggccccaggcacctgattgctgggggcaccgtgtctgccctgtgccaggcctacctgggccacggctacggctttgaccaggccctggccctgctggtgggcctgctggccgctgctgagacccagtgctggaaggaggccgagccagacctgctggccgtgctgcggggcctgtctgaggacttccagaaggccgaggatgccagcaagtttgagctgtgccagctgctgcccctcttcctgccccccaccaccgtgcccccagagtgctacagagacctgtag

SEQ ID NO: 161619 - DNA, 1791 bp, Artificial Sequence
  Description of Artificial Sequence: Synthetic coding sequence
atggagcctgagctggccgcccagaagcagccccggcccaggagaagaagccggcgggccagcggcctgagcacagaaggagccaccggccccagcgctgacaccagcggcagcgagctggatggccgctgcagcctgcggcggggcagcagcttcaccttcctgaccccaggccccaactgggacttcaccctgaagaggaagagaagagagaaggatgatgatgtggtgtccctgagcagcctggacctgaaggagcccagcaacaagagggtgcggcccctggcccgggtgaccagcctggccaacctgatcagccctgtgagaaatggagctgtgcggcgcttcggccagaccatccagagcttcaccctgcggggggaccacaggagccctgccagcgcccagaagttcagcagccgcagcacagtgcccaccccagccaagaggaggagcagcgccctgtggagcgagatgctggacatcaccatgaaggagagcctgaccacccgggagatccggcggcaggaggccatctatgagatgagcagaggagagcaggacctgattgaggacctgaagctggccaggaaggcctaccatgaccccatgctgaagctgagcatcatgtctgaggaggagctgacccacatctttggagacctggacagctacatccccctgcacgaggacctgctgacccgcatcggggaggccaccaagccagatggcaccgtggagcagatcggccacatcctggtgtcctggctgccccggctgaatgcctaccggggctactgcagcaaccagctggccgccaaggccctgctggaccagaagaagcaggacccccgggtgcaggacttcctgcagcgctgcctggagagccccttcagcaggaagctggacctgtggagcttcctggacatccccaggagccggctggtgaagtaccccctgctgctgaaggagatcctgaagcacacccccaaggagcacccagatgtgcagctgctggaggatgccatcctgatcatccagggcgtgctgagtgacatcaacctgaagaagggggagagcgagtgccagtactacatcgacaagctggagtacctggatgagaagcagagggaccccagaattgaggccagcaaggtgctgctgtgccacggggagctgcggagcaagagcggccacaagctgtacatcttcctgttccaggacatcctggtgctgaccaggcctgtgaccagaaatgaaagacacagctaccaggtgtaccggcagcccatccctgtgcaggagctggtgctggaggacctgcaggatggagatgtgaggatgggcggcagcttccggggggccttcagcaacagcgagaaggccaagaacatcttccgcatccgcttccatgaccccagccctgcccagagccacaccctgcaggccaatgatgtgttccacaagcagcagtggttcaactgcatccgggccgccatcgcccccttccagagcgctggcagccccccagagctgcagggcctgcctgagctgcatgaagaatgtgagggcaaccaccccagcgccaggaagctgacagcccagaggcgggccagcacagtgtcctctgtgacccaggtggaggtggatgaaaatgcctaccgctgtggcagcggcatgcagatggccgaggacagcaagagcctgaagacccaccagacccagcccggcatcagaagagcccgggacaaggccctgagcggcggcaagaggaaggagaccctggtgtag

SEQ ID NO: 161620 - DNA, 483 bp, Artificial Sequence
  Description of Artificial Sequence: Synthetic coding sequence
atggtggcccatgatgaaacaggaggcctgctgcccatcaagaggaccatccgggtgctggatgtgaacaaccagagcttccgggagcaggaggagctgacccacatctttggagacctggacagctacatccccctgcacgaggacctgctgacccgcatcggggaggccaccaagccagatggcaccgtggagcagatcggccacatcctggtgtcctggctgccccggctgaatgcctaccggggctactgcagcaaccagctggccgccaaggccctgctggaccagaagaagcaggacccccgggtgcaggacttcctgcagcgctgcctggagagccccttcagcaggaagctggacctgtggagcttcctggacatccccaggagccggctggtgaagtaccccctgctgctgaaggagatcctgaagcacacccccaaggagcacccagatgtgcagctgctggaggatgcctag

SEQ ID NO: 161621 - DNA, 1629 bp, Artificial Sequence
  Description of Artificial Sequence: Synthetic coding sequence
atggtggcccatgatgaaacaggaggcctgctgcccatcaagaggaccatccgggtgctggatgtgaacaaccagagcttccgggagcaggaggagcccagcaacaagagggtgcggcccctggcccgggtgaccagcctggccaacctgatcagccctgtgagaaatggagctgtgcggcgcttcggccagaccatccagagcttcaccctgcggggggaccacaggagccctgccagcgcccagaagttcagcagccgcagcacagtgcccaccccagccaagaggaggagcagcgccctgtggagcgagatgctggacatcaccatgaaggagagcctgaccacccgggagatccggcggcaggaggccatctatgagatgagcagaggagagcaggacctgattgaggacctgaagctggccaggaaggcctaccatgaccccatgctgaagctgagcatcatgtctgaggaggagctgacccacatctttggagacctggacagctacatccccctgcacgaggacctgctgacccgcatcggggaggccaccaagccagatggcaccgtggagcagatcggccacatcctggtgtcctggctgccccggctgaatgcctaccggggctactgcagcaaccagctggccgccaaggccctgctggaccagaagaagcaggacccccgggtgcaggacttcctgcagcgctgcctggagagccccttcagcaggaagctggacctgtggagcttcctggacatccccaggagccggctggtgaagtaccccctgctgctgaaggagatcctgaagcacacccccaaggagcacccagatgtgcagctgctggaggatgccatcctgatcatccagggcgtgctgagtgacatcaacctgaagaagggggagagcgagtgccagtactacatcgacaagctggagtacctggatgagaagcagagggaccccagaattgaggccagcaaggtgctgctgtgccacggggagctgcggagcaagagcggccacaagctgtacatcttcctgttccaggacatcctggtgctgaccaggcctgtgaccagaaatgaaagacacagctaccaggtgtaccggcagcccatccctgtgcaggagctggtgctggaggacctgcaggatggagatgtgaggatgggcggcagcttccggggggccttcagcaacagcgagaaggccaagaacatcttccgcatccgcttccatgaccccagccctgcccagagccacaccctgcaggccaatgatgtgttccacaagcagcagtggttcaactgcatccgggccgccatcgcccccttccagagcgctggcagccccccagagctgcagggcctgcctgagctgcatgaagaatgtgagggcaaccaccccagcgccaggaagctgacagcccagaggcgggccagcacagtgtcctctgtgacccaggtggaggtggatgaaaatgcctaccgctgtggcagcggcatgcagatggccgaggacagcaagagcctgaagacccaccagacccagcccggcatcagaagagcccgggacaaggccctgagcggcggcaagaggaaggagaccctggtgtag

SEQ ID NO: 161622 - DNA, 483 bp, Artificial Sequence; identical to SEQ ID NO: 161620
  Description of Artificial Sequence: Synthetic coding sequence

SEQ ID NO: 161623 - DNA, 1248 bp, Artificial Sequence
  Description of Artificial Sequence: Synthetic coding sequence
atgagcagaggagagcaggacctgattgaggacctgaagctggccaggaaggcctaccatgaccccatgctgaagctgagcatcatgtctgaggaggagctgacccacatctttggagacctggacagctacatccccctgcacgaggacctgctgaccagaattggagaggccaccaagccagatggcaccgtggagcagatcggccacatcctggtgtcctggctgccccggctgaatgcctaccggggctactgcagcaaccagctggccgccaaggccctgctggaccagaagaagcaggacccccgggtgcaggacttcctgcagcgctgcctggagagccccttcagcaggaagctggacctgtggagcttcctggacatccccaggagccggctggtgaagtaccccctgctgctgaaggagatcctgaagcacacccccaaggagcacccagatgtgcagctgctggaggatgccatcctgatcatccagggcgtgctgagtgacatcaacctgaagaagggggagagcgagtgccagtactacatcgacaagctggagtacctggatgagaagcagagggacccccgcatcgaggccagcaaggtgctgctgtgccacggggagctgcggagcaagagcggccacaagctgtacatcttcctgttccaggacatcctggtgctgaccaggcctgtgaccagaaatgaaagacacagctaccaggtgtaccggcagcccatccctgtgcaggagctggtgctggaggacctgcaggatggagatgtgaggatgggcggcagcttccggggggccttcagcaacagcgagaaggccaagaacatcttccgcatccgcttccatgaccccagccctgcccagagccacaccctgcaggccaatgatgtgttccacaagcagcagtggttcaactgcatccgggccgccatcgcccccttccagagcgctggcagccccccagagctgcagggcctgcctgagctgcacgaggagtgtgagggcaaccaccccagcgccaggaagctgacagcccagaggcgggccagcacagtgtcctctgtgacccaggtggaggtggatgaaaatgcctaccgctgtggcagcggcatgcagatggccgaggacagcaagagcctgaagacccaccagacccagcccggcatccggcgggcccgggacaaggccctgagcggcggcaagaggaaggagaccctggtgtag

SEQ ID NO: 161624 - DNA, 3063 bp, Artificial Sequence
  Description of Artificial Sequence: Synthetic coding sequence
atgatgagctttggaggagcagatgccctgctgggcgccccctttgcccccctgcatggaggcggcagcctgcactacgccctggccaggaaaggaggagctgggggcaccaggtctgctgctggcagcagcagcggcttccacagctggaccaggacctctgtgtcctctgtgtctgccagccccagccgcttccggggggccggggccgccagcagcacagacagcctggacaccctgagcaatggacctgagggctgcatggtggccgtggccaccagccgctctgagaaggagcagctgcaggccctgaatgacagatttgctggctacatcgacaaggtgcggcagctggaggcccacaacagaagcctggagggggaggccgccgccctgcggcagcagcaggccggccgcagcgccatgggagagctgtatgaaagagaggtgcgggagatgagaggagctgtgctgcggctgggcgccgcccggggccagctgcggctggagcaggagcacctgctggaggacatcgcccacgtgcggcagaggctggatgatgaggcccggcagcgggaggaggccgaggccgccgcccgggccctggccaggtttgcccaggaggccgaggccgcccgggtggacctgcagaagaaggcccaggccctgcaggaggagtgtggctacctgcggcggcaccaccaggaggaggtgggggagctgctgggccagatccagggcagcggggccgcccaggcccagatgcaggccgagaccagagatgccctgaagtgtgatgtgaccagcgccctgcgggagatccgggcccagctggagggccatgctgtgcagagcaccctgcagagcgaggagtggttccgggtgcggctggaccggctgtctgaggccgccaaggtgaacacagatgccatgaggtctgcccaggaggagatcacagagtaccgccggcagctgcaggcccggaccacagagctggaggccctgaagagcaccaaggacagcctggagcggcagaggtctgagctggaggacagacaccaggccgacatcgccagctaccaggaggccatccagcagctggatgctgagctgaggaacaccaagtgggagatggccgcccagctgcgggagtaccaggacctgctgaatgtgaagatggccctggacattgaaattgctgcctacaggaagctgctggagggggaggagtgcagaattggatttggccccatccccttcagcctgcctgagggcctgcccaagatccccagcgtgtccacccacatcaaggtgaagtctgaggagaagatcaaggtggtggagaagtctgagaaggagaccgtcatcgtggaggagcagacagaggagacccaggtgacagaggaggtgacagaggaggaggagaaggaggccaaggaggaggagggcaaggaggaggagggcggggaggaggaggaggccgagggcggggaggaggagaccaagagccccccagctgaggaggccgccagccctgagaaggaggccaagagccctgtgaaggaggaggccaagagccctgctgaggccaagagccctgagaaggaggaggccaagagccctgctgaggtgaagagccctgagaaggccaagagccctgccaaggaggaggccaagagccccccagaggccaagagccctgagaaggaggaggccaagagccctgctgaggtgaagagccctgagaaggccaagagccctgccaaggaggaggccaagagccctgctgaggccaagagccctgagaaggccaagagccctgtgaaggaggaggccaagagccctgctgaggccaagagccctgtgaaggaggaggccaagagccctgctgaggtgaagagccctgagaaggccaagagccccaccaaggaggaggccaagagccctgagaaggccaagagccctgagaaggaggaggccaagagccctgagaaggccaagagccctgtgaaggccgaggccaagagccctgagaaggccaagagccctgtgaaggccgaggccaagagccctgagaaggccaagagccctgtgaaggaggaggccaagagccctgagaaggccaagagccctgtgaaggaggaggccaagagccctgagaaggccaagagccctgtgaaggaggaggccaagaccccagagaaggccaagagccctgtgaaggaggaggccaagagccctgagaaggccaagagccctgagaaggccaagaccctggatgtgaagagccctgaggccaagaccccagccaaggaggaggcccggagccctgctgacaagtttcctgagaaggccaagagccctgtgaaggaggaggtgaagagccctgagaaggccaagagccccctgaaggaggatgccaaggcccctgagaaggagatccccaagaaggaggaggtgaagagccctgtgaaggaggaggagaagccccaggaggtgaaggtgaaggagccccccaagaaggccgaggaggagaaggccccagccacccccaagacagaggagaagaaggacagcaagaaggaggaggcccccaagaaggaggcccccaagcccaaggtggaggagaagaaggagcctgctgtggagaagcccaaggagagcaaggtggaggccaagaaggaggaggccgaggacaagaagaaggtgcccaccccagagaaggaggccccagccaaggtggaggtgaaggaggatgccaagcccaaggagaagacagaggtggccaagaaggagccagatgatgccaaggccaaggagcccagcaagccagctgagaagaaggaggccgcccctgagaagaaggacaccaaggaggagaaggccaagaagccagaggagaagcccaagacagaggccaaggccaaggaggatgacaagaccctgagcaaggagcccagcaagcccaaggccgagaaggccgagaagagcagcagcacagaccagaaggacagcaagcccccagagaaggccacagaggacaaggccgccaagggcaagtag

SEQ ID NO: 161625 - DNA, 2916 bp, Artificial Sequence
  Description of Artificial Sequence: Synthetic coding sequence
atgatgagctttggaggagcagatgccctgctgggcgccccctttgcccccctgcatggaggcggcagcctgcactacgccctggccaggaaaggaggagctgggggcaccaggtctgctgctggcagcagcagcggcttccacagctggaccaggacctctgtgtcctctgtgtctgccagccccagccgcttccggggggccggggccgccagcagcacagacagcctggacaccctgagcaatggacctgagggctgcatggtggccgtggccaccagccgctctgagaaggagcagctgcaggccctgaatgacagatttgctggctacatcgacaaggtgcggcagctggaggcccacaacagaagcctggagggggaggccgccgccctgcggcagcagcaggccggccgcagcgccatgggagagctgtatgaaagagaggtgcgggagatgagaggagctgtgctgcggctgggcgccgcccggggccagctgcggctggagcaggagcacctgctggaggacatcgcccacgtgcggcagaggctggatgatgaggcccggcagcgggaggaggccgaggccgccgcccgggccctggccaggtttgcccaggaggccgaggccgcccgggtggacctgcagaagaaggcccaggccctgcaggaggagtgtggctacctgcggcggcaccaccaggaggaggtgggggagctgctgggccagatccagggcagcggggccgcccaggcccagatgcaggccgagaccagagatgccctgaagtgtgatgtgaccagcgccctgcgggagatccgggcccagctggagggccatgctgtgcagagcaccctgcagagcgaggagtggttccgggtgcggctggaccggctgtctgaggccgccaaggtgaacacagatgccatgaggtctgcccaggaggagatcacagagtaccgccggcagctgcaggcccggaccacagagctggaggccctgaagagcaccaaggacagcctggagcggcagaggtctgagctggaggacagacaccaggccgacatcgccagctaccaggaggccatccagcagctggatgctgagctgaggaacaccaagtgggagatggccgcccagctgcgggagtaccaggacctgctgaatgtgaagatggccctggacattgaaattgctgcctacaggaagctgctggagggggaggagtgcagaattggatttggccccatccccttcagcctgcctgagggcctgcccaagatccccagcgtgtccacccacatcaaggtgaagtctgaggagaagatcaaggtggtggagaagtctgagaaggagaccgtcatcgtggaggagcagacagaggagacccaggtgacagaggaggtgacagaggaggaggagaaggaggccaaggaggaggagggcaaggaggaggagggcggggaggaggaggaggccgagggcggggaggaggagaccaagagccccccagctgaggaggccgccagccctgagaaggaggccaagagccctgtgaaggaggaggccaagagccctgctgaggccaagagccctgagaaggaggaggccaagagccctgctgaggtgaagagccctgagaaggccaagagccctgccaaggaggaggccaagagccccccagaggccaagagccctgagaaggaggaggccaagagccctgctgaggtgaagagccctgagaaggccaagagccctgccaaggaggaggccaagagccctgctgaggccaagagccctgagaaggccaagagccctgtgaaggaggaggccaagagccctgctgaggccaagagccctgtgaaggaggaggccaagagccctgctgaggtgaagagccctgagaaggccaagagccccaccaaggaggaggccaagagccctgagaaggccaagagccctgagaaggaggaggccaagagccctgagaaggccaagagccctgtgaaggccgaggccaagagccctgagaaggccaagagccctgtgaaggccgaggccaagagccctgagaaggccaagagccctgtgaaggaggaggccaagagccctgagaaggccaagagccctgtgaaggaggaggccaagagccctgagaaggccaagagccctgtgaaggaggaggccaagaccccagagaaggccaagagccctgtgaaggaggaggccaagagccctgagaaggccaagagccccctgaaggaggatgccaaggcccctgagaaggagatccccaagaaggaggaggtgaagagccctgtgaaggaggaggagaagccccaggaggtgaaggtgaaggagccccccaagaaggccgaggaggagaaggccccagccacccccaagacagaggagaagaaggacagcaagaaggaggaggcccccaagaaggaggcccccaagcccaaggtggaggagaagaaggagcctgctgtggagaagcccaaggagagcaaggtggaggccaagaaggaggaggccgaggacaagaagaaggtgcccaccccagagaaggaggccccagccaaggtggaggtgaaggaggatgccaagcccaaggagaagacagaggtggccaagaaggagccagatgatgccaaggccaaggagcccagcaagccagctgagaagaaggaggccgcccctgagaagaaggacaccaaggaggagaaggccaagaagccagaggagaagcccaagacagaggccaaggccaaggaggatgacaagaccctgagcaaggagcccagcaagcccaaggccgagaaggccgagaagagcagcagcacagaccagaaggacagcaagcccccagagaaggccacagaggacaaggccgccaagggcaagtag

SEQ ID NO: 161626 - DNA, 930 bp, Artificial Sequence
  Description of Artificial Sequence: Synthetic coding sequence
atggatgacaaggccttcaccaaggagctggaccagtgggtggagcagctgaatgaatgcaagcagctgaatgaaaaccaggtgaggaccctgtgtgagaaggccaaggagatcctgaccaaggagagcaatgtgcaggaggtgcgctgccctgtgacagtgtgtggagatgtgcacggccagttccatgacctgatggagctgttcagaattggaggcaagagcccagacaccaactacctgttcatgggagactatgtggaccggggctactacagcgtggagaccgtgaccctgctggtggccctgaaggtgcgctacccagagcgcatcaccatcctgcggggcaaccacgagagccggcagatcacccaggtgtatggcttctatgatgagtgcctgaggaaatatggaaatgccaacgtgtggaagtacttcacagacctgtttgactacctgcccctgacagccctggtggatggccagatcttctgcctgcatggaggcctgagccccagcattgacaccctggaccacatccgggccctggaccggctgcaggaggtgccccatgagggccccatgtgtgacctgctgtggagcgaccctgatgacagaggaggctggggcatcagccccaggggggccggctacaccttcggccaggacatcagcgagaccttcaaccacgccaacggcctgaccctggtgtcccgggcccaccagctggtgatggagggctacaactggtgccacgacagaaatgtggtgaccatcttcagcgcccccaactactgctaccgctgtggcaaccaggccgccatcatggagctggatgacaccctgaagtacagcttcctgcagtttgatcctgccccccggcggggggagccccacgtgaccaggaggaccccagactacttcctgtag

SEQ ID NO: 161627 - DNA, 1623 bp, Artificial Sequence
  Description of Artificial Sequence: Synthetic coding sequence
atggcccggcacctgcgggagtaccaggacctgctgaatgtgaagatggccctggacatcgagattgctgcctacaggaagctgctggagggggaggagacccgcttcagcacctttgctggcagcatcaccggccccctgtacacccaccggccccccatcaccatcagcagcaagatccagaagcccaaggtggaggcccccaagctgaaggtgcagcacaagtttgtggaggagatcatcgaggagaccaaggtggaggatgagaagtctgagatggaggaggccctgacagccatcacagaggagctggccgtgtccatgaaggaggagaagaaggaggccgctgaggagaaggaggaggagcctgaggccgaggaggaggaggtggccgccaagaagagccctgtgaaggccacagcccctgaggtgaaggaggaggagggggagaaggaggaggaggagggccaggaggaggaggaggaggaggatgagggcgccaagagtgaccaggccgaggagggcggcagcgagaaggagggcagcagcgagaaggaggagggggagcaggaggagggggagacagaagctgaggccgagggggaggaggccgaggccaaggaggagaagaaggtggaggagaagtctgaggaggtggccaccaaggaggagctggtggctgatgccaaggtggagaagccagagaaggccaagagccctgtgcccaagagccctgtggaggagaagggcaagagccctgtgcccaagagccctgtggaggagaagggcaagagccctgtgcccaagagccctgtggaggagaagggcaagagccctgtgcccaagagccctgtggaggagaagggcaagagccctgtgtccaagagccctgtggaggagaaggccaagagccctgtgcccaagagccctgtggaggaggccaagagcaaggccgaggtgggcaagggggagcagaaggaggaggaggagaaggaggtgaaggaggcccccaaggaggagaaggtggagaagaaggaggagaagcccaaggatgtgcctgagaagaagaaggccgagagccctgtgaaggaggaggccgtggccgaggtggtgaccatcaccaagtctgtgaaggtgcacctggagaaggagaccaaggaggagggcaagcccctgcagcaggagaaggagaaggagaaggccggcggggagggcggcagcgaggaggagggcagtgacaagggggccaagggcagcaggaaggaggacattgctgtgaatggagaggtggagggcaaggaggaggtggagcaggagaccaaggagaagggcagcggccgggaggaggagaagggcgtggtgaccaacggcctggacctgagccctgcagatgagaagaagggcggggacaagtctgaggagaaggtggtggtgaccaagacagtggagaagatcaccagcgagggcggagatggagccaccaagtacatcaccaagtctgtgacagtgacccagaaggtggaggagcacgaggagacctttgaggagaagctggtgtccaccaagaaggtggagaaggtgaccagccacgccatcgtgaaggaggtgacccagagcgactag

SEQ ID NO: 161628 - DNA, 2634 bp, Artificial Sequence
  Description of Artificial Sequence: Synthetic coding sequence
atgagctacaccctggacagcctgggcaaccccagcgcctacagaagagtgacagagaccaggagcagcttcagccgggtgtctggcagccccagcagcggcttccgcagccagagctggagccggggcagccccagcacagtgagcagcagctacaagaggtccatgctggccccccggctggcctacagcagcgccatgctgagcagcgctgagagcagcctggacttcagccagagcagcagcctgctgaatggaggcagcggccctggaggagactacaagctgagccgcagcaatgagaaggagcagctgcagggcctgaatgacagatttgctggctacatcgagaaggtgcactacctggagcagcagaacaaggagattgaagctgagatccaggccctgcggcagaagcaggccagccacgcccagctgggagatgcctatgaccaggagatccgggagctgcgggccaccctggagatggtgaaccacgagaaggcccaggtgcagctggacagcgaccacctggaggaggacatccaccggctgaaggagagatttgaggaggaggcccggctgagagatgacacagaagctgccatccgggccctgaggaaggacatcgaggaggccagcctggtgaaggtggagctggacaagaaggtgcagagcctgcaggatgaggtggccttcctgcggagcaaccacgaggaggaggtggccgacctgctggcccagatccaggccagccacatcaccgtggagaggaaggactacctgaagacagacatcagcacagccctgaaggagatccgcagccagctggagagccacagcgaccagaacatgcaccaggccgaggagtggttcaagtgccgctatgccaagctgacagaggccgctgagcagaacaaggaggccatccgcagcgccaaggaggagattgctgagtaccgccggcagctgcagagcaagagcattgagctggagagcgtgcggggcaccaaggagagcctggagcggcagctgagtgacatcgaggagcggcacaaccacgacctgagcagctaccaggacaccatccagcagctggagaatgagctgcggggcaccaagtgggagatggcccggcacctgcgggagtaccaggacctgctgaatgtgaagatggccctggacatcgagattgctgcctacaggaagctgctggagggggaggagacccgcttcagcacctttgctggcagcatcaccggccccctgtacacccaccggccccccatcaccatcagcagcaagatccagaagcccaaggtggaggcccccaagctgaaggtgcagcacaagtttgtggaggagatcatcgaggagaccaaggtggaggatgagaagtctgagatggaggaggccctgacagccatcacagaggagctggccgtgtccatgaaggaggagaagaaggaggccgctgaggagaaggaggaggagcctgaggccgaggaggaggaggtggccgccaagaagagccctgtgaaggccacagcccctgaggtgaaggaggaggagggggagaaggaggaggaggagggccaggaggaggaggaggaggaggatgagggcgccaagagtgaccaggccgaggagggcggcagcgagaaggagggcagcagcgagaaggaggagggggagcaggaggagggggagacagaagctgaggccgagggggaggaggccgaggccaaggaggagaagaaggtggaggagaagtctgaggaggtggccaccaaggaggagctggtggctgatgccaaggtggagaagccagagaaggccaagagccctgtgcccaagagccctgtggaggagaagggcaagagccctgtgtccaagagccctgtggaggagaaggccaagagccctgtgcccaagagccctgtggaggaggccaagagcaaggccgaggtgggcaaaggagagcagaaggaggaggaggagaaggaggtgaaggaggcccccaaggaggagaaggtggagaagaaggaggagaagcccaaggatgtgcctgagaagaagaaggccgagagccctgtgaaggaggaggccgtggccgaggtggtgaccatcaccaagtctgtgaaggtgcacctggagaaggagaccaaggaggagggcaagcccctgcagcaggagaaggagaaggagaaggccggcggggagggcggcagcgaggaggagggcagtgacaagggggccaagggcagcaggaaagaagatattgctgtgaatggagaggtggagggcaaggaggaggtggagcaggagaccaaggagaagggcagcggccgggaggaggagaagggcgtggtgaccaacggcctggacctgagccctgcagatgagaagaagggcggggacaagtctgaggagaaggtggtggtgaccaagacagtggagaagatcaccagcgagggcggagatggagccaccaagtacatcaccaagtctgtgacagtgacccagaaggtggaggagcacgaggagacctttgaggagaagctggtgtccaccaagaaggtggagaaggtgaccagccacgccatcgtgaaggaggtgacccagagcgactag

SEQ ID NO: 161629 - DNA, 1071 bp, Artificial Sequence
  Description of Artificial Sequence: Synthetic coding sequence
atgaccaagagctacagcgagagcggcctgatgggagagccccagccccagggccccccatcctggacagatgaatgtctgagcagccaggatgaggagcacgaggccgacaagaaggaggatgacctggagaccatgaatgctgaggaggacagcctgagaaatggaggagaggaggaggatgaagatgaggacctggaggaggaggaggaggaggaggaggaggatgatgaccagaagcccaagagaagaggccccaagaagaagaagatgaccaaggcccggctggagcgcttcaagctgcggaggatgaaggccaatgcccgggagaggaacaggatgcacggcctgaatgctgccctggacaacctgaggaaggtggtgccctgctacagcaagacccagaagctgagcaagattgagaccctgcggctggccaagaactacatctgggccctgtctgagatcctgcggagcggcaagagcccagacctggtgtcctttgtgcagaccctgtgcaagggcctgagccagcccaccaccaacctggtggccggctgcctgcagctgaaccccaggaccttcctgcctgagcagaaccaggacatgccaccccacctgcccacagccagcgccagcttccctgtgcacccctacagctaccagagccctggcctgcccagccccccctacggcaccatggacagcagccacgtgttccacgtgaagcccccacctcatgcctacagcgctgccctggagcccttctttgagagccccctgacagactgcaccagccccagctttgatggccccctgagcccccccctgagcatcaatggaaacttctccttcaagcatgagcccagcgctgagtttgagaagaactatgccttcaccatgcactacccagctgccaccctggccggggcccagagccacggcagcatcttctctggaacagctgccccccgctgtgagatccccatcgacaacatcatgagctttgacagccacagccaccacgagcgggtgatgtctgcccagctgaatgccatcttccatgactag

SEQ ID NO: 161630 - DNA, 1149 bp, Artificial Sequence
  Description of Artificial Sequence: Synthetic coding sequence
atgctgaccaggctcttcagcgagcccggcctgctgagtgatgtgcccaagtttgcctcctggggagatggagaagatgatgagcccaggagtgacaagggagatgcccctcctcctcctcctccagcccctggccctggggcccctggccctgcccgggccgccaagcctgtgcccctgcggggggaggagggcacagaggccaccctggccgaggtgaaggaggagggggagctgggcggggaggaggaggaggaggaggaggaggaggagggcctggatgaggccgagggggagcggcccaagaagaggggccccaagaagaggaagatgaccaaggcccggctggagaggagcaagctgcggcggcagaaggccaatgcccgggagaggaacaggatgcatgacctgaatgctgccctggacaacctgaggaaggtggtgccctgctacagcaagacccagaagctgagcaagattgagaccctgcggctggccaagaactacatctgggccctgtctgagatcctgcggagcggcaagaggccagacctggtgtcctatgtgcagaccctgtgcaagggcctgagccagcccaccaccaacctggtggccggctgcctgcagctgaacagcaggaacttcctgacagagcagggcgcagatggagctggccgcttccacggcagcggcggcccctttgccatgcacccctacccctacccctgcagccggctggccggggcccagtgccaggccgccggcggcctgggcggcggggccgcccacgccctgcggacccacggctactgtgccgcctatgagaccctgtatgctgctgctgggggcggcggggccagcccagactacaacagcagtgaatatgagggccccctgagcccccccctgtgcctgaatggaaacttcagcctgaagcaggacagcagcccagaccacgagaagagctaccactacagcatgcactacagcgccctgcccggcagccggcccaccggccacggcctggtgtttggcagcagcgctgtgcggggcggcgtgcacagcgagaacctgctgtcctatgacatgcacctgcaccacgaccggggccccatgtatgaggagctgaatgccttcttccacaactag

SEQ ID NO: 161631 - DNA, 996 bp, Artificial Sequence
  Description of Artificial Sequence: Synthetic coding sequence
atgagcaagacctttgtgaagagcaaggagatgggagagctggtgaacacccccagctggatggacaagggcctgggcagccagaatgaggtgaaggaggaggagagccggcccggcacctacggcatgctgagcagcctgacagaggagcatgacagcattgaggaggaggaggaggaggaggaggatggagagaagcccaagagaagaggccccaagaagaagaagatgaccaaggcccggctggagcgcttccgggcccggcgggtgaaggccaatgcccgggagaggaccaggatgcacggcctgaatgatgccctggacaacctgcggcgggtgatgccctgctacagcaagacccagaagctgagcaagattgagaccctgcggctggccaggaactacatctgggccctgtctgaggtgctggagaccggccagaccccagagggcaagggctttgtggagatgctgtgcaagggcctgagccagcccaccagcaacctggtggccggctgcctgcagctgggcccccagagcgtgctgctggagaagcatgaggacaagagccccatctgtgacagcgccatctctgtgcacaacttcaactaccagagccctggcctgcccagccccccctacggccacatggagacccacctgctgcacctgaagccccaggtgttcaagagcctgggggagagcagctttggcagccacctgcctgactgcagcaccccaccctatgagggccccctgaccccacccctgagcatcagcggcaacttcagcctgaagcaggacggcagcccagacctggagaagagctacagcttcatgccccactaccccagcagcagcctgagcagcggccacgtgcacagcacccccttccaggccggcacccccaggtatgatgtgcccatcgacatgtcctatgacagctacccccaccacggcatcggcacccagctgaacacagtgttcacagaatag

SEQ ID NO: 161632 - DNA, 1014 bp, Artificial Sequence
  Description of Artificial Sequence: Synthetic coding sequence
atgctgaccctgccctttgatgaatctgtggtgatgcctgagagccagatgtgcaggaagttcagccgggagtgtgaggaccagaagcagatcaagaagccagagagcttcagcaagcagatcgtgctgcggggcaagagcatcaagagggcccctggagaggagacagagaaggaggaggaggaggaggaccgggaggaggaggatgaaaatggcctgccccggcggcggggcctgaggaagaagaagaccaccaagctgcggctggagcgggtgaagttccggcggcaggaggccaatgcccgggagaggaacaggatgcacggcctgaatgatgccctggacaacctgaggaaggtggtgccctgctacagcaagacccagaagctgagcaagattgagaccctgcggctggccaagaactacatctgggccctgtctgagatcctgcgcatcggcaagaggccagacctgctgacctttgtgcagaacctgtgcaagggcctgagccagcccaccaccaacctggtggccggctgcctgcagctgaatgcccgctccttcctgatgggccagggcggggaggccgcccaccacaccaggagcccctacagcaccttctacccaccctaccacagccctgagctgaccaccccacctggccacggcaccctggacaacagcaagtccatgaagccctacaactactgcagcgcctatgagagcttctatgagagcaccagcccagaatgtgccagcccccagtttgagggccccctgagccccccacccatcaactacaacggcatcttcagcctgaagcaggaggagaccctggactatggcaagaactacaactacggcatgcactactgtgctgtgcccccccggggccccctgggccagggcgccatgttccggctgcccacagacagccacttcccctatgacctgcacctgcggagccagagcctgaccatgcaggatgagctgaatgctgtgttccacaactag

SEQ ID NO: 161633 - DNA, 714 bp, Artificial Sequence
  Description of Artificial Sequence: Synthetic coding sequence
atgcctgcccggctggagacctgcatcagtgacctggactgtgccagcagcagcggcagtgacctgagcggcttcctgacagatgaggaggactgtgcccggctgcagcaggccgccagcgccagcggccccccagccccagccaggagaggagcccccaacatcagccgggccagcgaggtgcctggggcccaggatgatgagcaggagaggagaagaagaagaggaagaaccagggtgcgctctgaggccctgctgcacagcctgcggcgcagcagaagagtgaaggccaatgaccgggagaggaacaggatgcacaacctgaatgctgccctggatgccctgcggtctgtgctgcccagcttcccagatgacaccaagctgaccaagattgagaccctgcgctttgcctacaactacatctgggccctggccgagaccctgcggctggccgaccagggcctgcccggcggcggggcccgggagcggctgctgcccccccagtgtgtgccctgcctgcccggcccccccagccctgccagtgatgctgagagctggggcagcggggctgctgctgccagccccctgagtgaccccagcagccctgctgccagcgaggacttcacctacagacctggggaccctgtgttctccttccccagcctgcccaaggacctgctgcacaccaccccctgcttcatcccctaccactag

SEQ ID NO: 161634 - DNA, 645 bp, Artificial Sequence
  Description of Artificial Sequence: Synthetic coding sequence
atgaccccccagcccagcggggcccccaccgtgcaggtgacccgggagacagagaggagcttcccccgggcctctgaagatgaggtgacctgccccaccagcgccccacccagccccaccaggacccggggcaactgtgccgaggccgaggagggcggctgccgcggggcccccaggaagctgcgggcccggcggggcggccgcagccggcccaagtctgagctggccctgagcaagcagaggaggagcaggaggaagaaggccaatgaccgggagaggaacaggatgcacaacctgaacagcgccctggatgccctgcggggcgtgctgcccaccttcccagatgatgccaagctgaccaagattgagaccctgcgctttgcccacaactacatctgggccctgacccagaccctgagaattgctgaccacagcctgtatgccctggagcccccagccccccactgtggggagctgggcagccctgggggcagccctggggactggggcagcctgtacagccctgtgtcccaggccggcagcctgagccctgctgccagcctggaggagcggcccggcctgctgggcgccaccttcagcgcctgcctgagccctggcagcctggccttcagtgacttcctgtag

SEQ ID NO: 161635 - DNA, 456 bp, Artificial Sequence
  Description of Artificial Sequence: Synthetic coding sequence
atggagaggcctgagcctgagctgatccggcagagctggagggctgtgagccgcagccccctggagcacggcaccgtgctgtttgcccggctgtttgccctggagccagacctgctgcccctcttccagtacaactgccggcagttcagcagccctgaggactgcctgagcagccctgagttcctggaccacatcaggaaggtgatgctggtgattgatgctgctgtgaccaacgtggaggacctgagcagcctggaggagtacctggccagcctgggcaggaagcacagagctgtgggcgtgaagctgagcagcttcagcacagtgggggagagcctgctgtacatgctggagaagtgcctgggccctgccttcaccccagccaccagggctgcctggagccagctgtatggagctgtggtgcaggccatgagccggggctgggatggagagtag

SEQ ID NO: 161636 - DNA, 237 bp, Artificial Sequence
  Description of Artificial Sequence: Synthetic coding sequence
atggactgctgcacagaaaatgcctgcagcaagccagatgatgacatcctggacatccccctggatgaccccggggccaatgctgctgctgccaagatccaggccagcttccggggccacatggccaggaagaagatcaagagcggggagcggggcaggaagggccctggccctgggggccctggaggagctggggtggcccggggcggggccggcggcggccccagcggggactag

SEQ ID NO: 161637 - DNA, 237 bp, Artificial Sequence; identical to SEQ ID NO: 161636
  Description of Artificial Sequence: Synthetic coding sequence

SEQ ID NO: 161638 - DNA, 237 bp, Artificial Sequence; identical to SEQ ID NO: 161636
  Description of Artificial Sequence: Synthetic coding sequence

SEQ ID NO: 161639 - DNA, 936 bp, Artificial Sequence
  Description of Artificial Sequence: Synthetic coding sequence
atggccgccctgggcgtgctggagagtgacctgcccagcgctgtgaccctgctgaagaacctgcaggagcaggtgatggctgtgacagcccaggtgaagagcctgacccagaaggtgcaggccggggcctaccccacagagaagggcctgtccttcctggaggtgaaggaccagctgctgctgatgtacctgatggacctgacccacctgatcctggacaaggccagcggcggcagcctgcagggccatgatgctgtgctgcggctggtggagatcagaacagtgctggagaagctgcggcccctggaccagaagctgaagtaccagattgacaagctgatcaagacagctgtgacaggcagcctgtctgaaaatgaccccctgcgcttcaagccccaccccagcaacatgatgagcaagctgagcagtgaagatgaggaggaggatgaagcagaagatgaccagagcgaggccagcggcaagaagtctgtgaagggcgtgtccaagaagtatgtgcccccccggctggtgcctgtgcactatgatgaaacagaggccgagcgggagaagaagaggctggagcgggccaagaggcgggccctgagcagcagcgtcatccgggagctgaaggagcagtacagtgatgcccctgaggagatcagagatgcccggcacccccacgtgacccggcagagccaggaggaccagcaccgcatcaactatgaggagagcatgatggtgcggctgtctgtgtccaagcgggagaagggccgcaggaagagggccaacgtgatgagcagccagctgcacagcctgacccacttcagtgacatcagcgccctgaccggcggcaccgtgcacctggatgaggaccagaaccccatcaagaagaggaagaagatcccccagaagggcaggaagaagaagggccagtag

SEQ ID NO: 161640 - DNA, 948 bp, Artificial Sequence
  Description of Artificial Sequence: Synthetic coding sequence
atggccgccctgggcgtgctggagagtgacctgcccagcgctgtgaccctgctgaagaacctgcaggagcaggtgatggctgtgacagcccaggtgaagagcctgacccagaaggtgcaggccggggcctaccccacagagaagggcctgtccttcctggaggtgaaggaccagctgctgctgatgtacctgatggacctgacccacctgatcctggacaaggccagcggcggcagcctgcagggccatgatgctgtgctgcggctggtggagatcagaacagtgctggagaagctgcggcccctggaccagaagctgaagtaccagattgacaagctgatcaagacagctgtgacaggcagcctgtctgaaaatgaccccctgcgcttcaagccccaccccagcaacatgatgagcaagctgagcagtgaagatgaggaggaggatgaagcagaagatgaccagagcgaggccagcggcaagaagtctgtgaagggcgtgtccaagaagtatgtgcccccccggctggtgcctgtgcactatgatgaaacagaggccgagcgggagaagaagaggctggagcgggccaagaggcgggccctgagcagcagcgtcatccgggagctgaaggagcagtacagtgatgcccctgaggagatcagagatgcccggcacccccacgtgacccggcagagccaggaggaccagcaccgcatcaactatgaggagagcatgatggtgcggctgtctgtgtccaagcgggagaagggccgcaggaagagggccaacgtgatgagcagccagctgcacagcctgacccacttcagtgacatcagcgccctgaccggcggcaccgtgcacctggatgaggaccagaaccccatcaagaagaggaagaagatcccccagaagggcaggaagaagaagggcttcagaagaagaagatag

SEQ ID NO: 161641 - DNA, 2472 bp, Artificial Sequence
  Description of Artificial Sequence: Synthetic coding sequence
atggccctgccccgctgcacctggcccaactacgtgtggagggctgtgatggcctgcctggtgcaccggggcctgggcgcccccctgaccctgtgcatgctgggctgcctgctgcaggccggccacgtgctgagccagaagctggatgatgtggaccccctggtggccaccaactttgggaagatccggggcatcaagaaggagctgaacaatgagatcctgggccctgtgatccagttcctgggcgtgccctatgctgccccacccaccggggagcggcgcttccagcccccagagccccccagcccctggagcgacatcagaaatgccacccagtttgcccctgtgtgcccccagaacatcattgatggccgcctgcctgaggtgatgctgcctgtgtggttcaccaacaacctggatgtggtgagcagctatgtgcaggaccagagcgaggactgcctgtacctgaacatctacgtgcccacagaagatgacatccgggacagcggcggccccaagcctgtgatggtgtacatccacggcggcagctacatggagggcaccggcaacctgtatgatggctctgtgctggccagctatggaaatgtcatcgtcatcaccgtgaactaccgcctgggcgtgctgggcttcctgagcactggagaccaggccgccaagggcaactacggcctgctggacctgatccaggccctgcgctggaccagtgaaaatattggcttcttcggcggggaccccctgcgcatcaccgtgtttggcagcggggccggcggcagctgtgtgaacctgctgaccctgagccactacagcgagggcaaccgctggagcaacagcaccaagggcctcttccagagggccatcgcccagagcggcacagccctgagctcctgggccgtgtccttccagcctgccaagtatgccaggatgctggccaccaaggtgggctgcaatgtgtctgacacagtggagctggtggagtgcctgcagaagaagccctacaaggagctggtggaccaggacatccagcctgcccgctaccacatcgccttcggccctgtgattgatggagatgtgatcccagatgacccccagatcctgatggagcagggcgagttcctgaactatgacatcatgctgggcgtgaaccagggcgagggcctgaagtttgtggagaacatcgtggacagtgatgatggcatcagcgccagtgactttgattttgctgtgagcaactttgtggacaacctgtatggctacccagagggcaaggatgtgctgcgggagaccatcaagttcatgtacacagactgggccgacagacacaaccctgagaccaggaggaagaccctgctggccctcttcacagaccaccagtgggtggccccagctgtggccacagctgacctgcacagcaactttggcagccccacctacttctacgccttctaccaccactgccagacagaccaggtgcctgcctgggcagatgctgcccatggagatgaggtgccctacgtgctgggcatccccatgattggccccacagagctgttcccctgcaacttcagcaagaatgatgtgatgctgtctgctgtggtgatgacctactggaccaactttgccaagacaggagaccccaaccagcctgtgccccaggacaccaagttcatccacaccaagcccaacagatttgaggaggtggcctggacccgctacagccagaaggaccagctgtacctgcacatcggcctgaagccccgggtgaaggagcactaccgggccaacaaggtgaacctgtggctggagctggtgccccacctgcacaacctgaatgacatcagccagtacaccagcaccaccaccaaggtgcccagcacagacatcaccttccggcccaccaggaagaacagcgtgcctgtgaccagcgccttccccacagccaagcaggatgaccccaagcagcagcccagccccttctctgtggaccagagggactacagcacagagctgtctgtgaccatcgctgtgggcgccagcctgctcttcctgaacatcctggcctttgctgccctgtactacaagaaggacaagagaagacatgatgtgcaccggcgctgcagcccccagaggaccaccaccaatgacctgacccacgcccaggaggaggagatcatgagcctgcagatgaagcacacagacctggaccatgaatgtgagagcatccacccccatgaggtggtgctgaggacagcctgccccccagactacaccctggccatgagaagaagcccagatgatgtgcccctgatgacccccaacaccatcaccatgatccccaacaccatccctggcatccagcccctgcacaccttcaacaccttcaccggcggccagaacaacaccctgccccacccccacccccacccccacagccacagcaccaccagggtgtag

SEQ ID NO: 161642 - DNA, 2592 bp, Artificial Sequence
  Description of Artificial Sequence: Synthetic coding sequence
atggccctgccccgctgcacctggcccaactacgtgtggagggctgtgatggcctgcctggtgcaccggggcctgggcgcccccctgaccctgtgcatgctgggctgcctgctgcaggccggccacgtgctgagccagaagctggatgatgtggaccccctggtggccaccaactttgggaagatccggggcatcaagaaggagctgaacaatgagatcctgggccctgtgatccagttcctgggcgtgccctatgctgccccacccaccggggagcggcgcttccagcccccagagccccccagcccctggagcgacatcagaaatgccacccagtttgcccctgtgtgcccccagaacatcattgatggccgcctgcctgaggtgatgctgcctgtgtggttcaccaacaacctggatgtggtgagcagctatgtgcaggaccagagcgaggactgcctgtacctgaacatctacgtgcccacagaagatgtgaagaggatcagcaaagaatgtgccaggaagccaggcaagaagatctgcaggaaaggaggccccctgaccaagaagcagacagatgacctgggggacaatgatggagcagaagatgaggacatccgggacagcggcggccccaagcctgtgatggtgtacatccacggcggcagctacatggagggcaccggcaacctgtatgatggctctgtgctggccagctatggaaatgtcatcgtcatcaccgtgaactaccgcctgggcgtgctgggcttcctgagcactggagaccaggccgccaagggcaactacggcctgctggacctgatccaggccctgcgctggaccagtgaaaatattggcttcttcggcggggaccccctgcgcatcaccgtgtttggcagcggggccggcggcagctgtgtgaacctgctgaccctgagccactacagcgagggcaaccgctggagcaacagcaccaagggcctcttccagagggccatcgcccagagcggcacagccctgagctcctgggccgtgtccttccagcctgccaagtatgccaggatgctggccaccaaggtgggctgcaatgtgtctgacacagtggagctggtggagtgcctgcagaagaagccctacaaggagctggtggaccaggacatccagcctgcccgctaccacatcgccttcggccctgtgattgatggagatgtgatcccagatgacccccagatcctgatggagcagggcgagttcctgaactatgacatcatgctgggcgtgaaccagggcgagggcctgaagtttgtggagaacatcgtggacagtgatgatggcatcagcgccagtgactttgattttgctgtgagcaactttgtggacaacctgtatggctacccagagggcaaggatgtgctgcgggagaccatcaagttcatgtacacagactgggccgacagacacaaccctgagaccaggaggaagaccctgctggccctcttcacagaccaccagtgggtggccccagctgtggccacagctgacctgcacagcaactttggcagccccacctacttctacgccttctaccaccactgccagacagaccaggtgcctgcctgggcagatgctgcccatggagatgaggtgccctacgtgctgggcatccccatgattggccccacagagctgttcccctgcaacttcagcaagaatgatgtgatgctgtctgctgtggtgatgacctactggaccaactttgccaagacaggagaccccaaccagcctgtgccccaggacaccaagttcatccacaccaagcccaacagatttgaggaggtggcctggacccgctacagccagaaggaccagctgtacctgcacatcggcctgaagccccgggtgaaggagcactaccgggccaacaaggtgaacctgtggctggagctggtgccccacctgcacaacctgaatgacatcagccagtacaccagcaccaccaccaaggtgcccagcacagacatcaccttccggcccaccaggaagaacagcgtgcctgtgaccagcgccttccccacagccaagcaggatgaccccaagcagcagcccagccccttctctgtggaccagagggactacagcacagagctgtctgtgaccatcgctgtgggcgccagcctgctcttcctgaacatcctggcctttgctgccctgtactacaagaaggacaagagaagacatgatgtgcaccggcgctgcagcccccagaggaccaccaccaatgacctgacccacgcccaggaggaggagatcatgagcctgcagatgaagcacacagacctggaccatgaatgtgagagcatccacccccatgaggtggtgctgaggacagcctgccccccagactacaccctggccatgagaagaagcccagatgatgtgcccctgatgacccccaacaccatcaccatgatccccaacaccatccctggcatccagcccctgcacaccttcaacaccttcaccggcggccagaacaacaccctgccccacccccacccccacccccacagccacagcaccaccagggtgtag

SEQ ID NO: 161643 - DNA, 33 bp, Artificial Sequence
  Description of Artificial Sequence: Synthetic coding sequence
atggccctgccccgctgcacctggcccaactag

SEQ ID NO: 161644 - DNA, 42 bp, Artificial Sequence
  Description of Artificial Sequence: Synthetic coding sequence
atggccctgccccgctgcacctggcccaactacgtgtggtag

SEQ ID NO: 161645 - DNA, 2472 bp, Artificial Sequence; identical to SEQ ID NO: 161641
  Description of Artificial Sequence: Synthetic coding sequence

SEQ ID NO: 161646 - DNA, 2472 bp, Artificial Sequence; identical to SEQ ID NO: 161641
  Description of Artificial Sequence: Synthetic coding sequence

SEQ ID NO: 161647 - DNA, 2508 bp, Artificial Sequence
  Description of Artificial Sequence: Synthetic coding sequence
atgtggctgctggccctgtgcctggtgggcctggccggggcccagagaggaggcggcggccctgggggcggggcccctgggggccctggcctgggcctgggcagcctgggggaggagcgcttccctgtggtgaacacagcctacggccgggtgcggggcgtgagaagagagctgaacaatgagatcctgggccctgtggtgcagttcctgggcgtgccctatgccaccccacccctgggcgcccggcgcttccagcccccagaggccccagcctcctggccaggagtgagaaatgccaccaccctgcccccagcctgcccccagaacctgcatggagccctgcctgccatcatgctgcctgtgtggttcacagacaacctggaggccgccgccacctacgtgcagaaccagagcgaggactgcctgtacctgaacctgtatgtgcccacagaagatggccccctgaccaagaagagagatgaggccaccctgaaccccccagacacagacatccgggaccccgggaagaagcctgtgatgctgttcctgcacggcggcagctacatggagggcaccggcaacatgtttgatggctctgtgctggccgcctatggaaatgtcatcgtggccaccctgaactaccgcctgggcgtgctgggcttcctgagcactggagaccaggccgccaagggcaactacggcctgctggaccagatccaggccctgcgctggctgtctgaaaatattgcccactttggaggagaccctgagcgcatcaccatcttcggcagcggggccggggccagctgtgtgaacctgctgatcctgagccaccacagcgagggcctcttccagaaggccatcgcccagagcggcacagccatcagctcctggagcgtgaactaccagcccctgaagtacacccggctgctggccgccaaggtgggctgtgaccgggaggacagcgctgaggccgtggagtgcctgcggaggaagcccagccgggagctggtggaccaggatgtgcagcctgcccgctaccacatcgcctttggacctgtggtggatggagatgtggtgcctgatgatcctgagatcctgatgcagcagggcgagttcctgaactatgacatgctgattggagtgaaccagggcgagggcctgaagtttgtggaggacagcgctgagagtgaagatggagtgtctgccagcgcctttgacttcaccgtgagcaactttgtggacaacctgtatggctacccagagggcaaggatgtgctgcgggagaccatcaagttcatgtacacagactgggccgaccgggacaatggagagatgaggaggaagaccctgctggccctcttcacagaccaccagtgggtggccccagctgtggccacagccaagctgcacgccgactaccagagccctgtgtacttctacaccttctaccaccactgccaggccgagggccggcctgagtgggcagatgctgcccatggagatgagctgccctacgtgtttggagtgcccatggtgggcgccacagacctcttcccctgcaacttcagcaagaatgatgtgatgctgtctgctgtggtgatgacctactggaccaactttgccaagacaggagaccccaaccagcctgtgccccaggacaccaagttcatccacaccaagcccaacagatttgaggaggtggtgtggagcaagttcaacagcaaggagaagcagtacctgcacatcggcctgaagccccgggtgcgggacaactaccgggccaacaaggtggccttctggctggagctggtgccccacctgcacaacctgcacacagagctgttcaccaccaccacccggctgcccccctatgccacccgctggccacccaggcctcctgctggggcccctggcaccaggaggcctcctcctccagccaccctgcccccagagcctgagcctgagcccggcccccgggcctatgaccgcttccctggggacagccgggactacagcacagagctgtctgtgacagtggccgtgggcgccagcctgctcttcctgaacatcctggcctttgctgccctgtactacaagagggaccggcggcaggagctgcgctgccggcggctgagccccccaggcggcagcggcagcggcgtgcctgggggcggccccctgctgcctgctgctggccgggagctgcccccagaggaggagctggtgtccctgcagctgaagaggggcggcggcgtgggcgctgaccctgctgaggccctgcggcctgcctgccccccagactacaccctggccctgcggcgggccccagatgatgtgcccctgctggcccctggggccctgaccctgctgcccagcggcctgggccccccacctcctcctcctccacccagcctgcaccccttcggccccttccccccacctccacccacagccaccagccacaacaacaccctgccccacccccacagcaccaccagggtgtag

SEQ ID NO: 161648 - DNA, 2547 bp, Artificial Sequence
  Description of Artificial Sequence: Synthetic coding sequence
atgtggctgcggctgggcccccccagcctgagcctgagccccaagcccaccgtgggccgcagcctgtgcctgaccctgtggttcctgagcctggccctgcgggccagcacccaggccccagcccccaccgtgaacacccactttgggaagctgcggggggcccgggtgcccctgcccagcgagatcctgggccctgtggaccagtacctgggcgtgccctatgctgccccacccatcggggagaagcgcttcctgcccccagagcccccacccagctggagcggcatcagaaatgccacccacttcccccctgtgtgcccccagaacatccacacagctgtgcctgaggtgatgctgcctgtgtggttcaccgccaacctggacatcgtggccacctacatccaggagcccaatgaagactgcctgtacctgaatgtgtatgtgcccacagaagatgtgaagaggatcagcaaagaatgtgccaggaagcccaacaagaagatctgcaggaaaggaggcagcggggccaagaagcagggcgaggacctggccgacaatgatggagatgaagatgaggacatccgggacagcggggccaagcctgtgatggtgtacatccatggaggcagctacatggagggcactggaaacatgattgatggcagcatcctggccagctatggaaatgtgattgtcatcaccctgaactacagagtgggcgtgctgggcttcctgagcactggagaccaggccgccaagggcaactacggcctgctggaccagatccaggccctgcgctgggtgtctgagaacatcgccttctttggaggagacccccggcgcatcaccgtgtttggaagtggcattggagccagctgtgtgtccctgctgaccctgagccaccacagcgagggcctcttccagagggccatcatccagagcggcagcgccctgagctcctgggccgtgaactaccagcctgtgaagtacaccagcctgctggccgacaaggtgggctgcaatgtgctggacacagtggacatggtggactgcctgcggcagaagagcgccaaggagctggtggagcaggacatccagcctgcccgctaccacgtggccttcggccctgtgattgatggagatgtgatcccagatgatcctgagatcctgatggagcagggcgagttcctgaactatgacatcatgctgggcgtgaaccagggcgagggcctgaagtttgtggagggcgtggtggaccctgaagatggagtgtctggaacagactttgactacagcgtgagcaactttgtggacaacctgtatggctacccagagggcaaggacaccctgcgggagaccatcaagttcatgtacacagactgggccgaccgggacaaccctgagaccaggaggaagaccctggtggccctcttcacagaccaccagtgggtggagcccagcgtggtgacagctgacctgcacgcccgctatggcagccccacctacttctacgccttctaccaccactgccagagcctgatgaagccagcctggagcgatgctgcccatggagatgaggtgccctacgtgtttggagtgcccatggtgggccccacagacctcttcccctgcaacttcagcaagaatgatgtgatgctgtctgctgtggtgatgacctactggaccaactttgccaagacaggagaccccaacaagcctgtgccccaggacaccaagttcatccacaccaaggccaacagatttgaggaggtggcctggagcaagtacaacccccgggaccagctgtacctgcacatcggcctgaagccccgggtgcgggaccactaccgggccaccaaggtggccttctggaagcacctggtgccccacctgtacaacctgcatgacatgttccactacaccagcaccaccaccaaggtgcccccaccagacaccacccacagcagccacatcacccggcggcccaacgggaagacctggagcaccaagaggcctgccatcagccctgcctacagcaatgaaaatgcccagggctcctggaatggagaccaggatgctggccccctgctggtggagaacccccgggactacagcacagagctgtctgtgaccatcgctgtgggcgccagcctgctcttcctgaatgtgctggcctttgctgccctgtactacaggaaggacaagaggcggcaggagcccctgcggcagcccagcccccagagaggagctggggcccctgagctgggcgccgcccctgaggaggagctggccgccctgcagctgggccccacccaccatgaatgtgaggccggcccccctcatgacaccctgcggctgacagccctgcctgactacaccctgaccctgcggcgcagcccagatgacatccccctgatgacccccaacaccatcaccatgatccccaacagcctggtgggcctgcagaccctgcacccctacaacacctttgctgctggcttcaacagcacaggcctgccccacagccacagcaccaccagggtgtag

SEQ ID NO: 161649 - DNA, 2487 bp, Artificial Sequence
  Description of Artificial Sequence: Synthetic coding sequence
atgtggctgcggctgggcccccccagcctgagcctgagccccaagcccaccgtgggccgcagcctgtgcctgaccctgtggttcctgagcctggccctgcgggccagcacccaggccccagcccccaccgtgaacacccactttgggaagctgcggggggcccgggtgcccctgcccagcgagatcctgggccctgtggaccagtacctgggcgtgccctatgctgccccacccatcggggagaagcgcttcctgcccccagagcccccacccagctggagcggcatcagaaatgccacccacttcccccctgtgtgcccccagaacatccacacagctgtgcctgaggtgatgctgcctgtgtggttcaccgccaacctggacatcgtggccacctacatccaggagcccaatgaagactgcctgtacctgaatgtgtatgtgcccacagaagatggcagcggggccaagaagcagggcgaggacctggccgacaatgatggagatgaagatgaggacatccgggacagcggggccaagcctgtgatggtgtacatccatggaggcagctacatggagggcactggaaacatgattgatggcagcatcctggccagctatggaaatgtgattgtcatcaccctgaactacagagtgggcgtgctgggcttcctgagcactggagaccaggccgccaagggcaactacggcctgctggaccagatccaggccctgcgctgggtgtctgagaacatcgccttctttggaggagacccccggcgcatcaccgtgtttggaagtggcattggagccagctgtgtgtccctgctgaccctgagccaccacagcgagggcctcttccagagggccatcatccagagcggcagcgccctgagctcctgggccgtgaactaccagcctgtgaagtacaccagcctgctggccgacaaggtgggctgcaatgtgctggacacagtggacatggtggactgcctgcggcagaagagcgccaaggagctggtggagcaggacatccagcctgcccgctaccacgtggccttcggccctgtgattgatggagatgtgatcccagatgatcctgagatcctgatggagcagggcgagttcctgaactatgacatcatgctgggcgtgaaccagggcgagggcctgaagtttgtggagggcgtggtggaccctgaagatggagtgtctggaacagactttgactacagcgtgagcaactttgtggacaacctgtatggctacccagagggcaaggacaccctgcgggagaccatcaagttcatgtacacagactgggccgaccgggacaaccctgagaccaggaggaagaccctggtggccctcttcacagaccaccagtgggtggagcccagcgtggtgacagctgacctgcacgcccgctatggcagccccacctacttctacgccttctaccaccactgccagagcctgatgaagccagcctggagcgatgctgcccatggagatgaggtgccctacgtgtttggagtgcccatggtgggccccacagacctcttcccctgcaacttcagcaagaatgatgtgatgctgtctgctgtggtgatgacctactggaccaactttgccaagacaggagaccccaacaagcctgtgccccaggacaccaagttcatccacaccaaggccaacagatttgaggaggtggcctggagcaagtacaacccccgggaccagctgtacctgcacatcggcctgaagccccgggtgcgggaccactaccgggccaccaaggtggccttctggaagcacctggtgccccacctgtacaacctgcatgacatgttccactacaccagcaccaccaccaaggtgcccccaccagacaccacccacagcagccacatcacccggcggcccaacgggaagacctggagcaccaagaggcctgccatcagccctgcctacagcaatgaaaatgcccagggctcctggaatggagaccaggatgctggccccctgctggtggagaacccccgggactacagcacagagctgtctgtgaccatcgctgtgggcgccagcctgctcttcctgaatgtgctggcctttgctgccctgtactacaggaaggacaagaggcggcaggagcccctgcggcagcccagcccccagagaggagctggggcccctgagctgggcgccgcccctgaggaggagctggccgccctgcagctgggccccacccaccatgaatgtgaggccggcccccctcatgacaccctgcggctgacagccctgcctgactacaccctgaccctgcggcgcagcccagatgacatccccctgatgacccccaacaccatcaccatgatccccaacagcctggtgggcctgcagaccctgcacccctacaacacctttgctgctggcttcaacagcacaggcctgccccacagccacagcaccaccagggtgtag

SEQ ID NO: 161650 - DNA, 1542 bp, Artificial Sequence
  Description of Artificial Sequence: Synthetic coding sequence
atgtggctgcggctgggcccccccagcctgagcctgagccccaagcccaccgtgggccgcagcctgtgcctgaccctgtggttcctgagcctggccctgcgggccagcacccaggccccagcccccaccgtgaacacccactttgggaagctgcggggggcccgggtgcccctgcccagcgagatcctgggccctgtggaccagtacctgggcgtgccctatgctgccccacccatcggggagaagcgcttcctgcccccagagcccccacccagctggagcggcatcagaaatgccacccacttcccccctgtgtgcccccagaacatccacacagctgtgcctgaggtgatgctgcctgtgtggttcaccgccaacctggacatcgtggccacctacatccaggagcccaatgaagactgcctgtacctgaatgtgtatgtgcccacagaagatgacatccgggacagcggggccaagcctgtgatggtgtacatccatggaggcagctacatggagggcactggaaacatgattgatggcagcatcctggccagctatggaaatgtgattgtcatcaccctgaactacagagtgggcgtgctgggcttcctgagcactggagaccaggccgccaagggcaactacggcctgctggaccagatccaggccctgcgctgggtgtctgagaacatcgccttctttggaggagacccccggcgcatcaccgtgtttggaagtggcattggagccagctgtgtgtccctgctgaccctgagccaccacagcgagggcctcttccagagggccatcatccagagcggcagcgccctgagctcctgggccgtgaactaccagcctgtgaagtacaccagcctgctggccgacaaggtgggctgcaatgtgctggacacagtggacatggtggactgcctgcggcagaagagcgccaaggagctggtggagcaggacatccagcctgcccgctaccacgtggccttcggccctgtgattgatggagatgtgatcccagatgatcctgagatcctgatggagcagggcgagttcctgaactatgacatcatgctgggcgtgaaccagggcgagggcctgaagtttgtggagggcgtggtggaccctgaagatggagtgtctggaacagactttgactacagcgtgagcaactttgtggacaacctgtatggctacccagagggcaaggacaccctgcgggagaccatcaagttcatgtacacagactgggccgaccgggacaaccctgagaccaggaggaagaccctggtggccctcttcacagaccaccagtgggtggagcccagcgtggtgacagctgacctgcacgcccgctatggcagccccacctacttctacgccttctaccaccactgccagagcctgatgaagccagcctggagcgatgctgcccatggagatgaggtgccctacgtgtttggagtgcccatggtgggccccacagacctcttcccctgcaacttcagcaagaatgatgtgatgctgtag

SEQ ID NO: 161651 - DNA, 2427 bp, Artificial Sequence
  Description of Artificial Sequence: Synthetic coding sequence
atgtggctgcggctgggcccccccagcctgagcctgagccccaagcccaccgtgggccgcagcctgtgcctgaccctgtggttcctgagcctggccctgcgggccagcacccaggccccagcccccaccgtgaacacccactttgggaagctgcggggggcccgggtgcccctgcccagcgagatcctgggccctgtggaccagtacctgggcgtgccctatgctgccccacccatcggggagaagcgcttcctgcccccagagcccccacccagctggagcggcatcagaaatgccacccacttcccccctgtgtgcccccagaacatccacacagctgtgcctgaggtgatgctgcctgtgtggttcaccgccaacctggacatcgtggccacctacatccaggagcccaatgaagactgcctgtacctgaatgtgtatgtgcccacagaagatgacatccgggacagcggggccaagcctgtgatggtgtacatccatggaggcagctacatggagggcactggaaacatgattgatggcagcatcctggccagctatggaaatgtgattgtcatcaccctgaactacagagtgggcgtgctgggcttcctgagcactggagaccaggccgccaagggcaactacggcctgctggaccagatccaggccctgcgctgggtgtctgagaacatcgccttctttggaggagacccccggcgcatcaccgtgtttggaagtggcattggagccagctgtgtgtccctgctgaccctgagccaccacagcgagggcctcttccagagggccatcatccagagcggcagcgccctgagctcctgggccgtgaactaccagcctgtgaagtacaccagcctgctggccgacaaggtgggctgcaatgtgctggacacagtggacatggtggactgcctgcggcagaagagcgccaaggagctggtggagcaggacatccagcctgcccgctaccacgtggccttcggccctgtgattgatggagatgtgatcccagatgatcctgagatcctgatggagcagggcgagttcctgaactatgacatcatgctgggcgtgaaccagggcgagggcctgaagtttgtggagggcgtggtggaccctgaagatggagtgtctggaacagactttgactacagcgtgagcaactttgtggacaacctgtatggctacccagagggcaaggacaccctgcgggagaccatcaagttcatgtacacagactgggccgaccgggacaaccctgagaccaggaggaagaccctggtggccctcttcacagaccaccagtgggtggagcccagcgtggtgacagctgacctgcacgcccgctatggcagccccacctacttctacgccttctaccaccactgccagagcctgatgaagccagcctggagcgatgctgcccatggagatgaggtgccctacgtgtttggagtgcccatggtgggccccacagacctcttcccctgcaacttcagcaagaatgatgtgatgctgtctgctgtggtgatgacctactggaccaactttgccaagacaggagaccccaacaagcctgtgccccaggacaccaagttcatccacaccaaggccaacagatttgaggaggtggcctggagcaagtacaacccccgggaccagctgtacctgcacatcggcctgaagccccgggtgcgggaccactaccgggccaccaaggtggccttctggaagcacctggtgccccacctgtacaacctgcatgacatgttccactacaccagcaccaccaccaaggtgcccccaccagacaccacccacagcagccacatcacccggcggcccaacgggaagacctggagcaccaagaggcctgccatcagccctgcctacagcaatgaaaatgcccagggctcctggaatggagaccaggatgctggccccctgctggtggagaacccccgggactacagcacagagctgtctgtgaccatcgctgtgggcgccagcctgctcttcctgaatgtgctggcctttgctgccctgtactacaggaaggacaagaggcggcaggagcccctgcggcagcccagcccccagagaggagctggggcccctgagctgggcgccgcccctgaggaggagctggccgccctgcagctgggccccacccaccatgaatgtgaggccggcccccctcatgacaccctgcggctgacagccctgcctgactacaccctgaccctgcggcgcagcccagatgacatccccctgatgacccccaacaccatcaccatgatccccaacagcctggtgggcctgcagaccctgcacccctacaacacctttgctgctggcttcaacagcacaggcctgccccacagccacagcaccaccagggtgtag

SEQ ID NO: 161652 - DNA, 1056 bp, Artificial Sequence
  Description of Artificial Sequence: Synthetic coding sequence
atgctgcctgtgtggttcaccgccaacctggacatcgtggccacctacatccaggagcccaatgaagactgcctgtacctgaatgtgtatgtgcccacagaagatggcagcggggccaagaagcagggcgaggacctggccgacaatgatggagatgaagatgaggacatccgggacagcggggccaagcctgtgatggtgtacatccacggcggcagctacatggagggcaccggcaacatgattgatggcagcatcctggccagctatggaaatgtcatcgtcatcaccctgaactacagagtgggcgtgctgggcttcctgagcactggagaccaggccgccaagggcaactacggcctgctggaccagatccaggccctgcgctgggtgtctgaaaatattgccttcttcggcggggacccccggcgcatcaccgtgtttggcagcggcatcggggccagctgtgtgtccctgctgaccctgagccaccacagcgagggcctcttccagagggccatcatccagagcggcagcgccctgagctcctgggccgtgaactaccagcctgtgaagtacaccagcctgctggccgacaaggtgggctgcaatgtgctggacacagtggacatggtggactgcctgcggcagaagagcgccaaggagctggtggagcaggacatccagcctgcccgctaccacgtggcctttggacctgtgattgatggagatgtgatcccagatgatcctgagatcctgatggagcagggcgagttcctgaactatgacatcatgctgggcgtgaaccagggcgagggcctgaagtttgtggagggcgtggtggaccctgaagatggagtgtctggaacagactttgactacagcgtgtccatcctgtggaccatctgcatggccatcctgcgggtgaggaccccctgtgagcggcccagcagcagctgcatccagacaggccagacagtgaccaccctgcggcctgctgtgaagcactggtggcacagcagcctgaccaccagcggctggagcccccagtggtag

SEQ ID NO: 161653 - DNA, 771 bp, Artificial Sequence
  Description of Artificial Sequence: Synthetic coding sequence
atgctgcggccccagggcctgctgtggctgcccctgctcttcacctctgtgtgtgtgatgctgaacagcaatgtgctgctgtggatcacagccctggccatcaagttcaccctgattgacagccaggcccagtaccctgtggtgaacaccaactacggcaagatccagggcctgcggacccccctgcccagcgagatcctgggccctgtggagcagtacctgggcgtgccctatgccagccccccaactggagagcggcgcttccagcccccagagagccccagctcctggacaggcatcagaaatgccacccagttctctgctgtgtgcccccagcacctggatgagcgcttcctgctgcatgacatgctgcccatctggttcaccaccagcctggacaccctgatgacctacgtgcaggaccagaatgaagactgcctgtacctgaacatctacgtgcccatggaggatggcaccaacatcaagagaaatgctgatgacatcaccagcaatgaccatggagaggacaaggacatccacgagcagaacagcaagaagcctgtgatggtgtacatccatggaggcagctacatggagggcactggaaacatgattgatggcagcatcctggccagctatggaaatgtgattgtcatcaccatcaactaccgcctgggcatcctgggcatgcaggaggcccggctgtgtggcagcagcaagatgttcaactacttcaagagccccttcaccaacctgatcaacttcttctag

SEQ ID NO: 161654 - DNA, 2451 bp, Artificial Sequence
  Description of Artificial Sequence: Synthetic coding sequence
atgctgcggccccagggcctgctgtggctgcccctgctcttcacctctgtgtgtgtgatgctgaacagcaatgtgctgctgtggatcacagccctggccatcaagttcaccctgattgacagccaggcccagtaccctgtggtgaacaccaactacggcaagatccagggcctgcggacccccctgcccagcgagatcctgggccctgtggagcagtacctgggcgtgccctatgccagccccccaactggagagcggcgcttccagcccccagagagccccagctcctggacaggcatcagaaatgccacccagttctctgctgtgtgcccccagcacctggatgagcgcttcctgctgcatgacatgctgcccatctggttcaccaccagcctggacaccctgatgacctacgtgcaggaccagaatgaagactgcctgtacctgaacatctacgtgcccatggaggatgacatccacgagcagaacagcaagaagcctgtgatggtgtacatccatggaggcagctacatggagggcactggaaacatgattgatggcagcatcctggccagctatggaaatgtgattgtcatcaccatcaactaccgcctgggcatcctgggcttcctgagcactggagaccaggccgccaagggcaactacggcctgctggaccagatccaggccctgcgctggattgaggagaatgtgggcgcctttggaggagaccccaagagggtgaccatctttggaagtggagctggggccagctgtgtgtccctgctgaccctgagccactacagcgagggcctcttccagaaggccatcatccagagcggcacagccctgagctcctgggccgtgaactaccagcctgccaagtacacccgcatcctggccgacaaggtgggctgcaacatgctggacaccacagacatggtggagtgcctgaagaacaagaactacaaggagctgatccagcagaccatcaccccagccacctaccacatcgccttcggccctgtgattgatggagatgtgatcccagatgacccccagatcctgatggagcagggcgagttcctgaactatgacatcatgctgggcgtgaaccagggcgagggcctgaagtttgtggatggcatcgtggacaatgaagatggagtgaccccaaatgactttgacttctctgtgagcaactttgtggacaacctgtatggctacccagagggcaaggacaccctgcgggagaccatcaagttcatgtacacagactgggccgacaaggaaaatcctgagaccaggaggaagaccctggtggccctcttcacagaccaccagtgggtggccccagctgtggccacagctgacctgcacgcccagtatggcagccccacctacttctacgccttctaccaccactgccagagcgagatgaagcccagctgggccgacagcgcccatggagatgaggtgccctacgtgtttggcatccccatgattggccccacagagctgttcagctgcaacttcagcaagaatgatgtgatgctgtctgctgtggtgatgacctactggaccaactttgccaagacaggagaccccaaccagcctgtgccccaggacaccaagttcatccacaccaagcccaacagatttgaggaggtggcctggagcaagtacaaccccaaggaccagctgtacctgcacatcggcctgaagccccgggtgcgggaccactaccgggccaccaaggtggccttctggctggagctggtgccccacctgcacaacctgaatgagatcttccagtatgtgtccaccaccaccaaggtgcccccaccagacatgaccagcttcccctacggcacccggcgcagccctgccaagatctggcccaccaccaagaggcctgccatcaccccagccaacaaccccaagcacagcaaggacccccacaagacaggccctgaggacaccaccgtgctgattgagaccaagagggactacagcacagagctgtctgtgaccatcgctgtgggcgccagcctgctcttcctgaacatcctggcctttgctgccctgtactacaagaaggacaagagaagacatgagacccaccgccaccccagcccccagaggaacaccaccaatgacatcacccacatccagaatgaggagatcatgagcctgcagatgaagcagctggagcatgaccatgaatgtgagagcctgcaggcccatgacaccctgcggctgacctgccccccagactacaccctgaccctgcggcgcagcccagatgacatccccttcatgacccccaacaccatcaccatgatccccaacaccctgatgggcatgcagcccctgcacaccttcaagaccttcagcggcggccagaacagcaccaacctgccccacggccacagcaccaccagggtgtag

SEQ ID NO: 161655 - DNA, 2451 bp, Artificial Sequence; identical to SEQ ID NO: 161654
  Description of Artificial Sequence: Synthetic coding sequence

SEQ ID NO: 161656 - DNA, 2622 bp, Artificial Sequence
  Description of Artificial Sequence: Synthetic coding sequence
atgctgcggccccagggcctgctgtggctgcccctgctcttcacctctgtgtgtgtgatgctgaacagcaatgtgctgctgtggatcacagccctggccatcaagttcaccctgattgacagccaggcccagtaccctgtggtgaacaccaactacggcaagatccagggcctgcggacccccctgcccagcgagatcctgggccctgtggagcagtacctgggcgtgccctatgccagccccccaactggagagcggcgcttccagcccccagagagccccagctcctggacaggcatcagaaatgccacccagttctctgctgtgtgcccccagcacctggatgagcgcttcctgctgcatgacatgctgcccatctggttcaccaccagcctggacaccctgatgacctacgtgcaggaccagaatgaagactgcctgtacctgaacatctacgtgcccatggaggatggcaccaacatcaagagaaatgctgatgacatcaccagcaatgaccatggagaggacaaggacatccacgagcagaacagcaagaagcctgtgatggtgtacatccatggaggcagctacatggagggcactggaaacatgattgatggcagcatcctggccagctatggaaatgtgattgtcatcaccatcaactaccgcctgggcatcctggcccagaacaccctggcccacggcaactgcaagcaccgctgccagctgcacctgcaggccccccgggactgcaagagcgcctaccccttcagaaatgaagatgagatccggggcttcctgagcactggagaccaggccgccaagggcaactacggcctgctggaccagatccaggccctgcgctggattgaagaaaatgtgggcgccttcggcggggaccccaagagggtgaccatcttcggcagcggggccggggccagctgtgtgtccctgctgaccctgagccactacagcgagggcctcttccagaaggccatcatccagagcggcacagccctgagctcctgggccgtgaactaccagcctgccaagtacacccgcatcctggccgacaaggtgggctgcaacatgctggacaccacagacatggtggagtgcctgaagaacaagaactacaaggagctgatccagcagaccatcaccccagccacctaccacatcgcctttggacctgtgattgatggagatgtgatcccagatgacccccagatcctgatggagcagggcgagttcctgaactatgacatcatgctgggcgtgaaccagggcgagggcctgaagtttgtggatggcatcgtggacaatgaagatggagtgaccccaaatgactttgacttctctgtgagcaactttgtggacaacctgtatggctacccagagggcaaggacaccctgcgggagaccatcaagttcatgtacacagactgggccgacaaggagaaccctgagaccaggaggaagaccctggtggccctcttcacagaccaccagtgggtggccccagctgtggccacagctgacctgcacgcccagtatggcagccccacctacttctacgccttctaccaccactgccagagcgagatgaagcccagctgggccgacagcgcccatggagatgaggtgccctacgtgtttggcatccccatgattggccccacagagctgttcagctgcaacttcagcaagaatgatgtgatgctgtctgctgtggtgatgacctactggaccaactttgccaagacaggagaccccaaccagcctgtgccccaggacaccaagttcatccacaccaagcccaacagatttgaggaggtggcctggagcaagtacaaccccaaggaccagctgtacctgcacatcggcctgaagccccgggtgcgggaccactaccgggccaccaaggtggccttctggctggagctggtgccccacctgcacaacctgaatgagatcttccagtatgtgtccaccaccaccaaggtgcccccaccagacatgaccagcttcccctacggcaccaggaggagccctgccaagatctggcccaccaccaagaggcctgccatcaccccagccaacaaccccaagcacagcaaggacccccacaagacaggccctgaggacaccaccgtgctgattgagaccaagagggactacagcacagagctgtctgtgaccatcgctgtgggcgccagcctgctcttcctgaacatcctggcctttgctgccctgtactacaagaaggacaagagaagacatgagacccaccgccaccccagcccccagaggaacaccaccaatgacatcacccacatccagaatgaggagatcatgagcctgcagatgaagcagctggagcatgaccatgaatgtgagagcctgcaggcccatgacaccctgcggctgacctgccccccagactacaccctgaccctgcggcgcagcccagatgacatccccttcatgacccccaacaccatcaccatgatccccaacaccctgatgggcatgcagcccctgcacaccttcaagaccttcagcggcggccagaacagcaccaacctgccccacggccacagcaccaccagggtgtag

SEQ ID NO: 161657 - DNA, 1947 bp, Artificial Sequence
  Description of Artificial Sequence: Synthetic coding sequence
atggtgtacatccatggaggcagctacatggagggcactggaaacatgattgatggcagcatcctggccagctatggaaatgtgattgtcatcaccatcaactaccgcctgggcatcctgggcttcctgagcactggagaccaggccgccaagggcaactacggcctgctggaccagatccaggccctgcgctggattgaggagaatgtgggcgcctttggaggagaccccaagagggtgaccatctttggaagtggagctggggccagctgtgtgtccctgctgaccctgagccactacagcgagggcctcttccagaaggccatcatccagagcggcacagccctgagctcctgggccgtgaactaccagcctgccaagtacacccgcatcctggccgacaaggtgggctgcaacatgctggacaccacagacatggtggagtgcctgaagaacaagaactacaaggagctgatccagcagaccatcaccccagccacctaccacatcgccttcggccctgtgattgatggagatgtgatcccagatgacccccagatcctgatggagcagggcgagttcctgaactatgacatcatgctgggcgtgaaccagggcgagggcctgaagtttgtggatggcatcgtggacaatgaagatggagtgaccccaaatgactttgacttctctgtgagcaactttgtggacaacctgtatggctacccagagggcaaggacaccctgcgggagaccatcaagttcatgtacacagactgggccgacaaggaaaatcctgagaccaggaggaagaccctggtggccctcttcacagaccaccagtgggtggccccagctgtggccacagctgacctgcacgcccagtatggcagccccacctacttctacgccttctaccaccactgccagagcgagatgaagcccagctgggccgacagcgcccatggagatgaggtgccctacgtgtttggcatccccatgattggccccacagagctgttcagctgcaacttcagcaagaatgatgtgatgctgtctgctgtggtgatgacctactggaccaactttgccaagacaggagaccccaaccagcctgtgccccaggacaccaagttcatccacaccaagcccaacagatttgaggaggtggcctggagcaagtacaaccccaaggaccagctgtacctgcacatcggcctgaagccccgggtgcgggaccactaccgggccaccaaggtggccttctggctggagctggtgccccacctgcacaacctgaatgagatcttccagtatgtgtccaccaccaccaaggtgcccccaccagacatgaccagcttcccctacggcacccggcgcagccctgccaagatctggcccaccaccaagaggcctgccatcaccccagccaacaaccccaagcacagcaaggacccccacaagacaggccctgaggacaccaccgtgctgattgagaccaagagggactacagcacagagctgtctgtgaccatcgctgtgggcgccagcctgctcttcctgaacatcctggcctttgctgccctgtactacaagaaggacaagagaagacatgagacccaccgccaccccagcccccagaggaacaccaccaatgacatcacccacatccagaatgaggagatcatgagcctgcagatgaagcagctggagcatgaccatgaatgtgagagcctgcaggcccatgacaccctgcggctgacctgccccccagactacaccctgaccctgcggcgcagcccagatgacatccccttcatgacccccaacaccatcaccatgatccccaacaccctgatgggcatgcagcccctgcacaccttcaagaccttcagcggcggccagaacagcaccaacctgccccacggccacagcaccaccagggtgtag

SEQ ID NO: 161658 - DNA, 711 bp, Artificial Sequence
  Description of Artificial Sequence: Synthetic coding sequence
tgaaacagcaatgtgctgctgtggatcacagccctggccatcaagttcaccctgattgacagccaggcccagtaccctgtggtgaacaccaactacggcaagatccagggcctgcggacccccctgcccagcgagatcctgggccctgtggagcagtacctgggcgtgccctatgccagccccccaactggagagcggcgcttccagcccccagagagccccagctcctggacaggcatcagaaatgccacccagttctctgctgtgtgcccccagcacctggatgagcgcttcctgctgcatgacatgctgcccatctggttcaccaccagcctggacaccctgatgacctacgtgcaggaccagaatgaagactgcctgtacctgaacatctacgtgcccatggaggatggcaccaacatcaagagaaatgctgatgacatcaccagcaatgaccatggagaggacaaggacatccacgagcagaacagcaagaagcctgtgatggtgtacatccatggaggcagctacatggagggcactggaaacatgattgatggcagcatcctggccagctatggaaatgtgattgtcatcaccatcaactaccgcctgggcatcctgggcatgcaggaggcccggctgtgtggcagcagcaagatgttcaactacttcaagagccccttcaccaacctgatcaacttcttctag

SEQ ID NO: 161659 - DNA, 2511 bp, Artificial Sequence
  Description of Artificial Sequence: Synthetic coding sequence
atgctgcggccccagggcctgctgtggctgcccctgctcttcacctctgtgtgtgtgatgctgaacagcaatgtgctgctgtggatcacagccctggccatcaagttcaccctgattgacagccaggcccagtaccctgtggtgaacaccaactacggcaagatccagggcctgcggacccccctgcccagcgagatcctgggccctgtggagcagtacctgggcgtgccctatgccagccccccaactggagagcggcgcttccagcccccagagagccccagctcctggacaggcatcagaaatgccacccagttctctgctgtgtgcccccagcacctggatgagcgcttcctgctgcatgacatgctgcccatctggttcaccaccagcctggacaccctgatgacctacgtgcaggaccagaatgaagactgcctgtacctgaacatctacgtgcccatggaggatggcaccaacatcaagagaaatgctgatgacatcaccagcaatgaccatggagaggacaaggacatccacgagcagaacagcaagaagcctgtgatggtgtacatccatggaggcagctacatggagggcactggaaacatgattgatggcagcatcctggccagctatggaaatgtgattgtcatcaccatcaactaccgcctgggcatcctgggcttcctgagcactggagaccaggccgccaagggcaactacggcctgctggaccagatccaggccctgcgctggattgaggagaatgtgggcgcctttggaggagaccccaagagggtgaccatctttggaagtggagctggggccagctgtgtgtccctgctgaccctgagccactacagcgagggcctcttccagaaggccatcatccagagcggcacagccctgagctcctgggccgtgaactaccagcctgccaagtacacccgcatcctggccgacaaggtgggctgcaacatgctggacaccacagacatggtggagtgcctgaagaacaagaactacaaggagctgatccagcagaccatcaccccagccacctaccacatcgccttcggccctgtgattgatggagatgtgatcccagatgacccccagatcctgatggagcagggcgagttcctgaactatgacatcatgctgggcgtgaaccagggcgagggcctgaagtttgtggatggcatcgtggacaatgaagatggagtgaccccaaatgactttgacttctctgtgagcaactttgtggacaacctgtatggctacccagagggcaaggacaccctgcgggagaccatcaagttcatgtacacagactgggccgacaaggaaaatcctgagaccaggaggaagaccctggtggccctcttcacagaccaccagtgggtggccccagctgtggccacagctgacctgcacgcccagtatggcagccccacctacttctacgccttctaccaccactgccagagcgagatgaagcccagctgggccgacagcgcccatggagatgaggtgccctacgtgtttggcatccccatgattggccccacagagctgttcagctgcaacttcagcaagaatgatgtgatgctgtctgctgtggtgatgacctactggaccaactttgccaagacaggagaccccaaccagcctgtgccccaggacaccaagttcatccacaccaagcccaacagatttgaggaggtggcctggagcaagtacaaccccaaggaccagctgtacctgcacatcggcctgaagccccgggtgcgggaccactaccgggccaccaaggtggccttctggctggagctggtgccccacctgcacaacctgaatgagatcttccagtatgtgtccaccaccaccaaggtgcccccaccagacatgaccagcttcccctacggcacccggcgcagccctgccaagatctggcccaccaccaagaggcctgccatcaccccagccaacaaccccaagcacagcaaggacccccacaagacaggccctgaggacaccaccgtgctgattgagaccaagagggactacagcacagagctgtctgtgaccatcgctgtgggcgccagcctgctcttcctgaacatcctggcctttgctgccctgtactacaagaaggacaagagaagacatgagacccaccgccaccccagcccccagaggaacaccaccaatgacatcacccacatccagaatgaggagatcatgagcctgcagatgaagcagctggagcatgaccatgaatgtgagagcctgcaggcccatgacaccctgcggctgacctgccccccagactacaccctgaccctgcggcgcagcccagatgacatccccttcatgacccccaacaccatcaccatgatccccaacaccctgatgggcatgcagcccctgcacaccttcaagaccttcagcggcggccagaacagcaccaacctgccccacggccacagcaccaccagggtgtag

SEQ ID NO: 161660 - DNA, 1824 bp, Artificial Sequence
  Description of Artificial Sequence: Synthetic coding sequence
atgattgcccgctgcctgctggccgtgcgcagcctgcggcgggtgggcggcagccgcatcctgctgaggatgaccctgggccgggaggtgatgagccccctgcaggccatgagcagctacacagtggccggcagaaatgtgctgcgctgggacctgagccctgagcagatcaagaccaggacagaggagctgattgtgcagaccaagcaggtgtatgatgctgtgggcatgctgggcatcgaggaggtgacctatgagaactgcctgcaggccctggctgatgtggaggtgaagtacatcgtggagaggaccatgctggacttcccccagcacgtgtccagtgacaaggaggtgcgggccgccagcacagaagctgacaagaggctgagcagatttgacatcgagatgtccatgagaggagacatctttgagcgcatcgtgcacctgcaggagacctgtgacctgggcaagatcaagccagaggcccggcgctacctggagaagagcatcaagatgggcaagagaaatggcctgcacctgcctgagcaggtgcagaatgagatcaagtccatgaagaagaggatgtctgagctgtgcatcgacttcaacaagaacctgaatgaagatgacaccttcctggtgttcagcaaggccgagctgggcgccctgcctgatgacttcatcgacagcctggagaagacagatgatgacaagtacaagatcaccctgaagtacccccactacttccctgtgatgaagaagtgctgcatccctgagaccaggaggaggatggagatggccttcaacacccgctgcaaggaggagaacaccatcatcctgcagcagctgctgcccctgcggaccaaggtggccaagctgctgggctacagcacccacgccgactttgtgctggagatgaacacagccaagagcaccagccgggtgacagccttcctggatgacctgagccagaagctgaagcccctgggggaggccgagcgggagttcatcctgaacctgaagaagaaggagtgcaaggaccggggctttgaatatgatggcaagatcaatgcctgggacctgtactactacatgacccagacagaggagctgaagtacagcattgaccaggagttcctgaaggagtacttccccatcgaggtggtgacagagggcctgctgaacacctaccaggagctgctgggcctgagctttgagcagatgacagatgcccacgtgtggaacaagtctgtgaccctgtacacagtgaaggacaaggccaccggggaggtgctgggccagttctacctggacctgtacccccgggagggcaagtacaaccacgccgcctgcttcggcctgcagcccggctgcctgctgcctgatggcagcaggatgatggctgtggccgccctggtggtgaacttcagccagcctgtggccggccggcccagcctgctgcggcatgatgaggtgaggacctacttccatgaatttggacatgtgatgcaccagatctgtgcccagacagactttgcccgcttcagcggcaccaacgtggagacagactttgtggaggtgcccagccagatgctggagaactgggtgtgggatgtggacagcctgcggcggctgagcaagcactacaaggatggcagccccatcgcagatgacctgctggagaagctggtggccagccggctggtgaacacaggcctgctgaccctgcggcagatcgtgctgagcaaggtggaccagagcctgcacaccaacaccagcctggatgctgccagcaacatgcccaacacagcccagaagtactag

SEQ ID NO: 161661 - DNA, 2115 bp, Artificial Sequence
  Description of Artificial Sequence: Synthetic coding sequence
atgattgcccgctgcctgctggccgtgcgcagcctgcggcgggtgggcggcagccgcatcctgctgaggatgaccctgggccgggaggtgatgagccccctgcaggccatgagcagctacacagtggccggcagaaatgtgctgcgctgggacctgagccctgagcagatcaagaccaggacagaggagctgattgtgcagaccaagcaggtgtatgatgctgtgggcatgctgggcatcgaggaggtgacctatgagaactgcctgcaggccctggctgatgtggaggtgaagtacatcgtggagaggaccatgctggacttcccccagcacgtgtccagtgacaaggaggtgcgggccgccagcacagaagctgacaagaggctgagcagatttgacatcgagatgtccatgagaggagacatctttgagcgcatcgtgcacctgcaggagacctgtgacctgggcaagatcaagccagaggcccggcgctacctggagaagagcatcaagatgggcaagagaaatggcctgcacctgcctgagcaggtgcagaatgagatcaagtccatgaagaagaggatgtctgagctgtgcatcgacttcaacaagaacctgaatgaagatgacaccttcctggtgttcagcaaggccgagctgggcgccctgcctgatgacttcatcgacagcctggagaagacagatgatgacaagtacaagatcaccctgaagtacccccactacttccctgtgatgaagaagtgctgcatccctgagaccaggaggaggatggagatggccttcaacacccgctgcaaggaggagaacaccatcatcctgcagcagctgctgcccctgcggaccaaggtggccaagctgctgggctacagcacccacgccgactttgtgctggagatgaacacagccaagagcaccagccgggtgacagccttcctggatgacctgagccagaagctgaagcccctgggggaggccgagcgggagttcatcctgaacctgaagaagaaggagtgcaaggaccggggctttgaatatgatggcaagatcaatgcctgggacctgtactactacatgacccagacagaggagctgaagtacagcattgaccaggagttcctgaaggagtacttccccatcgaggtggtgacagagggcctgctgaacacctaccaggagctgctgggcctgagctttgagcagatgacagatgcccacgtgtggaacaagtctgtgaccctgtacacagtgaaggacaaggccaccggggaggtgctgggccagttctacctggacctgtacccccgggagggcaagtacaaccacgccgcctgcttcggcctgcagcccggctgcctgctgcctgatggcagcaggatgatggctgtggccgccctggtggtgaacttcagccagcctgtggccggccggcccagcctgctgcggcatgatgaggtgaggacctacttccatgaatttggacatgtgatgcaccagatctgtgcccagacagactttgcccgcttcagcggcaccaacgtggagacagactttgtggaggtgcccagccagatgctggagaactgggtgtgggatgtggacagcctgcggcggctgagcaagcactacaaggatggcagccccatcgcagatgacctgctggagaagctggtggccagccggctggtgaacacaggcctgctgaccctgcggcagatcgtgctgagcaaggtggaccagagcctgcacaccaacaccagcctggatgctgcctctgaatatgccaagtactgcagcgagatcctgggcgtggccgccaccccaggcaccaacatgcctgccaccttcggccacctggccggcggctatgatggccagtactacggctacctgtggagcgaggtgttctccatggacatgttctacagctgcttcaagaaggagggcatcatgaaccctgaggtgggcatgaagtacagaaacctgatcctgaagccaggcggcagcctggatggcatggacatgctgcacaacttcctgaagcgggagcccaaccagaaggccttcctgatgagccggggcctgcacgccccctag

SEQ ID NO: 161662 - DNA, 1803 bp, Artificial Sequence
  Description of Artificial Sequence: Synthetic coding sequence
atgctggacttcccccagcacgtgtccagtgacaaggaggtgcgggccgccagcacagaagctgacaagaggctgagcagatttgacatcgagatgtccatgagaggagacatctttgagcgcatcgtgcacctgcaggagacctgtgacctgggcaagatcaagccagaggcccggcgctacctggagaagagcatcaagatgggcaagagaaatggcctgcacctgcctgagcaggtgcagaatgagatcaagtccatgaagaagaggatgtctgagctgtgcatcgacttcaacaagaacctgaatgaagatgacaccttcctggtgttcagcaaggccgagctgggcgccctgcctgatgacttcatcgacagcctggagaagacagatgatgacaagtacaagatcaccctgaagtacccccactacttccctgtgatgaagaagtgctgcatccctgagaccaggaggaggatggagatggccttcaacacccgctgcaaggaggagaacaccatcatcctgcagcagctgctgcccctgcggaccaaggtggccaagctgctgggctacagcacccacgccgactttgtgctggagatgaacacagccaagagcaccagccgggtgacagccttcctggatgacctgagccagaagctgaagcccctgggggaggccgagcgggagttcatcctgaacctgaagaagaaggagtgcaaggaccggggctttgaatatgatggcaagatcaatgcctgggacctgtactactacatgacccagacagaggagctgaagtacagcattgaccaggagttcctgaaggagtacttccccatcgaggtggtgacagagggcctgctgaacacctaccaggagctgctgggcctgagctttgagcagatgacagatgcccacgtgtggaacaagtctgtgaccctgtacacagtgaaggacaaggccaccggggaggtgctgggccagttctacctggacctgtacccccgggagggcaagtacaaccacgccgcctgcttcggcctgcagcccggctgcctgctgcctgatggcagcaggatgatggctgtggccgccctggtggtgaacttcagccagcctgtggccggccggcccagcctgctgcggcatgatgaggtgaggacctacttccatgaatttggacatgtgatgcaccagatctgtgcccagacagactttgcccgcttcagcggcaccaacgtggagacagactttgtggaggtgcccagccagatgctggagaactgggtgtgggatgtggacagcctgcggcggctgagcaagcactacaaggatggcagccccatcgcagatgacctgctggagaagctggtggccagccggctggtgaacacaggcctgctgaccctgcggcagatcgtgctgagcaaggtggaccagagcctgcacaccaacaccagcctggatgctgcctctgaatatgccaagtactgcagcgagatcctgggcgtggccgccaccccaggcaccaacatgcctgccaccttcggccacctggccggcggctatgatggccagtactacggctacctgtggagcgaggtgttctccatggacatgttctacagctgcttcaagaaggagggcatcatgaaccctgaggtgggcatgaagtacagaaacctgatcctgaagccaggcggcagcctggatggcatggacatgctgcacaacttcctgaagcgggagcccaaccagaaggccttcctgatgagccggggcctgcacgccccctag

SEQ ID NO: 161663 - DNA, 366 bp, Artificial Sequence
  Description of Artificial Sequence: Synthetic coding sequence
atggccaggagagctggaggagccaggatgtttggcagcctgctgctgtttgccctgctggccgccggcgtggcccccctgtcctgggacctgcctgagcccaggagccgggccagcaagatccgggtgcacagccggggcaacctgtgggccaccggccacttcatgggcaagaagagcctggagcccagcagccccagccccctgggcacagccccccacaccagcctgcgggaccagaggctgcagctgagccatgacctgctgggcatcctgctgctgaagaaggccctgggcgtgtccctgagcaggcctgccccccagatccagtaccgccgcctgctggtgcagatcctgcagaagtag

SEQ ID NO: 161664 - DNA, 465 bp, Artificial Sequence
  Description of Artificial Sequence: Synthetic coding sequence
atggccaggagagctggaggagccaggatgtttggcagcctgctgctgtttgccctgctggccgccggcgtggcccccctgtcctgggacctgcctgagcccaggagccgggccagcaagatccgggtgcacagccggggcaacctgtgggccaccggccacttcatgggcaagaagagcctggagcccagcagccccagccccctgggcacagccccccacaccagcctgcgggaccagaggctgcagctgagccatgacctgctgggcatcctgctgctgaagaaggccctgggcgtgtccctgagcaggcctgccccccagatccaggaggccgccggcaccaacacagctgagatgacccccatcatgggccagacccagcagaggggcctggactgtgcccaccctgggaaggtgctgaatggcaccctgctgatggcccccagcggctgcaagagctag

SEQ ID NO: 161665 - DNA, 1173 bp, Artificial Sequence
  Description of Artificial Sequence: Synthetic coding sequence
atgcccagcaagagcctgagcaacctgtctgtgaccactggagccaatgaaagtggctctgtgcctgagggctgggagcgggacttcctgcctgccagtgatggcaccaccacagagctggtgatccgctgcgtcatccccagcctgtacctgctgatcatcaccgtgggcctgctgggcaacatcatgctggtgaagatcttcatcaccaacagcgccatgaggtctgtgcccaacatcttcatcagcaacctggccgccggggacctgctgctgctgctgacctgtgtgcctgtggatgccagccgctacttctttgatgagtggatgtttgggaaggtgggctgcaagctgatccctgtgatccagctgacctctgtgggcgtgtctgtgttcaccctgacagccctgtctgctgaccgctaccgggccatcgtgaaccccatggacatgcagaccagcggggccctgctgcggacctgtgtgaaggccatgggcatctgggtggtgtctgtgctgctggccgtgcctgaggccgtgttcagcgaggtggcccgcatcagcagcctggacaacagcagcttcaccgcctgcatcccctacccccagacagatgagctgcaccccaagatccacagcgtgctgatcttcctggtgtacttcctgatccccctggccatcatcagcatctactactaccacatcgccaagaccctcatcaagagcgcccacaacctgcctggagagtacaatgagcacaccaagaagcagatggagaccaggaagaggctggccaagatcgtgctggtgtttgtgggctgcttcatcttctgctggttccccaaccacatcctgtacatgtaccgctccttcaactacaatgaaattgaccccagcctgggccacatgattgtgaccctggtggcccgggtgctgagctttggaaacagctgtgtgaacccctttgccctgtacctgctgtctgagagcttccgccgccacttcaacagccagctgtgctgcggcaggaagagctaccaggagcggggcaccagctacctgctgagcagcagcgctgtgaggatgaccagcctgaagagcaatgccaagaacatggtgaccaacagcgtgctgctgaatggccacagcatgaagcaggagatggccctgtag

SEQ ID NO: 161666 - DNA, 1281 bp, Artificial Sequence
  Description of Artificial Sequence: Synthetic coding sequence
atgacccccctgtgcctgaactgcagcgtgctgcccggggacctgtacccaggaggagccaggaaccccatggcctgcaatggatctgctgcccggggccactttgatcctgaggacctgaacctgacagatgaggccctgcggctgaagtacctgggcccccagcagacagagctgttcatgcccatctgtgccacctacctgctgatctttgtggtgggcgctgtgggcaatggcctgacctgcctggtgatcctgcggcacaaggccatgaggacccccaccaactactacctgttcagcctggccgtgtctgacctgctggtgctgctggtgggcctgcccctggagctgtatgagatgtggcacaactaccccttcctgctgggcgtgggcggctgctacttccgcaccctgctgtttgagatggtgtgcctggcctctgtgctgaatgtgacagccctgtctgtggagcgctacgtggccgtggtgcaccccctgcaggcccgctccatggtgacccgggcccacgtgagaagagtgctgggcgctgtgtggggcctggccatgctgtgcagcctgcccaacaccagcctgcacggcatccggcagctgcacgtgccctgccggggccctgtgcctgacagcgctgtgtgcatgctggtgcggccccgggccctgtacaacatggtggtgcagaccacagccctgctcttcttctgcctgcccatggccatcatgtctgtgctgtacctgctgattggcctgcggctgcggcgggagcggctgctgctgatgcaggaggccaagggccggggcagcgctgctgcccggagccgctacacctgccgcctgcagcagcacgaccggggccggcggcaggtgaccaagatgctgtttgtgctggtggtggtgtttggcatctgctgggcccccttccacgccgacagagtgatgtggagcgtggtgtcccagtggacagatggcctgcacctggccttccagcacgtgcacgtgatcagcggcatcttcttctacctgggcagcgctgccaaccctgtgctgtacagcctgatgagcagccgcttccgggagaccttccaggaggccctgtgcctgggcgcctgctgccaccggctgcggcccaggcacagcagccacagcctgagcaggatgaccaccggcagcaccctgtgtgatgtgggcagcctgggctcctgggtgcaccccctggccggaaatgatggccctgaggcccagcaggagacagaccccagctag

SEQ ID NO: 161667 - DNA, 1248 bp, Artificial Sequence
  Description of Artificial Sequence: Synthetic coding sequence
atgagcggcatggagaagctgcagaatgcctcctggatctaccagcagaagctggaggaccccttccagaagcacctgaacagcacagaggagtacctggccttcctgtgtggcccccggcgcagccacttcttcctgcctgtgtctgtggtgtatgtgcccatctttgtggtgggcgtgattggaaatgtgctggtgtgcctggtgatcctgcagcaccaggccatgaagacccccaccaactactacctgttcagcctggccgtgtctgacctgctggtgctgctgctgggcatgcccctggaggtgtatgagatgtggaggaactaccccttcctgtttggacctgtgggctgctacttcaagacagccctgtttgagaccgtgtgctttgccagcatcctgagcatcaccaccgtgtctgtggagagatatgtggccatcctgcaccccttccgggccaagctgcagagcaccaggagaagagccctgcgcatcctgggcatcgtgtggggcttctctgtgctcttcagcctgcccaacaccagcatccacggcatcaagttccactacttccccaacggcagcctggtgcccggcagcgccacctgcaccgtcatcaagcccatgtggatctacaacttcatcatccaggtgaccagcttcctgttctacctgctgcccatgaccgtcatctctgtgctgtactacctgatggccctgcggctgaagaaggacaagagcctggaggctgatgagggcaatgccaacatccagaggccctgcaggaagtctgtgaacaagatgctgtttgtgctggtgctggtgtttgccatctgctgggcccccttccacatcgacaggctcttcttctcctttgtggaggagtggagcgagagcctggccgctgtgttcaacctggtgcacgtggtgtctggagtcttcttctacctgagcagcgctgtgaaccccatcatctacaacctgctgagccgccgcttccaggccgccttccagaatgtcatcagcagcttccacaagcagtggcacagccagcacgacccccagctgcccccagcccagaggaacatcttcctgacagagtgccactttgtggagctgacagaggacatcggcccccagttcccctgccagagctccatgcacaacagccacctgcctgctgccctgagcagcgagcagatgagcaggaccaactaccagagcttccacttcaacaagacctag

SEQ ID NO: 161668 - DNA, 5625 bp, Artificial Sequence
  Description of Artificial Sequence: Synthetic coding sequence
atgctgggcagctctgtgaagtctgtgcagcctgaggtggagctgagcagcggcggcggagatgaaggagcagatgagcccaggggggccggcaggaaggctgctgctgctgatggccggggcatgctgcccaagagggccaaggcccctgggggcggcggcggcatggccaaggccagcgctgctgagctgaaggtgttcaagagcggctctgtggacagccgggtgcctgggggccccccagccagcaacctgaggaagcagaagagcctgaccaacctgtccttcctgacagacagcgagaagaagctgcagctgtatgagcctgagtggagcgatgacatggccaaggcccccaagggcctgggcaaggtgggcagcaagggccgggaggcccccctgatgagcaagaccctgagcaagtctgagcacagcctcttccaggccaagggcagccctgctgggggcgccaagacccccctggcccccctggcccccaacctgggcaagcccagccgcatcccccggggcccctatgcagaggtgaagcccctgagcaaggcccctgaggccgctgtgtctgaagatggcaagagtgatgatgagctgctgagcagcaaggccaaggcccagaagagcagcggccctgtgcccagcgccaagggccaggaggagcgggccttcctgaaggtggaccctgagctggtggtgacagtgctgggggacctggagcagctgctcttcagccagatgctggaccctgagagccagaggaagaggacagtgcagaatgtgctggacctgcggcagaacctggaggagaccatgagcagcctgcggggcagccaggtgacccacagcagcctggagatgacctgctatgacagtgatgatgccaaccccaggtctgtgagcagcctgagcaacagaagcagccccctgtcctggaggtatggccagagcagcccccggctgcaggccggagatgcccccagcgtgggcggcagctgccgctctgagggcaccccagcctggtacatgcacggggagcgggcccactacagccacaccatgcccatgaggagccccagcaagctgagccacatcagccggctggagctggtggagagcctggacagtgatgaggtggacctgaagagcggctacatgtctgacagcgacctgatgggcaagaccatgacagaagatgatgacatcaccaccggctgggatgagagcagcagcatcagcagcggcctgagtgatgccagtgacaacctgagcagcgaggagttcaatgccagcagcagcctgaacagcctgcccagcacccccacagccagcagaagaaacagcaccatcgtgctgaggacagacagcgagaagaggagcctggccgagagcggcctgtcctggttcagcgagagcgaggagaaggcccccaagaagctggagtatgacagcggcagcctgaagatggagcccggcaccagcaagtggaggcgggagaggcctgagagctgtgatgacagcagcaaaggaggagagctgaagaagcccatcagcctgggccaccctggcagcctgaagaagggcaagaccccacctgtggccgtgaccagccccatcacccacacagcccagagcgccctgaaggtggccggcaagccagagggcaaggccacagacaagggcaagctggccgtgaagaacacaggcctgcagaggagcagcagtgatgctggccgggaccggctgagtgatgccaagaagccacccagcggcatcgcccggcccagcaccagcggcagctttggctacaagaagcccccaccagccaccggcacagccaccgtgatgcagacaggaggcagcgccaccctgagcaagatccagaagagcagcggcatccctgtgaagcctgtgaatggaaggaagaccagcctggatgtgagcaacagcgctgagcccggcttcctggcccctggggcccggagcaacatccagtaccgcagcctgcccaggcctgccaagagcagctccatgtctgtgactggaggccggggcggccccaggcctgtgagcagcagcattgaccccagcctgctgagcaccaagcagggcggcctgacccccagccggctgaaggagcccaccaaggtggccagcggccgcaccaccccagcccctgtgaaccagacagaccgggagaaggagaaggccaaggccaaggctgtggccctggacagcgacaacatcagcctgaagagcatcggcagccctgagagcacccccaagaaccaggccagccaccccacagccaccaagctggccgagctgccccccacccccctgcgggccacagccaagagctttgtgaagccacccagcctggccaacctggacaaggtgaacagcaacagcctggacctgcccagcagcagtgacaccacccacgccagcaaggtgcctgacctgcacgccaccagcagcgccagcggcggccccctgcccagctgcttcacccccagccctgcccccatcctgaacatcaacagcgccagcttcagccagggcctggagctgatgagcggcttctctgtgcccaaggagaccaggatgtaccccaagctgagcggcctgcaccgctccatggagagcctgcagatgcccatgagcctgcccagcgccttccccagcagcacccctgtgcccaccccaccagcccccccagctgcccccacagaggaggagacagaggagctgacctggagcggcagcccccgggccggccagctggacagcaaccagagggacaggaacaccctgcccaagaagggcctgcgctaccagctgcagagccaggaggagaccaaggagaggaggcacagccacaccatcggcggcctgcctgagagtgatgaccagagcgagctgcccagccccccagccctgcccatgagcctgagcgccaagggccagctgaccaacatcgtgagccccacagctgccaccaccccccgcatcaccaggagcaacagcatccccacccatgaggccgcctttgagctgtacagcggcagccagatgggcagcaccctgagcctggccgagcggcccaagggcatgatccgcagcggcagcttccgggaccccacagatgatgtgcacggctctgtgctgagcctggccagcagcgccagcagcacctacagcagcgctgaggagaggatgcagagcgagcagatcaggaagctgcggcgggagctggagagcagccaggagaaggtggccaccctgaccagccagctgagcgccaatgccaacctggtggccgcctttgagcagagcctggtgaacatgaccagccggctgcggcacctggccgagacagctgaggagaaggacacagagctgctggacctgcgggagaccatcgacttcctgaagaagaagaacagcgaggcccaggccgtcatccagggcgccctgaatgccagcgagaccacccccaaggagctgcgcatcaagaggcagaacagcagtgacagcatcagcagcctgaacagcatcaccagccacagcagcatcggcagcagcaaggatgctgatgccaagaagaagaagaagaagtcctggctgcggagcagcttcaacaaggccttcagcatcaagaagggccccaagagcgccagcagctacagcgacatcgaggagatcgccaccccagacagcagcgcccccagcagccccaagctgcagcacggcagcacagaaacagccagccccagcatcaagagcagcaccagcagctctgtgggcacagatgtgacagagggccctgcccacccagccccccacaccaggctcttccacgccaatgaggaggaggagcctgagaagaaggaggtgtctgagctgcggtctgagctgtgggagaaggagatgaagctgacagacatccggctggaggccctgaacagcgcccaccagctggaccagctgcgggagaccatgcacaacatgcagctggaggtggacctgctgaaggccgagaatgaccggctgaaggtggcccctggccccagcagcggcagcaccccaggccaggtgcccggcagcagcgccctgagcagccccaggaggagcctgggcctggccctgacccacagctttggccccagcctggccgacacagacctgagccccatggatggcatcagcacctgtggccccaaggaggaggtgaccctgcgggtggtggtgaggatgccaccccagcacatcatcaagggggacctgaagcagcaggagttcttcctgggctgcagcaaggtgtctgggaaggtggactggaagatgctggatgaggccgtgttccaggtgttcaaggactacatcagcaagatggaccctgccagcaccctgggcctgagcacagagagcatccacggctacagcatcagccacgtgaagagggtgctggatgctgagcccccagagatgccaccctgccggcggggcgtgaacaacatctctgtgtccctgaagggcctgaaggagaagtgtgtggacagcctggtgtttgagaccctcatccccaagcccatgatgcagcactacatcagcctgctgctgaagcaccggcggctggtgctgagcggccccagcggcaccgggaagacctacctgaccaaccggctggccgagtacctggtggagaggagcggccgggaggtgacagagggcatcgtgtccaccttcaacatgcaccagcagagctgcaaggacctgcagctgtacctgagcaacctggccaaccagattgaccgggagactggaattggagatgtgcccctggtgatcctgctggatgacctgtctgaggccggcagcatcagcgagctggtgaatggagccctgacctgcaagtaccacaagtgcccctacatcatcggcaccaccaaccagcctgtgaagatgacccccaaccacggcctgcacctgtccttcaggatgctgaccttcagcaacaacgtggagcccgccaacggcttcctggtgcgctacctgcggaggaagctggtggagagtgacagcgacatcaatgccaacaaggaggagctgctgcgggtgctggactgggtgcccaagctgtggtaccacctgcacaccttcctggagaagcacagcaccagtgacttcctgattggcccctgcttcttcctgagctgccccatcggcatcgaggacttccgcacctggttcatcgacctgtggaacaacagcatcatcccctacctgcaggagggcgccaaggatggcatcaaggtgcacggccagaaggccgcctgggaggaccctgtggagtgggtgcgggacaccctgccctggcccagcgcccagcaggaccagagcaagctgtaccacctgcccccacccaccgtgggcccccacagcatcgccagccccccagaggacagaacagtgaaggacagcacccccagcagcctggacagcgaccccctgatggccatgctgctgaagctgcaggaggccgccaactacatcgagagcccagaccgggagaccatcctggaccccaacctgcaggccaccctgtag

SEQ ID NO: 161669 - DNA, 5634 bp, Artificial Sequence
  Description of Artificial Sequence: Synthetic coding sequence
atgctgggcagctctgtgaagtctgtgcagcctgaggtggagctgagcagcggcggcggagatgaaggagcagatgagcccaggggggccggcaggaaggctgctgctgctgatggccggggcatgctgcccaagagggccaaggcccctgggggcggcggcggcatggccaaggccagcgctgctgagctgaaggtgttcaagagcggctctgtggacagccgggtgcctgggggccccccagccagcaacctgaggaagcagaagagcctgaccaacctgtccttcctgacagacagcgagaagaagctgcagctgtatgagcctgagtggagcgatgacatggccaaggcccccaagggcctgggcaaggtgggcagcaagggccgggaggcccccctgatgagcaagaccctgagcaagtctgagcacagcctcttccaggccaagggcagccctgctgggggcgccaagacccccctggcccccctggcccccaacctgggcaagcccagccgcatcccccggggcccctatgcagaggtgaagcccctgagcaaggcccctgaggccgctgtgtctgaagatggcaagagtgatgatgagctgctgagcagcaaggccaaggcccagaagagcagcggccctgtgcccagcgccaagggccaggaggagcgggccttcctgaaggtggaccctgagctggtggtgacagtgctgggggacctggagcagctgctcttcagccagatgctggaccctgagagccagaggaagaggacagtgcagaatgtgctggacctgcggcagaacctggaggagaccatgagcagcctgcggggcagccaggtgacccacagcagcctggagatgacctgctatgacagtgatgatgccaaccccaggtctgtgagcagcctgagcaacagaagcagccccctgtcctggaggtatggccagagcagcccccggctgcaggccggagatgcccccagcgtgggcggcagctgccgctctgagggcaccccagcctggtacatgcacggggagcgggcccactacagccacaccatgcccatgaggagccccagcaagctgagccacatcagccggctggagctggtggagagcctggacagtgatgaggtggacctgaagagcggctacatgtctgacagcgacctgatgggcaagaccatgacagaagatgatgacatcaccaccggctgggatgagagcagcagcatcagcagcggcctgagtgatgccagtgacaacctgagcagcgaggagttcaatgccagcagcagcctgaacagcctgcccagcacccccacagccagcagaagaaacagcaccatcgtgctgaggacagacagcgagaagaggagcctggccgagagcggcctgtcctggttcagcgagagcgaggagaaggcccccaagaagctggagtatgacagcggcagcctgaagatggagcccggcaccagcaagtggaggcgggagaggcctgagagctgtgatgacagcagcaaaggaggagagctgaagaagcccatcagcctgggccaccctggcagcctgaagaagggcaagaccccacctgtggccgtgaccagccccatcacccacacagcccagagcgccctgaaggtggccggcaagccagagggcaaggccacagacaagggcaagctggccgtgaagaacacaggcctgcagaggagcagcagtgatgctggccgggaccggctgagtgatgccaagaagccacccagcggcatcgcccggcccagcaccagcggcagctttggctacaagaagcccccaccagccaccggcacagccaccgtgatgcagacaggaggcagcgccaccctgagcaagatccagaagagcagcggcatccctgtgaagcctgtgaatggaaggaagaccagcctggatgtgagcaacagcgctgagcccggcttcctggcccctggggcccggagcaacatccagtaccgcagcctgcccaggcctgccaagagcagctccatgtctgtgactggaggccggggcggccccaggcctgtgagcagcagcattgaccccagcctgctgagcaccaagcagggcggcctgacccccagccggctgaaggagcccaccaaggtggccagcggccgcaccaccccagcccctgtgaaccagacagaccgggagaaggagaaggccaaggccaaggctgtggccctggacagcgacaacatcagcctgaagagcatcggcagccctgagagcacccccaagaaccaggccagccaccccacagccaccaagctggccgagctgccccccacccccctgcgggccacagccaagagctttgtgaagccacccagcctggccaacctggacaaggtgaacagcaacagcctggacctgcccagcagcagtgacaccacccacgccagcaaggtgcctgacctgcacgccaccagcagcgccagcggcggccccctgcccagctgcttcacccccagccctgcccccatcctgaacatcaacagcgccagcttcagccagggcctggagctgatgagcggcttctctgtgcccaaggagaccaggatgtaccccaagctgagcggcctgcaccgctccatggagagcctgcagatgcccatgagcctgcccagcgccttccccagcagcacccctgtgcccaccccaccagcccccccagctgcccccacagaggaggagacagaggagctgacctggagcggcagcccccgggccggccagctggacagcaaccagagggacaggaacaccctgcccaagaagggcctgcgctaccagctgcagagccaggaggagaccaaggagaggaggcacagccacaccatcggcggcctgcctgagagtgatgaccagagcgagctgcccagccccccagccctgcccatgagcctgagcgccaagggccagctgaccaacatcgtgagccccacagctgccaccaccccccgcatcaccaggagcaacagcatccccacccatgaggccgcctttgagctgtacagcggcagccagatgggcagcaccctgagcctggccgagcggcccaagggcatgatccgcagcggcagcttccgggaccccacagatgatgtgcacggctctgtgctgagcctggccagcagcgccagcagcacctacagcagcgctgaggagaggatgcagagcgagcagatcaggaagctgcggcgggagctggagagcagccaggagaaggtggccaccctgaccagccagctgagcgccaatgccaacctggtggccgcctttgagcagagcctggtgaacatgaccagccggctgcggcacctggccgagacagctgaggagaaggacacagagctgctggacctgcgggagaccatcgacttcctgaagaagaagaacagcgaggcccaggccgtcatccagggcgccctgaatgccagcgagaccacccccaaggagctgcgcatcaagaggcagaacagcagtgacagcatcagcagcctgaacagcatcaccagccacagcagcatcggcagcagcaaggatgctgatgccaagaagaagaagaagaagtcctgggtgtatgagctgcggagcagcttcaacaaggccttcagcatcaagaagggccccaagagcgccagcagctacagcgacatcgaggagatcgccaccccagacagcagcgcccccagcagccccaagctgcagcacggcagcacagaaacagccagccccagcatcaagagcagcaccagcagctctgtgggcacagatgtgacagagggccctgcccacccagccccccacaccaggctcttccacgccaatgaggaggaggagcctgagaagaaggaggtgtctgagctgcggtctgagctgtgggagaaggagatgaagctgacagacatccggctggaggccctgaacagcgcccaccagctggaccagctgcgggagaccatgcacaacatgcagctggaggtggacctgctgaaggcagaaaatgaccggctgaaggtggcccctggccccagcagcggcagcaccccaggccaggtgcccggcagcagcgccctgagcagcccccggcgcagcctgggcctggccctgacccacagctttggccccagcctggccgacacagacctgagccccatggatggcatcagcacctgtggccccaaggaggaggtgaccctgcgggtggtggtgaggatgccaccccagcacatcatcaagggggacctgaagcagcaggagttcttcctgggctgcagcaaggtgtctgggaaggtggactggaagatgctggatgaagctgtgttccaggtgttcaaggactacatcagcaagatggaccctgccagcaccctgggcctgagcacagagagcatccacggctacagcatcagccacgtgaagagggtgctggatgctgagcccccagagatgccaccctgcagaagaggagtgaacaacatctctgtgtccctgaagggcctgaaggagaagtgtgtggacagcctggtgtttgagaccctcatccccaagcccatgatgcagcactacatcagcctgctgctgaagcaccggcggctggtgctgagcggccccagcggcaccgggaagacctacctgaccaaccggctggccgagtacctggtggagaggagcggccgggaggtgacagagggcatcgtgtccaccttcaacatgcaccagcagagctgcaaggacctgcagctgtacctgagcaacctggccaaccagattgaccgggagaccggcattggagatgtgcccctggtgatcctgctggatgacctgtctgaggccggcagcatcagcgagctggtgaatggagccctgacctgcaagtaccacaagtgcccctacatcatcggcaccaccaaccagcctgtgaagatgacccccaaccacggcctgcacctgtccttcaggatgctgaccttcagcaacaacgtggagcccgccaacggcttcctggtgcgctacctgcggaggaagctggtggagagtgacagcgacatcaatgccaacaaggaggagctgctgcgggtgctggactgggtgcccaagctgtggtaccacctgcacaccttcctggagaagcacagcaccagtgacttcctgattggcccctgcttcttcctgagctgccccatcggcatcgaggacttccgcacctggttcatcgacctgtggaacaacagcatcatcccctacctgcaggagggcgccaaggatggcatcaaggtgcacggccagaaggccgcctgggaggaccctgtggagtgggtgcgggacaccctgccctggcccagcgcccagcaggaccagagcaagctgtaccacctgcccccacccaccgtgggcccccacagcatcgccagccccccagaggacagaacagtgaaggacagcacccccagcagcctggacagcgaccccctgatggccatgctgctgaagctgcaggaggccgccaactacatcgagagcccagaccgggagaccatcctggaccccaacctgcaggccaccctgtag

SEQ ID NO: 161670 - DNA, 5610 bp, Artificial Sequence
  Description of Artificial Sequence: Synthetic coding sequence
atgctgggcagctctgtgaagtctgtgcagcctgaggtggagctgagcagcggcggcggagatgaaggagcagatgagcccaggggggccggcaggaaggctgctgctgctgatggccggggcatgctgcccaagagggccaaggcccctgggggcggcggcggcatggccaaggccagcgctgctgagctgaaggtgttcaagagcggctctgtggacagccgggtgcctgggggccccccagccagcaacctgaggaagcagaagagcctgaccaacctgtccttcctgacagacagcgagaagaagctgcagctgtatgagcctgagtggagcgatgacatggccaaggcccccaagggcctgggcaaggtgggcagcaagggccgggaggcccccctgatgagcaagaccctgagcaagtctgagcacagcctcttccaggccaagggcagccctgctgggggcgccaagacccccctggcccccctggcccccaacctgggcaagcccagccgcatcccccggggcccctatgcagaggtgaagcccctgagcaaggcccctgaggccgctgtgtctgaagatggcaagagtgatgatgagctgctgagcagcaaggccaaggcccagaagagcagcggccctgtgcccagcgccaagggccaggaggagcgggccttcctgaaggtggaccctgagctggtggtgacagtgctgggggacctggagcagctgctcttcagccagatgctggaccctgagagccagaggaagaggacagtgcagaatgtgctggacctgcggcagaacctggaggagaccatgagcagcctgcggggcagccaggtgacccacagcagcctggagatgacctgctatgacagtgatgatgccaaccccaggtctgtgagcagcctgagcaacagaagcagccccctgtcctggaggtatggccagagcagcccccggctgcaggccggagatgcccccagcgtgggcggcagctgccgctctgagggcaccccagcctggtacatgcacggggagcgggcccactacagccacaccatgcccatgaggagccccagcaagctgagccacatcagccggctggagctggtggagagcctggacagtgatgaggtggacctgaagagcggctacatgtctgacagcgacctgatgggcaagaccatgacagaagatgatgacatcaccaccggctgggatgagagcagcagcatcagcagcggcctgagtgatgccagtgacaacctgagcagcgaggagttcaatgccagcagcagcctgaacagcctgcccagcacccccacagccagcagaagaaacagcaccatcgtgctgaggacagacagcgagaagaggagcctggccgagagcggcctgtcctggttcagcgagagcgaggagaaggcccccaagaagctggagtatgacagcggcagcctgaagatggagcccggcaccagcaagtggaggcgggagaggcctgagagctgtgatgacagcagcaaaggaggagagctgaagaagcccatcagcctgggccaccctggcagcctgaagaagggcaagaccccacctgtggccgtgaccagccccatcacccacacagcccagagcgccctgaaggtggccggcaagccagagggcaaggccacagacaagggcaagctggccgtgaagaacacaggcctgcagaggagcagcagtgatgctggccgggaccggctgagtgatgccaagaagccacccagcggcatcgcccggcccagcaccagcggcagctttggctacaagaagcccccaccagccaccggcacagccaccgtgatgcagacaggaggcagcgccaccctgagcaagatccagaagagcagcggcatccctgtgaagcctgtgaatggaaggaagaccagcctggatgtgagcaacagcgctgagcccggcttcctggcccctggggcccggagcaacatccagtaccgcagcctgcccaggcctgccaagagcagctccatgtctgtgactggaggccggggcggccccaggcctgtgagcagcagcattgaccccagcctgctgagcaccaagcagggcggcctgacccccagccggctgaaggagcccaccaaggtggccagcggccgcaccaccccagcccctgtgaaccagacagaccgggagaaggagaaggccaaggccaaggctgtggccctggacagcgacaacatcagcctgaagagcatcggcagccctgagagcacccccaagaaccaggccagccaccccacagccaccaagctggccgagctgccccccacccccctgcgggccacagccaagagctttgtgaagccacccagcctggccaacctggacaaggtgaacagcaacagcctggacctgcccagcagcagtgacaccacccacgccagcaaggtgcctgacctgcacgccaccagcagcgccagcggcggccccctgcccagctgcttcacccccagccctgcccccatcctgaacatcaacagcgccagcttcagccagggcctggagctgatgagcggcttctctgtgcccaaggagaccaggatgtaccccaagctgagcggcctgcaccgctccatggagagcctgcagatgcccatgagcctgcccagcgccttccccagcagcacccctgtgcccaccccaccagcccccccagctgcccccacagaggaggagacagaggagctgacctggagcggcagcccccgggccggccagctggacagcaaccagagggacaggaacaccctgcccaagaagggcctgcgctaccagctgcagagccaggaggagaccaaggagaggaggcacagccacaccatcggcggcctgcctgagagtgatgaccagagcgagctgcccagccccccagccctgcccatgagcctgagcgccaagggccagctgaccaacatcgtgagccccacagctgccaccaccccccgcatcaccaggagcaacagcatccccacccatgaggccgcctttgagctgtacagcggcagccagatgggcagcaccctgagcctggccgagcggcccaagggcatgatccgcagcggcagcttccgggaccccacagatgatgtgcacggctctgtgctgagcctggccagcagcgccagcagcacctacagcagccagatcaggaagctgcggcgggagctggagagcagccaggagaaggtggccaccctgaccagccagctgagcgccaatgccaacctggtggccgcctttgagcagagcctggtgaacatgaccagccggctgcggcacctggccgagacagctgaggagaaggacacagagctgctggacctgcgggagaccatcgacttcctgaagaagaagaacagcgaggcccaggccgtcatccagggcgccctgaatgccagcgagaccacccccaaggagctgcgcatcaagaggcagaacagcagtgacagcatcagcagcctgaacagcatcaccagccacagcagcatcggcagcagcaaggatgctgatgccaagaagaagaagaagaagtcctgggtgtatgagctgcggagcagcttcaacaaggccttcagcatcaagaagggccccaagagcgccagcagctacagcgacatcgaggagatcgccaccccagacagcagcgcccccagcagccccaagctgcagcacggcagcacagaaacagccagccccagcatcaagagcagcaccagcagctctgtgggcacagatgtgacagagggccctgcccacccagccccccacaccaggctcttccacgccaatgaggaggaggagcctgagaagaaggaggtgtctgagctgcggtctgagctgtgggagaaggagatgaagctgacagacatccggctggaggccctgaacagcgcccaccagctggaccagctgcgggagaccatgcacaacatgcagctggaggtggacctgctgaaggcagaaaatgaccggctgaaggtggcccctggccccagcagcggcagcaccccaggccaggtgcccggcagcagcgccctgagcagcccccggcgcagcctgggcctggccctgacccacagctttggccccagcctggccgacacagacctgagccccatggatggcatcagcacctgtggccccaaggaggaggtgaccctgcgggtggtggtgaggatgccaccccagcacatcatcaagggggacctgaagcagcaggagttcttcctgggctgcagcaaggtgtctgggaaggtggactggaagatgctggatgaagctgtgttccaggtgttcaaggactacatcagcaagatggaccctgccagcaccctgggcctgagcacagagagcatccacggctacagcatcagccacgtgaagagggtgctggatgctgagcccccagagatgccaccctgcagaagaggagtgaacaacatctctgtgtccctgaagggcctgaaggagaagtgtgtggacagcctggtgtttgagaccctcatccccaagcccatgatgcagcactacatcagcctgctgctgaagcaccggcggctggtgctgagcggccccagcggcaccgggaagacctacctgaccaaccggctggccgagtacctggtggagaggagcggccgggaggtgacagagggcatcgtgtccaccttcaacatgcaccagcagagctgcaaggacctgcagctgtacctgagcaacctggccaaccagattgaccgggagaccggcattggagatgtgcccctggtgatcctgctggatgacctgtctgaggccggcagcatcagcgagctggtgaatggagccctgacctgcaagtaccacaagtgcccctacatcatcggcaccaccaaccagcctgtgaagatgacccccaaccacggcctgcacctgtccttcaggatgctgaccttcagcaacaacgtggagcccgccaacggcttcctggtgcgctacctgcggaggaagctggtggagagtgacagcgacatcaatgccaacaaggaggagctgctgcgggtgctggactgggtgcccaagctgtggtaccacctgcacaccttcctggagaagcacagcaccagtgacttcctgattggcccctgcttcttcctgagctgccccatcggcatcgaggacttccgcacctggttcatcgacctgtggaacaacagcatcatcccctacctgcaggagggcgccaaggatggcatcaaggtgcacggccagaaggccgcctgggaggaccctgtggagtgggtgcgggacaccctgccctggcccagcgcccagcaggaccagagcaagctgtaccacctgcccccacccaccgtgggcccccacagcatcgccagccccccagaggacagaacagtgaaggacagcacccccagcagcctggacagcgaccccctgatggccatgctgctgaagctgcaggaggccgccaactacatcgagagcccagaccgggagaccatcctggaccccaacctgcaggccaccctgtag

SEQ ID NO: 161671 - DNA, 5454 bp, Artificial Sequence
  Description of Artificial Sequence: Synthetic coding sequence
atgctgggcagctctgtgaagtctgtgcagcctgaggtggagctgagcagcggcggcggagatgaaggagcagatgagcccaggggggccggcaggaaggctgctgctgctgatggccggggcatgctgcccaagagggccaaggcccctgggggcggcggcggcatggccaaggccagcgctgctgagctgaaggtgttcaagagcggctctgtggacagccgggtgcctgggggccccccagccagcaacctgaggaagcagaagagcctgaccaacctgtccttcctgacagacagcgagaagaagctgcagctgtatgagcctgagtggagcgatgacatggccaaggcccccaagggcctgggcaaggtgggcagcaagggccgggaggcccccctgatgagcaagaccctgagcaagtctgagcacagcctcttccaggccaagggcagccctgctgggggcgccaagacccccctggcccccctggcccccaacctgggcaagcccagccgcatcccccggggcccctatgcagaggtgaagcccctgagcaaggcccctgaggccgctgtgtctgaagatggcaagagtgatgatgagctgctgagcagcaaggccaaggcccagaagagcagcggccctgtgcccagcgccaagggccaggaggagcgggccttcctgaaggtggaccctgagctggtggtgacagtgctgggggacctggagcagctgctcttcagccagatgctggaccctgagagccagaggaagaggacagtgcagaatgtgctggacctgcggcagaacctggaggagaccatgagcagcctgcggggcagccaggtgacccacagcagcctggagatgacctgctatgacagtgatgatgccaaccccaggtctgtgagcagcctgagcaacagaagcagccccctgtcctggaggtatggccagagcagcccccggctgcaggccggagatgcccccagcgtgggcggcagctgccgctctgagggcaccccagcctggtacatgcacggggagcgggcccactacagccacaccatgcccatgaggagccccagcaagctgagccacatcagccggctggagctggtggagagcctggacagtgatgaggtggacctgaagagcggctacatgtctgacagcgacctgatgggcaagaccatgacagaagatgatgacatcaccaccggctgggatgagagcagcagcatcagcagcggcctgagtgatgccagtgacaacctgagcagcgaggagttcaatgccagcagcagcctgaacagcctgcccagcacccccacagccagcagaagaaacagcaccatcgtgctgaggacagacagcgagaagaggagcctggccgagagcggcctgtcctggttcagcgagagcgaggagaaggcccccaagaagctggagtatgacagcggcagcctgaagatggagcccggcaccagcaagtggaggcgggagaggcctgagagctgtgatgacagcagcaaaggaggagagctgaagaagcccatcagcctgggccaccctggcagcctgaagaagggcaagaccccacctgtggccgtgaccagccccatcacccacacagcccagagcgccctgaaggtggccggcaagccagagggcaaggccacagacaagggcaagctggccgtgaagaacacaggcctgcagaggagcagcagtgatgctggccgggaccggctgagtgatgccaagaagccacccagcggcatcgcccggcccagcaccagcggcagctttggctacaagaagcccccaccagccaccggcacagccaccgtgatgcagacaggaggcagcgccaccctgagcaagatccagaagagcagcggcatccctgtgaagcctgtgaatggaaggaagaccagcctggatgtgagcaacagcgctgagcccggcttcctggcccctggggcccggagcaacatccagtaccgcagcctgcccaggcctgccaagagcagctccatgtctgtgactggaggccggggcggccccaggcctgtgagcagcagcattgaccccagcctgctgagcaccaagcagggcggcctgacccccagccggctgaaggagcccaccaaggtggccagcggccgcaccaccccagcccctgtgaaccagacagaccgggagaaggagaaggccaaggccaaggctgtggccctggacagcgacaacatcagcctgaagagcatcggcagccctgagagcacccccaagaaccaggccagccaccccacagccaccaagctggccgagctgccccccacccccctgcgggccacagccaagagctttgtgaagccacccagcctggccaacctggacaaggtgaacagcaacagcctggacctgcccagcagcagtgacaccacccacgccagcaaggtgcctgacctgcacgccaccagcagcgccagcggcggccccctgcccagctgcttcacccccagccctgcccccatcctgaacatcaacagcgccagcttcagccagggcctggagctgatgagcggcttctctgtgcccaaggagaccaggatgtaccccaagctgagcggcctgcaccgctccatggagagcctgcagatgcccatgagcctgcccagcgccttccccagcagcacccctgtgcccaccccaccagcccccccagctgcccccacagaggaggagacagaggagctgacctggagcggcagcccccgggccggccagctggacagcaaccagagggacaggaacaccctgcccaagaagggcctgcgctaccagctgcagagccaggaggagaccaaggagaggaggcacagccacaccatcggcggcctgcctgagagtgatgaccagagcgagctgcccagccccccagccctgcccatgagcctgagcgccaagggccagctgaccaacatcgtgcacggctctgtgctgagcctggccagcagcgccagcagcacctacagcagcgctgaggagaggatgcagagcgagcagatcaggaagctgcggcgggagctggagagcagccaggagaaggtggccaccctgaccagccagctgagcgccaatgccaacctggtggccgcctttgagcagagcctggtgaacatgaccagccggctgcggcacctggccgagacagctgaggagaaggacacagagctgctggacctgcgggagaccatcgacttcctgaagaagaagaacagcgaggcccaggccgtcatccagggcgccctgaatgccagcgagaccacccccaaggagctgcgcatcaagaggcagaacagcagtgacagcatcagcagcctgaacagcatcaccagccacagcagcatcggcagcagcaaggatgctgatgccaagaagaagaagaagaagtcctggctgcggagcagcttcaacaaggccttcagcatcaagaagggccccaagagcgccagcagctacagcgacatcgaggagatcgccaccccagacagcagcgcccccagcagccccaagctgcagcacggcagcacagaaacagccagccccagcatcaagagcagcaccagcagctctgtgggcacagatgtgacagagggccctgcccacccagccccccacaccaggctcttccacgccaatgaggaggaggagcctgagaagaaggaggtgtctgagctgcggtctgagctgtgggagaaggagatgaagctgacagacatccggctggaggccctgaacagcgcccaccagctggaccagctgcgggagaccatgcacaacatgcagctggaggtggacctgctgaaggcagaaaatgaccggctgaaggtggcccctggccccagcagcggcagcaccccaggccaggtgcccggcagcagcgccctgagcagcccccggcgcagcctgggcctggccctgacccacagctttggccccagcctggccgacacagacctgagccccatggatggcatcagcacctgtggccccaaggaggaggtgaccctgcgggtggtggtgaggatgccaccccagcacatcatcaagggggacctgaagcagcaggagttcttcctgggctgcagcaaggtgtctgggaaggtggactggaagatgctggatgaagctgtgttccaggtgttcaaggactacatcagcaagatggaccctgccagcaccctgggcctgagcacagagagcatccacggctacagcatcagccacgtgaagagggtgctggatgctgagcccccagagatgccaccctgcagaagaggagtgaacaacatctctgtgtccctgaagggcctgaaggagaagtgtgtggacagcctggtgtttgagaccctcatccccaagcccatgatgcagcactacatcagcctgctgctgaagcaccggcggctggtgctgagcggccccagcggcaccgggaagacctacctgaccaaccggctggccgagtacctggtggagaggagcggccgggaggtgacagagggcatcgtgtccaccttcaacatgcaccagcagagctgcaaggacctgcagctgtacctgagcaacctggccaaccagattgaccgggagaccggcattggagatgtgcccctggtgatcctgctggatgacctgtctgaggccggcagcatcagcgagctggtgaatggagccctgacctgcaagtaccacaagtgcccctacatcatcggcaccaccaaccagcctgtgaagatgacccccaaccacggcctgcacctgtccttcaggatgctgaccttcagcaacaacgtggagcccgccaacggcttcctggtgcgctacctgcggaggaagctggtggagagtgacagcgacatcaatgccaacaaggaggagctgctgcgggtgctggactgggtgcccaagctgtggtaccacctgcacaccttcctggagaagcacagcaccagtgacttcctgattggcccctgcttcttcctgagctgccccatcggcatcgaggacttccgcacctggttcatcgacctgtggaacaacagcatcatcccctacctgcaggagggcgccaaggatggcatcaaggtgcacggccagaaggccgcctgggaggaccctgtggagtgggtgcgggacaccctgccctggcccagcgcccagcaggaccagagcaagctgtaccacctgcccccacccaccgtgggcccccacagcatcgccagccccccagaggacagaacagtgaaggacagcacccccagcagcctggacagcgaccccctgatggccatgctgctgaagctgcaggaggccgccaactacatcgagagcccagaccgggagaccatcctggaccccaacctgcaggccaccctgtag

SEQ ID NO: 161672 - DNA, 783 bp, Artificial Sequence
  Description of Artificial Sequence: Synthetic coding sequence
atgcaccagcagagctgcaaggacctgcagctgtacctgagcaacctggccaaccagattgaccgggagaccggcattggagatgtgcccctggtgatcctgctggatgacctgtctgaggccggcagcatcagcgagctggtgaatggagccctgacctgcaagtaccacaagtgcccctacatcatcggcaccaccaaccagcctgtgaagatgacccccaaccacggcctgcacctgtccttcagcaggatgctgaccttcagcaacaacgtggagcccgccaacggcttcctggtgcgctacctgcggaggaagctggtggagagtgacagcgacatcaatgccaacaaggaggagctgctgcgggtgctggactgggtgcccaagctgtggtaccacctgcacaccttcctggagaagcacagcaccagtgacttcctgattggcagcccctgcttcttcctgagctgccccatcggcatcgaggacttccgcacctggttcatcgacctgtggaacaacagcatcatcccctacctgcaggagggcgccaaggatggcatcaaggtgcacggccagaaggccgcctgggaggaccctgtggagtgggtgcgggacaccctgccctggcccagcgcccagcaggatgacagcacccccagcagcctggacagcgaccccctgatggccatgctgctgaagctgcaggaggccgccaactacatcgagagcccagaccgggagaccatcctggaccccaacctgcaggccaccctgtag

SEQ ID NO: 161673 - DNA, 2193 bp, Artificial Sequence
  Description of Artificial Sequence: Synthetic coding sequence
atggagcccggcaccagcaagtggaggcgggagaggcctgagagctgtgatgacagcagcaaaggaggagagctgaagaagcccatcagcctgggccaccctggcagcctgaagaagggcaagaccccacctgtggccgtgaccagccccatcacccacacagcccagagcgccctgaaggtggccggcaagccagagggcaaggccacagacaagggcaagctggccgtgaagaacacaggcctgcagaggagcagcagtgatgctggccgggaccggctgagtgatgccaagaagccacccagcggcatcgcccggcccagcaccagcggcagctttggctacaagaagcccccaccagccaccggcacagccaccgtgatgcagacaggaggcagcgccaccctgagcaagatccagaagagcagcggcatccctgtgaagcctgtgaatggaaggaagaccagcctggatgtgagcaacagcgctgagcccggcttcctggcccctggggcccggagcaacatccagtaccgcagcctgcccaggcctgccaagagcagctccatgtctgtgactggaggccggggcggccccaggcctgtgagcagcagcattgaccccagcctgctgagcaccaagcagggcggcctgacccccagccggctgaaggagcccaccaaggtggccagcggccgcaccaccccagcccctgtgaaccagacagaccgggagaaggagaaggccaaggccaaggctgtggccctggacagcgacaacatcagcctgaagagcatcggcagccctgagagcacccccaagaaccaggccagccaccccacagccaccaagctggccgagctgccccccacccccctgcgggccacagccaagagctttgtgaagccacccagcctggccaacctggacaaggtgaacagcaacagcctggacctgcccagcagcagtgacaccacccacgccagcaaggtgcctgacctgcacgccaccagcagcgccagcggcggccccctgcccagctgcttcacccccagccctgcccccatcctgaacatcaacagcgccagcttcagccagggcctggagctgatgagcggcttctctgtgcccaaggagaccaggatgtaccccaagctgagcggcctgcaccgctccatggagagcctgcagatgcccatgagcctgcccagcgccttccccagcagcacccctgtgcccaccccaccagcccccccagctgcccccacagaggaggagacagaggagctgacctggagcggcagcccccgggccggccagctggacagcaaccagagggacaggaacaccctgcccaagaagggcctgcgctaccagctgcagagccaggaggagaccaaggagaggaggcacagccacaccatcggcggcctgcctgagagtgatgaccagagcgagctgcccagccccccagccctgcccatgagcctgagcgccaagggccagctgaccaacatcgtgagccccacagctgccaccaccccccgcatcaccaggagcaacagcatccccacccatgaggccgcctttgagctgtacagcggcagccagatgggcagcaccctgagcctggccgagcggcccaagggcatgatccgcagcggcagcttccgggaccccacagatgatgtgcacggctctgtgctgagcctggccagcagcgccagcagcacctacagcagccagatcaggaagctgcggcgggagctggagagcagccaggagaaggtggccaccctgaccagccagctgagcgccaatgccaacctggtggccgcctttgagcagagcctggtgaacatgaccagccggctgcggcacctggccgagacagctgaggagaagatggagttccgcagctgccaccctggctggagcgccctggcccgctcctggctgacagccaacagcgccagccaggacacagagctgctggacctgcgggagaccatcgacttcctgaagaagaagaacagcgaggcccaggccgtcatccagggcgccctgaatgccagcgagaccacccccaaggagctgcgcatcaagaggcagaacagcagtgacagcatcagcagcctgaacagcatcaccagccacagcagcatcggcagcagcaaggatgctgatgcctag

SEQ ID NO: 161674 - DNA, 4452 bp, Artificial Sequence
  Description of Artificial Sequence: Synthetic coding sequence
atgctgcacctgcccctgcccaggagcggccgcacagtgaacttccccaggtcctgggatgagagcagcagcatcagcagcggcctgagtgatgccagtgacaacctgagcagcgaggagttcaatgccagcagcagcctgaacagcctgcccagcacccccacagccagcagaagaaacagcaccatcgtgctgaggacagattctgagaagaggagcctggccgagagcggcctgtcctggttcagcgagagcgaggagaaggcccccaagaagctggagtatgattctggcagcctgaagatggagcccggcaccagcaagtggaggcgggagaggcctgagagctgtgatgacagcagcaagggcggggagctgaagaagcccatcagcctgggccaccctggcagcctgaagaagggcaagaccccacctgtggccgtgaccagccccatcacccacacagcccagagcgccctgaaggtggccggcaagccagagggcaaggccacagacaagggcaagctggccgtgaagaacacaggcctgcagaggagcagcagtgatgctggccgggaccggctgagtgatgccaagaagcccccatctggaattgcccggcccagcaccagcggcagctttggctacaagaagcccccaccagccactggaacagccaccgtgatgcagacaggaggcagcgccaccctgagcaagatccagaagagcagcggcatccctgtgaagcctgtgaatggaaggaagaccagcctggatgtgagcaacagcgctgagcccggcttcctggcccctggggcccggagcaacatccagtaccgcagcctgcccaggcctgccaagagcagctccatgtctgtgactggaggccggggcggccccaggcctgtgagcagcagcattgaccccagcctgctgagcaccaagcagggcggcctgacccccagccggctgaaggagcccaccaaggtggccagcggccgcaccaccccagcccctgtgaaccagacagaccgggagaaggagaaggccaaggccaaggctgtggccctggacagcgacaacatcagcctgaagagcatcggcagccctgagagcacccccaagaaccaggccagccaccccacagccaccaagctggccgagctgccccccacccccctgcgggccacagccaagagctttgtgaagccacccagcctggccaacctggacaaggtgaacagcaacagcctggacctgcccagcagcagtgacaccacccacgccagcaaggtgcctgacctgcacgccaccagcagcgccagcggcggccccctgcccagctgcttcacccccagccctgcccccatcctgaacatcaacagcgccagcttcagccagggcctggagctgatgagcggcttctctgtgcccaaggagaccaggatgtaccccaagctgagcggcctgcaccgctccatggagagcctgcagatgcccatgagcctgcccagcgccttccccagcagcacccctgtgcccaccccaccagcccctcctgctgcccccacagaggaggagacagaggagctgacctggagcggcagccccagggctggccagctggacagcaaccagagggacaggaacaccctgcccaagaagggcctgcgctaccagctgcagagccaggaggagaccaaggagcggcggcacagccacaccatcggcggcctgcctgagagtgatgaccagagcgagctgcccagccccccagccctgcccatgagcctgagcgccaagggccagctgaccaacatcgtgagccccacagctgccaccaccccccgcatcaccaggagcaacagcatccccacccatgaagctgcctttgagctgtacagcggcagccagatgggcagcaccctgagcctggccgagcggcccaagggcatgatccgcagcggcagcttccgggaccccacagatgatgtgcacggctctgtgctgagcctggccagcagcgccagcagcacctacagcagcgctgaggagaggatgcagagcgagcagatcaggaagctgcggcgggagctggagagcagccaggagaaggtggccaccctgaccagccagctgagcgccaatgccaacctggtggccgcctttgagcagagcctggtgaacatgaccagccggctgcggcacctggccgagacagctgaggagaaggacacagagctgctggacctgcgggagaccatcgacttcctgaagaagaagaacagcgaggcccaggccgtcatccagggcgccctgaatgccagcgagaccacccccaaggagctgcgcatcaagaggcagaacagcagtgacagcatcagcagcctgaacagcatcaccagccacagcagcatcggcagcagcaaggatgctgatgccaagaagaagaagaagaagtcctggctgcggagcagcttcaacaaggccttcagcatcaagaagggccccaagagcgccagcagctacagcgacatcgaggagatcgccaccccagacagcagcgcccccagcagccccaagctgcagcacggcagcacagaaacagccagccccagcatcaagagcagcaccagcagctctgtgggcacagatgtgacagagggccctgcccacccagccccccacaccaggctcttccacgccaatgaggaggaggagcctgagaagaaggaggtgtctgagctgcggtctgagctgtgggagaaggagatgaagctgacagacatccggctggaggccctgaacagcgcccaccagctggaccagctgcgggagaccatgcacaacatgcagctggaggtggacctgctgaaggcagaaaatgaccggctgaaggtggcccctggccccagcagcggcagcaccccaggccaggtgcccggcagcagcgccctgagcagcccccggcgcagcctgggcctggccctgacccacagctttggccccagcctggccgacacagacctgagccccatggatggcatcagcacctgtggccccaaggaggaggtgaccctgcgggtggtggtgaggatgccaccccagcacatcatcaagggggacctgaagcagcaggagttcttcctgggctgcagcaaggtgtctgggaaggtggactggaagatgctggatgaagctgtgttccaggtgttcaaggactacatcagcaagatggaccctgccagcaccctgggcctgagcacagagagcatccacggctacagcatcagccacgtgaagagggtgctggatgctgagcccccagagatgccaccctgcagaagaggagtgaacaacatctctgtgtccctgaagggcctgaaggagaagtgtgtggacagcctggtgtttgagaccctcatccccaagcccatgatgcagcactacatcagcctgctgctgaagcaccggcggctggtgctgagcggccccagcggcaccgggaagacctacctgaccaaccggctggccgagtacctggtggagaggagcggccgggaggtgacagagggcatcgtgtccaccttcaacatgcaccagcagagctgcaaggacctgcagctgtacctgagcaacctggccaaccagattgaccgggagaccggcattggagatgtgcccctggtgatcctgctggatgacctgtctgaggccggcagcatcagcgagctggtgaatggagccctgacctgcaagtaccacaagtgcccctacatcatcggcaccaccaaccagcctgtgaagatgacccccaaccacggcctgcacctgtccttcaggatgctgaccttcagcaacaacgtggagcccgccaacggcttcctggtgcgctacctgcggaggaagctggtggagagtgacagcgacatcaatgccaacaaggaggagctgctgcgggtgctggactgggtgcccaagctgtggtaccacctgcacaccttcctggagaagcacagcaccagtgacttcctgattggcccctgcttcttcctgagctgccccatcggcatcgaggacttccgcacctggttcatcgacctgtggaacaacagcatcatcccctacctgcaggagggcgccaaggatggcatcaaggtgcacggccagaaggccgcctgggaggaccctgtggagtgggtgcgggacaccctgccctggcccagcgcccagcaggaccagagcaagctgtaccacctgcccccacccaccgtgggcccccacagcatcgccagccccccagaggacagaacagtgaaggacagcacccccagcagcctggacagcgaccccctgatggccatgctgctgaagctgcaggaggccgccaactacatcgagagcccagaccgggagaccatcctggaccccaacctgcaggccaccctgtag

SEQ ID NO: 161675 - DNA, 4482 bp, Artificial Sequence
  Description of Artificial Sequence: Synthetic coding sequence
atgctgtggcccaggaacctgacctcctgggatgacagcagctctgtgagcagcggcatcagtgacaccatcgacaacctgagcacagatgacatcaacaccagcagcagcatcagcagctatgccaacaccccagccagcagcaggaagaacctggatgtgcagacagatgctgagaagcacagccaggtggagaggaacagcctgtggagcggagatgatgtgaagaagagtgatggcggcagtgacagcggcatcaagatggagcccggcagcaagtggaggaggaaccccagtgatgtgtctgatgaaagtgacaagagcaccagcggcaagaagaaccctgtgatcagccagacaggctcctggaggcggggcatgacagcccaggtgggcatcaccatgcccaggaccaagcccagcgccccagctggggccctgaagaccccaggcaccgggaagacagatgatgccaaggtgtctgagaagggccgcctgagccccaaggccagccaggtgaagaggagccccagtgatgctggccgcagcagtggagatgagagcaagaagcccctgcccagcagcagcaggacccccacagccaatgccaacagctttggcttcaagaagcagagcggcagcgctgctggcctggccatgatcacagccagcggcgtgacagtgaccagccgcagcgccaccctgggcaagatccccaagagcagcgccctggtgagccgctctgctggcaggaagagctccatggatggagcccagaaccaggatgatggctacctggccctgagcagcaggaccaacctgcagtaccgcagcctgccccggcccagcaagagcaacagcagaaatggagctggcaacagaagcagcaccagcagcattgacagcaacatcagcagcaagtctgctggcctgcctgtgcccaagctgcgggagcccagcaagacagccctgggcagcagcctgcccggcctggtgaaccagacagacaaggagaagggcatcagcagtgacaatgaatctgtggccagctgcaacagcgtgaaggtgaacccagctgcccagcctgtgagcagccctgcccagaccagcctgcagcccggggccaagtacccagatgtggccagccccaccctgcggcggctgtttggaggcaagcccaccaagcaggtgcccatcgccacagctgagaacatgaagaacagcgtggtgatcagcaacccccacgccaccatgacccagcagggcaacctggacagccccagcggcagcggcgtgctgagcagcggcagcagcagccccctgtacagcaagaatgtggacctgaaccagagccccctggccagcagccccagcagcgcccacagcgcccccagcaacagcctgacctggggcaccaatgccagcagcagcagcgctgtgtccaaggatggcctgggcttccagagcgtgagcagcctgcacaccagctgtgagagcattgacatcagcctgagcagcggcggcgtgcccagccacaacagcagcacaggcctgattgccagcagcaaggatgacagcctgaccccatttgtgaggaccaacagcgtgaagaccaccctgtctgagagtgacccccacctggacaggaacaccctgcccaagaagggcctgcgctacacccccaccagccagctgcggacccaggaggatgccaaggagtggctgcggagccacagcgctgggggcctgcaggacacagctgccaacagccccttcagcagcggcagctctgtgaccagccccagcggcacccgcttcaacttcagccagctggccagccccaccaccgtgacccagatgagcctgagcaaccccaccatgctgcggacccacagcctgagcaatgctgatggccagtatgacccctacacagacagccgcttcaggaacagctccatgagcctggatgagaagagcaggaccatgagccgcagcggcagcttcagagatggctttgaggaggtgcacggcagcagcctgagcctggtgagcagcaccagctctgtgtacagcaccccagaggagaagtgccagagcgagatcaggaagctgcggcgggagctggatgccagccaggagaaggtgtctgccctgaccacccagctgacagccaatgcccacctggtggccgcctttgagcagagcctgggcaacatgaccatccggctgcagagcctgaccatgacagctgagcagaaggacagcgagctgaatgagctgaggaagaccatcgagctgctgaagaagcagaatgctgctgcccaggccgccatcaatggagtcatcaacaccccagagctgaactgcaagggaaatggaacagcccagagcgctgacctgcgcatccggcggcagcacagcagtgacagcgtgagcagcatcaacagcgccaccagccacagctctgtgggcagcaacattgaaagtgacagcaagaagaagaagaggaagaactggctgcggagcagcttcaagcaggccttcggcaagaagaagagccccaagagcgccagcagccacagcgacatcgaggagatgacagacagcagcctgcccagcagccccaagctgccccacaacggcagcacaggcagcacccccctgctgaggaacagccacagcaacagcctcatcagcgagtgcatggacagcgaggccgagaccgtgatgcagctgagaaatgagctgcgggacaaggagatgaagctgacagacatccggctggaggccctgagcagcgcccaccagctggaccagctgcgggaggccatgaacaggatgcagagcgagattgagaagctgaaggcagaaaatgaccggctgaagtctgagagccagggcagcggctgcagccgggcccccagccaggtgtccatcagcgccagcccccggcagagcatgggcctgagccagcacagcctgaacctgacagagagcaccagcctggacatgctgctggatgacacaggagaatgttctgccaggaaggagggcggcagacatgtgaagatcgtggtgtccttccaggaggagatgaagtggaaggaggacagccggccccacctgttcctgattggctgcatcggcgtgtctgggaagaccaagtgggatgtgctggatggagtggtgcggcggctcttcaaggagtacatcatccacgtggaccctgtgtcccagctgggcctgaacagcgacagcgtgctgggctacagcatcggggagatcaagaggagcaacaccagcgagaccccagagctgctgccctgtggctacctggtgggggagaacaccaccatctctgtgacagtgaagggcctggccgagaacagcctggacagcctggtgtttgagagcctcatccccaagcccatcctgcagcgctacgtgtccctgctgattgagcaccggcgcatcatcctgagcggccccagcggcaccgggaagacctacctggccaaccggctgtctgagtacatcgtgctgcgggagggccgggagctgacagatggagtcatcgccaccttcaacgtggaccacaagagcagcaaggagctgcggcagtacctgagcaacctggccgaccagtgcaacagtgaaaataatgctgtggacatgcccctggtgatcatcctggacaacctgcaccacgtgagcagcctgggggagatcttcaacggcctgctgaactgcaagtaccacaagtgcccctacatcatcggcaccatgaaccaggccaccagcagcacccccaacctgcagctgcaccacaacttccgctgggtgctgtgtgccaaccacacagagcctgtgaagggcttcctgggccgcttcctgcggaggaagctgatggagacagagatcagcggccgggtgaggaacatggagctggtgaagatcatcgactggatccccaaggtgtggcaccacctgaaccgcttcctggaggcccacagcagcagtgatgtgaccatcggccccaggctcttcctgagctgccccattgatgtggatggcagccgggtgtggttcacagacctgtggaactacagcatcatcccctacctgctggaggccgtgcgggagggcctgcagctgtatggccggcgggccccctgggaggaccctgccaagtgggtgatggacacctacccctgggccgccagcccccagcagcacgagtggccacccctgctgcagctgcggccagaagatgtgggctttgatggctacagcatgccccgggagggcagcaccagcaagcagatgcccccatctgatgctgagggggaccccctgatgaacatgctgatgaggctgcaggaggccgccaactacagcagcccccagagctatgacagcgacagcaacagcaacagccaccatgatgacatcctggacagcagcctggagagcaccctgtag

SEQ ID NO: 161676 - DNA, 7290 bp, Artificial Sequence
  Description of Artificial Sequence: Synthetic coding sequence
atgcctgccatcctggtggccagcaagatgaagagcggcctgcccaagcctgtgcacagcgctgcccccatcctgcacgtgcccccagcccgggccggcccccagccctgctacctgaagctgggcagcaaggtggaggtgtccaagaccacctaccccagccagatccccctgaagagccaggtgctgcagggcctgcaggagcctgctggggagggcctgcccctgaggaagagcggctctgtggagaatggatttgacacccagatctacacagactgggccaaccactacctggccaagagcggccacaagaggctcatccgggacctgcagcaggatgtgacagatggagtgctgctggcccagatcatccaggtggtggccaatgagaagattgaggacatcaatggctgccccaagaacagaagccagatgattgagaacattgatgcctgcctgaacttcctggccgccaagggcatcaacatccagggcctgtctgctgaggagatcagaaatggaaacctgaaggccatcctgggcctcttcttcagcctgagccgctacaagcagcagcagcagcagccccagaagcagcacctgagcagccccctgcccccagctgtgtcccaggtggccggggcccccagccagtgccaggccggcaccccccagcagcaggtgcctgtgaccccccaggccccctgccagccccaccagcctgccccccaccagcagagcaaggcccaggccgagatgcagagccggctgcccggccccacagcccgggtgtctgctgctggcagcgaggccaagacccggggcggcagcaccacagccaacaacagaagaagccagagcttcaacaactatgacaagagcaagcctgtgaccagccccccacctccacccagcagccatgagaaggagcccctggccagcagcgccagcagccaccctggcatgtctgacaatgccccagccagcctggagagcggcagcagcagcacccccaccaactgcagcaccagcagcgccatcccccagcctggagctgccaccaagccctggaggagcaagagcctgtctgtgaagcacagcgccaccgtgtccatgctgtctgtgaagcccccaggccctgaggccccccggcccaccccagaggccatgaagccagcccccaacaaccagaagtccatgctggagaagctgaagctgttcaacagcaaaggaggcagcaaggccggggagggccctggcagccgggacaccagctgtgagcggctggagaccctgcccagctttgaggagagcgaggagctggaggccgccagcaggatgctgaccaccgtgggccctgccagcagcagccccaagatcgccctgaagggcatcgcccagaggaccttcagccgggccctgaccaacaagaagagcagcctgaagggaaatgagaaggagaaggagaagcagcagcgggagaaggacaaggagaagagcaaggacctggccaagagggcctctgtgacagagcggctggacctgaaggaggagcccaaggaggaccccagcggggctgctgtgcctgagatgcccaagaagagcagcaagatcgccagcttcatccccaagggcggcaagctgaacagcgccaagaaggagcccatggcccccagccacagcggcatccccaagccaggcatgaagtccatgcctgggaagagccccagcgccccagcccccagcaaggagggggagaggagccgcagcggcaagctgagcagcggcctgccccagcagaagccccagctggatggccgccacagcagcagcagcagcagcctggccagcagcgagggcaagggccctgggggcaccaccctgaaccacagcatcagcagccagacagtgtctggctctgtgggcaccacccagaccaccggcagcaacacagtgtctgtgcagctgccccagccccagcagcagtacaaccaccccaacacagccaccgtggcccccttcctgtaccgcagccagacagacacagagggcaatgtgacagctgagagcagcagcactggagtgtctgtggagcccagccacttcaccaagacaggccagcctgccctggaggagctgactggagaagatcctgaggcccggcggctgaggacagtgaagaacattgctgacctgcggcagaacctggaggagaccatgagcagcctgcggggcacccaggtgacccacagcaccctggagaccacctttgacaccaacgtgaccacagagatgagcggccgcagcatcctgagcctgaccggccggcccacccccctgtcctggaggctgggccagagcagcccccggctgcaggccggagatgcccccagcatgggaaatggctacccaccccgggccaatgccagccgcttcatcaacacagagagcggccgctacgtgtacagcgcccccctgcggcggcagctggccagccggggcagctctgtgtgccacgtggatgtgtctgacaaggctggagatgagatggacctggagggcatctccatggatgcccctggctacatgtctgatggagatgtgctgagcaagaacatcagaacagatgacatcaccagcggctacatgacagatggcggcctgggcctgtacacccggcggctgaaccggctgcctgatggcatggctgtggtgcgggagaccctgcagaggaacaccagcctgggcctgggagatgctgacagctgggatgacagcagctctgtgagcagcggcatcagtgacaccatcgacaacctgagcacagatgacatcaacaccagcagcagcatcagcagctatgccaacaccccagccagcagcaggaagaacctggatgtgcagacagatgctgagaagcacagccaggtggagaggaacagcctgtggagcggagatgatgtgaagaagagtgatggcggcagtgacagcggcatcaagatggagcccggcagcaagtggaggaggaaccccagtgatgtgtctgatgaaagtgacaagagcaccagcggcaagaagaaccctgtgatcagccagacaggctcctggaggcggggcatgacagcccaggtgggcatcaccatgcccaggaccaagcccagcgccccagctggggccctgaagaccccaggcaccgggaagacagatgatgccaaggtgtctgagaagggccgcctgagccccaaggccagccaggtgaagaggagccccagtgatgctggccgcagcagtggagatgagagcaagaagcccctgcccagcagcagcaggacccccacagccaatgccaacagctttggcttcaagaagcagagcggcagcgctgctggcctggccatgatcacagccagcggcgtgacagtgaccagccgcagcgccaccctgggcaagatccccaagagcagcgccctggtgagccgctctgctggcaggaagagctccatggatggagcccagaaccaggatgatggctacctggccctgagcagcaggaccaacctgcagtaccgcagcctgccccggcccagcaagagcaacagcagaaatggagctggcaacagaagcagcaccagcagcattgacagcaacatcagcagcaagtctgctggcctgcctgtgcccaagctgcgggagcccagcaagacagccctgggcagcagcctgcccggcctggtgaaccagacagacaaggagaagggcatcagcagtgacaatgaatctgtggccagctgcaacagcgtgaaggtgaacccagctgcccagcctgtgagcagccctgcccagaccagcctgcagcccggggccaagtacccagatgtggccagccccaccctgcggcggctgtttggaggcaagcccaccaagcaggtgcccatcgccacagctgagaacatgaagaacagcgtggtgatcagcaacccccacgccaccatgacccagcagggcaacctggacagccccagcggcagcggcgtgctgagcagcggcagcagcagccccctgtacagcaagaatgtggacctgaaccagagccccctggccagcagccccagcagcgcccacagcgcccccagcaacagcctgacctggggcaccaatgccagcagcagcagcgctgtgtccaaggatggcctgggcttccagagcgtgagcagcctgcacaccagctgtgagagcattgacatcagcctgagcagcggcggcgtgcccagccacaacagcagcacaggcctgattgccagcagcaaggatgacagcctgaccccatttgtgaggaccaacagcgtgaagaccaccctgtctgagagccccctgagcagccctgctgccagccccaagttctgccgcagcaccctgcccaggaagcaggacagcgacccccacctggacaggaacaccctgcccaagaagggcctgcgctacacccccaccagccagctgcggacccaggaggatgccaaggagtggctgcggagccacagcgctgggggcctgcaggacacagctgccaacagccccttcagcagcggcagctctgtgaccagccccagcggcacccgcttcaacttcagccagctggccagccccaccaccgtgacccagatgagcctgagcaaccccaccatgctgcggacccacagcctgagcaatgctgatggccagtatgacccctacacagacagccgcttcaggaacagctccatgagcctggatgagaagagcaggaccatgagccgcagcggcagcttcagagatggctttgaggaggtgcacggcagcagcctgagcctggtgagcagcaccagctctgtgtacagcaccccagaggagaagtgccagagcgagatcaggaagctgcggcgggagctggatgccagccaggagaaggtgtctgccctgaccacccagctgacagccaatgcccacctggtggccgcctttgagcagagcctgggcaacatgaccatccggctgcagagcctgaccatgacagctgagcagaaggacagcgagctgaatgagctgaggaagaccatcgagctgctgaagaagcagaatgctgctgcccaggccgccatcaatggagtcatcaacaccccagagctgaactgcaagggaaatggaacagcccagagcgctgacctgcgcatccggcggcagcacagcagtgacagcgtgagcagcatcaacagcgccaccagccacagctctgtgggcagcaacattgaaagtgacagcaagaagaagaagaggaagaactggctgcggagcagcttcaagcaggccttcggcaagaagaagagccccaagagcgccagcagccacagcgacatcgaggagatgacagacagcagcctgcccagcagccccaagctgccccacaacggcagcacaggcagcacccccctgctgaggaacagccacagcaacagcctcatcagcgagtgcatggacagcgaggccgagaccgtgatgcagctgagaaatgagctgcgggacaaggagatgaagctgacagacatccggctggaggccctgagcagcgcccaccagctggaccagctgcgggaggccatgaacaggatgcagagcgagattgagaagctgaaggcagaaaatgaccggctgaagtctgagagccagggcagcggctgcagccgggcccccagccaggtgtccatcagcgccagcccccggcagagcatgggcctgagccagcacagcctgaacctgacagagagcaccagcctggacatgctgctggatgacacaggagaatgttctgccaggaaggagggcggcagacatgtgaagatcgtggtgtccttccaggaggagatgaagtggaaggaggacagccggccccacctgttcctgattggctgcatcggcgtgtctgggaagaccaagtgggatgtgctggatggagtggtgcggcggctcttcaaggagtacatcatccacgtggaccctgtgtcccagctgggcctgaacagcgacagcgtgctgggctacagcatcggggagatcaagaggagcaacaccagcgagaccccagagctgctgccctgtggctacctggtgggggagaacaccaccatctctgtgacagtgaagggcctggccgagaacagcctggacagcctggtgtttgagagcctcatccccaagcccatcctgcagcgctacgtgtccctgctgattgagcaccggcgcatcatcctgagcggccccagcggcaccgggaagacctacctggccaaccggctgtctgagtacatcgtgctgcgggagggccgggagctgacagatggagtcatcgccaccttcaacgtggaccacaagagcagcaaggagctgcggcagtacctgagcaacctggccgaccagtgcaacagtgaaaataatgctgtggacatgcccctggtgatcatcctggacaacctgcaccacgtgagcagcctgggggagatcttcaacggcctgctgaactgcaagtaccacaagtgcccctacatcatcggcaccatgaaccaggccaccagcagcacccccaacctgcagctgcaccacaacttccgctgggtgctgtgtgccaaccacacagagcctgtgaagggcttcctgggccgcttcctgcggaggaagctgatggagacagagatcagcggccgggtgaggaacatggagctggtgaagatcatcgactggatccccaaggtgtggcaccacctgaaccgcttcctggaggcccacagcagcagtgatgtgaccatcggccccaggctcttcctgagctgccccattgatgtggatggcagccgggtgtggttcacagacctgtggaactacagcatcatcccctacctgctggaggccgtgcgggagggcctgcagctgtatggccggcgggccccctgggaggaccctgccaagtgggtgatggacacctacccctgggccgccagcccccagcagcacgagtggccacccctgctgcagctgcggccagaagatgtgggctttgatggctacagcatgccccgggagggcagcaccagcaagcagatgcccccatctgatgctgagggggaccccctgatgaacatgctgatgaggctgcaggaggccgccaactacagcagcccccagagctatgacagcgacagcaacagcaacagccaccatgatgacatcctggacagcagcctggagagcaccctgtag

SEQ ID NO: 161677 - DNA, 7299 bp, Artificial Sequence
  Description of Artificial Sequence: Synthetic coding sequence
atgcctgccatcctggtggccagcaagatgaagagcggcctgcccaagcctgtgcacagcgctgcccccatcctgcacgtgcccccagcccgggccggcccccagccctgctacctgaagctgggcagcaaggtggaggtgtccaagaccacctaccccagccagatccccctgaagagccaggtgctgcagggcctgcaggagcctgctggggagggcctgcccctgaggaagagcggctctgtggagaatggatttgacacccagatctacacagactgggccaaccactacctggccaagagcggccacaagaggctcatccgggacctgcagcaggatgtgacagatggagtgctgctggcccagatcatccaggtggtggccaatgagaagattgaggacatcaatggctgccccaagaacagaagccagatgattgagaacattgatgcctgcctgaacttcctggccgccaagggcatcaacatccagggcctgtctgctgaggagatcagaaatggaaacctgaaggccatcctgggcctcttcttcagcctgagccgctacaagcagcagcagcagcagccccagaagcagcacctgagcagccccctgcccccagctgtgtcccaggtggccggggcccccagccagtgccaggccggcaccccccagcagcaggtgcctgtgaccccccaggccccctgccagccccaccagcctgccccccaccagcagagcaaggcccaggccgagatgcagagccggctgcccggccccacagcccgggtgtctgctgctggcagcgaggccaagacccggggcggcagcaccacagccaacaacagaagaagccagagcttcaacaactatgacaagagcaagcctgtgaccagccccccacctccacccagcagccatgagaaggagcccctggccagcagcgccagcagccaccctggcatgtctgacaatgccccagccagcctggagagcggcagcagcagcacccccaccaactgcagcaccagcagcgccatcccccagcctggagctgccaccaagccctggaggagcaagagcctgtctgtgaagcacagcgccaccgtgtccatgctgtctgtgaagcccccaggccctgaggccccccggcccaccccagaggccatgaagccagcccccaacaaccagaagtccatgctggagaagctgaagctgttcaacagcaaaggaggcagcaaggccggggagggccctggcagccgggacaccagctgtgagcggctggagaccctgcccagctttgaggagagcgaggagctggaggccgccagcaggatgctgaccaccgtgggccctgccagcagcagccccaagatcgccctgaagggcatcgcccagaggaccttcagccgggccctgaccaacaagaagagcagcctgaagggaaatgagaaggagaaggagaagcagcagcgggagaaggacaaggagaagagcaaggacctggccaagagggcctctgtgacagagcggctggacctgaaggaggagcccaaggaggaccccagcggggctgctgtgcctgagatgcccaagaagagcagcaagatcgccagcttcatccccaagggcggcaagctgaacagcgccaagaaggagcccatggcccccagccacagcggcatccccaagccaggcatgaagtccatgcctgggaagagccccagcgccccagcccccagcaaggagggggagaggagccgcagcggcaagctgagcagcggcctgccccagcagaagccccagctggatggccgccacagcagcagcagcagcagcctggccagcagcgagggcaagggccctgggggcaccaccctgaaccacagcatcagcagccagacagtgtctggctctgtgggcaccacccagaccaccggcagcaacacagtgtctgtgcagctgccccagccccagcagcagtacaaccaccccaacacagccaccgtggcccccttcctgtaccgcagccagacagacacagagggcaatgtgacagctgagagcagcagcactggagtgtctgtggagcccagccacttcaccaagacaggccagcctgccctggaggagctgactggagaagatcctgaggcccggcggctgaggacagtgaagaacattgctgacctgcggcagaacctggaggagaccatgagcagcctgcggggcacccaggtgacccacagcaccctggagaccacctttgacaccaacgtgaccacagagatgagcggccgcagcatcctgagcctgaccggccggcccacccccctgtcctggaggctgggccagagcagcccccggctgcaggccggagatgcccccagcatgggaaatggctacccaccccgggccaatgccagccgcttcatcaacacagagagcggccgctacgtgtacagcgcccccctgcggcggcagctggccagccggggcagctctgtgtgccacgtggatgtgtctgacaaggctggagatgagatggacctggagggcatctccatggatgcccctggctacatgtctgatggagatgtgctgagcaagaacatcagaacagatgacatcaccagcggctacatgacagatggcggcctgggcctgtacacccggcggctgaaccggctgcctgatggcatggctgtggtgcgggagaccctgcagaggaacaccagcctgggcctgggagatgctgacagctgggatgacagcagctctgtgagcagcggcatcagtgacaccatcgacaacctgagcacagatgacatcaacaccagcagcagcatcagcagctatgccaacaccccagccagcagcaggaagaacctggatgtgcagacagatgctgagaagcacagccaggtggagaggaacagcctgtggagcggagatgatgtgaagaagagtgatggcggcagtgacagcggcatcaagatggagcccggcagcaagtggaggaggaaccccagtgatgtgtctgatgaaagtgacaagagcaccagcggcaagaagaaccctgtgatcagccagacaggctcctggaggcggggcatgacagcccaggtgggcatcaccatgcccaggaccaagcccagcgccccagctggggccctgaagaccccaggcaccgggaagacagatgatgccaaggtgtctgagaagggccgcctgagccccaaggccagccaggtgaagaggagccccagtgatgctggccgcagcagtggagatgagagcaagaagcccctgcccagcagcagcaggacccccacagccaatgccaacagctttggcttcaagaagcagagcggcagcgctgctggcctggccatgatcacagccagcggcgtgacagtgaccagccgcagcgccaccctgggcaagatccccaagagcagcgccctggtgagccgctctgctggcaggaagagctccatggatggagcccagaaccaggatgatggctacctggccctgagcagcaggaccaacctgcagtaccgcagcctgccccggcccagcaagagcaacagcagaaatggagctggcaacagaagcagcaccagcagcattgacagcaacatcagcagcaagtctgctggcctgcctgtgcccaagctgcgggagcccagcaagacagccctgggcagcagcctgcccggcctggtgaaccagacagacaaggagaagggcatcagcagtgacaatgaatctgtggccagctgcaacagcgtgaaggtgaacccagctgcccagcctgtgagcagccctgcccagaccagcctgcagcccggggccaagtacccagatgtggccagccccaccctgcggcggctgtttggaggcaagcccaccaagcaggtgcccatcgccacagctgagaacatgaagaacagcgtggtgatcagcaacccccacgccaccatgacccagcagggcaacctggacagccccagcggcagcggcgtgctgagcagcggcagcagcagccccctgtacagcaagaatgtggacctgaaccagagccccctggccagcagccccagcagcgcccacagcgcccccagcaacagcctgacctggggcaccaatgccagcagcagcagcgctgtgtccaaggatggcctgggcttccagagcgtgagcagcctgcacaccagctgtgagagcattgacatcagcctgagcagcggcggcgtgcccagccacaacagcagcacaggcctgattgccagcagcaaggatgacagcctgaccccatttgtgaggaccaacagcgtgaagaccaccctgtctgagagccccctgagcagccctgctgccagccccaagttctgccgcagcaccctgcccaggaagcaggacagcgacccccacctggacaggaacaccctgcccaagaagggcctgcgctacacccccaccagccagctgcggacccaggaggatgccaaggagtggctgcggagccacagcgctgggggcctgcaggacacagctgccaacagccccttcagcagcggcagctctgtgaccagccccagcggcacccgcttcaacttcagccagctggccagccccaccaccgtgacccagatgagcctgagcaaccccaccatgctgcggacccacagcctgagcaatgctgatggccagtatgacccctacacagacagccgcttcaggaacagctccatgagcctggatgagaagagcaggaccatgagccgcagcggcagcttcagagatggctttgaggaggtgcacggcagcagcctgagcctggtgagcagcaccagctctgtgtacagcaccccagaggagaagtgccagagcgagatcaggaagctgcggcgggagctggatgccagccaggagaaggtgtctgccctgaccacccagctgacagccaatgcccacctggtggccgcctttgagcagagcctgggcaacatgaccatccggctgcagagcctgaccatgacagctgagcagaaggacagcgagctgaatgagctgaggaagaccatcgagctgctgaagaagcagaatgctgctgcccaggccgccatcaatggagtcatcaacaccccagagctgaactgcaagggaaatggaacagcccagagcgctgacctgcgcatccggcggcagcacagcagtgacagcgtgagcagcatcaacagcgccaccagccacagctctgtgggcagcaacattgaaagtgacagcaagaagaagaagaggaagaactgggtgaatgagctgcggagcagcttcaagcaggccttcggcaagaagaagagccccaagagcgccagcagccacagcgacatcgaggagatgacagacagcagcctgcccagcagccccaagctgccccacaacggcagcacaggcagcacccccctgctgaggaacagccacagcaacagcctcatcagcgagtgcatggattctgaggccgagaccgtgatgcagctgagaaatgagctgcgggacaaggagatgaagctgacagacatccggctggaggccctgagcagcgcccaccagctggaccagctgcgggaggccatgaacaggatgcagagcgagattgagaagctgaaggccgagaatgaccggctgaagtctgagagccagggcagcggctgcagccgggcccccagccaggtgtccatcagcgccagcccccggcagagcatgggcctgagccagcacagcctgaacctgacagagagcaccagcctggacatgctgctggatgacaccggggagtgcagcgccaggaaggagggcggccgccacgtgaagatcgtggtgtccttccaggaggagatgaagtggaaggaggacagccggccccacctgttcctgattggctgcattggagtgtctgggaagaccaagtgggatgtgctggatggagtggtgagaagactcttcaaggagtacatcatccacgtggaccctgtgtcccagctgggcctgaacagcgacagcgtgctgggctacagcattggagagatcaagaggagcaacaccagcgagaccccagagctgctgccctgtggctacctggtgggggagaacaccaccatctctgtgacagtgaagggcctggccgagaacagcctggacagcctggtgtttgagagcctcatccccaagcccatcctgcagagatatgtgtccctgctgattgagcaccggcgcatcatcctgagcggccccagcggcaccgggaagacctacctggccaaccggctgtctgagtacatcgtgctgcgggagggccgggagctgacagatggagtgattgccaccttcaacgtggaccacaagagcagcaaggagctgcggcagtacctgagcaacctggccgaccagtgcaacagcgagaacaatgctgtggacatgcccctggtgatcatcctggacaacctgcaccacgtgagcagcctgggggagatcttcaacggcctgctgaactgcaagtaccacaagtgcccctacatcatcggcaccatgaaccaggccaccagcagcacccccaacctgcagctgcaccacaacttccgctgggtgctgtgtgccaaccacacagagcctgtgaagggcttcctgggccgcttcctgcggaggaagctgatggagacagagatcagcggccgggtgaggaacatggagctggtgaagatcatcgactggatccccaaggtgtggcaccacctgaaccgcttcctggaggcccacagcagcagtgatgtgaccatcggccccaggctcttcctgagctgccccattgatgtggatggcagccgggtgtggttcacagacctgtggaactacagcatcatcccctacctgctggaggccgtgcgggagggcctgcagctgtatggaagaagagccccctgggaggaccctgccaagtgggtgatggacacctacccctgggccgccagcccccagcagcacgagtggccacccctgctgcagctgcggccagaagatgtgggctttgatggctacagcatgccccgggagggcagcaccagcaagcagatgccacccagtgatgctgagggggaccccctgatgaacatgctgatgaggctgcaggaggccgccaactacagcagcccccagagctatgacagcgacagcaacagcaacagccaccatgatgacatcctggacagcagcctggagagcaccctgtag

SEQ ID NO: 161678 - DNA, 7467 bp, Artificial Sequence
  Description of Artificial Sequence: Synthetic coding sequence
atgcctgccatcctggtggccagcaagatgaagagcggcctgcccaagcctgtgcacagcgctgcccccatcctgcacgtgcccccagcccgggccggcccccagccctgctacctgaagctgggcagcaaggtggaggtgtccaagaccacctaccccagccagatccccctgaagagccaggtgctgcagggcctgcaggagcctgctggggagggcctgcccctgaggaagagcggctctgtggagaatggatttgacacccagatctacacagactgggccaaccactacctggccaagagcggccacaagaggctcatccgggacctgcagcaggatgtgacagatggagtgctgctggcccagatcatccaggtggtggccaatgagaagattgaggacatcaatggctgccccaagaacagaagccagatgattgagaacattgatgcctgcctgaacttcctggccgccaagggcatcaacatccagggcctgtctgctgaggagatcagaaatggaaacctgaaggccatcctgggcctcttcttcagcctgagccgctacaagcagcagcagcagcagccccagaagcagcacctgagcagccccctgcccccagctgtgtcccaggtggccggggcccccagccagtgccaggccggcaccccccagcagcaggtgcctgtgaccccccaggccccctgccagccccaccagcctgccccccaccagcagagcaaggcccaggccgagatgcagagcagcgccagcagcaaggacagcagccagagcaagatcatccgcttcaccctgggccagaagaagatcagccggctgcccggccccacagcccgggtgtctgctgctggcagcgaggccaagacccggggcggcagcaccacagccaacaacagaagaagccagagcttcaacaactatgacaagagcaagcctgtgaccagccccccacctccacccagcagccatgagaaggagcccctggccagcagcgccagcagccaccctggcatgtctgacaatgccccagccagcctggagagcggcagcagcagcacccccaccaactgcagcaccagcagcgccatcccccagcccggggccgccaccaagccctggaggagcaagagcctgtctgtgaagcacagcgccaccgtgtccatgctgtctgtgaagcccccaggccctgaggccccccggcccaccccagaggccatgaagccagcccccaacaaccagaagtccatgctggagaagctgaagctgttcaacagcaagggcggcagcaaggccggggagggccctggcagccgggacaccagctgtgagcggctggagaccctgcccagctttgaggagagcgaggagctggaggccgccagcaggatgctgaccaccgtgggccctgccagcagcagccccaagatcgccctgaagggcatcgcccagaggaccttcagccgggccctgaccaacaagaagagcagcctgaagggaaatgagaaggagaaggagaagcagcagcgggagaaggacaaggagaagagcaaggacctggccaagagggcctctgtgacagagcggctggacctgaaggaggagcccaaggaggaccccagcggggctgctgtgcctgagatgcccaagaagagcagcaagatcgccagcttcatccccaagggcggcaagctgaacagcgccaagaaggagcccatggcccccagccacagcggcatccccaagccaggcatgaagtccatgcctgggaagagccccagcgccccagcccccagcaaggagggggagaggagccgcagcggcaagctgagcagcggcctgccccagcagaagccccagctggatggccgccacagcagcagcagcagcagcctggccagcagcgagggcaaaggacctgggggcaccaccctgaaccacagcatcagcagccagacagtgtctggctctgtgggcaccacccagaccaccggcagcaacacagtgtctgtgcagctgccccagccccagcagcagtacaaccaccccaacacagccaccgtggcccccttcctgtaccgcagccagacagacacagagggcaatgtgacagctgagagcagcagcactggagtgtctgtggagcccagccacttcaccaagacaggccagcctgccctggaggagctgaccggggaggaccctgaggcccggcggctgaggacagtgaagaacattgctgacctgcggcagaacctggaggagaccatgagcagcctgcggggcacccaggtgacccacagcaccctggagaccacctttgacaccaacgtgaccacagagatgagcggccgcagcatcctgagcctgaccggccggcccacccccctgtcctggaggctgggccagagcagcccccggctgcaggccggagatgcccccagcatgggaaatggctacccaccccgggccaatgccagccgcttcatcaacacagaaagtggccgctacgtgtacagcgcccccctgcggcggcagctggccagccggggcagctctgtgtgccacgtggatgtgtctgacaaggctggagatgagatggacctggagggcatctccatggatgcccctggctacatgtctgatggagatgtgctgagcaagaacatcagaacagatgacatcaccagcggctacatgacagatggcggcctgggcctgtacacccggcggctgaaccggctgcctgatggcatggctgtggtgcgggagaccctgcagaggaacaccagcctgggcctgggagatgctgacagctgggatgacagcagctctgtgagcagcggcatcagtgacaccatcgacaacctgagcacagatgacatcaacaccagcagcagcatcagcagctatgccaacaccccagccagcagcaggaagaacctggatgtgcagacagatgctgagaagcacagccaggtggagaggaacagcctgtggagcggagatgatgtgaagaagagtgatggcggcagtgacagcggcatcaagatggagcccggcagcaagtggaggaggaaccccagtgatgtgtctgatgaaagtgacaagagcaccagcggcaagaagaaccctgtgatcagccagacaggctcctggaggcggggcatgacagcccaggtgggcatcaccatgcccaggaccaagcccagcgccccagctggggccctgaagaccccaggcaccgggaagacagatgatgccaaggtgtctgagaagggccgcctgagccccaaggccagccaggtgaagaggagccccagtgatgctggccgcagcagtggagatgagagcaagaagcccctgcccagcagcagcaggacccccacagccaatgccaacagctttggcttcaagaagcagagcggcagcgctgctggcctggccatgatcacagccagcggcgtgacagtgaccagccgcagcgccaccctgggcaagatccccaagagcagcgccctggtgagccgctctgctggcaggaagagctccatggatggagcccagaaccaggatgatggctacctggccctgagcagcaggaccaacctgcagtaccgcagcctgccccggcccagcaagagcaacagcagaaatggagctggcaacagaagcagcaccagcagcattgacagcaacatcagcagcaagtctgctggcctgcctgtgcccaagctgcgggagcccagcaagacagccctgggcagcagcctgcccggcctggtgaaccagacagacaaggagaagggcatcagcagtgacaatgaatctgtggccagctgcaacagcgtgaaggtgaacccagctgcccagcctgtgagcagccctgcccagaccagcctgcagcccggggccaagtacccagatgtggccagccccaccctgcggcggctgtttggaggcaagcccaccaagcaggtgcccatcgccacagctgagaacatgaagaacagcgtggtgatcagcaacccccacgccaccatgacccagcagggcaacctggacagccccagcggcagcggcgtgctgagcagcggcagcagcagccccctgtacagcaagaatgtggacctgaaccagagccccctggccagcagccccagcagcgcccacagcgcccccagcaacagcctgacctggggcaccaatgccagcagcagcagcgctgtgtccaaggatggcctgggcttccagagcgtgagcagcctgcacaccagctgtgagagcattgacatcagcctgagcagtggaggagtgcccagccacaacagcagcacaggcctcatcgccagcagcaaggatgacagcctgaccccatttgtgaggaccaacagcgtgaagaccaccctgtctgagagccccctgagcagccctgctgccagccccaagttctgccgcagcaccctgcccaggaagcaggacagcgacccccacctggacaggaacaccctgcccaagaagggcctgcgctacacccccaccagccagctgcggacccaggaggatgccaaggagtggctgcggagccacagcgctgggggcctgcaggacacagctgccaacagccccttcagcagcggcagctctgtgaccagccccagcggcacccgcttcaacttcagccagctggccagccccaccaccgtgacccagatgagcctgagcaaccccaccatgctgcggacccacagcctgagcaatgctgatggccagtatgacccctacacagacagccgcttcaggaacagctccatgagcctggatgagaagagcaggaccatgagccgcagcggcagcttcagagatggctttgaggaggagagctgggagaagagctctgtggacaactttgtgtcccggctgcacagcagcctgcacttcagcctgcccctcttccaccacgcccgctatgagctggtgcacggcagcagcctgagcctggtgagcagcaccagctctgtgtacagcaccccagaggagaagtgccagagcgagatcaggaagctgcggcgggagctggatgccagccaggagaaggtgtctgccctgaccacccagctgacagccaatgcccacctggtggccgcctttgagcagagcctgggcaacatgaccatccggctgcagagcctgaccatgacagctgagcagaaggacagcgagctgaatgagctgaggaagaccatcgagctgctgaagaagcagaatgctgctgcccaggccgccatcaatggagtcatcaacaccccagagctgaactgcaagggaaatggaacagcccagagcgctgacctgcgcatccggcggcagcacagcagtgacagcgtgagcagcatcaacagcgccaccagccacagctctgtgggcagcaacattgaaagtgacagcaagaagaagaagaggaagaactgggtgaatgagctgcggagcagcttcaagcaggccttcggcaagaagaagagccccaagagcgccagcagccacagcgacatcgaggagatgacagacagcagcctgcccagcagccccaagctgccccacaacggcagcacaggcagcacccccctgctgaggaacagccacagcaacagcctcatcagcgagtgcatggattctgaggccgagaccgtgatgcagctgagaaatgagctgcgggacaaggagatgaagctgacagacatccggctggaggccctgagcagcgcccaccagctggaccagctgcgggaggccatgaacaggatgcagagcgagattgagaagctgaaggccgagaatgaccggctgaagtctgagagccagggcagcggctgcagccgggcccccagccaggtgtccatcagcgccagcccccggcagagcatgggcctgagccagcacagcctgaacctgacagagagcaccagcctggacatgctgctggatgacaccggggagtgcagcgccaggaaggagggcggccgccacgtgaagatcgtggtgtccttccaggaggagatgaagtggaaggaggacagccggccccacctgttcctgattggctgcattggagtgtctgggaagaccaagtgggatgtgctggatggagtggtgagaagactcttcaaggagtacatcatccacgtggaccctgtgtcccagctgggcctgaacagcgacagcgtgctgggctacagcattggagagatcaagaggagcaacaccagcgagaccccagagctgctgccctgtggctacctggtgggggagaacaccaccatctctgtgacagtgaagggcctggccgagaacagcctggacagcctggtgtttgagagcctcatccccaagcccatcctgcagagatatgtgtccctgctgattgagcaccggcgcatcatcctgagcggccccagcggcaccgggaagacctacctggccaaccggctgtctgagtacatcgtgctgcgggagggccgggagctgacagatggagtgattgccaccttcaacgtggaccacaagagcagcaaggagctgcggcagtacctgagcaacctggccgaccagtgcaacagcgagaacaatgctgtggacatgcccctggtgatcatcctggacaacctgcaccacgtgagcagcctgggggagatcttcaacggcctgctgaactgcaagtaccacaagtgcccctacatcatcggcaccatgaaccaggccaccagcagcacccccaacctgcagctgcaccacaacttccgctgggtgctgtgtgccaaccacacagagcctgtgaagggcttcctgggccgcttcctgcggaggaagctgatggagacagagatcagcggccgggtgaggaacatggagctggtgaagatcatcgactggatccccaaggtgtggcaccacctgaaccgcttcctggaggcccacagcagcagtgatgtgaccatcggccccaggctcttcctgagctgccccattgatgtggatggcagccgggtgtggttcacagacctgtggaactacagcatcatcccctacctgctggaggccgtgcgggagggcctgcagctgtatggaagaagagccccctgggaggaccctgccaagtgggtgatggacacctacccctgggccgccagcccccagcagcacgagtggccacccctgctgcagctgcggccagaagatgtgggctttgatggctacagcatgccccgggagggcagcaccagcaagcagatgccacccagtgatgctgagggggaccccctgatgaacatgctgatgaggctgcaggaggccgccaactacagcagcccccagagctatgacagcgacagcaacagcaacagccaccatgatgacatcctggacagcagcctggagagcaccctgtag

SEQ ID NO: 161679 - DNA, 7254 bp, Artificial Sequence
  Description of Artificial Sequence: Synthetic coding sequence
atgtctgtgatgctgtggcgctgggagcagaacaacaccaccatgaagctgcagatctacacagactgggccaaccactacctggccaagagcggccacaagaggctcatccgggacctgcagcaggatgtgacagatggagtgctgctggcccagatcatccaggtggtggccaatgagaagattgaggacatcaatggctgccccaagaacagaagccagatgattgaaaatattgatgcctgcctgaacttcctggccgccaagggcatcaacatccagggcctgtctgctgaggagatcagaaatggaaacctgaaggccatcctgggcctcttcttcagcctgagccgctacaagcagcagcagcagcagccccagaagcagcacctgagcagccccctgcccccagctgtgtcccaggtggccggggcccccagccagtgccaggccggcaccccccagcagcaggtgcctgtgaccccccaggccccctgccagccccaccagcctgccccccaccagcagagcaaggcccaggccgagatgcagagcagcgccagcagcaaggacagcagccagagcaagatcatccgcttcaccctgggccagaagaagatcagccggctgcccggccccacagcccgggtgtctgctgctggcagcgaggccaagacccggggcggcagcaccacagccaacaacagaagaagccagagcttcaacaactatgacaagagcaagcctgtgaccagccccccacctccacccagcagccatgagaaggagcccctggccagcagcgccagcagccaccctggcatgtctgacaatgccccagccagcctggagagcggcagcagcagcacccccaccaactgcagcaccagcagcgccatcccccagcctggagctgccaccaagccctggaggagcaagagcctgtctgtgaagcacagcgccaccgtgtccatgctgtctgtgaagcccccaggccctgaggccccccggcccaccccagaggccatgaagccagcccccaacaaccagaagtccatgctggagaagctgaagctgttcaacagcaaaggaggcagcaaggccggggagggccctggcagccgggacaccagctgtgagcggctggagaccctgcccagctttgaggagagcgaggagctggaggccgccagcaggatgctgaccaccgtgggccctgccagcagcagccccaagatcgccctgaagggcatcgcccagaggaccttcagccgggccctgaccaacaagaagagcagcctgaagggaaatgagaaggagaaggagaagcagcagcgggagaaggacaaggagaagagcaaggacctggccaagagggcctctgtgacagagcggctggacctgaaggaggagcccaaggaggaccccagcggggctgctgtgcctgagatgcccaagaagagcagcaagatcgccagcttcatccccaagggcggcaagctgaacagcgccaagaaggagcccatggcccccagccacagcggcatccccaagccaggcatgaagtccatgcctgggaagagccccagcgccccagcccccagcaaggagggggagaggagccgcagcggcaagctgagcagcggcctgccccagcagaagccccagctggatggccgccacagcagcagcagcagcagcctggccagcagcgagggcaagggccctgggggcaccaccctgaaccacagcatcagcagccagacagtgtctggctctgtgggcaccacccagaccaccggcagcaacacagtgtctgtgcagctgccccagccccagcagcagtacaaccaccccaacacagccaccgtggcccccttcctgtaccgcagccagacagacacagagggcaatgtgacagctgagagcagcagcactggagtgtctgtggagcccagccacttcaccaagacaggccagcctgccctggaggagctgactggagaagatcctgaggcccggcggctgaggacagtgaagaacattgctgacctgcggcagaacctggaggagaccatgagcagcctgcggggcacccaggtgacccacagcaccctggagaccacctttgacaccaacgtgaccacagagatgagcggccgcagcatcctgagcctgaccggccggcccacccccctgtcctggaggctgggccagagcagcccccggctgcaggccggagatgcccccagcatgggaaatggctacccaccccgggccaatgccagccgcttcatcaacacagagagcggccgctacgtgtacagcgcccccctgcggcggcagctggccagccggggcagctctgtgtgccacgtggatgtgtctgacaaggctggagatgagatggacctggagggcatctccatggatgcccctggctacatgtctgatggagatgtgctgagcaagaacatcagaacagatgacatcaccagcggctacatgacagatggcggcctgggcctgtacacccggcggctgaaccggctgcctgatggcatggctgtggtgcgggagaccctgcagaggaacaccagcctgggcctgggagatgctgacagctgggatgacagcagctctgtgagcagcggcatcagtgacaccatcgacaacctgagcacagatgacatcaacaccagcagcagcatcagcagctatgccaacaccccagccagcagcaggaagaacctggatgtgcagacagatgctgagaagcacagccaggtggagaggaacagcctgtggagcggagatgatgtgaagaagagtgatggcggcagtgacagcggcatcaagatggagcccggcagcaagtggaggaggaaccccagtgatgtgtctgatgaaagtgacaagagcaccagcggcaagaagaaccctgtgatcagccagacaggctcctggaggcggggcatgacagcccaggtgggcatcaccatgcccaggaccaagcccagcgccccagctggggccctgaagaccccaggcaccgggaagacagatgatgccaaggtgtctgagaagggccgcctgagccccaaggccagccaggtgaagaggagccccagtgatgctggccgcagcagtggagatgagagcaagaagcccctgcccagcagcagcaggacccccacagccaatgccaacagctttggcttcaagaagcagagcggcagcgctgctggcctggccatgatcacagccagcggcgtgacagtgaccagccgcagcgccaccctgggcaagatccccaagagcagcgccctggtgagccgctctgctggcaggaagagctccatggatggagcccagaaccaggatgatggctacctggccctgagcagcaggaccaacctgcagtaccgcagcctgccccggcccagcaagagcaacagcagaaatggagctggcaacagaagcagcaccagcagcattgacagcaacatcagcagcaagtctgctggcctgcctgtgcccaagctgcgggagcccagcaagacagccctgggcagcagcctgcccggcctggtgaaccagacagacaaggagaagggcatcagcagtgacaatgaatctgtggccagctgcaacagcgtgaaggtgaacccagctgcccagcctgtgagcagccctgcccagaccagcctgcagcccggggccaagtacccagatgtggccagccccaccctgcggcggctgtttggaggcaagcccaccaagcaggtgcccatcgccacagctgagaacatgaagaacagcgtggtgatcagcaacccccacgccaccatgacccagcagggcaacctggacagccccagcggcagcggcgtgctgagcagcggcagcagcagccccctgtacagcaagaatgtggacctgaaccagagccccctggccagcagccccagcagcgcccacagcgcccccagcaacagcctgacctggggcaccaatgccagcagcagcagcgctgtgtccaaggatggcctgggcttccagagcgtgagcagcctgcacaccagctgtgagagcattgacatcagcctgagcagcggcggcgtgcccagccacaacagcagcacaggcctgattgccagcagcaaggatgacagcctgaccccatttgtgaggaccaacagcgtgaagaccaccctgtctgagagccccctgagcagccctgctgccagccccaagttctgccgcagcaccctgcccaggaagcaggacagcgacccccacctggacaggaacaccctgcccaagaagggcctgcgctacacccccaccagccagctgcggacccaggaggatgccaaggagtggctgcggagccacagcgctgggggcctgcaggacacagctgccaacagccccttcagcagcggcagctctgtgaccagccccagcggcacccgcttcaacttcagccagctggccagccccaccaccgtgacccagatgagcctgagcaaccccaccatgctgcggacccacagcctgagcaatgctgatggccagtatgacccctacacagacagccgcttcaggaacagctccatgagcctggatgagaagagcaggaccatgagccgcagcggcagcttcagagatggctttgaggaggagagctgggagaagagctctgtggacaactttgtgtcccggctgcacagcagcctgcacttcagcctgcccctcttccaccacgcccgctatgagctggtgcacggcagcagcctgagcctggtgagcagcaccagctctgtgtacagcaccccagaggagaagtgccagagcgagatcaggaagctgcggcgggagctggatgccagccaggagaaggtgtctgccctgaccacccagctgacagccaatgcccacctggtggccgcctttgagcagagcctgggcaacatgaccatccggctgcagagcctgaccatgacagctgagcagaaggacagcgagctgaatgagctgaggaagaccatcgagctgctgaagaagcagaatgctgctgcccaggccgccatcaacggggtcatcaacaccccagagctgaactgcaagggaaatggaacagcccagagcgctgacctgcgcatccggcggcagcacagcagtgacagcgtgagcagcatcaacagcgccaccagccacagctctgtgggcagcaacatcgagagtgacagcaagaagaagaagaggaagaactgggtgaatgagctgcggagcagcttcaagcaggccttcggcaagaagaagagccccaagagcgccagcagccacagcgacatcgaggagatgacagacagcagcctgcccagcagccccaagctgccccacaacggcagcacaggcagcacccccctgctgaggaacagccacagcaacagcctcatcagcgagtgcatggacagcgaggccgagaccgtgatgcagctgagaaatgagctgcgggacaaggagatgaagctgacagacatccggctggaggccctgagcagcgcccaccagctggaccagctgcgggaggccatgaacaggatgcagagcgagattgagaagctgaaggcagaaaatgaccggctgaagtctgagagccagggcagcggctgcagccgggcccccagccaggtgtccatcagcgccagcccccggcagagcatgggcctgagccagcacagcctgaacctgacagagagcaccagcctggacatgctgctggatgacacaggagaatgttctgccaggaaggagggcggcagacatgtgaagatcgtggtgtccttccaggaggagatgaagtggaaggaggacagccggccccacctgttcctgattggctgcatcggcgtgtctgggaagaccaagtgggatgtgctggatggagtggtgcggcggctcttcaaggagtacatcatccacgtggaccctgtgtcccagctgggcctgaacagcgacagcgtgctgggctacagcatcggggagatcaagaggagcaacaccagcgagaccccagagctgctgccctgtggctacctggtgggggagaacaccaccatctctgtgacagtgaagggcctggccgagaacagcctggacagcctggtgtttgagagcctcatccccaagcccatcctgcagcgctacgtgtccctgctgattgagcaccggcgcatcatcctgagcggccccagcggcaccgggaagacctacctggccaaccggctgtctgagtacatcgtgctgcgggagggccgggagctgacagatggagtcatcgccaccttcaacgtggaccacaagagcagcaaggagctgcggcagtacctgagcaacctggccgaccagtgcaacagtgaaaataatgctgtggacatgcccctggtgatcatcctggacaacctgcaccacgtgagcagcctgggggagatcttcaacggcctgctgaactgcaagtaccacaagtgcccctacatcatcggcaccatgaaccaggccaccagcagcacccccaacctgcagctgcaccacaacttccgctgggtgctgtgtgccaaccacacagagcctgtgaagggcttcctgggccgcttcctgcggaggaagctgatggagacagagatcagcggccgggtgaggaacatggagctggtgaagatcatcgactggatccccaaggtgtggcaccacctgaaccgcttcctggaggcccacagcagcagtgatgtgaccatcggccccaggctcttcctgagctgccccattgatgtggatggcagccgggtgtggttcacagacctgtggaactacagcatcatcccctacctgctggaggccgtgcgggagggcctgcagctgtatggccggcgggccccctgggaggaccctgccaagtgggtgatggacacctacccctgggccgccagcccccagcagcacgagtggccacccctgctgcagctgcggccagaagatgtgggctttgatggctacagcatgccccgggagggcagcaccagcaagcagatgcccccatctgatgctgagggggaccccctgatgaacatgctgatgaggctgcaggaggccgccaactacagcagcccccagagctatgacagcgacagcaacagcaacagccaccatgatgacatcctggacagcagcctggagagcaccctgtag

SEQ ID NO: 161680 - DNA, 4482 bp, Artificial Sequence; identical to SEQ ID NO: 161675
  Description of Artificial Sequence: Synthetic coding sequence

SEQ ID NO: 161681 - DNA, 2451 bp, Artificial Sequence
  Description of Artificial Sequence: Synthetic coding sequence
atgctgtggcccaggaacctgacctcctgggatgacagcagctctgtgagcagcggcatcagtgacaccatcgacaacctgagcacagatgacatcaacaccagcagcagcatcagcagctatgccaacaccccagccagcagcaggaagaacctggatgtgcagacagatgctgagaagcacagccaggtggagaggaacagcctgtggagcggagatgatgtgaagaagagtgatggcggcagtgacagcggcatcaagatggagcccggcagcaagtggaggaggaaccccagtgatgtgtctgatgaaagtgacaagagcaccagcggcaagaagaaccctgtgatcagccagacaggctcctggaggcggggcatgacagcccaggtgggcatcaccatgcccaggaccaagcccagcgccccagctggggccctgaagaccccaggcaccgggaagacagatgatgccaaggtgtctgagaagggccgcctgagccccaaggccagccaggtgaagaggagccccagtgatgctggccgcagcagtggagatgagagcaagaagcccctgcccagcagcagcaggacccccacagccaatgccaacagctttggcttcaagaagcagagcggcagcgctgctggcctggccatgatcacagccagcggcgtgacagtgaccagccgcagcgccaccctgggcaagatccccaagagcagcgccctggtgagccgctctgctggcaggaagagctccatggatggagcccagaaccaggatgatggctacctggccctgagcagcaggaccaacctgcagtaccgcagcctgccccggcccagcaagagcaacagcagaaatggagctggcaacagaagcagcaccagcagcattgacagcaacatcagcagcaagtctgctggcctgcctgtgcccaagctgcgggagcccagcaagacagccctgggcagcagcctgcccggcctggtgaaccagacagacaaggagaagggcatcagcagtgacaatgaatctgtggccagctgcaacagcgtgaaggtgaacccagctgcccagcctgtgagcagccctgcccagaccagcctgcagcccggggccaagtacccagatgtggccagccccaccctgcggcggctgtttggaggcaagcccaccaagcaggtgcccatcgccacagctgagaacatgaagaacagcgtggtgatcagcaacccccacgccaccatgacccagcagggcaacctggacagccccagcggcagcggcgtgctgagcagcggcagcagcagccccctgtacagcaagaatgtggacctgaaccagagccccctggccagcagccccagcagcgcccacagcgcccccagcaacagcctgacctggggcaccaatgccagcagcagcagcgctgtgtccaaggatggcctgggcttccagagcgtgagcagcctgcacaccagctgtgagagcattgacatcagcctgagcagcggcggcgtgcccagccacaacagcagcacaggcctgattgccagcagcaaggatgacagcctgaccccatttgtgaggaccaacagcgtgaagaccaccctgtctgagcgctacacccccaccagccagctgcggacccaggaggatgccaaggagtggctgcggagccacagcgctgggggcctgcaggacacagctgccaacagccccttcagcagcggcagctctgtgaccagccccagcggcacccgcttcaacttcagccagctggccagccccaccaccgtgacccagatgagcctgagcaaccccaccatgctgcggacccacagcctgagcaatgctgatggccagtatgacccctacacagacagccgcttcaggaacagctccatgagcctggatgagaagagcaggaccatgagccgcagcggcagcttcagagatggctttgaggaggtgcacggcagcagcctgagcctggtgagcagcaccagctctgtgtacagcaccccagaggagaagtgccagagcgagatcaggaagctgcggcgggagctggatgccagccaggagaaggtgtctgccctgaccacccagctgacagccaatgcccacctggtggccgcctttgagcagagcctgggcaacatgaccatccggctgcagagcctgaccatgacagctgagcagaaggacagcgagctgaatgagctgaggaagaccatcgagctgctgaagaagcagaatgctgctgcccaggccgccatcaacggggtcatcaacaccccagagctgaactgcaagggaaatggaacagcccagagcgctgacctgcgcatccggcggcagcacagcagtgacagcgtgagcagcatcaacagcgccaccagccacagctctgtgggcagcaacatcgagagtgacagctag

SEQ ID NO: 161682 - DNA, 7260 bp, Artificial Sequence
  Description of Artificial Sequence: Synthetic coding sequence
atggccatcgacctgtactgcggcctggcctgcctgtggggcatccacgagccccggcagatctacacagactgggccaaccactacctggccaagagcggccacaagaggctcatccgggacctgcagcaggatgtgacagatggagtgctgctggcccagatcatccaggtggtggccaatgagaagattgaggacatcaatggctgccccaagaacagaagccagatgattgaaaatattgatgcctgcctgaacttcctggccgccaagggcatcaacatccagggcctgtctgctgaggagatcagaaatggaaacctgaaggccatcctgggcctcttcttcagcctgagccgctacaagcagcagcagcagcagccccagaagcagcacctgagcagccccctgcccccagctgtgtcccaggtggccggggcccccagccagtgccaggccggcaccccccagcagcaggtgcctgtgaccccccaggccccctgccagccccaccagcctgccccccaccagcagagcaaggcccaggccgagatgcagagcagcgccagcagcaaggacagcagccagagcaagatcatccgcttcaccctgggccagaagaagatcagccggctgcccggccccacagcccgggtgtctgctgctggcagcgaggccaagacccggggcggcagcaccacagccaacaacagaagaagccagagcttcaacaactatgacaagagcaagcctgtgaccagccccccacctccacccagcagccatgagaaggagcccctggccagcagcgccagcagccaccctggcatgtctgacaatgccccagccagcctggagagcggcagcagcagcacccccaccaactgcagcaccagcagcgccatcccccagcctggagctgccaccaagccctggaggagcaagagcctgtctgtgaagcacagcgccaccgtgtccatgctgtctgtgaagcccccaggccctgaggccccccggcccaccccagaggccatgaagccagcccccaacaaccagaagtccatgctggagaagctgaagctgttcaacagcaaaggaggcagcaaggccggggagggccctggcagccgggacaccagctgtgagcggctggagaccctgcccagctttgaggagagcgaggagctggaggccgccagcaggatgctgaccaccgtgggccctgccagcagcagccccaagatcgccctgaagggcatcgcccagaggaccttcagccgggccctgaccaacaagaagagcagcctgaagggaaatgagaaggagaaggagaagcagcagcgggagaaggacaaggagaagagcaaggacctggccaagagggcctctgtgacagagcggctggacctgaaggaggagcccaaggaggaccccagcggggctgctgtgcctgagatgcccaagaagagcagcaagatcgccagcttcatccccaagggcggcaagctgaacagcgccaagaaggagcccatggcccccagccacagcggcatccccaagccaggcatgaagtccatgcctgggaagagccccagcgccccagcccccagcaaggagggggagaggagccgcagcggcaagctgagcagcggcctgccccagcagaagccccagctggatggccgccacagcagcagcagcagcagcctggccagcagcgagggcaagggccctgggggcaccaccctgaaccacagcatcagcagccagacagtgtctggctctgtgggcaccacccagaccaccggcagcaacacagtgtctgtgcagctgccccagccccagcagcagtacaaccaccccaacacagccaccgtggcccccttcctgtaccgcagccagacagacacagagggcaatgtgacagctgagagcagcagcactggagtgtctgtggagcccagccacttcaccaagacaggccagcctgccctggaggagctgactggagaagatcctgaggcccggcggctgaggacagtgaagaacattgctgacctgcggcagaacctggaggagaccatgagcagcctgcggggcacccaggtgacccacagcaccctggagaccacctttgacaccaacgtgaccacagagatgagcggccgcagcatcctgagcctgaccggccggcccacccccctgtcctggaggctgggccagagcagcccccggctgcaggccggagatgcccccagcatgggaaatggctacccaccccgggccaatgccagccgcttcatcaacacagagagcggccgctacgtgtacagcgcccccctgcggcggcagctggccagccggggcagctctgtgtgccacgtggatgtgtctgacaaggctggagatgagatggacctggagggcatctccatggatgcccctggctacatgtctgatggagatgtgctgagcaagaacatcagaacagatgacatcaccagcggctacatgacagatggcggcctgggcctgtacacccggcggctgaaccggctgcctgatggcatggctgtggtgcgggagaccctgcagaggaacaccagcctgggcctgggagatgctgacagctgggatgacagcagctctgtgagcagcggcatcagtgacaccatcgacaacctgagcacagatgacatcaacaccagcagcagcatcagcagctatgccaacaccccagccagcagcaggaagaacctggatgtgcagacagatgctgagaagcacagccaggtggagaggaacagcctgtggagcggagatgatgtgaagaagagtgatggcggcagtgacagcggcatcaagatggagcccggcagcaagtggaggaggaaccccagtgatgtgtctgatgaaagtgacaagagcaccagcggcaagaagaaccctgtgatcagccagacaggctcctggaggcggggcatgacagcccaggtgggcatcaccatgcccaggaccaagcccagcgccccagctggggccctgaagaccccaggcaccgggaagacagatgatgccaaggtgtctgagaagggccgcctgagccccaaggccagccaggtgaagaggagccccagtgatgctggccgcagcagtggagatgagagcaagaagcccctgcccagcagcagcaggacccccacagccaatgccaacagctttggcttcaagaagcagagcggcagcgctgctggcctggccatgatcacagccagcggcgtgacagtgaccagccgcagcgccaccctgggcaagatccccaagagcagcgccctggtgagccgctctgctggcaggaagagctccatggatggagcccagaaccaggatgatggctacctggccctgagcagcaggaccaacctgcagtaccgcagcctgccccggcccagcaagagcaacagcagaaatggagctggcaacagaagcagcaccagcagcattgacagcaacatcagcagcaagtctgctggcctgcctgtgcccaagctgcgggagcccagcaagacagccctgggcagcagcctgcccggcctggtgaaccagacagacaaggagaagggcatcagcagtgacaatgaatctgtggccagctgcaacagcgtgaaggtgaacccagctgcccagcctgtgagcagccctgcccagaccagcctgcagcccggggccaagtacccagatgtggccagccccaccctgcggcggctgtttggaggcaagcccaccaagcaggtgcccatcgccacagctgagaacatgaagaacagcgtggtgatcagcaacccccacgccaccatgacccagcagggcaacctggacagccccagcggcagcggcgtgctgagcagcggcagcagcagccccctgtacagcaagaatgtggacctgaaccagagccccctggccagcagccccagcagcgcccacagcgcccccagcaacagcctgacctggggcaccaatgccagcagcagcagcgctgtgtccaaggatggcctgggcttccagagcgtgagcagcctgcacaccagctgtgagagcattgacatcagcctgagcagcggcggcgtgcccagccacaacagcagcacaggcctgattgccagcagcaaggatgacagcctgaccccatttgtgaggaccaacagcgtgaagaccaccctgtctgagagccccctgagcagccctgctgccagccccaagttctgccgcagcaccctgcccaggaagcaggacagcgacccccacctggacaggaacaccctgcccaagaagggcctgcgctacacccccaccagccagctgcggacccaggaggatgccaaggagtggctgcggagccacagcgctgggggcctgcaggacacagctgccaacagccccttcagcagcggcagctctgtgaccagccccagcggcacccgcttcaacttcagccagctggccagccccaccaccgtgacccagatgagcctgagcaaccccaccatgctgcggacccacagcctgagcaatgctgatggccagtatgacccctacacagacagccgcttcaggaacagctccatgagcctggatgagaagagcaggaccatgagccgcagcggcagcttcagagatggctttgaggaggagagctgggagaagagctctgtggacaactttgtgtcccggctgcacagcagcctgcacttcagcctgcccctcttccaccacgcccgctatgagctggtgcacggcagcagcctgagcctggtgagcagcaccagctctgtgtacagcaccccagaggagaagtgccagagcgagatcaggaagctgcggcgggagctggatgccagccaggagaaggtgtctgccctgaccacccagctgacagccaatgcccacctggtggccgcctttgagcagagcctgggcaacatgaccatccggctgcagagcctgaccatgacagctgagcagaaggacagcgagctgaatgagctgaggaagaccatcgagctgctgaagaagcagaatgctgctgcccaggccgccatcaacggggtcatcaacaccccagagctgaactgcaagggaaatggaacagcccagagcgctgacctgcgcatccggcggcagcacagcagtgacagcgtgagcagcatcaacagcgccaccagccacagctctgtgggcagcaacatcgagagtgacagcaagaagaagaagaggaagaactgggtgaatgagctgcggagcagcttcaagcaggccttcggcaagaagaagagccccaagagcgccagcagccacagcgacatcgaggagatgacagacagcagcctgcccagcagccccaagctgccccacaacggcagcacaggcagcacccccctgctgaggaacagccacagcaacagcctcatcagcgagtgcatggacagcgaggccgagaccgtgatgcagctgagaaatgagctgcgggacaaggagatgaagctgacagacatccggctggaggccctgagcagcgcccaccagctggaccagctgcgggaggccatgaacaggatgcagagcgagattgagaagctgaaggcagaaaatgaccggctgaagtctgagagccagggcagcggctgcagccgggcccccagccaggtgtccatcagcgccagcccccggcagagcatgggcctgagccagcacagcctgaacctgacagagagcaccagcctggacatgctgctggatgacacaggagaatgttctgccaggaaggagggcggcagacatgtgaagatcgtggtgtccttccaggaggagatgaagtggaaggaggacagccggccccacctgttcctgattggctgcatcggcgtgtctgggaagaccaagtgggatgtgctggatggagtggtgcggcggctcttcaaggagtacatcatccacgtggaccctgtgtcccagctgggcctgaacagcgacagcgtgctgggctacagcatcggggagatcaagaggagcaacaccagcgagaccccagagctgctgccctgtggctacctggtgggggagaacaccaccatctctgtgacagtgaagggcctggccgagaacagcctggacagcctggtgtttgagagcctcatccccaagcccatcctgcagcgctacgtgtccctgctgattgagcaccggcgcatcatcctgagcggccccagcggcaccgggaagacctacctggccaaccggctgtctgagtacatcgtgctgcgggagggccgggagctgacagatggagtcatcgccaccttcaacgtggaccacaagagcagcaaggagctgcggcagtacctgagcaacctggccgaccagtgcaacagtgaaaataatgctgtggacatgcccctggtgatcatcctggacaacctgcaccacgtgagcagcctgggggagatcttcaacggcctgctgaactgcaagtaccacaagtgcccctacatcatcggcaccatgaaccaggccaccagcagcacccccaacctgcagctgcaccacaacttccgctgggtgctgtgtgccaaccacacagagcctgtgaagggcttcctgggccgcttcctgcggaggaagctgatggagacagagatcagcggccgggtgaggaacatggagctggtgaagatcatcgactggatccccaaggtgtggcaccacctgaaccgcttcctggaggcccacagcagcagtgatgtgaccatcggccccaggctcttcctgagctgccccattgatgtggatggcagccgggtgtggttcacagacctgtggaactacagcatcatcccctacctgctggaggccgtgcgggagggcctgcagctgtatggccggcgggccccctgggaggaccctgccaagtgggtgatggacacctacccctgggccgccagcccccagcagcacgagtggccacccctgctgcagctgcggccagaagatgtgggctttgatggctacagcatgccccgggagggcagcaccagcaagcagatgcccccatctgatgctgagggggaccccctgatgaacatgctgatgaggctgcaggaggccgccaactacagcagcccccagagctatgacagcgacagcaacagcaacagccaccatgatgacatcctggacagcagcctggagagcaccctgtag

SEQ ID NO: 161683 - DNA, 7098 bp, Artificial Sequence
  Description of Artificial Sequence: Synthetic coding sequence
atggagagcgtgtctgagagcagccagcagcagaagaggaagcctgtgatccacggcctggaggaccagaagaggatctacacagactgggccaaccactacctggccaagagcggccacaagaggctcatccgggacctgcagcaggatgtgacagatggagtgctgctggcccagatcatccaggtggtggccaatgagaagattgaggacatcaatggctgccccaagaacagaagccagatgattgagaacattgatgcctgcctgaacttcctggccgccaagggcatcaacatccagggcctgtctgctgaggagatcagaaatggaaacctgaaggccatcctgggcctcttcttcagcctgagccgctacaagcagcagcagcagcagccccagaagcagcacctgagcagccccctgcccccagctgtgtcccaggtggccggggcccccagccagtgccaggccggcaccccccagcagcaggtgcctgtgaccccccaggccccctgccagccccaccagcctgccccccaccagcagagcaaggcccaggccgagatgcagagccggctgcccggccccacagcccgggtgtctgctgctggcagcgaggccaagacccggggcggcagcaccacagccaacaacagaagaagccagagcttcaacaactatgacaagagcaagcctgtgaccagccccccacctccacccagcagccatgagaaggagcccctggccagcagcgccagcagccaccctggcatgtctgacaatgccccagccagcctggagagcggcagcagcagcacccccaccaactgcagcaccagcagcgccatcccccagcctggagctgccaccaagccctggaggagcaagagcctgtctgtgaagcacagcgccaccgtgtccatgctgtctgtgaagcccccaggccctgaggccccccggcccaccccagaggccatgaagccagcccccaacaaccagaagtccatgctggagaagctgaagctgttcaacagcaaaggaggcagcaaggccggggagggccctggcagccgggacaccagctgtgagcggctggagaccctgcccagctttgaggagagcgaggagctggaggccgccagcaggatgctgaccaccgtgggccctgccagcagcagccccaagatcgccctgaagggcatcgcccagaggaccttcagccgggccctgaccaacaagaagagcagcctgaagggaaatgagaaggagaaggagaagcagcagcgggagaaggacaaggagaagagcaaggacctggccaagagggcctctgtgacagagcggctggacctgaaggaggagcccaaggaggaccccagcggggctgctgtgcctgagatgcccaagaagagcagcaagatcgccagcttcatccccaagggcggcaagctgaacagcgccaagaaggagcccatggcccccagccacagcggcatccccaagccaggcatgaagtccatgcctgggaagagccccagcgccccagcccccagcaaggagggggagaggagccgcagcggcaagctgagcagcggcctgccccagcagaagccccagctggatggccgccacagcagcagcagcagcagcctggccagcagcgagggcaagggccctgggggcaccaccctgaaccacagcatcagcagccagacagtgtctggctctgtgggcaccacccagaccaccggcagcaacacagtgtctgtgcagctgccccagccccagcagcagtacaaccaccccaacacagccaccgtggcccccttcctgtaccgcagccagacagacacagagggcaatgtgacagctgagagcagcagcactggagtgtctgtggagcccagccacttcaccaagacaggccagcctgccctggaggagctgactggagaagatcctgaggcccggcggctgaggacagtgaagaacattgctgacctgcggcagaacctggaggagaccatgagcagcctgcggggcacccaggtgacccacagcaccctggagaccacctttgacaccaacgtgaccacagagatgagcggccgcagcatcctgagcctgaccggccggcccacccccctgtcctggaggctgggccagagcagcccccggctgcaggccggagatgcccccagcatgggaaatggctacccaccccgggccaatgccagccgcttcatcaacacagagagcggccgctacgtgtacagcgcccccctgcggcggcagctggccagccggggcagctctgtgtgccacgtggatgtgtctgacaaggctggagatgagatggacctggagggcatctccatggatgcccctggctacatgtctgatggagatgtgctgagcaagaacatcagaacagatgacatcaccagcggctacatgacagatggcggcctgggcctgtacacccggcggctgaaccggctgcctgatggcatggctgtggtgcgggagaccctgcagaggaacaccagcctgggcctgggagatgctgacagctgggatgacagcagctctgtgagcagcggcatcagtgacaccatcgacaacctgagcacagatgacatcaacaccagcagcagcatcagcagctatgccaacaccccagccagcagcaggaagaacctggatgtgcagacagatgctgagaagcacagccaggtggagaggaacagcctgtggagcggagatgatgtgaagaagagtgatggcggcagtgacagcggcatcaagatggagcccggcagcaagtggaggaggaaccccagtgatgtgtctgatgaaagtgacaagagcaccagcggcaagaagaaccctgtgatcagccagacaggctcctggaggcggggcatgacagcccaggtgggcatcaccatgcccaggaccaagcccagcgccccagctggggccctgaagaccccaggcaccgggaagacagatgatgccaaggtgtctgagaagggccgcctgagccccaaggccagccaggtgaagaggagccccagtgatgctggccgcagcagtggagatgagagcaagaagcccctgcccagcagcagcaggacccccacagccaatgccaacagctttggcttcaagaagcagagcggcagcgctgctggcctggccatgatcacagccagcggcgtgacagtgaccagccgcagcgccaccctgggcaagatccccaagagcagcgccctggtgagccgctctgctggcaggaagagctccatggatggagcccagaaccaggatgatggctacctggccctgagcagcaggaccaacctgcagtaccgcagcctgccccggcccagcaagagcaacagcagaaatggagctggcaacagaagcagcaccagcagcattgacagcaacatcagcagcaagtctgctggcctgcctgtgcccaagctgcgggagcccagcaagacagccctgggcagcagcctgcccggcctggtgaaccagacagacaaggagaagggcatcagcagtgacaatgaatctgtggccagctgcaacagcgtgaaggtgaacccagctgcccagcctgtgagcagccctgcccagaccagcctgcagcccggggccaagtacccagatgtggccagccccaccctgcggcggctgtttggaggcaagcccaccaagcaggtgcccatcgccacagctgagaacatgaagaacagcgtggtgatcagcaacccccacgccaccatgacccagcagggcaacctggacagccccagcggcagcggcgtgctgagcagcggcagcagcagccccctgtacagcaagaatgtggacctgaaccagagccccctggccagcagccccagcagcgcccacagcgcccccagcaacagcctgacctggggcaccaatgccagcagcagcagcgctgtgtccaaggatggcctgggcttccagagcgtgagcagcctgcacaccagctgtgagagcattgacatcagcctgagcagcggcggcgtgcccagccacaacagcagcacaggcctgattgccagcagcaaggatgacagcctgaccccatttgtgaggaccaacagcgtgaagaccaccctgtctgagagccccctgagcagccctgctgccagccccaagttctgccgcagcaccctgcccaggaagcaggacagcgacccccacctggacaggaacaccctgcccaagaagggcctgcgctacacccccaccagccagctgcggacccaggaggatgccaaggagtggctgcggagccacagcgctgggggcctgcaggacacagctgccaacagccccttcagcagcggcagctctgtgaccagccccagcggcacccgcttcaacttcagccagctggccagccccaccaccgtgacccagatgagcctgagcaaccccaccatgctgcggacccacagcctgagcaatgctgatggccagtatgacccctacacagacagccgcttcaggaacagctccatgagcctggatgagaagagcaggaccatgagccgcagcggcagcttcagagatggctttgaggaggtgcacggcagcagcctgagcctggtgagcagcaccagctctgtgtacagcaccccagaggagaagtgccagagcgagatcaggaagctgcggcgggagctggatgccagccaggagaaggtgtctgccctgaccacccagctgacagccaatgcccacctggtggccgcctttgagcagagcctgggcaacatgaccatccggctgcagagcctgaccatgacagctgagcagaaggacagcgagctgaatgagctgaggaagaccatcgagctgctgaagaagcagaatgctgctgcccaggccgccatcaatggagtcatcaacaccccagagctgaactgcaagggaaatggaacagcccagagcgctgacctgcgcatccggcggcagcacagcagtgacagcgtgagcagcatcaacagcgccaccagccacagctctgtgggcagcaacattgaaagtgacagcaagaagaagaagaggaagaactggctgcggagcagcttcaagcaggccttcggcaagaagaagagccccaagagcgccagcagccacagcgacatcgaggagatgacagacagcagcctgcccagcagccccaagctgccccacaacggcagcacaggcagcacccccctgctgaggaacagccacagcaacagcctcatcagcgagtgcatggacagcgaggccgagaccgtgatgcagctgagaaatgagctgcgggacaaggagatgaagctgacagacatccggctggaggccctgagcagcgcccaccagctggaccagctgcgggaggccatgaacaggatgcagagcgagattgagaagctgaaggcagaaaatgaccggctgaagtctgagagccagggcagcggctgcagccgggcccccagccaggtgtccatcagcgccagcccccggcagagcatgggcctgagccagcacagcctgaacctgacagagagcaccagcctggacatgctgctggatgacacaggagaatgttctgccaggaaggagggcggcagacatgtgaagatcgtggtgtccttccaggaggagatgaagtggaaggaggacagccggccccacctgttcctgattggctgcatcggcgtgtctgggaagaccaagtgggatgtgctggatggagtggtgcggcggctcttcaaggagtacatcatccacgtggaccctgtgtcccagctgggcctgaacagcgacagcgtgctgggctacagcatcggggagatcaagaggagcaacaccagcgagaccccagagctgctgccctgtggctacctggtgggggagaacaccaccatctctgtgacagtgaagggcctggccgagaacagcctggacagcctggtgtttgagagcctcatccccaagcccatcctgcagcgctacgtgtccctgctgattgagcaccggcgcatcatcctgagcggccccagcggcaccgggaagacctacctggccaaccggctgtctgagtacatcgtgctgcgggagggccgggagctgacagatggagtcatcgccaccttcaacgtggaccacaagagcagcaaggagctgcggcagtacctgagcaacctggccgaccagtgcaacagtgaaaataatgctgtggacatgcccctggtgatcatcctggacaacctgcaccacgtgagcagcctgggggagatcttcaacggcctgctgaactgcaagtaccacaagtgcccctacatcatcggcaccatgaaccaggccaccagcagcacccccaacctgcagctgcaccacaacttccgctgggtgctgtgtgccaaccacacagagcctgtgaagggcttcctgggccgcttcctgcggaggaagctgatggagacagagatcagcggccgggtgaggaacatggagctggtgaagatcatcgactggatccccaaggtgtggcaccacctgaaccgcttcctggaggcccacagcagcagtgatgtgaccatcggccccaggctcttcctgagctgccccattgatgtggatggcagccgggtgtggttcacagacctgtggaactacagcatcatcccctacctgctggaggccgtgcgggagggcctgcagctgtatggccggcgggccccctgggaggaccctgccaagtgggtgatggacacctacccctgggccgccagcccccagcagcacgagtggccacccctgctgcagctgcggccagaagatgtgggctttgatggctacagcatgccccgggagggcagcaccagcaagcagatgcccccatctgatgctgagggggaccccctgatgaacatgctgatgaggctgcaggaggccgccaactacagcagcccccagagctatgacagcgacagcaacagcaacagccaccatgatgacatcctggacagcagcctggagagcaccctgtag

SEQ ID NO: 161684 - DNA, 1089 bp, Artificial Sequence
  Description of Artificial Sequence: Synthetic coding sequence
atgttcagctctgtggcccacctggcccgggccaaccccttcaacaccccccacctgcagctggtgcatgatggcctgggggacctgcggagcagcagccctggccccaccggccagccccggcggcccaggaacctggccgctgctgctgtggaggagcagtacagctgtgactatggcagcggccgcttcttcatcctgtgtggcctgggcggcatcatcagctgtggcaccacccacacagccctggtgcccctggacctggtgaagtgcaggatgcaggtggacccccagaagtacaagggcatcttcaacggcttctctgtgaccctgaaggaggatggagtgcggggcctggccaagggctgggcccccaccttcctgggctacagcatgcagggcctgtgcaagtttggcttctatgaggtgttcaaggtgctgtacagcaacatgctgggggaggagaacacctacctgtggaggaccagcctgtacctggccgccagcgccagcgctgagttctttgctgacatcgccctggcccccatggaggccgccaaggtgcgcatccagacccagcccggctacgccaacaccctgagagatgctgcccccaagatgtacaaggaggagggcctgaaggccttctacaagggcgtggcccccctgtggatgaggcagatcccctacaccatgatgaagtttgcctgctttgagaggacagtggaggccctgtacaagtttgtggtgcccaagcccaggtctgagtgcagcaagccagagcagctggtggtgacctttgtggccggctacatcgccggggtcttctgtgccatcgtgagccaccctgctgacagcgtggtgtctgtgctgaacaaggagaagggcagcagcgccagcctggtgctgaagaggctgggcttcaagggcgtgtggaagggcctgtttgcccgcatcatcatgattggcaccctgacagccctgcagtggttcatctatgattctgtgaaggtgtacttccggctgcccaggcctcctcctcctgagatgcctgagagcctgaagaagaagctgggcctgacccagtag

SEQ ID NO: 161685 - DNA, 6561 bp, Artificial Sequence
  Description of Artificial Sequence: Synthetic coding sequence
atgcctgtgctgggcgtggccagcaagctgcggcagcctgctgtgggcagcaagcctgtgcacacagccctgcccatccccaacctgggcaccaccggcagccagcactgcagcagccggcccctggagctgacagaaacagagagctccatgctgagctgccagctggccctgaagagcacctgtgaatttggagagaagaagcccctgcagggcaaggccaaggagaaggaggacagcaagatctacacagactgggccaaccactacctggccaagagcggccacaagaggctcatcaaggacctgcagcaggacattgctgatggagtgctgctggccgagatcatccagatcatcgccaatgagaaggtggaggacatcaatggctgccccaggagccagagccagatgattgaaaatgtggatgtgtgcctgtccttcctggccgcccggggcgtgaatgtgcagggcctgtctgctgaggagatcagaaatggaaacctgaaggccatcctgggcctcttcttcagcctgagccgctacaagcagcagcagcaccaccagcagcagtactaccagagcctggtggagctgcagcagagggtgacccacgccagcccccccagcgaggccagccaggccaagacccagcaggacatgcagagcagcctggccgcccgctatgccacccagagcaaccacagcggcatcgccaccagccagaagaagcccacccggctgcccggccccagccgggtgcctgctgctggcagcagcagcaaggtgcagggcgccagcaacctgaacagaagaagccagagcttcaacagcattgacaagaacaagccacccaactatgccaatggaaatgagaaggacagcagcaagggcccccagagcagcagtggagtgaatggaaatgtgcagccccccagcacagctggccagcccccagccagcgccatccccagccccagcgccagcaagccctggaggagcaagtccatgaatgtgaagcacagcgccaccagcaccatgctgactgtgaagcagagcagcacagccaccagccccacccccagcagtgaccggctgaagccccctgtgtctgaaggagtgaagacagcccccagcggccagaagtccatgctggagaagttcaagctggtgaatgccaggacagccctgcggcccccccagccccccagcagcggccccagtgatggcggcaaggatgatgatgccttcagcgagagcggggagatggagggcttcaacagcggcctgaacagcggcggcagcaccaacagcagccccaaggtgagccccaagctggccccacccaaggccggcagcaagaacctgagcaacaagaagagcctgctgcagcccaaggagaaggaggagaagaacagagacaagaacaaggtgtgcacagagaagcctgtgaaggaggagaaggaccaggtgacagagatggcccccaagaagaccagcaagatcgccagcctcatccccaagggcagcaagaccacagctgccaagaaggagagcctcatccccagcagcagcggcatccccaagccaggcagcaaggtgcccaccgtgaagcagaccatcagccctggcagcacagccagcaaggagagcgagaagttccgcaccaccaagggcagccccagccagagcctgagcaagcccatcaccatggagaaggccagcgccagcagctgcccagcccccctggagggccgggaggccggccaggccagccccagcggcagctgcaccatgacagtggcccagagcagcggccagagcactggaaatggagctgtgcagctgccccagcagcagcagcacagccaccccaacacagccaccgtggcccccttcatctaccgggcccacagtgaaaatgaaggaacagccctgcccagcgctgacagctgcaccagccccaccaagatggacctgagctacagcaagacagccaagcagtgcctggaggagatcagcggggaggaccctgagaccaggaggatgaggacagtgaagaacattgctgacctgcggcagaacctggaggagaccatgagcagcctgcggggcacccagatcagccacagcaccctggagaccacctttgacagcacagtgaccacagaggtgaatggccgcaccatccccaacctgaccagccggcccacccccatgacctggaggctgggccaggcctgcccccggctgcaggccggagatgcccccagcctgggcgccggctaccccaggagcggcaccagccgcttcatccacacagaccccagccgcttcatgtacaccacccccctgcggcgggctgctgtgtcccggctgggcaacatgagccagattgacatgtctgagaaggccagcagtgacctggacatgagcagcgaggtggatgtgggcggctacatgtctgatggagacatcctgggcaagagcctgaggacagatgacatcaacagcggctacatgacagatggcggcctgaacctgtacaccaggagcctgaaccgcatcccagacacagccaccagccgggacatcatccagaggggcgtgcatgatgtgacagtggatgctgacagctgggatgacagcagctctgtgagcagcggcctgagtgacaccctggacaacatcagcacagatgacctgaacaccaccagctctgtgagcagctacagcaacatcaccgtgcccagcaggaagaacacccagctgaggacagacagcgagaagaggagcaccacagatgagacctgggacagccctgaggagctgaagaagccagaagaagattttgacagccatggagatgctgggggcaagtggaagacagtgagcagcggcctgcctgaggaccctgagaaggccggccagaaggccagcctgtctgtgtcccagacaggctcctggaggcggggcatgtctgcccagggcggggcccccagccggcagaaggccggcaccagcgccctgaagaccccaggcaagacagatgatgccaaggccagcgagaagggcaaggcccccctgaagggcagcagcctgcagaggagccccagtgatgctgggaagagcagtggagatgagggcaagaagccacccagcggcatcggccgcagcacagccaccagcagctttggcttcaagaagcccagcggcgtgggcagcagcgccatgatcaccagcagcggggccaccatcaccagcggcagcgccaccctgggcaagatccccaagtctgctgccatcggcggcaagagcaatgccggcaggaagaccagcctggatggcagccagaaccaggatgatgtggtgctgcacgtgagcagcaagaccaccctgcagtaccgcagcctgccccggcccagcaagagcagcaccagcggcatccctggccggggcggccacaggagcagcaccagcagcattgacagcaatgtgagcagcaagtctgctggggccaccaccagcaagctgcgggagcccaccaagattggcagcggccgcagcagccctgtgacagtgaaccagacagacaaggagaaggagaaggtggccgtgtctgattctgagagcgtgtccctgagcggcagccccaagagcagccccaccagcgccagcgcctgtggggcccagggcctgcggcagcccggcagcaagtacccagacatcgccagccccaccttccgccgctacacccccagcagccggcaggccaaccaggaggagggcaaggagtggctgcggagccacagcactggaggcctgcaggacaccggcaaccagagccccctggtgagccccagcgccatgagcagcagcgctgctgggaagtaccacttcagcaacctggtgagccccaccaacctgagccagttcaacctgcccggccccagcatgatgaggagcaacagcatcccagcccaggacagcagctttgacctgtatgatgacagccagctgtgtggcagcgccaccagcctggaggagcggccccgggccatcagccacagcggcagcttccgggacagcatggaggaggtgcacggcagcagcctgagcctggtgagcagcaccagcagcctgtacagcacagctgaggccggcggcagcctggagcagatccacaagctgcggcgggagctggtggccagccaggagaaggtggccaccctgaccagccagctgagcgccaatgcccacctggtggccgcctttgagaagagcctgggcaacatgacaggccgcctgcagagcctgaccatgacagctgagcagaaggagagcgagctgattgagctgcgggagaccatcgagatgctgaaggcccagaacagcgctgcccaggccgccatccagggcgccctgaatggaccagaccacccccccaaggacctgcgcatccggcggcagcacagcagcgagagcgtgagcagcatcaacagcgccaccagccacagcagcatcggcagcggaaatgatgctgacagcaagaagaagaagaagaagaactgggtgaacagccggggcagcgagctgcggagcagcttcaagcaggccttcggcaagaagaagagcaccaagccacccagcagccacagcgacatcgaggagctgacagacagcagcctgcctgccagccccaagctgccccacaatgctggggactgtggcagcgcctccatgaagcccagccagagcgccagcgccatctgtgagtgcacagaggccgaggccgagatcatcctgcagctgaagtctgagctgcgggagaaggagctgaagctgacagacatccggctggaggccctgagcagcgcccaccacctggaccagatccgggaggccatgaacaggatgcagaatgaaattgagatcctgaaggcagaaaatgaccggctgaaggccgagactggaaacacagccaagcccacccggccccccagcgagagcagcagcagcaccagcagcagcagcagccggcagagcctgggcctgagcctgaacaacctgaacatcacagaagctgtgtccagtgacatcctgctggatgatgctggagatgccaccggccacaaggatggccgctctgtgaagatcatcgtgtccatcagcaagggctacggccgggccaaggaccagaagagccaggcctacctgattggcagcattggagtgtctgggaagaccaagtgggatgtgctggatggagtcatcagaagactcttcaaggagtatgtgttcagaattgacaccagcaccagcctgggcctgagcagtgactgcatcgccagctactgcattggagacctgatccgcagccacaacctggaggtgcctgagctgctgccctgtggctacctggtgggggacaacaacatcatcaccgtgaacctgaagggcgtggaggagaacagcctggacagctttgtgtttgacaccctcatccccaagcccatcacccagcgctacttcaacctgctgatggagcaccaccgcatcatcctgagcggccccagcggcaccgggaagacctacctggccaacaagctggccgagtatgtgatcaccaagagcggcaggaagaagacagaagatgccatcgccaccttcaacgtggaccacaagagcagcaaggagctgcagcagtacctggccaacctggccgagcagtgcagcgctgacaacaacggggtggagctgcctgtggtgatcatcctggacaacctgcaccacgtgggcagcctgagtgacatcttcaacggcttcctgaactgcaagtacaacaagtgcccctacatcatcggcaccatgaaccagggcgtgagcagcagccccaacctggagctgcaccacaacttccgctgggtgctgtgtgccaaccacacagagcctgtgaagggcttcctgggccgctacctgcggaggaagctgattgaaattgaaattgaaagaaacatcagaaataatgacctggtgaagatcatcgactggatccccaagacctggcaccacctgaacagcttcctggagacccacagcagcagtgatgtgaccatcggccccaggctcttcctgccctgccccatggatgtggagggcagccgggtgtggttcatggacctgtggaactacagcctggtgccctacatcctggaggccgtgcgggagggcctgcagatgtatggcaagaggaccccctgggaggaccccagcaagtgggtgctggacacctacccctggagcagcgccaccctgccccaggagagccctgccctgctgcagctgcggccagaagatgtgggctatgagagctgcaccagcaccaaggaggccaccaccagcaagcacatcccccagacagacacagaaggagaccccctgatgaacatgctgatgaagctgcaggaggccgccaactacagcagcacccagagctgtgacagcgagagcaccagccaccacgaggacatcctggacagcagcctggagagcaccctgtag

SEQ ID NO: 161686 - DNA, 2376 bp, Artificial Sequence
  Description of Artificial Sequence: Synthetic coding sequence
atgaccagcctgcacaccagcagcgagagcattgacctgcccctgagccaccacggcagcctgagcggcctgaccaccggcacccatgaggtgcagagcctgctgatgaggacaggctctgtgcgcagcaccctgtctgagcgctacacccccagcagccggcaggccaaccaggaggagggcaaggagtggctgcggagccacagcactggaggcctgcaggacaccggcaaccagagccccctggtgagccccagcgccatgagcagcagcgctgctgggaagtaccacttcagcaacctggtgagccccaccaacctgagccagttcaacctgcccggccccagcatgatgaggagcaacagcatcccagcccaggacagcagctttgacctgtatgatgacagccagctgtgtggcagcgccaccagcctggaggagcggccccgggccatcagccacagcggcagcttccgggacagcatggaggaggtgcacggcagcagcctgagcctggtgagcagcaccagcagcctgtacagcacagccatccagaagcccaacatccagcagatccacaagctgcggcgggagctggtggccagccaggagaaggtggccaccctgaccagccagctgagcgccaatgcccacctggtggccgcctttgagaagagcctgggcaacatgacaggccgcctgcagagcctgaccatgacagctgagcagaaggagagcgagctgattgagctgcgggagaccatcgagatgctgaaggcccagaacagcgctgcccaggccgccatccagggcgccctgaatggaccagaccacccccccaaggacctgcgcatccggcggcagcacagcagcgagagcgtgagcagcatcaacagcgccaccagccacagcagcatcggcagcggaaatgatgctgacagcaagaagaagaagaagaagaactggctgcggagcagcttcaagcaggccttcggcaagaagaagagcaccaagccacccagcagccacagcgacatcgaggagctgacagacagcagcctgcctgccagccccaagctgccccacaatgctggggactgtggcagcgcctccatgaagcccagccagagcgccagcgccatctgtgaatgtacagaagctgaggccgagatcatcctgcagctgaagtctgagctgcgggagaaggagctgaagctgacagacatccggctggaggccctgagcagcgcccaccacctggaccagatccgggaggccatgaacaggatgcagaatgaaattgagatcctgaaggccgagaatgaccggctgaaggccgagaccggcaacacagccaagcccaccaggcctccttctgagagcagcagcagcaccagcagcagcagcagccggcagagcctgggcctgagcctgaacaacctgaacatcacagaggccgtgtccagtgacatcctgctggatgatgctggagatgccaccggccacaaggatggccgctctgtgaagatcatcgtgtccatcagcaagggctacggccgggccaaggaccagaagagccaggcctacctgattggcagcattggagtgtctgggaagaccaagtgggatgtgctggatggagtcatccggcggctcttcaaggagtatgtgttcagaattgacaccagcaccagcctgggcctgagcagtgactgcatcgccagctactgcatcggggacctgatccgcagccacaacctggaggtgcctgagctgctgccctgtggctacctggtgggggacaacaacatcatcaccgtgaacctgaagggcgtggaggagaacagcctggacagctttgtgtttgacaccctcatccccaagcccatcacccagcgctacttcaacctgctgatggagcaccaccgcatcatcctgagcggccccagcggcaccgggaagacctacctggccaacaagctggccgagtatgtgatcaccaagagcggcaggaagaagacagaagatgccatcgccaccttcaacgtggaccacaagagcagcaaggagctgcagcagtacctggccaacctggccgagcagtgcagcgctgacaacaatggagtggagctgcctgtggtgatcatcctggacaacctgcaccacgtgggcagcctgagtgacatcttcaacggcttcctgaactgcaagtacaacaagtgcccctacatcatcggcaccatgaaccagggcgtgagcagcagccccaacctggagctgcaccacaacttccgctgggtgctgtgtgccaaccacacagagcctgtgaagggcttcctgggccgctacctgcggaggaagctgattgagatctag

SEQ ID NO: 161687 - DNA, 7158 bp, Artificial Sequence
  Description of Artificial Sequence: Synthetic coding sequence
atgcctgtgctgggcgtggccagcaagctgcggcagcctgctgtgggcagcaagcctgtgcacacagccctgcccatccccaacctgggcaccaccggcagccagcactgcagcagccggcccctggagctgacagaaacagagagctccatgctgagctgccagctggccctgaagagcacctgtgaatttggagagaagaagcccctgcagggcaaggccaaggagaaggaggacagcaagatctacacagactgggccaaccactacctggccaagagcggccacaagaggctcatcaaggacctgcagcaggacattgctgatggagtgctgctggccgagatcatccagatcatcgccaatgagaaggtggaggacatcaatggctgccccaggagccagagccagatgattgaaaatgtggatgtgtgcctgtccttcctggccgcccggggcgtgaatgtgcagggcctgtctgctgaggagatcagaaatggaaacctgaaggccatcctgggcctcttcttcagcctgagccgctacaagcagcagcagcaccaccagcagcagtactaccagagcctggtggagctgcagcagagggtgacccacgccagcccccccagcgaggccagccaggccaagacccagcaggacatgcagagcagcctggccgcccgctatgccacccagagcaaccacagcggcatcgccaccagccagaagaagcccacccggctgcccggccccagccgggtgcctgctgctggcagcagcagcaaggtgcagggcgccagcaacctgaacagaagaagccagagcttcaacagcattgacaagaacaagccacccaactatgccaatggaaatgagaaggacagcagcaagggcccccagagcagcagtggagtgaatggaaatgtgcagccccccagcacagctggccagcccccagccagcgccatccccagccccagcgccagcaagccctggaggagcaagtccatgaatgtgaagcacagcgccaccagcaccatgctgactgtgaagcagagcagcacagccaccagccccacccccagcagtgaccggctgaagccccctgtgtctgaaggagtgaagacagcccccagcggccagaagtccatgctggagaagttcaagctggtgaatgccaggacagccctgcggcccccccagccccccagcagcggccccagtgatggcggcaaggatgatgatgccttcagcgagagcggggagatggagggcttcaacagcggcctgaacagcggcggcagcaccaacagcagccccaaggtgagccccaagctggccccacccaaggccggcagcaagaacctgagcaacaagaagagcctgctgcagcccaaggagaaggaggagaagaacagagacaagaacaaggtgtgcacagagaagcctgtgaaggaggagaaggaccaggtgacagagatggcccccaagaagaccagcaagatcgccagcctcatccccaagggcagcaagaccacagctgccaagaaggagagcctcatccccagcagcagcggcatccccaagccaggcagcaaggtgcccaccgtgaagcagaccatcagccctggcagcacagccagcaaggagagcgagaagttccgcaccaccaagggcagccccagccagagcctgagcaagcccatcaccatggagaaggccagcgccagcagctgcccagcccccctggagggccgggaggccggccaggccagccccagcggcagctgcaccatgacagtggcccagagcagcggccagagcactggaaatggagctgtgcagctgccccagcagcagcagcacagccaccccaacacagccaccgtggcccccttcatctaccgggcccacagtgaaaatgaaggaacagccctgcccagcgctgacagctgcaccagccccaccaagatggacctgagctacagcaagacagccaagcagtgcctggaggagatcagcggggaggaccctgagaccaggaggatgaggacagtgaagaacattgctgacctgcggcagaacctggaggagaccatgagcagcctgcggggcacccagatcagccacagcaccctggagaccacctttgacagcacagtgaccacagaggtgaatggccgcaccatccccaacctgaccagccggcccacccccatgacctggaggctgggccaggcctgcccccggctgcaggccggagatgcccccagcctgggcgccggctaccccaggagcggcaccagccgcttcatccacacagaccccagccgcttcatgtacaccacccccctgcggcgggctgctgtgtcccggctgggcaacatgagccagattgacatgtctgagaaggccagcagtgacctggacatgagcagcgaggtggatgtgggcggctacatgtctgatggagacatcctgggcaagagcctgaggacagatgacatcaacagcggctacatgacagatggcggcctgaacctgtacaccaggagcctgaaccgcatcccagacacagccaccagccgggacatcatccagaggggcgtgcatgatgtgacagtggatgctgacagctgggatgacagcagctctgtgagcagcggcctgagtgacaccctggacaacatcagcacagatgacctgaacaccaccagctctgtgagcagctacagcaacatcaccgtgcccagcaggaagaacacccagctgaggacagacagcgagaagaggagcaccacagatgagacctgggacagccctgaggagctgaagaagccagaagaagattttgacagccatggagatgctgggggcaagtggaagacagtgagcagcggcctgcctgaggaccctgagaaggccggccagaaggccagcctgtctgtgtcccagacaggctcctggaggcggggcatgtctgcccagggcggggcccccagccggcagaaggccggcaccagcgccctgaagaccccaggcaagacagatgatgccaaggccagcgagaagggcaaggcccccctgaagggcagcagcctgcagaggagccccagtgatgctgggaagagcagtggagatgagggcaagaagccacccagcggcatcggccgcagcacagccaccagcagctttggcttcaagaagcccagcggcgtgggcagcagcgccatgatcaccagcagcggggccaccatcaccagcggcagcgccaccctgggcaagatccccaagtctgctgccatcggcggcaagagcaatgccggcaggaagaccagcctggatggcagccagaaccaggatgatgtggtgctgcacgtgagcagcaagaccaccctgcagtaccgcagcctgccccggcccagcaagagcagcaccagcggcatccctggccggggcggccacaggagcagcaccagcagcattgacagcaatgtgagcagcaagtctgctggggccaccaccagcaagctgcgggagcccaccaagattggcagcggccgcagcagccctgtgacagtgaaccagacagacaaggagaaggagaaggtggccgtgtctgattctgagagcgtgtccctgagcggcagccccaagagcagccccaccagcgccagcgcctgtggggcccagggcctgcggcagcccggcagcaagtacccagacatcgccagccccaccttcagaagactctttggagccaaggccggcggcaagagcgccagcgcccccaacacagagggcgtgaagagcagctctgtgatgcccagccccagcaccaccctggcccggcagggcagcctggagagccccagcagcggcaccggctccatgggcagcgctgggggcctgagcggcagcagcagccccctcttcaacaagcccagcgacctgaccacagatgtgatcagcctgagccacagcctggccagcagccctgcctctgtgcacagcttcaccagcggcggcctggtgtgggccgccaacatgagcagcagcagcgctggcagcaaggacacccccagctaccagagcatgaccagcctgcacaccagcagcgagagcattgacctgcccctgagccaccacggcagcctgagcggcctgaccaccggcacccatgaggtgcagagcctgctgatgaggactggatctgtgcgcagcaccctgtctgagagcatgcagctggacaggaacaccctgcccaagaagggcctgcgctacacccccagcagccggcaggccaaccaggaggagggcaaggagtggctgcggagccacagcactggaggcctgcaggacaccggcaaccagagccccctggtgagccccagcgccatgagcagcagcgctgctgggaagtaccacttcagcaacctggtgagccccaccaacctgagccagttcaacctgcccggccccagcatgatgaggagcaacagcatcccagcccaggacagcagctttgacctgtatgatgacagccagctgtgtggcagcgccaccagcctggaggagcggccccgggccatcagccacagcggcagcttccgggacagcatggaggaggtgcacggcagcagcctgagcctggtgagcagcaccagcagcctgtacagcacagctgaggagaaggcccacagcgagcagatccacaagctgcggcgggagctggtggccagccaggagaaggtggccaccctgaccagccagctgagcgccaatgcccacctggtggccgcctttgagaagagcctgggcaacatgacaggccgcctgcagagcctgaccatgacagctgagcagaaggagagcgagctgattgagctgcgggagaccatcgagatgctgaaggcccagaacagcgctgcccaggccgccatccagggcgccctgaatggaccagaccacccccccaaggacctgcgcatccggcggcagcacagcagcgagagcgtgagcagcatcaacagcgccaccagccacagcagcatcggcagcggaaatgatgctgacagcaagaagaagaagaagaagaactgggtgaacagccggggcagcgagctgcggagcagcttcaagcaggccttcggcaagaagaagagcaccaagccacccagcagccacagcgacatcgaggagctgacagacagcagcctgcctgccagccccaagctgccccacaatgctggggactgtggcagcgcctccatgaagcccagccagagcgccagcgccagccccctggtgtggccacccaagaagaggcagaatggacctgtgatctacaagcacaggagccgcatctgtgaatgtacagaagctgaggccgagatcatcctgcagctgaagtctgagctgcgggagaaggagctgaagctgacagacatccggctggaggccctgagcagcgcccaccacctggaccagatccgggaggccatgaacaggatgcagaatgaaattgagatcctgaaggccgagaatgaccggctgaaggccgagaccggcaacacagccaagcccaccaggcctccttctgagagcagcagcagcaccagcagcagcagcagccggcagagcctgggcctgagcctgaacaacctgaacatcacagaggccgtgtccagtgacatcctgctggatgatgctggagatgccaccggccacaaggatggccgctctgtgaagatcatcgtgtccatcagcaagggctacggccgggccaaggaccagaagagccaggcctacctgattggcagcattggagtgtctgggaagaccaagtgggatgtgctggatggagtcatccggcggctcttcaaggagtatgtgttcagaattgacaccagcaccagcctgggcctgagcagtgactgcatcgccagctactgcatcggggacctgatccgcagccacaacctggaggtgcctgagctgctgccctgtggctacctggtgggggacaacaacatcatcaccgtgaacctgaagggcgtggaggagaacagcctggacagctttgtgtttgacaccctcatccccaagcccatcacccagcgctacttcaacctgctgatggagcaccaccgcatcatcctgagcggccccagcggcaccgggaagacctacctggccaacaagctggccgagtatgtgatcaccaagagcggcaggaagaagacagaagatgccatcgccaccttcaacgtggaccacaagagcagcaaggagctgcagcagtacctggccaacctggccgagcagtgcagcgctgacaacaatggagtggagctgcctgtggtgatcatcctggacaacctgcaccacgtgggcagcctgagtgacatcttcaacggcttcctgaactgcaagtacaacaagtgcccctacatcatcggcaccatgaaccagggcgtgagcagcagccccaacctggagctgcaccacaacttccgctgggtgctgtgtgccaaccacacagagcctgtgaagggcttcctgggccgctacctgcggaggaagctgattgaaattgaaattgaaagaaacatccggaacaatgacctggtgaagatcatcgactggatccccaagacctggcaccacctgaacagcttcctggagacccacagcagcagtgatgtgaccatcggccccaggctcttcctgccctgccccatggatgtggagggcagccgggtgtggttcatggacctgtggaactacagcctggtgccctacatcctggaggccgtgcgggagggcctgcagatgtatggcaagaggaccccctgggaggaccccagcaagtgggtgctggacacctacccctggagcagcgccaccctgccccaggagagccctgccctgctgcagctgcggccagaagatgtgggctatgagagctgcaccagcaccaaggaggccaccaccagcaagcacatcccccagacagacacagaaggagaccccctgatgaacatgctgatgaagctgcaggaggccgccaactacagcagcacccagagctgtgacagcgagagcaccagccaccacgaggacatcctggacagcagcctggagagcaccctgtag

SEQ ID NO: 161688 - DNA, 7092 bp, Artificial Sequence
  Description of Artificial Sequence: Synthetic coding sequence
atgcctgtgctgggcgtggccagcaagctgcggcagcctgctgtgggcagcaagcctgtgcacacagccctgcccatccccaacctgggcaccaccggcagccagcactgcagcagccggcccctggagctgacagaaacagagagctccatgctgagctgccagctggccctgaagagcacctgtgaatttggagagaagaagcccctgcagggcaaggccaaggagaaggaggacagcaagatctacacagactgggccaaccactacctggccaagagcggccacaagaggctcatcaaggacctgcagcaggacattgctgatggagtgctgctggccgagatcatccagatcatcgccaatgagaaggtggaggacatcaatggctgccccaggagccagagccagatgattgaaaatgtggatgtgtgcctgtccttcctggccgcccggggcgtgaatgtgcagggcctgtctgctgaggagatcagaaatggaaacctgaaggccatcctgggcctcttcttcagcctgagccgctacaagcagcagcagcaccaccagcagcagtactaccagagcctggtggagctgcagcagagggtgacccacgccagcccccccagcgaggccagccaggccaagacccagcaggacatgcagagcagcctggccgcccgctatgccacccagagcaaccacagcggcatcgccaccagccagaagaagcccacccggctgcccggccccagccgggtgcctgctgctggcagcagcagcaaggtgcagggcgccagcaacctgaacagaagaagccagagcttcaacagcattgacaagaacaagccacccaactatgccaatggaaatgagaaggacagcagcaagggcccccagagcagcagtggagtgaatggaaatgtgcagccccccagcacagctggccagcccccagccagcgccatccccagccccagcgccagcaagccctggaggagcaagtccatgaatgtgaagcacagcgccaccagcaccatgctgactgtgaagcagagcagcacagccaccagccccacccccagcagtgaccggctgaagccccctgtgtctgaaggagtgaagacagcccccagcggccagaagtccatgctggagaagttcaagctggtgaatgccaggacagccctgcggcccccccagccccccagcagcggccccagtgatggcggcaaggatgatgatgccttcagcgagagcggggagatggagggcttcaacagcggcctgaacagcggcggcagcaccaacagcagccccaaggtgagccccaagctggccccacccaaggccggcagcaagaacctgagcaacaagaagagcctgctgcagcccaaggagaaggaggagaagaacagagacaagaacaaggtgtgcacagagaagcctgtgaaggaggagaaggaccaggtgacagagatggcccccaagaagaccagcaagatcgccagcctcatccccaagggcagcaagaccacagctgccaagaaggagagcctcatccccagcagcagcggcatccccaagccaggcagcaaggtgcccaccgtgaagcagaccatcagccctggcagcacagccagcaaggagagcgagaagttccgcaccaccaagggcagccccagccagagcctgagcaagcccatcaccatggagaaggccagcgccagcagctgcccagcccccctggagggccgggaggccggccaggccagccccagcggcagctgcaccatgacagtggcccagagcagcggccagagcactggaaatggagctgtgcagctgccccagcagcagcagcacagccaccccaacacagccaccgtggcccccttcatctaccgggcccacagtgaaaatgaaggaacagccctgcccagcgctgacagctgcaccagccccaccaagatggacctgagctacagcaagacagccaagcagtgcctggaggagatcagcggggaggaccctgagaccaggaggatgaggacagtgaagaacattgctgacctgcggcagaacctggaggagaccatgagcagcctgcggggcacccagatcagccacagcaccctggagaccacctttgacagcacagtgaccacagaggtgaatggccgcaccatccccaacctgaccagccggcccacccccatgacctggaggctgggccaggcctgcccccggctgcaggccggagatgcccccagcctgggcgccggctaccccaggagcggcaccagccgcttcatccacacagaccccagccgcttcatgtacaccacccccctgcggcgggctgctgtgtcccggctgggcaacatgagccagattgacatgtctgagaaggccagcagtgacctggacatgagcagcgaggtggatgtgggcggctacatgtctgatggagacatcctgggcaagagcctgaggacagatgacatcaacagcggctacatgacagatggcggcctgaacctgtacaccaggagcctgaaccgcatcccagacacagccaccagccgggacatcatccagaggggcgtgcatgatgtgacagtggatgctgacagctgggatgacagcagctctgtgagcagcggcctgagtgacaccctggacaacatcagcacagatgacctgaacaccaccagctctgtgagcagctacagcaacatcaccgtgcccagcaggaagaacacccagctgaggacagacagcgagaagaggagcaccacagatgagacctgggacagccctgaggagctgaagaagccagaagaagattttgacagccatggagatgctgggggcaagtggaagacagtgagcagcggcctgcctgaggaccctgagaaggccggccagaaggccagcctgtctgtgtcccagacaggctcctggaggcggggcatgtctgcccagggcggggcccccagccggcagaaggccggcaccagcgccctgaagaccccaggcaagacagatgatgccaaggccagcgagaagggcaaggcccccctgaagggcagcagcctgcagaggagccccagtgatgctgggaagagcagtggagatgagggcaagaagccacccagcggcatcggccgcagcacagccaccagcagctttggcttcaagaagcccagcggcgtgggcagcagcgccatgatcaccagcagcggggccaccatcaccagcggcagcgccaccctgggcaagatccccaagtctgctgccatcggcggcaagagcaatgccggcaggaagaccagcctggatggcagccagaaccaggatgatgtggtgctgcacgtgagcagcaagaccaccctgcagtaccgcagcctgccccggcccagcaagagcagcaccagcggcatccctggccggggcggccacaggagcagcaccagcagcattgacagcaatgtgagcagcaagtctgctggggccaccaccagcaagctgcgggagcccaccaagattggcagcggccgcagcagccctgtgacagtgaaccagacagacaaggagaaggagaaggtggccgtgtctgattctgagagcgtgtccctgagcggcagccccaagagcagccccaccagcgccagcgcctgtggggcccagggcctgcggcagcccggcagcaagtacccagacatcgccagccccaccttcagaagactctttggagccaaggccggcggcaagagcgccagcgcccccaacacagagggcgtgaagagcagctctgtgatgcccagccccagcaccaccctggcccggcagggcagcctggagagccccagcagcggcaccggctccatgggcagcgctgggggcctgagcggcagcagcagccccctcttcaacaagcccagcgacctgaccacagatgtgatcagcctgagccacagcctggccagcagccctgcctctgtgcacagcttcaccagcggcggcctggtgtgggccgccaacatgagcagcagcagcgctggcagcaaggacacccccagctaccagagcatgaccagcctgcacaccagcagcgagagcattgacctgcccctgagccaccacggcagcctgagcggcctgaccaccggcacccatgaggtgcagagcctgctgatgaggactggatctgtgcgcagcaccctgtctgagagcatgcagctggacaggaacaccctgcccaagaagggcctgcgctacacccccagcagccggcaggccaaccaggaggagggcaaggagtggctgcggagccacagcactggaggcctgcaggacaccggcaaccagagccccctggtgagccccagcgccatgagcagcagcgctgctgggaagtaccacttcagcaacctggtgagccccaccaacctgagccagttcaacctgcccggccccagcatgatgaggagcaacagcatcccagcccaggacagcagctttgacctgtatgatgacagccagctgtgtggcagcgccaccagcctggaggagcggccccgggccatcagccacagcggcagcttccgggacagcatggaggaggtgcacggcagcagcctgagcctggtgagcagcaccagcagcctgtacagcacagctgaggagaaggcccacagcgagcagatccacaagctgcggcgggagctggtggccagccaggagaaggtggccaccctgaccagccagctgagcgccaatgcccacctggtggccgcctttgagaagagcctgggcaacatgacaggccgcctgcagagcctgaccatgacagctgagcagaaggagagcgagctgattgagctgcgggagaccatcgagatgctgaaggcccagaacagcgctgcccaggccgccatccagggcgccctgaatggaccagaccacccccccaaggacctgcgcatccggcggcagcacagcagcgagagcgtgagcagcatcaacagcgccaccagccacagcagcatcggcagcggaaatgatgctgacagcaagaagaagaagaagaagaactgggtgaacagccggggcagcgagctgcggagcagcttcaagcaggccttcggcaagaagaagagcaccaagccacccagcagccacagcgacatcgaggagctgacagacagcagcctgcctgccagccccaagctgccccacaatgctggggactgtggcagcgcctccatgaagcccagccagagcgccagcgccatctgtgaatgtacagaagctgaggccgagatcatcctgcagctgaagtctgagctgcgggagaaggagctgaagctgacagacatccggctggaggccctgagcagcgcccaccacctggaccagatccgggaggccatgaacaggatgcagaatgaaattgagatcctgaaggccgagaatgaccggctgaaggccgagaccggcaacacagccaagcccaccaggcctccttctgagagcagcagcagcaccagcagcagcagcagccggcagagcctgggcctgagcctgaacaacctgaacatcacagaggccgtgtccagtgacatcctgctggatgatgctggagatgccaccggccacaaggatggccgctctgtgaagatcatcgtgtccatcagcaagggctacggccgggccaaggaccagaagagccaggcctacctgattggcagcattggagtgtctgggaagaccaagtgggatgtgctggatggagtcatccggcggctcttcaaggagtatgtgttcagaattgacaccagcaccagcctgggcctgagcagtgactgcatcgccagctactgcatcggggacctgatccgcagccacaacctggaggtgcctgagctgctgccctgtggctacctggtgggggacaacaacatcatcaccgtgaacctgaagggcgtggaggagaacagcctggacagctttgtgtttgacaccctcatccccaagcccatcacccagcgctacttcaacctgctgatggagcaccaccgcatcatcctgagcggccccagcggcaccgggaagacctacctggccaacaagctggccgagtatgtgatcaccaagagcggcaggaagaagacagaagatgccatcgccaccttcaacgtggaccacaagagcagcaaggagctgcagcagtacctggccaacctggccgagcagtgcagcgctgacaacaatggagtggagctgcctgtggtgatcatcctggacaacctgcaccacgtgggcagcctgagtgacatcttcaacggcttcctgaactgcaagtacaacaagtgcccctacatcatcggcaccatgaaccagggcgtgagcagcagccccaacctggagctgcaccacaacttccgctgggtgctgtgtgccaaccacacagagcctgtgaagggcttcctgggccgctacctgcggaggaagctgattgaaattgaaattgaaagaaacatccggaacaatgacctggtgaagatcatcgactggatccccaagacctggcaccacctgaacagcttcctggagacccacagcagcagtgatgtgaccatcggccccaggctcttcctgccctgccccatggatgtggagggcagccgggtgtggttcatggacctgtggaactacagcctggtgccctacatcctggaggccgtgcgggagggcctgcagatgtatggcaagaggaccccctgggaggaccccagcaagtgggtgctggacacctacccctggagcagcgccaccctgccccaggagagccctgccctgctgcagctgcggccagaagatgtgggctatgagagctgcaccagcaccaaggaggccaccaccagcaagcacatcccccagacagacacagaaggagaccccctgatgaacatgctgatgaagctgcaggaggccgccaactacagcagcacccagagctgtgacagcgagagcaccagccaccacgaggacatcctggacagcagcctggagagcaccctgtag

SEQ ID NO: 161689 - DNA, 648 bp, Artificial Sequence
  Description of Artificial Sequence: Synthetic coding sequence
atgaagcgctgggtgctgtgtgccaaccacacagagcctgtgaagggcttcctgggccgctacctgcggaggaagctgattgaaattgaaattgaaagaaacatccggaacaatgacctggtgaagatcatcgactggatccccaagacctggcaccacctgaacagcttcctggagacccacagcagcagtgatgtgaccatcggccccaggctcttcctgccctgccccatggatgtggagggcagccgggtgtggttcatggacctgtggaactacagcctggtgccctacatcctggaggccgtgcgggagggcctgcagatgtatggcaagaggaccccctgggaggaccccagcaagtgggtgctggacacctacccctggagcagcgccaccctgccccaggagagccctgccctgctgcagctgcggccagaagatgtgggctatgagagctgcaccagcaccaaggaggccaccaccagcaagcacatcccccagacagacacagaaggagaccccctgatgaacatgctgatgaagctgcaggaggccgccaactacagcagcacccagagctgtgacagcgagagcaccagccaccacgaggacatcctggacagcagcctggagagcaccctgtag

SEQ ID NO: 161690 - DNA, 573 bp, Artificial Sequence
  Description of Artificial Sequence: Synthetic coding sequence
atgggcaagagcaacagcaagctgaagccagaggtggtggaggagctgaccaggaagacctacttcacagagaaggaggtgcagcagtggtacaagggcttcatcaaggactgccccagcggccagctggatgctgctggcttccagaagatctacaagcagttcttcccctttggagaccccaccaagtttgccacctttgtgttcaacgtgtttgatgagaacaaggatggccgcatcgagttcagcgagttcatccaggccctgtctgtgaccagccggggcaccctggatgagaagctgcgctgggccttcaagctgtatgacctggacaatgatggctacatcaccagaaatgagatgctggacatcgtggatgccatctaccagatggtgggcaacacagtggagctgcctgaggaggagaacaccccagagaagagggtggaccgcatctttgccatgatggacaagaatgctgatggcaagctgaccctgcaggagttccaggagggcagcaaggctgaccccagcatcgtgcaggccctgagcctgtatgatggcctggtgtag

SEQ ID NO: 161691 - DNA, 519 bp, Artificial Sequence
  Description of Artificial Sequence: Synthetic coding sequence
atggccaccatcacagagaaggaggtgcagcagtggtacaagggcttcatcaaggactgccccagcggccagctggatgctgctggcttccagaagatctacaagcagttcttcccctttggagaccccaccaagtttgccacctttgtgttcaacgtgtttgatgagaacaaggatggccgcatcgagttcagcgagttcatccaggccctgtctgtgaccagccggggcaccctggatgagaagctgcgctgggccttcaagctgtatgacctggacaatgatggctacatcaccagaaatgagatgctggacatcgtggatgccatctaccagatggtgggcaacacagtggagctgcctgaggaggagaacaccccagagaagagggtggaccgcatctttgccatgatggacaagaatgctgatggcaagctgaccctgcaggagttccaggagggcagcaaggctgaccccagcatcgtgcaggccctgagcctgtatgatggcctggtgtag

SEQ ID NO: 161692 - DNA, 3552 bp, Artificial Sequence
  Description of Artificial Sequence: Synthetic coding sequence
atgcagctgaagatcatgcccaagaagaagaggctgtctgctggccgggtgcccctcatcctcttcctgtgccagatgatcagcgccctggaggtgcccctggacctggtgcagccccccaccatcacccagcagagccccaaggactacatcatcgacccccgggagaacatcgtcatccagtgtgaggccaagggcaagcccccacccagcttctcctggaccagaaatggcacccactttgatattgacaaggaccccctggtgaccatgaagccaggcaccggcaccctcatcatcaacatcatgtctgagggcaaggccgagacctatgaaggagtgtaccagtgcacagccagaaatgaaagaggagctgctgtgagcaacaacatcgtggtgcggcccagccgcagccccctgtggaccaaggagaagctggagcccatcaccctgcagagcggccagagcctggtgctgccctgcaggcctcccatcggcctgcccccacccatcatcttctggatggacaacagcttccagaggctgccccagagcgagcgggtgtcccagggcctgaatggagacctgtacttcagcaatgtgctgcctgaggacacccgggaggactacatctgctacgcccgcttcaaccacacccagaccatccagcagaagcagcccatctctgtgaaggtgatctctgtggatgagctgaatgacaccatcgccgccaacctgagtgacacagagttctacggggccaagagcagccgggagaggcctcccaccttcctgaccccagagggcaatgccagcaacaaggaggagctgcggggaaatgtgctgagcctggagtgcatcgccgagggcctgcccacccccatcatctactgggccaaggaggatggcatgctgcccaagaacagaacagtgtacaagaactttgagaagaccctgcagatcatccacgtgtctgaggccgacagcggcaactaccagtgcatcgccaagaatgccctgggcgccatccaccacaccatctctgtgcgggtgaaggccgccccctactggatcacagccccccagaacctggtgctgagccctggagaagatggcaccctcatctgccgggccaatggaaaccccaagccccgcatctcctggctgaccaatggagtgcccattgaaattgccccagatgaccccagcaggaagattgatggagacaccatcatcttcagcaatgtgcaggagaggagcagcgctgtgtaccagtgcaatgccagcaatgaatatggctacctgctggccaatgcctttgtgaatgtgctggccgagcccccacgcatcctgaccccagccaacaccctgtaccaggtgattgccaacagacctgccctgctggactgtgccttcttcggcagccccctgcccaccatcgagtggttcaagggggccaagggcagcgccctgcacgaggacatctacgtgctgcatgaaaatggcaccctggagatccctgtggcccagaaggacagcacaggcacctacacctgtgtggccaggaacaagctgggcatggccaagaatgaggtgcacctggagatcaaggaccccacctggatcgtgaagcagccagaatatgctgtggtgcagaggggctccatggtgtcctttgagtgcaaggtgaagcatgaccacaccctgagcctgactgtgctgtggctgaaggacaaccgggagctgcccagtgatgagcgcttcaccgtggacaaggaccacctggtggtggctgatgtgtctgatgatgattctggcacctacacctgtgtggccaacaccaccctggacagcgtgtctgccagcgctgtgctgtctgtggtggatgtgcccaaccccccatttgacctggagctgacagaccagctggacaagtctgtgcagctgtcctggaccccaggagatgacaacaacagccccatcaccaagttcatcatcgagtatgaagatgccatgcacaagccaggcctgtggcaccaccagacagaggtgtctggcacccagaccacagcccagctgaagctgagcccctacgtgaactacagcttccgggtgatggctgtgaacagcatcggcaagagcctgcccagcgaggccagcgagcagtacctgaccaaggccagcgagccagacaagaaccccacagctgtggagggcctgggcagcgagccagacaacctggtgatcacctggaagcccctgaatggatttgagagcaatggacctggcctgcagtacaaggtgtcctggaggcagaaggatggagatgatgagtggacctctgtggtggtggccaacgtgtccaagtacatcgtgtctggcacccccacctttgtgccctacctgatcaaggtgcaggccctgaatgacatgggctttgcccctgagcctgctgtggtgatgggccacagcggggaggacctgcccatggtggcccctggaaatgtgcgggtgaatgtggtgaacagcaccctggccgaggtgcactgggaccctgtgcccctgaagagcatccggggccacctgcagggctaccgcatctactactggaagacccagagcagcagcaagaggaacagaagacacatcgagaagaagatcctgaccttccagggcagcaagacccacggcatgctgcccggcctggagcccttcagccactacaccctgaatgtgcgggtggtgaatggcaagggggagggccctgccagcccagacagagtcttcaacaccccagagggcgtgcccagcgcccccagcagcctgaagatcgtgaaccccaccctggacagcctgaccctggagtgggacccccccagccaccccaacggcatcctgacagagtacaccctgaagtaccagcccatcaacagcacccatgagctgggccccctggtggacctgaagatcccagccaacaagacccgctggaccctgaagaacctgaacttcagcacccgctacaagttctacttctacgcccagaccagcgctggcagcggcagccagatcacagaggaggccgtgaccaccgtggatgaggccatggccagccggcaggtggacatcgccacccagggctggttcatcggcctgatgtgtgctgtggccctgctgatcctgatcctgctgattgtgtgcttcatcagaagaaataaaggaggcaagtaccctgtgaaggagaaggaggatgcccatgctgaccctgagatccagcccatgaaggaggatgatggcacctttggagagtacagtgatgctgaggaccacaagcccctgaagaagggcagcaggacccccagcgacagaacagtgaagaaggaggacagtgatgacagcctggtggactatggagagggcgtgaatggccagttcaatgaagatggcagcttcatcggccagtacagcggcaagaaggagaaggagcctgctgagggcaatgaaagcagcgaggcccccagccctgtgaatgccatgaacagctttgtgtag

SEQ ID NO: 161693 - DNA, 3711 bp, Artificial Sequence
  Description of Artificial Sequence: Synthetic coding sequence
atgcagctgaagatcatgcccaagaagaagaggctgtctgctggccgggtgcccctcatcctcttcctgtgccagatgatcagcgccctggaggtgcccctggaccagaagagcacagaggtgatggtgcagccccccaccatcacccagcagagccccaaggactacatcatcgacccccgggagaacatcgtcatccagtgtgaggccaagggcaagcccccacccagcttctcctggaccagaaatggcacccactttgatattgacaaggaccccctggtgaccatgaagccaggcaccggcaccctcatcatcaacatcatgtctgagggcaaggccgagacctatgaaggagtgtaccagtgcacagccagaaatgaaagaggagctgctgtgagcaacaacatcgtggtgcggcccagccgcagccccctgtggaccaaggagaagctggagcccatcaccctgcagagcggccagagcctggtgctgccctgcaggcctcccatcggcctgcccccacccatcatcttctggatggacaacagcttccagaggctgccccagagcgagcgggtgtcccagggcctgaatggagacctgtacttcagcaatgtgctgcctgaggacacccgggaggactacatctgctacgcccgcttcaaccacacccagaccatccagcagaagcagcccatctctgtgaaggtgatctctgtggatgagctgaatgacaccatcgccgccaacctgagtgacacagagttctacggggccaagagcagccgggagaggcctcccaccttcctgaccccagagggcaatgccagcaacaaggaggagctgcggggaaatgtgctgagcctggagtgcatcgccgagggcctgcccacccccatcatctactgggccaaggaggatggcatgctgcccaagaacagaacagtgtacaagaactttgagaagaccctgcagatcatccacgtgtctgaggccgacagcggcaactaccagtgcatcgccaagaatgccctgggcgccatccaccacaccatctctgtgcgggtgaaggccgccccctactggatcacagccccccagaacctggtgctgagccctggagaagatggcaccctcatctgccgggccaatggaaaccccaagccccgcatctcctggctgaccaatggagtgcccattgaaattgccccagatgaccccagcaggaagattgatggagacaccatcatcttcagcaatgtgcaggagaggagcagcgctgtgtaccagtgcaatgccagcaatgaatatggctacctgctggccaatgcctttgtgaatgtgctggccgagcccccacgcatcctgaccccagccaacaccctgtaccaggtgattgccaacagacctgccctgctggactgtgccttcttcggcagccccctgcccaccatcgagtggttcaagggggccaagggcagcgccctgcacgaggacatctacgtgctgcatgaaaatggcaccctggagatccctgtggcccagaaggacagcacaggcacctacacctgtgtggccaggaacaagctgggcatggccaagaatgaggtgcacctggagatcaaggaccccacctggatcgtgaagcagccagaatatgctgtggtgcagaggggctccatggtgtcctttgagtgcaaggtgaagcatgaccacaccctgagcctgactgtgctgtggctgaaggacaaccgggagctgcccagtgatgagcgcttcaccgtggacaaggaccacctggtggtggctgatgtgtctgatgatgattctggcacctacacctgtgtggccaacaccaccctggacagcgtgtctgccagcgctgtgctgtctgtggtggcccccacccccaccccagcccctgtgtatgatgtgcccaaccccccatttgacctggagctgacagaccagctggacaagtctgtgcagctgtcctggaccccaggagatgacaacaacagccccatcaccaagttcatcatcgagtatgaagatgccatgcacaagccaggcctgtggcaccaccagacagaggtgtctggcacccagaccacagcccagctgaagctgagcccctacgtgaactacagcttccgggtgatggctgtgaacagcatcggcaagagcctgcccagcgaggccagcgagcagtacctgaccaaggccagcgagccagacaagaaccccacagctgtggagggcctgggcagcgagccagacaacctggtgatcacctggaagcccctgaatggatttgagagcaatggacctggcctgcagtacaaggtgtcctggaggcagaaggatggagatgatgagtggacctctgtggtggtggccaacgtgtccaagtacatcgtgtctggcacccccacctttgtgccctacctgatcaaggtgcaggccctgaatgacatgggctttgcccctgagcctgctgtggtgatgggccacagcggggaggacctgcccatggtggcccctggaaatgtgcgggtgaatgtggtgaacagcaccctggccgaggtgcactgggaccctgtgcccctgaagagcatccggggccacctgcagggctaccgcatctactactggaagacccagagcagcagcaagaggaacagaagacacatcgagaagaagatcctgaccttccagggcagcaagacccacggcatgctgcccggcctggagcccttcagccactacaccctgaatgtgcgggtggtgaatggcaagggggagggccctgccagcccagacagagtcttcaacaccccagagggcgtgcccagcgcccccagcagcctgaagatcgtgaaccccaccctggacagcctgaccctggagtgggacccccccagccaccccaacggcatcctgacagagtacaccctgaagtaccagcccatcaacagcacccatgagctgggccccctggtggacctgaagatcccagccaacaagacccgctggaccctgaagaacctgaacttcagcacccgctacaagttctacttctacgcccagaccagcgctggcagcggcagccagatcacagaggaggccgtgaccaccgtggatgaagctggcatcctgcccccagatgtgggcgctgggaaggtgcaggccgtgaacccccgcatcagcaacctgacagctgctgctgctgagacctacgccaacatctcctgggagtatgagggccctgagcacgtgaacttctacgtggagtatggagtggccggcagcaaggaggagtggaggaaggagatcgtgaatggcagccgctccttcttcggcctgaagggcctgatgcctggaacagcctacaaggtgcgggtgggcgctgtgggggacagcggctttgtgtccagtgaagatgtgtttgaaacaggccctgccatggccagccggcaggtggacatcgccacccagggctggttcatcggcctgatgtgtgctgtggccctgctgatcctgatcctgctgattgtgtgcttcatcagaagaaacaagggcggcaagtaccctgtgaaggagaaggaggatgcccacgccgaccctgagatccagcccatgaaggaggatgatggcaccttcggggagtaccgcctcttctcctttgtgtcctctgccagcttctag

SEQ ID NO: 161694 - DNA, 3579 bp, Artificial Sequence
  Description of Artificial Sequence: Synthetic coding sequence
atgcagctgaagatcatgcccaagaagaagaggctgtctgctggccgggtgcccctcatcctcttcctgtgccagatgatcagcgccctggaggtgcccctggaccccaagctgctggaggacctggtgcagccccccaccatcacccagcagagccccaaggactacatcatcgacccccgggagaacatcgtcatccagtgtgaggccaagggcaagcccccacccagcttctcctggaccagaaatggcacccactttgatattgacaaggaccccctggtgaccatgaagccaggcaccggcaccctcatcatcaacatcatgtctgagggcaaggccgagacctatgaaggagtgtaccagtgcacagccagaaatgaaagaggagctgctgtgagcaacaacatcgtggtgcggcccagccgcagccccctgtggaccaaggagaagctggagcccatcaccctgcagagcggccagagcctggtgctgccctgcaggcctcccatcggcctgcccccacccatcatcttctggatggacaacagcttccagaggctgccccagagcgagcgggtgtcccagggcctgaatggagacctgtacttcagcaatgtgctgcctgaggacacccgggaggactacatctgctacgcccgcttcaaccacacccagaccatccagcagaagcagcccatctctgtgaaggtgatcagcgccaagagcagccgggagcggccccccaccttcctgaccccagagggcaatgccagcaacaaggaggagctgcggggaaatgtgctgagcctggagtgcatcgccgagggcctgcccacccccatcatctactgggccaaggaggatggcatgctgcccaagaacagaacagtgtacaagaactttgagaagaccctgcagatcatccacgtgtctgaggccgacagcggcaactaccagtgcatcgccaagaatgccctgggcgccatccaccacaccatctctgtgcgggtgaaggccgccccctactggatcacagccccccagaacctggtgctgagccctggagaagatggcaccctcatctgccgggccaacggcaaccccaagccccgcatctcctggctgaccaacggggtgcccatcgagatcgccccagatgaccccagcaggaagattgatggagacaccatcatcttcagcaatgtgcaggagaggagcagcgctgtgtaccagtgcaatgccagcaatgaatatggctacctgctggccaatgcctttgtgaatgtgctggccgagcccccacgcatcctgaccccagccaacaccctgtaccaggtgattgccaacagacctgccctgctggactgtgccttcttcggcagccccctgcccaccatcgagtggttcaagggggccaagggcagcgccctgcacgaggacatctacgtgctgcatgaaaatggcaccctggagatccctgtggcccagaaggacagcacaggcacctacacctgtgtggccaggaacaagctgggcatggccaagaatgaggtgcacctggagatcaaggaccccacctggatcgtgaagcagccagaatatgctgtggtgcagaggggctccatggtgtcctttgagtgcaaggtgaagcatgaccacaccctgagcctgactgtgctgtggctgaaggacaaccgggagctgcccagtgatgagcgcttcaccgtggacaaggaccacctggtggtggctgatgtgtctgatgatgacagcggcacctacacctgtgtggccaacaccaccctggacagcgtgtctgccagcgctgtgctgtctgtggtggcccccacccccaccccagcccctgtgtatgatgtgcccaaccccccatttgacctggagctgacagaccagctggacaagtctgtgcagctgtcctggaccccaggagatgacaacaacagccccatcaccaagttcatcattgaatatgaagatgccatgcacaagccaggcctgtggcaccaccagacagaggtgtctggcacccagaccacagcccagctgaagctgagcccctacgtgaactacagcttccgggtgatggctgtgaacagcatcggcaagagcctgcccagcgaggccagcgagcagtacctgaccaaggccagcgagccagacaagaaccccacagctgtggagggcctgggcagcgagccagacaacctggtgatcacctggaagcccctgaatggatttgagagcaatggacctggcctgcagtacaaggtgtcctggaggcagaaggatggagatgatgagtggacctctgtggtggtggccaacgtgtccaagtacatcgtgtctggcacccccacctttgtgccctacctgatcaaggtgcaggccctgaatgacatgggctttgcccctgagcctgctgtggtgatgggccacagcggggaggacctgcccatggtggcccctggaaatgtgcgggtgaatgtggtgaacagcaccctggccgaggtgcactgggaccctgtgcccctgaagagcatccggggccacctgcagggctaccgcatctactactggaagacccagagcagcagcaagaggaacagaagacacatcgagaagaagatcctgaccttccagggcagcaagacccacggcatgctgcccggcctggagcccttcagccactacaccctgaatgtgcgggtggtgaatggaaaaggagagggccctgccagcccagacagagtcttcaacaccccagagggcgtgcccagcgcccccagcagcctgaagatcgtgaaccccaccctggacagcctgaccctggagtgggacccccccagccaccccaacggcatcctgacagagtacaccctgaagtaccagcccatcaacagcacccatgagctgggccccctggtggacctgaagatcccagccaacaagacccgctggaccctgaagaacctgaacttcagcacccgctacaagttctacttctacgcccagaccagcgctggcagcggcagccagatcacagaggaggccgtgaccaccgtggatgaggccggcatcctgcccccagatgtgggcgccggcaaggccatggccagccggcaggtggacatcgccacccagggctggttcatcggcctgatgtgtgctgtggccctgctgatcctgatcctgctgattgtgtgcttcatcagaagaaacaagggcggcaagtaccctgtgaaggagaaggaggatgcccacgccgaccctgagatccagcccatgaaggaggatgatggcaccttcggggagtacagtgatgctgaggaccacaagcccctgaagaagggcagcaggacccccagcgacagaacagtgaagaaggaggacagtgatgacagcctggtggactatggagaaggagtgaatggccagttcaatgaagatggcagcttcatcggccagtacagcggcaagaaggagaaggagcctgctgagggcaatgaatcttctgaggcccccagccctgtgaatgccatgaacagctttgtgtag

SEQ ID NO: 161695 - DNA, 3915 bp, Artificial Sequence
  Description of Artificial Sequence: Synthetic coding sequence
atgcagctgaagatcatgcccaagaagaagaggctgtctgctggccgggtgcccctcatcctcttcctgtgccagatgatcagcgccctggaggtgcccctggaccccaagctgctggaggacctggtgcagccccccaccatcacccagcagagccccaaggactacatcatcgacccccgggagaacatcgtcatccagtgtgaggccaagggcaagcccccacccagcttctcctggaccagaaatggcacccactttgatattgacaaggaccccctggtgaccatgaagccaggcaccggcaccctcatcatcaacatcatgtctgagggcaaggccgagacctatgaaggagtgtaccagtgcacagccagaaatgaaagaggagctgctgtgagcaacaacatcgtggtgcggcccagccgcagccccctgtggaccaaggagaagctggagcccatcaccctgcagagcggccagagcctggtgctgccctgcaggcctcccatcggcctgcccccacccatcatcttctggatggacaacagcttccagaggctgccccagagcgagcgggtgtcccagggcctgaatggagacctgtacttcagcaatgtgctgcctgaggacacccgggaggactacatctgctacgcccgcttcaaccacacccagaccatccagcagaagcagcccatctctgtgaaggtgatctctgtggatgagctgaatgacaccatcgccgccaacctgagtgacacagagttctacggggccaagagcagccgggagaggcctcccaccttcctgaccccagagggcaatgccagcaacaaggaggagctgcggggaaatgtgctgagcctggagtgcatcgccgagggcctgcccacccccatcatctactgggccaaggaggatggcatgctgcccaagaacagaacagtgtacaagaactttgagaagaccctgcagatcatccacgtgtctgaggccgacagcggcaactaccagtgcatcgccaagaatgccctgggcgccatccaccacaccatctctgtgcgggtgaaggccgccccctactggatcacagccccccagaacctggtgctgagccctggagaagatggcaccctcatctgccgggccaatggaaaccccaagccccgcatctcctggctgaccaatggagtgcccattgaaattgccccagatgaccccagcaggaagattgatggagacaccatcatcttcagcaatgtgcaggagaggagcagcgctgtgtaccagtgcaatgccagcaatgaatatggctacctgctggccaatgcctttgtgaatgtgctggccgagcccccacgcatcctgaccccagccaacaccctgtaccaggtgattgccaacagacctgccctgctggactgtgccttcttcggcagccccctgcccaccatcgagtggttcaagggggccaagggcagcgccctgcacgaggacatctacgtgctgcatgaaaatggcaccctggagatccctgtggcccagaaggacagcacaggcacctacacctgtgtggccaggaacaagctgggcatggccaagaatgaggtgcacctggagatcaaggaccccacctggatcgtgaagcagccagaatatgctgtggtgcagaggggctccatggtgtcctttgagtgcaaggtgaagcatgaccacaccctgagcctgactgtgctgtggctgaaggacaaccgggagctgcccagtgatgagcgcttcaccgtggacaaggaccacctggtggtggctgatgtgtctgatgatgattctggcacctacacctgtgtggccaacaccaccctggacagcgtgtctgccagcgctgtgctgtctgtggtggcccccacccccaccccagcccctgtgtatgatgtgcccaaccccccatttgacctggagctgacagaccagctggacaagtctgtgcagctgtcctggaccccaggagatgacaacaacagccccatcaccaagttcatcatcgagtatgaagatgccatgcacaagccaggcctgtggcaccaccagacagaggtgtctggcacccagaccacagcccagctgaagctgagcccctacgtgaactacagcttccgggtgatggctgtgaacagcatcggcaagagcctgcccagcgaggccagcgagcagtacctgaccaaggccagcgagccagacaagaaccccacagctgtggagggcctgggcagcgagccagacaacctggtgatcacctggaagcccctgaatggatttgagagcaatggacctggcctgcagtacaaggtgtcctggaggcagaaggatggagatgatgagtggacctctgtggtggtggccaacgtgtccaagtacatcgtgtctggcacccccacctttgtgccctacctgatcaaggtgcaggccctgaatgacatgggctttgcccctgagcctgctgtggtgatgggccacagcggggaggacctgcccatggtggcccctggaaatgtgcgggtgaatgtggtgaacagcaccctggccgaggtgcactgggaccctgtgcccctgaagagcatccggggccacctgcagggctaccgcatctactactggaagacccagagcagcagcaagaggaacagaagacacatcgagaagaagatcctgaccttccagggcagcaagacccacggcatgctgcccggcctggagcccttcagccactacaccctgaatgtgcgggtggtgaatggcaagggggagggccctgccagcccagacagagtcttcaacaccccagagggcgtgcccagcgcccccagcagcctgaagatcgtgaaccccaccctggacagcctgaccctggagtgggacccccccagccaccccaacggcatcctgacagagtacaccctgaagtaccagcccatcaacagcacccatgagctgggccccctggtggacctgaagatcccagccaacaagacccgctggaccctgaagaacctgaacttcagcacccgctacaagttctacttctacgcccagaccagcgctggcagcggcagccagatcacagaggaggccgtgaccaccgtggatgaagctggcatcctgcccccagatgtgggcgctgggaaggtgcaggccgtgaacccccgcatcagcaacctgacagctgctgctgctgagacctacgccaacatctcctgggagtatgagggccctgagcacgtgaacttctacgtggagtatggagtggccggcagcaaggaggagtggaggaaggagatcgtgaatggcagccgctccttcttcggcctgaagggcctgatgcctggaacagcctacaaggtgcgggtgggcgctgtgggggacagcggctttgtgtccagtgaagatgtgtttgaaacaggccctgccatggccagccggcaggtggacatcgccacccagggctggttcatcggcctgatgtgtgctgtggccctgctgatcctgatcctgctgattgtgtgcttcatcagaagaaacaagggcggcaagtaccctgtgaaggagaaggaggatgcccacgccgaccctgagatccagcccatgaaggaggatgatggcaccttcggggagtacagtgatgctgaggaccacaagcccctgaagaagggcagcaggacccccagcgacagaacagtgaagaaggaggacagtgatgacagcctggtggactatggagaaggagtgaatggccagttcaatgaagatggcagcttcatcggccagtacagcggcaagaaggagaaggagcctgctgagggcaatgaatcttctgaggcccccagccctgtgaatgccatgaacagctttgtgtag

SEQ ID NO: 161696 - DNA, 3927 bp, Artificial Sequence
  Description of Artificial Sequence: Synthetic coding sequence
atgcagctgaagatcatgcccaagaagaagaggctgtctgctggccgggtgcccctcatcctcttcctgtgccagatgatcagcgccctggaggtgcccctggaccagaagagcacagaggtgatggtgcagccccccaccatcacccagcagagccccaaggactacatcatcgacccccgggagaacatcgtcatccagtgtgaggccaagggcaagcccccacccagcttctcctggaccagaaatggcacccactttgatattgacaaggaccccctggtgaccatgaagccaggcaccggcaccctcatcatcaacatcatgtctgagggcaaggccgagacctatgaaggagtgtaccagtgcacagccagaaatgaaagaggagctgctgtgagcaacaacatcgtggtgcggcccagccgcagccccctgtggaccaaggagaagctggagcccatcaccctgcagagcggccagagcctggtgctgccctgcaggcctcccatcggcctgcccccacccatcatcttctggatggacaacagcttccagaggctgccccagagcgagcgggtgtcccagggcctgaatggagacctgtacttcagcaatgtgctgcctgaggacacccgggaggactacatctgctacgcccgcttcaaccacacccagaccatccagcagaagcagcccatctctgtgaaggtgatctctgtggatgagctgaatgacaccatcgccgccaacctgagtgacacagagttctacggggccaagagcagccgggagaggcctcccaccttcctgaccccagagggcaatgccagcaacaaggaggagctgcggggaaatgtgctgagcctggagtgcatcgccgagggcctgcccacccccatcatctactgggccaaggaggatggcatgctgcccaagaacagaacagtgtacaagaactttgagaagaccctgcagatcatccacgtgtctgaggccgacagcggcaactaccagtgcatcgccaagaatgccctgggcgccatccaccacaccatctctgtgcgggtgaaggccgccccctactggatcacagccccccagaacctggtgctgagccctggagaagatggcaccctcatctgccgggccaatggaaaccccaagccccgcatctcctggctgaccaatggagtgcccattgaaattgccccagatgaccccagcaggaagattgatggagacaccatcatcttcagcaatgtgcaggagaggagcagcgctgtgtaccagtgcaatgccagcaatgaatatggctacctgctggccaatgcctttgtgaatgtgctggccgagcccccacgcatcctgaccccagccaacaccctgtaccaggtgattgccaacagacctgccctgctggactgtgccttcttcggcagccccctgcccaccatcgagtggttcaagggggccaagggcagcgccctgcacgaggacatctacgtgctgcatgaaaatggcaccctggagatccctgtggcccagaaggacagcacaggcacctacacctgtgtggccaggaacaagctgggcatggccaagaatgaggtgcacctggagatcaaggaccccacctggatcgtgaagcagccagaatatgctgtggtgcagaggggctccatggtgtcctttgagtgcaaggtgaagcatgaccacaccctgagcctgactgtgctgtggctgaaggacaaccgggagctgcccagtgatgagcgcttcaccgtggacaaggaccacctggtggtggctgatgtgtctgatgatgattctggcacctacacctgtgtggccaacaccaccctggacagcgtgtctgccagcgctgtgctgtctgtggtggcccccacccccaccccagcccctgtgtatgatgtgcccaaccccccatttgacctggagctgacagaccagctggacaagtctgtgcagctgtcctggaccccaggagatgacaacaacagccccatcaccaagttcatcatcgagtatgaagatgccatgcacaagccaggcctgtggcaccaccagacagaggtgtctggcacccagaccacagcccagctgaagctgagcccctacgtgaactacagcttccgggtgatggctgtgaacagcatcggcaagagcctgcccagcgaggccagcgagcagtacctgaccaaggccagcgagccagacaagaaccccacagctgtggagggcctgggcagcgagccagacaacctggtgatcacctggaagcccctgaatggatttgagagcaatggacctggcctgcagtacaaggtgtcctggaggcagaaggatggagatgatgagtggacctctgtggtggtggccaacgtgtccaagtacatcgtgtctggcacccccacctttgtgccctacctgatcaaggtgcaggccctgaatgacatgggctttgcccctgagcctgctgtggtgatgggccacagcggggaggacctgcccatggtggcccctggaaatgtgcgggtgaatgtggtgaacagcaccctggccgaggtgcactgggaccctgtgcccctgaagagcatccggggccacctgcagggctaccgcatctactactggaagacccagagcagcagcaagaggaacagaagacacatcgagaagaagatcctgaccttccagggcagcaagacccacggcatgctgcccggcctggagcccttcagccactacaccctgaatgtgcgggtggtgaatggcaagggggagggccctgccagcccagacagagtcttcaacaccccagagggcgtgcccagcgcccccagcagcctgaagatcgtgaaccccaccctggacagcctgaccctggagtgggacccccccagccaccccaacggcatcctgacagagtacaccctgaagtaccagcccatcaacagcacccatgagctgggccccctggtggacctgaagatcccagccaacaagacccgctggaccctgaagaacctgaacttcagcacccgctacaagttctacttctacgcccagaccagcgctggcagcggcagccagatcacagaggaggccgtgaccaccgtggatgaagctggcatcctgcccccagatgtgggcgctgggaaggtgcaggccgtgaacccccgcatcagcaacctgacagctgctgctgctgagacctacgccaacatctcctgggagtatgagggccctgagcacgtgaacttctacgtggagtatggagtggccggcagcaaggaggagtggaggaaggagatcgtgaatggcagccgctccttcttcggcctgaagggcctgatgcctggaacagcctacaaggtgcgggtgggcgctgtgggggacagcggctttgtgtccagtgaagatgtgtttgaaacaggccctgccatggccagccggcaggtggacatcgccacccagggctggttcatcggcctgatgtgtgctgtggccctgctgatcctgatcctgctgattgtgtgcttcatcagaagaaacaagggcggcaagtaccctgtgaaggagaaggaggatgcccacgccgaccctgagatccagcccatgaaggaggatgatggcaccttcggggagtacagcagcctgaagaatgatgctgaggaccacaagcccctgaagaagggcagcaggacccccagcgacagaacagtgaagaaggaggacagtgatgacagcctggtggactatggagaaggagtgaatggccagttcaatgaagatggcagcttcatcggccagtacagcggcaagaaggagaaggagcctgctgagggcaatgaatcttctgaggcccccagccctgtgaatgccatgaacagctttgtgtag

SEQ ID NO: 161697 - DNA, 3543 bp, Artificial Sequence
  Description of Artificial Sequence: Synthetic coding sequence
atgcagctgaagatcatgcccaagaagaagaggctgtctgctggccgggtgcccctcatcctcttcctgtgccagatgatcagcgccctggaggtgcccctggaccagaagagcacagaggtgatggtgcagccccccaccatcacccagcagagccccaaggactacatcatcgacccccgggagaacatcgtcatccagtgtgaggccaagggcaagcccccacccagcttctcctggaccagaaatggcacccactttgatattgacaaggaccccctggtgaccatgaagccaggcaccggcaccctcatcatcaacatcatgtctgagggcaaggccgagacctatgaaggagtgtaccagtgcacagccagaaatgaaagaggagctgctgtgagcaacaacatcgtggtgcggcccagccgcagccccctgtggaccaaggagaagctggagcccatcaccctgcagagcggccagagcctggtgctgccctgcaggcctcccatcggcctgcccccacccatcatcttctggatggacaacagcttccagaggctgccccagagcgagcgggtgtcccagggcctgaatggagacctgtacttcagcaatgtgctgcctgaggacacccgggaggactacatctgctacgcccgcttcaaccacacccagaccatccagcagaagcagcccatctctgtgaaggtgatcagcgccaagagcagccgggagcggccccccaccttcctgaccccagagggcaatgccagcaacaaggaggagctgcggggaaatgtgctgagcctggagtgcatcgccgagggcctgcccacccccatcatctactgggccaaggaggatggcatgctgcccaagaacagaacagtgtacaagaactttgagaagaccctgcagatcatccacgtgtctgaggccgacagcggcaactaccagtgcatcgccaagaatgccctgggcgccatccaccacaccatctctgtgcgggtgaaggccgccccctactggatcacagccccccagaacctggtgctgagccctggagaagatggcaccctcatctgccgggccaacggcaaccccaagccccgcatctcctggctgaccaacggggtgcccatcgagatcgccccagatgaccccagcaggaagattgatggagacaccatcatcttcagcaatgtgcaggagaggagcagcgctgtgtaccagtgcaatgccagcaatgaatatggctacctgctggccaatgcctttgtgaatgtgctggccgagcccccacgcatcctgaccccagccaacaccctgtaccaggtgattgccaacagacctgccctgctggactgtgccttcttcggcagccccctgcccaccatcgagtggttcaagggggccaagggcagcgccctgcacgaggacatctacgtgctgcatgaaaatggcaccctggagatccctgtggcccagaaggacagcacaggcacctacacctgtgtggccaggaacaagctgggcatggccaagaatgaggtgcacctggagatcaaggaccccacctggatcgtgaagcagccagaatatgctgtggtgcagaggggctccatggtgtcctttgagtgcaaggtgaagcatgaccacaccctgagcctgactgtgctgtggctgaaggacaaccgggagctgcccagtgatgagcgcttcaccgtggacaaggaccacctggtggtggctgatgtgtctgatgatgacagcggcacctacacctgtgtggccaacaccaccctggacagcgtgtctgccagcgctgtgctgtctgtggtggcccccacccccaccccagcccctgtgtatgatgtgcccaaccccccatttgacctggagctgacagaccagctggacaagtctgtgcagctgtcctggaccccaggagatgacaacaacagccccatcaccaagttcatcattgaatatgaagatgccatgcacaagccaggcctgtggcaccaccagacagaggtgtctggcacccagaccacagcccagctgaagctgagcccctacgtgaactacagcttccgggtgatggctgtgaacagcatcggcaagagcctgcccagcgaggccagcgagcagtacctgaccaaggccagcgagccagacaagaaccccacagctgtggagggcctgggcagcgagccagacaacctggtgatcacctggaagcccctgaatggatttgagagcaatggacctggcctgcagtacaaggtgtcctggaggcagaaggatggagatgatgagtggacctctgtggtggtggccaacgtgtccaagtacatcgtgtctggcacccccacctttgtgccctacctgatcaaggtgcaggccctgaatgacatgggctttgcccctgagcctgctgtggtgatgggccacagcggggaggacctgcccatggtggcccctggaaatgtgcgggtgaatgtggtgaacagcaccctggccgaggtgcactgggaccctgtgcccctgaagagcatccggggccacctgcagggctaccgcatctactactggaagacccagagcagcagcaagaggaacagaagacacatcgagaagaagatcctgaccttccagggcagcaagacccacggcatgctgcccggcctggagcccttcagccactacaccctgaatgtgcgggtggtgaatggaaaaggagagggccctgccagcccagacagagtcttcaacaccccagagggcgtgcccagcgcccccagcagcctgaagatcgtgaaccccaccctggacagcctgaccctggagtgggacccccccagccaccccaacggcatcctgacagagtacaccctgaagtaccagcccatcaacagcacccatgagctgggccccctggtggacctgaagatcccagccaacaagacccgctggaccctgaagaacctgaacttcagcacccgctacaagttctacttctacgcccagaccagcgctggcagcggcagccagatcacagaggaggccgtgaccaccgtggatgaggccatggccagccggcaggtggacatcgccacccagggctggttcatcggcctgatgtgtgctgtggccctgctgatcctgatcctgctgattgtgtgcttcatcagaagaaacaagggcggcaagtaccctgtgaaggagaaggaggatgcccacgccgaccctgagatccagcccatgaaggaggatgatggcaccttcggggagtacagtgatgctgaggaccacaagcccctgaagaagggcagcaggacccccagcgacagaacagtgaagaaggaggacagtgatgacagcctggtggactatggagaaggagtgaatggccagttcaatgaagatggcagcttcatcggccagtacagcggcaagaaggagaaggagcctgctgagggcaatgaatcttctgaggcccccagccctgtgaatgccatgaacagctttgtgtag

SEQ ID NO: 161698 - DNA, 1296 bp, Artificial Sequence
  Description of Artificial Sequence: Synthetic coding sequence
atgcagctgaagatcatgcccaagaagaagaggctgtctgctggccgggtgcccctcatcctcttcctgtgccagatgatcagcgccctggaggtgcccctggacctggtgcagccccccaccatcacccagcagagccccaaggactacatcatcgacccccgggagaacatcgtcatccagtgtgaggccaagggcaagcccccacccagcttctcctggaccagaaatggcacccactttgatattgacaaggaccccctggtgaccatgaagccaggcaccggcaccctcatcatcaacatcatgtctgagggcaaggccgagacctatgaaggagtgtaccagtgcacagccagaaatgaaagaggagctgctgtgagcaacaacatcgtggtgcggcccagccgcagccccctgtggaccaaggagaagctggagcccatcaccctgcagagcggccagagcctggtgctgccctgcaggcctcccatcggcctgcccccacccatcatcttctggatggacaacagcttccagaggctgccccagagcgagcgggtgtcccagggcctgaatggagacctgtacttcagcaatgtgctgcctgaggacacccgggaggactacatctgctacgcccgcttcaaccacacccagaccatccagcagaagcagcccatctctgtgaaggtgatctctgtggatgagctgaatgacaccatcgccgccaacctgagtgacacagagttctacggggccaagagcagccgggagaggcctcccaccttcctgaccccagagggcaatgccagcaacaaggaggagctgcggggaaatgtgctgagcctggagtgcatcgccgagggcctgcccacccccatcatctactgggccaaggaggatggcatgctgcccaagaacagaacagtgtacaagaactttgagaagaccctgcagatcatccacgtgtctgaggccgacagcggcaactaccagtgcatcgccaagaatgccctgggcgccatccaccacaccatctctgtgcgggtgaaggccgccccctactggatcacagccccccagaacctggtgctgagccctggagaagatggcaccctcatctgccgggccaatggaaaccccaagccccgcatctcctggctgaccaatggagtgcccattgaaattgccccagatgaccccagcaggaagattgatggagacaccatcatcttcagcaatgtgcaggagaggagcagcgctgtgtaccagtgcaatgccagcaatgaatag

SEQ ID NO: 161699 - DNA, 186 bp, Artificial Sequence
  Description of Artificial Sequence: Synthetic coding sequence
atgcagctgaagatcatgcccaagaagaagaggctgtctgctggccgggtgcccctcatcctcttcctgtgccagatgatcagcgccctggaggtgcccctggaccccaagctgctggaggacctggtgcagccccccaccatcacccagcagagccccaaggactacatcatcgaccccaggtag

SEQ ID NO: 161700 - DNA, 321 bp, Artificial Sequence
  Description of Artificial Sequence: Synthetic coding sequence
atgcagctgaagatcatgcccaagaagaagaggctgtctgctggccgggtgcccctcatcctcttcctgtgccagatgatcagcgccctggaggtgcccctggacctggtgcagccccccaccatcacccagcagagccccaaggactacatcatcgacccccgggagaacatcgtcatccagtgtgaggccaagggcaagcccccacccagcttctcctggaccagaaatggcacccactttgatattgacaaggaccccctggtgaccatgaagccaggcaccggcaccctcatcatcaacatcatgtctgagggctag

SEQ ID NO: 161701 - DNA, 3915 bp, Artificial Sequence; identical to SEQ ID NO: 161695
  Description of Artificial Sequence: Synthetic coding sequence

SEQ ID NO: 161702 - DNA, 447 bp, Artificial Sequence
  Description of Artificial Sequence: Synthetic coding sequence
atggccagccggcaggtggacatcgccacccagggctggttcatcggcctgatgtgtgctgtggccctgctgatcctgatcctgctgattgtgtgcttcatcagaagaaacaagggcggcaagtaccctgtgaaggagaaggaggatgcccacgccgaccctgagatccagcccatgaaggaggatgatggcaccttcggggagtacagtgatgctgaggaccacaagcccctgaagaagggcagcaggacccccagcgacagaacagtgaagaaggaggacagtgatgacagcctggtggactatggagaaggagtgaatggccagttcaatgaagatggcagcttcatcggccagtacagcggcaagaaggagaaggagcctgctgagggcaatgaatcttctgaggcccccagccctgtgaatgccatgaacagctttgtgtag

SEQ ID NO: 161703 - DNA, 357 bp, Artificial Sequence
  Description of Artificial Sequence: Synthetic coding sequence
atgcagctgaagatcatgcccaagaagaagaggctgtctgctggccgggtgcccctcatcctcttcctgtgccagatgatcagcgccctggaggtgcccctggaccccaagctgctggaggacctggtgcagccccccaccatcacccagcagagccccaaggactacatcatcgacccccgggagaacatcgtcatccagtgtgaggccaagggcaagcccccacccagcttctcctggaccagaaatggcacccactttgatattgacaaggaccccctggtgaccatgaagccaggcaccggcaccctcatcatcaacatcatgtctgagggcaaggccgagacctatgaatag

SEQ ID NO: 161704 - DNA, 2316 bp, Artificial Sequence
  Description of Artificial Sequence: Synthetic coding sequence
atgcagctgaagatcatgcccaagaagaagaggctgtctgctggccgggtgcccctcatcctcttcctgtgccagatgatcagcgccctggaggtgcccctggacctggtgcagccccccaccatcacccagcagagccccaaggactacatcatcgacccccgggagaacatcgtcatccagtgtgaggccaagggcaagcccccacccagcttctcctggaccagaaatggcacccactttgatattgacaaggaccccctggtgaccatgaagccaggcaccggcaccctcatcatcaacatcatgtctgagggcaaggccgagacctatgaaggagtgtaccagtgcacagccagaaatgaaagaggagctgctgtgagcaacaacatcgtggtgcggcccagccgcagccccctgtggaccaaggagaagctggagcccatcaccctgcagagcggccagagcctggtgctgccctgcaggcctcccatcggcctgcccccacccatcatcttctggatggacaacagcttccagaggctgccccagagcgagcgggtgtcccagggcctgaatggagacctgtacttcagcaatgtgctgcctgaggacacccgggaggactacatctgctacgcccgcttcaaccacacccagaccatccagcagaagcagcccatctctgtgaaggtgatctctgtggatgagctgaatgacaccatcgccgccaacctgagtgacacagagttctacggggccaagagcagccgggagaggcctcccaccttcctgaccccagagggcaatgccagcaacaaggaggagctgcggggaaatgtgctgagcctggagtgcatcgccgagggcctgcccacccccatcatctactgggccaaggaggatggcatgctgcccaagaacagaacagtgtacaagaactttgagaagaccctgcagatcatccacgtgtctgaggccgacagcggcaactaccagtgcatcgccaagaatgccctgggcgccatccaccacaccatctctgtgcgggtgaaggccgccccctactggatcacagccccccagaacctggtgctgagccctggagaagatggcaccctcatctgccgggccaatggaaaccccaagccccgcatctcctggctgaccaatggagtgcccattgaaattgccccagatgaccccagcaggaagattgatggagacaccatcatcttcagcaatgtgcaggagaggagcagcgctgtgtaccagtgcaatgccagcaatgaatatggctacctgctggccaatgcctttgtgaatgtgctggccgagcccccacgcatcctgaccccagccaacaccctgtaccaggtgattgccaacagacctgccctgctggactgtgccttcttcggcagccccctgcccaccatcgagtggttcaagggggccaagggcagcgccctgcacgaggacatctacgtgctgcatgaaaatggcaccctggagatccctgtggcccagaaggacagcacaggcacctacacctgtgtggccaggaacaagctgggcatggccaagaatgaggtgcacctggagatcaaggaccccacctggatcgtgaagcagccagaatatgctgtggtgcagaggggctccatggtgtcctttgagtgcaaggtgaagcatgaccacaccctgagcctgactgtgctgtggctgaaggacaaccgggagctgcccagtgatgagcgcttcaccgtggacaaggaccacctggtggtggctgatgtgtctgatgatgattctggcacctacacctgtgtggccaacaccaccctggacagcgtgtctgccagcgctgtgctgtctgtggtggatgtgcccaaccccccatttgacctggagctgacagaccagctggacaagtctgtgcagctgtcctggaccccaggagatgacaacaacagccccatcaccaagttcatcatcgagtatgaagatgccatgcacaagccaggcctgtggcaccaccagacagaggtgtctggcacccagaccacagcccagctgaagctgagcccctacgtgaactacagcttccgggtgatggctgtgaacagcatcggcaagagcctgcccagcgaggccagcgagcagtacctgaccaaggccagcgagccagacaagaaccccacagctgtggagggcctgggcagcgagccagacaacctggtgatcacctggaagcccctgaatggatttgagagcaatggacctggcctgcagaccagcacagccagcttctag

SEQ ID NO: 161705 - DNA, 321 bp, Artificial Sequence; identical to SEQ ID NO: 161700
  Description of Artificial Sequence: Synthetic coding sequence

SEQ ID NO: 161706 - DNA, 3462 bp, Artificial Sequence
  Description of Artificial Sequence: Synthetic coding sequence
atgcagctgaagatcatgcccaagaagaagaggctgtctgctggccgggtgcccctcatcctcttcctgtgccagatgatcagcgccctggaggtgcccctggaccagaagagcacagaggtgatggtgcagccccccaccatcacccagcagagccccaaggactacatcatcgacccccgggagaacatcgtcatccagtgtgaggccaagggcaagcccccacccagcttctcctggaccagaaatggcacccactttgatattgacaaggaccccctggtgaccatgaagccaggcaccggcaccctcatcatcaacatcatgtctgagggcaaggccgagacctatgaaggagtgtaccagtgcacagccagaaatgaaagaggagctgctgtgagcaacaacatcgtggtgcggcccagccgcagccccctgtggaccaaggagaagctggagcccatcaccctgcagagcggccagagcctggtgctgccctgcaggcctcccatcggcctgcccccacccatcatcttctggatggacaacagcttccagaggctgccccagagcgagcgggtgtcccagggcctgaatggagacctgtacttcagcaatgtgctgcctgaggacacccgggaggactacatctgctacgcccgcttcaaccacacccagaccatccagcagaagcagcccatctctgtgaaggtgatctctgtggatgagctgaatgacaccatcgccgccaacctgagtgacacagagttctacggggccaagagcagccgggagaggcctcccaccttcctgaccccagagggcaatgccagcaacaaggaggagctgcggggaaatgtgctgagcctggagtgcatcgccgagggcctgcccacccccatcatctactgggccaaggaggatggcatgctgcccaagaacagaacagtgtacaagaactttgagaagaccctgcagatcatccacgtgtctgaggccgacagcggcaactaccagtgcatcgccaagaatgccctgggcgccatccaccacaccatctctgtgcgggtgaaggccgccccctactggatcacagccccccagaacctggtgctgagccctggagaagatggcaccctcatctgccgggccaatggaaaccccaagccccgcatctcctggctgaccaatggagtgcccattgaaattgccccagatgaccccagcaggaagattgatggagacaccatcatcttcagcaatgtgcaggagaggagcagcgctgtgtaccagtgcaatgccagcaatgaatatggctacctgctggccaatgcctttgtgaatgtgctggccgagcccccacgcatcctgaccccagccaacaccctgtaccaggtgattgccaacagacctgccctgctggactgtgccttcttcggcagccccctgcccaccatcgagtggttcaagggggccaagggcagcgccctgcacgaggacatctacgtgctgcatgaaaatggcaccctggagatccctgtggcccagaaggacagcacaggcacctacacctgtgtggccaggaacaagctgggcatggccaagaatgaggtgcacctggagatcaaggaccccacctggatcgtgaagcagccagaatatgctgtggtgcagaggggctccatggtgtcctttgagtgcaaggtgaagcatgaccacaccctgagcctgactgtgctgtggctgaaggacaaccgggagctgcccagtgatgagcgcttcaccgtggacaaggaccacctggtggtggctgatgtgtctgatgatgattctggcacctacacctgtgtggccaacaccaccctggacagcgtgtctgccagcgctgtgctgtctgtggtggcccccacccccaccccagcccctgtgtatgatgtgcccaaccccccatttgacctggagctgacagaccagctggacaagtctgtgcagctgtcctggaccccaggagatgacaacaacagccccatcaccaagttcatcatcgagtatgaagatgccatgcacaagccaggcctgtggcaccaccagacagaggtgtctggcacccagaccacagcccagctgaagctgagcccctacgtgaactacagcttccgggtgatggctgtgaacagcatcggcaagagcctgcccagcgaggccagcgagcagtacctgaccaaggccagcgagccagacaagaaccccacagctgtggagggcctgggcagcgagccagacaacctggtgatcacctggaagcccctgaatggatttgagagcaatggacctggcctgcagtacaaggtgtcctggaggcagaaggatggagatgatgagtggacctctgtggtggtggccaacgtgtccaagtacatcgtgtctggcacccccacctttgtgccctacctgatcaaggtgcaggccctgaatgacatgggctttgcccctgagcctgctgtggtgatgggccacagcggggaggacctgcccatggtggcccctggaaatgtgcgggtgaatgtggtgaacagcaccctggccgaggtgcactgggaccctgtgcccctgaagagcatccggggccacctgcagggctaccgcatctactactggaagacccagagcagcagcaagaggaacagaagacacatcgagaagaagatcctgaccttccagggcagcaagacccacggcatgctgcccggcctggagcccttcagccactacaccctgaatgtgcgggtggtgaatggcaagggggagggccctgccagcccagacagagtcttcaacaccccagagggcgtgcccagcgcccccagcagcctgaagatcgtgaaccccaccctggacagcctgaccctggagtgggacccccccagccaccccaacggcatcctgacagagtacaccctgaagtaccagcccatcaacagcacccatgagctgggccccctggtggacctgaagatcccagccaacaagacccgctggaccctgaagaacctgaacttcagcacccgctacaagttctacttctacgcccagaccagcgctggcagcggcagccagatcacagaggaggccgtgaccaccgtggatgaagctggcatcctgcccccagatgtgggcgctgggaaggccatggccagccggcaggtggacatcgccacccagggctggttcatcggcctgatgtgtgctgtggccctgctgatcctgatcctgctgattgtgtgcttcatcagaagaaataaaggaggcaagtaccctgtgaaggagaaggaggatgcccatgctgaccctgagatccagcccatgaaggaggatgatggcacctttggagagtacagtgatgctgaggaccacaagcccctgaagaagggcagcaggacccccagcgacagaacagtgtag

SEQ ID NO: 161707 - DNA, 681 bp, Artificial Sequence
  Description of Artificial Sequence: Synthetic coding sequence
atgcaggtgcacctgactgtgcaggtgccccccaagatctatgacatcagcaatgacatgacagtgaatgaaggcaccaacgtgaccctgacctgcctggccaccgggaagccagagcccagcatctcctggaggcacatcagccccagcgccaagccctttgaaaatggccagtacctggacatctacggcatcacccgggaccaggccggggagtatgagtgcagcgcagaaaatgatgtgtccttcccagatgtgaggaaggtgaaggtggtggtgaactttgcccccaccatccaggagatcaagagcggcaccgtgaccccaggccgcagcggcctcatccgctgtgagggcgctggggtgcccccaccagcctttgagtggtacaagggggagaagaagctgttcaacggccagcagggcatcatcatccagaacttcagcaccaggagcatcctgactgtgaccaacgtgacccaggagcacttcggcaactacacctgtgtggccgccaacaagctgggcaccaccaatgccagcctgcccctgaacccccccagcacagcccagtatggcatcactggatctgcagatgtgctcttcagctgctggtacctggtgctgaccctgagcagcttcaccagcatcttctacctgaagaatgccatcctgcagtag

SEQ ID NO: 161708 - DNA, 1065 bp, Artificial Sequence
  Description of Artificial Sequence: Synthetic coding sequence
atggacatgatgctgctggtgcagggcgcctgctgcagcaaccagtggctggccgctgtgctgctgagcctgtgctgcctgctgcccagctgcctgcctgctggccagagcgtggacttcccctgggccgctgtggacaacatgatggtgaggaagggggacacagctgtgctgcgctgctacctggaggatggagccagcaagggggcctggctgaacagaagcagcatcatctttgctggaggagacaagtggagcgtggacccccgggtgtccatcagcaccctgaacaagagggactacagcctgcagatccagaatgtggatgtgacagatgatggcccctacacctgcagcgtgcagacccagcacacccccaggaccatgcaggtgcacctgactgtgcaggtgccccccaagatctatgacatcagcaatgacatgacagtgaatgaaggcaccaacgtgaccctgacctgcctggccaccgggaagccagagcccagcatctcctggaggcacatcagccccagcgccaagccctttgaaaatggccagtacctggacatctacggcatcacccgggaccaggccggggagtatgagtgcagcgcagaaaatgatgtgtccttcccagatgtgaggaaggtgaaggtggtggtgaactttgcccccaccatccaggagatcaagagcggcaccgtgaccccaggccgcagcggcctcatccgctgtgagggcgctggggtgcccccaccagcctttgagtggtacaagggggagaagaagctgttcaacggccagcagggcatcatcatccagaacttcagcaccaggagcatcctgactgtgaccaacgtgacccaggagcacttcggcaactacacctgtgtggccgccaacaagctgggcaccaccaatgccagcctgcccctgaacccccccagcacagcccagtatggcatcactggatctgcagatgtgctcttcagctgctggtacctggtgctgaccctgagcagcttcaccagcatcttctacctgaagaatgccatcctgcagtag

SEQ ID NO: 161709 - DNA, 927 bp, Artificial Sequence
  Description of Artificial Sequence: Synthetic coding sequence
atgatgctgctggtgcagggcgcctgctgcagcaaccagtggctggccgctgtgctgctgagcctgtgctgcctgctgcccagctgcctgcctgctggccagagcgtggacttcccctgggccgctgtggacaacatgatggtgaggaagggggacacagctgtgctgcgctgctacctggaggatggagccagcaagggggcctggctgaacagaagcagcatcatctttgctggaggagacaagtggagcgtggacccccgggtgtccatcagcaccctgaacaagagggactacagcctgcagatccagaatgtggatgtgacagatgatggcccctacacctgcagcgtgcagacccagcacacccccaggaccatgcaggtgcacctgactgtgcaggtgccccccaagatctatgacatcagcaatgacatgacagtgaatgaaggcaccaacgtgaccctgacctgcctggccaccgggaagccagagcccagcatctcctggaggcacatcagccccagcgtggcccccaccatccaggagatcaagagcggcaccgtgaccccaggccgcagcggcctcatccgctgtgagggcgctggggtgcccccaccagcctttgagtggtacaagggggagaagaagctgttcaacggccagcagggcatcatcatccagaacttcagcaccaggagcatcctgactgtgaccaacgtgacccaggagcacttcggcaactacacctgtgtggccgccaacaagctgggcaccaccaatgccagcctgcccctgaacccccccagcacagcccagtatggcatcactggatctgcagatgtgctcttcagctgctggtacctggtgctgaccctgagcagcttcaccagcatcttctacctgaagaatgccatcctgcagtag

SEQ ID NO: 161710 - DNA, 2133 bp, Artificial Sequence
  Description of Artificial Sequence: Synthetic coding sequence
atggagacccgggagagcgaggacctggagaagaccaggaggaagagcgccagtgaccagtggaacacagacaatgaaccagccaaggtgaagccagagctgctgcctgagaaggaggagaccagccaggccgaccaggacatccaggacaaggagccccactgccacatccccatcaagagaaattccatcttcaacagaagcatccggaggaagagcaaggccaaggcccgggacaaccctgagagaaatgccagctgcctggccgacagccaggacaacgggaagtctgtgaatgagcccctgaccctgaacatcccctggagcaggatgccaccctgcaggacagccatgcagacagaccccggggcccaggagatgtctgagagcagcagcaccccaggaaatggagccaccccagaggagtggccagccctggccgacagccccaccaccctgacagaggccctgaggatgatccaccccatcccagctgacagctggaggaacctgattgagcagatcggcctgctgtaccaggagtacagagacaagagcaccctgcaggagattgagacccggcggcagcaggatgctgagattgaggacaacaccaacggcagccctgccagcgaggacaccccagaggaggaggaggaggaggaggaggaggaggagcccgccagccccccagagaggaagaccctgccccagatctgcctgctgagcaacccccacagccgcttcaacctgtggcaggacctgcctgagatccgcagcagtggagtgctggagatcctgcagcctgaggagatcaagctgcaggaggccatgtttgagctggtgaccagcgaggccagctactacaagagcctgaacctgctggtgagccacttcatggagaatgaaagaatcaggaagatcctgcaccccagcgaggcccacatcctcttcagcaatgtgctggatgtgctggccgtgtctgagcgcttcctgctggagctggagcacaggatggaggagaacatcgtcatcagtgatgtgtgtgacatcgtgtaccgctatgctgctgaccacttctctgtgtacatcacctacgtgagcaaccagacctaccaggagaggacctacaagcagctgctgcaggagaaggccgccttccgggagctgattgcccagctggagctggaccccaagtgccggggcctgcccttcagcagcttcctgatcctgcccttccagaggatcacccggctgaagctgctggtgcagaacatcctgaagagggtggaggagaggagtgaaagagaatgtacagccctggatgcccacaaggagctggagatggtggtgaaggcctgcaatgaaggagtgaggaagatgagcaggacagagcagatgatcagcatccagaagaagatggagttcaagatcaagtctgtgcccatcatcagccacagccgctggctgctgaagcagggcgagctgcagcagatgagcggccccaagaccagcaggaccctgcggaccaagaagctgttccacgagatctacctgttcctgttcaatgacctgctggtgatctgccggcagatccctggggacaagtaccaggtgtttgacagcgccccccggggcctgctgcgggtggaggagctggaggaccagggccagaccctggccaacgtgttcatcctgcggctgctggagaatgctgatgaccgggaggccacctacatgctgaaggccagcagccagagcgagatgaagcgctggatgaccagcctggcccccaacagaaggaccaagtttgtgtccttcaccagccggctgctggactgcccccaggtgcagtgtgtgcacccctacgtggcccagcagccagatgagctgaccctggagctggccgacatcctgaacatcctggacaagacagatgatggctggatctttggagagcggctgcatgaccaggagcggggctggttccccagctccatgacagaggagatcctgaaccccaagatccgcagccagaacctgaaggagtgcttccgggtgcacaagatggatgacccccagaggagccagaacaaggacaggaggaagctgggcagcaggaaccggcagtag

SEQ ID NO: 161711 - DNA, 1857 bp, Artificial Sequence
  Description of Artificial Sequence: Synthetic coding sequence
atggagctgctggccgccgccttctctgctgcctgtgctgtggaccatgacagcagcaccagcgagagtgatgcccgggacagcgctgctggccacctgcccggcagcgagagcagcagcaccccaggaaatggagccaccccagaggagtggccagccctggccgacagccccaccaccctgacagaggccctgaggatgatccaccccatcccagctgacagctggaggaacctgattgagcagatcggcctgctgtaccaggagtacagagacaagagcaccctgcaggagattgagacccggcggcagcaggatgctgagattgaggacaacaccaacggcagccctgccagcgaggacaccccagaggaggaggaggaggaggaggaggaggaggagcccgccagccccccagagaggaagaccctgccccagatctgcctgctgagcaacccccacagccgcttcaacctgtggcaggacctgcctgagatccgcagcagtggagtgctggagatcctgcagcctgaggagatcaagctgcaggaggccatgtttgagctggtgaccagcgaggccagctactacaagagcctgaacctgctggtgagccacttcatggagaatgaaagaatcaggaagatcctgcaccccagcgaggcccacatcctcttcagcaatgtgctggatgtgctggccgtgtctgagcgcttcctgctggagctggagcacaggatggaggagaacatcgtcatcagtgatgtgtgtgacatcgtgtaccgctatgctgctgaccacttctctgtgtacatcacctacgtgagcaaccagacctaccaggagaggacctacaagcagctgctgcaggagaaggccgccttccgggagctgattgcccagctggagctggaccccaagtgccggggcctgcccttcagcagcttcctgatcctgcccttccagaggatcacccggctgaagctgctggtgcagaacatcctgaagagggtggaggagaggagtgaaagagaatgtacagccctggatgcccacaaggagctggagatggtggtgaaggcctgcaatgaaggagtgaggaagatgagcaggacagagcagatgatcagcatccagaagaagatggagttcaagatcaagtctgtgcccatcatcagccacagccgctggctgctgaagcagggcgagctgcagcagatgagcggccccaagaccagcaggaccctgcggaccaagaagctgttccacgagatctacctgttcctgttcaatgacctgctggtgatctgccggcagatccctggggacaagtaccaggtgtttgacagcgccccccggggcctgctgcgggtggaggagctggaggaccagggccagaccctggccaacgtgttcatcctgcggctgctggagaatgctgatgaccgggaggccacctacatgctgaaggccagcagccagagcgagatgaagcgctggatgaccagcctggcccccaacagaaggaccaagtttgtgtccttcaccagccggctgctggactgcccccaggtgcagtgtgtgcacccctacgtggcccagcagccagatgagctgaccctggagctggccgacatcctgaacatcctggacaagacagatgatggctggatctttggagagcggctgcatgaccaggagcggggctggttccccagctccatgacagaggagatcctgaaccccaagatccgcagccagaacctgaaggagtgcttccgggtgcacaagatggatgacccccagaggagccagaacaaggacaggaggaagctgggcagcaggaaccggcagtag

SEQ ID NO: 161712 - DNA, 717 bp, Artificial Sequence
  Description of Artificial Sequence: Synthetic coding sequence
atggagctgctggccgccgccttctctgctgcctgtgctgtggaccatgacagcagcaccagcgagagtgatgcccgggacagcgctgctggccacctgcccggcagcgagagcagcagcaccccaggaaatggagccaccccagaggagtggccagccctggccgacagccccaccaccctgacagaggccctgaggatgatccaccccatcccagctgacagctggaggaacctgattgagcagatcggcctgctgtaccaggagtacagagacaagagcaccctgcaggagattgagacccggcggcagcaggatgctgagattgaggacaacaccaacggcagccctgccagcgaggacaccccagaggaggaggaggaggaggaggaggaggaggagcccgccagccccccagagaggaagaccctgccccagatctgcctgctgagcaacccccacagccgcttcaacctgtggcaggacctgcctgagatccgcagcagtggagtgctggagatcctgcagcctgaggagatcaagctgcaggaggccatgtttgagctggtgaccagcgaggccagctactacaagagcctgaacctgctggtgagccacttcatggagaatgaaagaatcaggaagatcctgcaccccagcgaggcccacatcctcttcagcaatgtgctggatgtgctggccgtgtctgagaggtag

SEQ ID NO: 161713 - DNA, 1302 bp, Artificial Sequence
  Description of Artificial Sequence: Synthetic coding sequence
atgtttgagctggtgaccagcgaggccagctactacaagagcctgaacctgctggtgagccacttcatggagaatgaaagaatcaggaagatcctgcaccccagcgaggcccacatcctcttcagcaatgtgctggatgtgctggccgtgtctgagcgcttcctgctggagctggagcacaggatggaggagaacatcgtcatcagtgatgtgtgtgacatcgtgtaccgctatgctgctgaccacttctctgtgtacatcacctacgtgagcaaccagacctaccaggagaggacctacaagcagctgctgcaggagaaggccgccttccgggagctgattgcccagctggagctggaccccaagtgccggggcctgcccttcagcagcttcctgatcctgcccttccagaggatcacccggctgaagctgctggtgcagaacatcctgaagagggtggaggagaggtctgagcgggagtgcacagccctggatgcccacaaggagctggagatggtggtgaaggcctgcaatgaaggagtgaggaagatgagcaggacagagcagatgatcagcatccagaagaagatggagttcaagatcaagtctgtgcccatcatcagccacagccgctggctgctgaagcagggcgagctgcagcagatgagcggccccaagaccagcaggaccctgcggaccaagaagctgttccacgagatctacctgttcctgttcaatgacctgctggtgatctgccggcagatccctggggacaagtaccaggtgtttgattctgccccccggggcctgctgcgggtggaggagctggaggaccagggccagaccctggccaacgtgttcatcctgcggctgctggagaatgctgatgaccgggaggccacctacatgctgaaggccagcagccagagcgagatgaagcgctggatgaccagcctggcccccaacagaaggaccaagtttgtgtccttcaccagccggctgctggactgcccccaggtgcagtgtgtgcacccctacgtggcccagcagccagatgagctgaccctggagctggccgacatcctgaacatcctggacaagacagatgatggctggatctttggagagcggctgcatgaccaggagcggggctggttccccagctccatgacagaggagatcctgaaccccaagatccgcagccagaacctgaaggagtgcttccgggtgcacaagatggatgacccccagaggagccagaacaaggacaggaggaagctgggcagcaggaaccggcagtag

SEQ ID NO: 161714 - DNA, 1803 bp, Artificial Sequence
  Description of Artificial Sequence: Synthetic coding sequence
atgccaccctgcaggacagccatgcagacagaccccggggcccaggagatgtctgagagcagcagcaccccaggaaatggagccaccccagaggagtggccagccctggccgacagccccaccaccctgacagaggccctgaggatgatccaccccatcccagctgacagctggaggaacctgattgagcagatcggcctgctgtaccaggagtacagagacaagagcaccctgcaggagattgagacccggcggcagcaggatgctgagattgaggacaacaccaacggcagccctgccagcgaggacaccccagaggaggaggaggaggaggaggaggaggaggagcccgccagccccccagagaggaagaccctgccccagatctgcctgctgagcaacccccacagccgcttcaacctgtggcaggacctgcctgagatccgcagcagtggagtgctggagatcctgcagcctgaggagatcaagctgcaggaggccatgtttgagctggtgaccagcgaggccagctactacaagagcctgaacctgctggtgagccacttcatggagaatgaaagaatcaggaagatcctgcaccccagcgaggcccacatcctcttcagcaatgtgctggatgtgctggccgtgtctgagcgcttcctgctggagctggagcacaggatggaggagaacatcgtcatcagtgatgtgtgtgacatcgtgtaccgctatgctgctgaccacttctctgtgtacatcacctacgtgagcaaccagacctaccaggagaggacctacaagcagctgctgcaggagaaggccgccttccgggagctgattgcccagctggagctggaccccaagtgccggggcctgcccttcagcagcttcctgatcctgcccttccagaggatcacccggctgaagctgctggtgcagaacatcctgaagagggtggaggagaggagtgaaagagaatgtacagccctggatgcccacaaggagctggagatggtggtgaaggcctgcaatgaaggagtgaggaagatgagcaggacagagcagatgatcagcatccagaagaagatggagttcaagatcaagtctgtgcccatcatcagccacagccgctggctgctgaagcagggcgagctgcagcagatgagcggccccaagaccagcaggaccctgcggaccaagaagctgttccacgagatctacctgttcctgttcaatgacctgctggtgatctgccggcagatccctggggacaagtaccaggtgtttgacagcgccccccggggcctgctgcgggtggaggagctggaggaccagggccagaccctggccaacgtgttcatcctgcggctgctggagaatgctgatgaccgggaggccacctacatgctgaaggccagcagccagagcgagatgaagcgctggatgaccagcctggcccccaacagaaggaccaagtttgtgtccttcaccagccggctgctggactgcccccaggtgcagtgtgtgcacccctacgtggcccagcagccagatgagctgaccctggagctggccgacatcctgaacatcctggacaagacagatgatggctggatctttggagagcggctgcatgaccaggagcggggctggttccccagctccatgacagaggagatcctgaaccccaagatccgcagccagaacctgaaggagtgcttccgggtgcacaagatggatgacccccagaggagccagaacaaggacaggaggaagctgggcagcaggaaccggcagtag

SEQ ID NO: 161715 - DNA, 705 bp, Artificial Sequence
  Description of Artificial Sequence: Synthetic coding sequence
atgacaggcagctctgtgtttgactacatccaccctggggaccacagcgaggtgctggagcagctgggcctgcggacccccaccccaggcccccccaccccacccagcgtgagcagcagcagcagcagcagcagcagcctggccgacaccccagaaattgaggccagcctgaccaaggtgccccccagcagcctggtgcaggagaggagcttctttgtgaggatgaagagcaccctgaccaagaggggcctgcacgtgaaggccagcggctacaaggtgattcatgtgacaggccgcctgcgggcccacgccctgggcctggtggccctgggccacaccctgcccccagcccccctggccgagctgcccctgcacggccacatgattgtgttccggctgagcctgggcctgaccatcctggcctgtgagagccgggtgtctgaccacatggacctgggccccagcgagctggtgggccgcagctgctaccagtttgtgcacggccaggatgccacccgcatccggcagagccacgtggacagctgccggggcctgcgggtggccgctgtgtgtggccacagcggctgggagcgggaggagcccaggggggccccctgtgccctgggccagccccgggcccagcccagccggggctggcccaacagctttggctgcctgcctgccagcagccagaggggcctgtag

SEQ ID NO: 161716 - DNA, 1773 bp, Artificial Sequence
  Description of Artificial Sequence: Synthetic coding sequence
atggccgccccctacccaggcagcggcggcggcagcgaggtgaagtgtgtgggcggccgcggggcctctgtgccctgggacttcctgcccggcctgatggtgaaggcccccagcggcccctgcctgcaggcccagaggaaggagaagagcagaaatgctgcccggagcagaagaggcaaggagaacctggagttctttgagctggccaagctgctgcccctgcccggggccatcagcagccagctggacaaggccagcatcgtgcggctgtctgtgacctacctgcggctgcggagatttgctgccctgggcgccccaccctggggcctgcgggctgctggccccccagctggcctggcccctggaagaagaggccctgctgccctggtgtctgaggtgtttgagcagcacctgggcggccacatcctgcagagcctggatggctttgtgtttgccctgaaccaggagggcaagttcctgtacatcagcgagaccgtgtccatctacctgggcctgagccaggtggagatgacaggcagctctgtgtttgactacatccaccctggggaccacagcgaggtgctggagcagctgggcctgcggacccccaccccaggcccccccaccccacccagcgtgagcagcagcagcagcagcagcagcagcctggccgacaccccagaaattgaggccagcctgaccaaggtgccccccagcagcctggtgcaggagaggagcttctttgtgaggatgaagagcaccctgaccaagaggggcctgcacgtgaaggccagcggctacaaggtgattcatgtgacaggccgcctgcgggcccacgccctgggcctggtggccctgggccacaccctgcccccagcccccctggccgagctgcccctgcacggccacatgattgtgttccggctgagcctgggcctgaccatcctggcctgtgagagccgggtgtctgaccacatggacctgggccccagcgagctggtgggccgcagctgctaccagtttgtgcacggccaggatgccacccgcatccggcagagccacgtggacctgctggacaagggccaggtgatgacaggctactaccgctggctgcagagagctgggggctttgtgtggctgcagagcgtggccaccgtggccggcagcggcaagagccctggagagcaccacgtgctgtgggtgagccacgtgctgagccaggccgagggcggccagacccccctggatgccttccagctgcctgcctctgtggcctgtgaggaggccagcagccctggccctgagcccacagagcctgagcccccaacagagggcaagcaggccgccccagcagaaaatgaggccccccagacccagggcaagaggatcaaggtggagcccggcccccgggagaccaagggcagcgaggacagcggagatgaggaccccagcagccacccagccacccccaggcctgagttcaccagcgtcatccgggccggcgtgctgaagcaggaccctgtgcggccctggggcctggcccctcctggggaccccccacccaccctgctgcacgccggcttcctgccccctgtggtgcggggcctgtgcaccccaggcaccatccgctatggccctgctgagctgggcctggtgtacccccacctgcagaggctgggccctggccctgccctgcctgaggccttctacccacccctgggcctgccctacccaggccctgctggcacccggctgcccaggaagggggactag

SEQ ID NO: 161717 - DNA, 2475 bp, Artificial Sequence
  Description of Artificial Sequence: Synthetic coding sequence
atggatgaagatgagaaggaccgggccaagagggccagcaggaacaagtctgagaagaagagaagagaccagttcaacgtgctgatcaaggagctgagctccatgctgcccggcaacaccaggaagatggacaagaccaccgtgctggagaaggtgattggcttcctgcagaagcacaatgaggtgtctgcccagacagagatctgtgacatccagcaggactggaagcccagcttcctgagcaatgaggagttcacccagctgatgctggaggccctggatggcttcatcatcgctgtgaccacagatggcagcatcatctacgtgtctgacagcatcacccccctgctgggccacctgcccagtgatgtgatggaccagaacctgctgaacttcctgcctgagcaggagcacagcgaggtgtacaagatcctgagcagccacatgctggtgacagacagccccagccctgagtacctgaagagtgacagcgacctggagttctactgccacctgctgcggggcagcctgaaccccaaggagttccccacctatgagtacatcaagtttgtgggcaacttccgcagctacaacaacgtgcccagccccagctgcaatggatttgacaacaccctgagccggccctgccgggtgcccctgggcaaggaggtgtgcttcatcgccaccgtgcggctggccaccccccagttcctgaaggagatgtgcatcgtggatgagcccctggaggagttcaccagccgccacagcctggagtggaagttcctgttcctggaccaccgggccccacccatcatcggctacctgccctttgaggtgctgggcaccagcggctatgactactaccacattgatgacctggagctgctggcccgctgccaccagcacctgatgcagtttgggaagggcaagagctgctgctaccgcttcctgaccaagggccagcagtggatctggctgcagacccactactacatcacctaccaccagtggaacagcaagccagagttcatcgtgtgcacccacagcgtggtgtcctatgcagatgtgcgggtggagcggcggcaggagctggccctggaggaccccccatctgaggccctgcacagcagcgccctgaaggacaagggcagcagcctggagccccggcagcacttcaacaccctggatgtgggcgccagcggcctgaacaccagccacagccccagcgccagcagccgcagcagccacaagagcagccacacagccatgtctgagcccaccagcacccccaccaagctgatggccgaggccagcaccccagccctgcccaggtctgccaccctgccccaggagctgcctgtgcccggcctgagccaggccgccaccatgcctgcccccctgcccagccccagcagctgtgacctgacccagcagctgctgccccagacagtgctgcagagcaccccagcccccatggcccagttcagcgcccagttctccatgttccagaccatcaaggaccagctggagcagaggacccgcatcctgcaggccaacatccgctggcagcaggaggagctgcacaagatccaggagcagctgtgcctggtgcaggacagcaatgtgcagatgttcctgcagcagcctgctgtgtccctgtccttcagcagcacccagaggcctgaggcccagcagcagctgcagcagaggtctgctgctgtgacccagccccagctgggcgccggcccccagctgcccggccagatcagcagcgcccaggtgaccagccagcacctgctgcgggagagcagcgtcatcagcacccagggccccaagcccatgaggagcagccagctgatgcagagcagcggccgcagcggcagcagcctggtgagccccttcagcagcgccacagctgccctgccccccagcctgaacctgaccaccccagccagcaccagccaggatgccagccagtgccagcccagcccagacttcagccatgaccggcagctgcggctgctgctgagccagcccatccagcccatgatgcctggcagctgtgatgcccggcagcccagcgaggtgtccaggacaggccggcaggtgaagtatgcccagagccagaccgtcttccagaacccagatgcccacccagccaacagcagcagcgcccccatgcctgtgctgctgatgggccaggccgtgctgcaccccagcttccctgccagccagcccagccccctgcagcctgcccaggcccggcagcagcccccccagcactacctgcaggtgcaggcccccaccagcctgcacagcgagcagcaggacagcctgctgctgagcacctacagccagcagcccggcaccctgggctacccccagcccccaccagcccagccccagcccctgcggcccccccggcgggtgagcagcctgtctgagagcagcggcctgcagcagccccccaggtag

SEQ ID NO: 161718 - DNA, 2670 bp, Artificial Sequence
  Description of Artificial Sequence: Synthetic coding sequence
atgtatgcctacggctttgtgggccgctgtgcccccttccctgctgaggagggccgcacctttgacctgtctgaggagctgggccgctctgtgacccgggagggcaccggcaccacccggctgaacagcgagcctgtgcccctgctgtgcctgcccctgctgaactgcagcaggaagaactgcatcgagaacctgatggatgaagatgagaaggaccgggccaagagggccagcaggaacaagtctgagaagaagaggcgggaccagttcaacgtgctgatcaaggagctgagctccatgctgcccggcaacaccaggaagatggacaagaccaccgtgctggagaaggtgattggcttcctgcagaagcacaatgaggtgtctgcccagacagagatctgtgacatccagcaggactggaagcccagcttcctgagcaatgaggagttcacccagctgatgctggaggccctggatggcttcatcatcgctgtgaccacagatggcagcatcatctacgtgtctgacagcatcacccccctgctgggccacctgcccagtgatgtgatggaccagaacctgctgaacttcctgcctgagcaggagcacagcgaggtgtacaagatcctgagcagccacatgctggtgacagacagccccagccctgagtacctgaagagtgacagcgacctggagttctactgccacctgctgcggggcagcctgaaccccaaggagttccccacctatgagtacatcaagtttgtgggcaacttccgcagctacaacaacgtgcccagccccagctgcaatggatttgacaacaccctgagccggccctgccgggtgcccctgggcaaggaggtgtgcttcatcgccaccgtgcggctggccaccccccagttcctgaaggagatgtgcatcgtggatgagcccctggaggagttcaccagccgccacagcctggagtggaagttcctgttcctggaccaccgggccccacccatcatcggctacctgccctttgaggtgctgggcaccagcggctatgactactaccacattgatgacctggagctgctggcccgctgccaccagcacctgatgcagtttgggaagggcaagagctgctgctaccgcttcctgaccaagggccagcagtggatctggctgcagacccactactacatcacctaccaccagtggaacagcaagccagagttcatcgtgtgcacccacagcgtggtgtcctatgcagatgtgcgggtggagcggcggcaggagctggccctggaggacccccccagcgaggccctgcacagcagcgccctgaaggacaagggcagcagcctggagccccggcagcacttcaacaccctggatgtgggcgccagcggcctgaacaccagccacagccccagcgccagcagccgcagcagccacaagagcagccacacagccatgtctgagcccaccagcacccccaccaagctgatggccgaggccagcaccccagccctgcccaggtctgccaccctgccccaggagctgcctgtgcccggcctgagccaggccgccaccatgcctgcccccctgcccagccccagcagctgtgacctgacccagcagctgctgccccagacagtgctgcagagcaccccagcccccatggcccagttcagcgcccagttctccatgttccagaccatcaaggaccagctggagcagaggacccgcatcctgcaggccaacatccgctggcagcaggaggagctgcacaagatccaggagcagctgtgcctggtgcaggacagcaatgtgcagatgttcctgcagcagcctgctgtgtccctgtccttcagcagcacccagaggcctgaggcccagcagcagctgcagcagaggtctgctgctgtgacccagccccagctgggcgccggcccccagctgcccggccagatcagcagcgcccaggtgaccagccagcacctgctgcgggagagcagcgtcatcagcacccagggccccaagcccatgaggagcagccagctgatgcagagcagcggccgcagcggcagcagcctggtgagccccttcagcagcgccacagctgccctgccccccagcctgaacctgaccaccccagccagcaccagccaggatgccagccagtgccagcccagcccagacttcagccatgaccggcagctgcggctgctgctgagccagcccatccagcccatgatgcctggcagctgtgatgcccggcagcccagcgaggtgtccaggacaggccggcaggtgaagtatgcccagagccagacagtgttccagaacccagatgcccacccagccaacagcagcagcgcccccatgcctgtgctgctgatgggccaggccgtgctgcaccccagcttccctgccagccagcccagccccctgcagcctgcccaggcccggcagcagcccccccagcactacctgcaggtgcaggcccccaccagcctgcacagcgagcagcaggacagcctgctgctgagcacctacagccagcagcccggcaccctgggctacccccagcccccaccagcccagccccagcccctgcggcccccaagaagagtgagcagcctgtctgagagcagcggcctgcagcagcccccaagatag

SEQ ID NO: 161719 - DNA, 774 bp, Artificial Sequence
  Description of Artificial Sequence: Synthetic coding sequence
atggcccccaccaagcccagcttccagcaggaccccagccggcgggagcgcatcacagcccagcaccccctgcccaaccagagtgaatgtaggaagatctaccgctatgatggcatctactgtgagagcacctaccagaacctgcaggccctgaggaaggagaagagcagagatgctgcccggagcagaagaggcaaggaaaattttgagttctatgagctggccaagctgctgcccctgcctgctgccatcaccagccagctggacaaggccagcatcatccggctgaccatctcctacctgaagatgagggactttgccaaccagggcgaccccccctggaacctgaggatggagggccccccacccaacacctctgtgaaggtgattggagcccagaggagaagaagccccagcgccctggccatcgaggtgtttgaggcccacctgggcagccacatcctgcagagcctggatggctttgtgtttgccctgaaccaggagggcaagttcctgtacatcagcgagaccgtgtccatctacctgggcctgagccaggtggagctgaccggcagctctgtgtttgattatgtgcaccctggggaccacgtggagatggccgagcagctgggcatgaagctgcccccaggccggggcctgctgagccagggcacagcagaagatggagccagcagcgccagcagcagcagccagagcgagaccccagagcctgtggtgtgcttccccccagccagtgaccagttcctgctgtag

SEQ ID NO: 161720 - DNA, 2706 bp, Artificial Sequence
  Description of Artificial Sequence: Synthetic coding sequence
atggcccccaccaagcccagcttccagcaggaccccagccggcgggagcggctgcaggccctgaggaaggagaagagcagagatgctgcccggagcagaagaggcaaggaaaattttgagttctatgagctggccaagctgctgcccctgcctgctgccatcaccagccagctggacaaggccagcatcatccggctgaccatctcctacctgaagatgagggactttgccaaccagggcgaccccccctggaacctgaggatggagggccccccacccaacacctctgtgaagggggcccagaggagaagaagccccagcgccctggccatcgaggtgtttgaggcccacctgggcagccacatcctgcagagcctggatggctttgtgtttgccctgaaccaggagggcaagttcctgtacatcagcgagaccgtgtccatctacctgggcctgagccaggtggagctgaccggcagctctgtgtttgattatgtgcaccctggggaccacgtggagatggccgagcagctgggcatgaagctgcccccaggccggggcctgctgagccagggcacagcagaagatggagccagcagcgccagcagcagcagccagagcgagaccccagagcctgtggagagcaccagccccagcctgctgaccacagacaacaccctggagaggagcttcttcatccgcatgaagagcaccctgaccaagaggggcgtgcacatcaagagcagcggctacaaggtgatccacatcaccggccgcctgcggctgcgggtgtccctgagccacggccgcacagtgcccagccagatcatgggcctggtggtggtggcccacgccctgcccccacccaccatcaatgaggtgagaattgactgccacatgtttgtgaccagggtgaacatggacctgaacatcatctactgtgaaaatcgcatcagtgactacatggacctgacccctgtggacatcgtgggcaagcgctgctaccacttcatccacgcagaagatgtggagggcatccgccacagccacctggacctgctgaacaagggccagtgtgtgaccaagtactaccgctggatgcagaagaatggaggctacatctggatccagagcagcgccaccatcgccatcaatgccaagaatgccaatgagaagaacatcatctgggtgaactacctgctgagcaaccctgagtacaaggacacccccatggacatcgcccagctgccccacctgcctgagaagaccagcgagagcagcgagaccagtgacagcgagagtgacagcaaggacaccagcggcatcacagaggacaatgaaaacagcaagagtgatgagaagggcaaccagagtgaaaattctgaggaccctgagccagacaggaagaagtctggaaatgcctgtgacaatgacatgaactgcaatgatgatggccacagcagcagcaacccagacagccgggacagtgatgacagctttgagcacagcgactttgagaaccccaaggccggggaggatggctttggagccctgggcgccatgcagatcaaggtggagcgctacgtggagagcgagagtgacctgcggctgcagaactgtgagagcctgaccagtgacagcgccaaggacagcgacagcgctggggaggccggggcccaggccagcagcaagcaccagaagaggaagaagaggaggaagaggcagaagggcggcagcgccagcagaagaaggctgagcagcgccagcagccctgggggcctggatgctggcctggtggagcccccccggctgctgagcagccccaacagcgcctctgtgctgaagatcaagacagagatcagcgagcccatcaactttgacaatgacagcagcatctggaactacccacccaaccgggagatcagcagaaatgaaagcccctacagcatgaccaagccacccagcagcgagcacttccccagcccccagggcggcggcggcggcggcggcggcggcggcggcctgcacgtggccatcccagacagcgtgctgaccccacctggagcagatggagctgctgccaggaagacccagtttggagccagcgccacagctgccctggcccctgtggccagtgaccccctgagcccccccctgagcgccagcccccgggacaagcaccctggaaatggaggcggcggcggcggcggcggcggcggggccggcggcggcggccccagcgccagcaacagcctgctgtacacaggagacctggaggccctgcagaggctgcaggccggaaatgtggtgctgcccctggtgcaccgggtgacaggcaccctggccgccaccagcacagctgcccagagggtgtacaccaccggcaccatccgctatgccccagctgaggtgaccctggccatgcagagcaacctgctgcccaatgcccatgctgtgaactttgtggatgtgaacagccctggcttcggcctggaccccaagacccccatggagatgctgtaccaccacgtgcaccggctgaacatgagcggcccctttggaggagctgtgtctgctgccagcctgacccagatgcctgctggaaatgtgttcaccacagctgagggcctcttcagcaccctgcccttccctgtgtacagcaatggcatccacgccgcccagaccctggagaggaaggaggactag

SEQ ID NO: 161721 - DNA, 2802 bp, Artificial Sequence
  Description of Artificial Sequence: Synthetic coding sequence
atggcccccaccaagcccagcttccagcaggaccccagccggcgggagcgcatcacagcccagcaccccctgcccaaccagagtgaatgtaggaagatctaccgctatgatggcatctactgtgagagcacctaccagaacctgcaggccctgaggaaggagaagagcagagatgctgcccggagcagaagaggcaaggaaaattttgagttctatgagctggccaagctgctgcccctgcctgctgccatcaccagccagctggacaaggccagcatcatccggctgaccatctcctacctgaagatgagggactttgccaaccagggcgaccccccctggaacctgaggatggagggccccccacccaacacctctgtgaaggtgattggagcccagaggagaagaagccccagcgccctggccatcgaggtgtttgaggcccacctgggcagccacatcctgcagagcctggatggctttgtgtttgccctgaaccaggagggcaagttcctgtacatcagcgagaccgtgtccatctacctgggcctgagccaggtggagctgaccggcagctctgtgtttgattatgtgcaccctggggaccacgtggagatggccgagcagctgggcatgaagctgcccccaggccggggcctgctgagccagggcacagcagaagatggagccagcagcgccagcagcagcagccagagcgagaccccagagcctgtggagagcaccagccccagcctgctgaccacagacaacaccctggagaggagcttcttcatccgcatgaagagcaccctgaccaagaggggcgtgcacatcaagagcagcggctacaaggtgatccacatcaccggccgcctgcggctgcgggtgtccctgagccacggccgcacagtgcccagccagatcatgggcctggtggtggtggcccacgccctgcccccacccaccatcaatgaggtgagaattgactgccacatgtttgtgaccagggtgaacatggacctgaacatcatctactgtgaaaatcgcatcagtgactacatggacctgacccctgtggacatcgtgggcaagcgctgctaccacttcatccacgcagaagatgtggagggcatccgccacagccacctggacctgctgaacaagggccagtgtgtgaccaagtactaccgctggatgcagaagaatggaggctacatctggatccagagcagcgccaccatcgccatcaatgccaagaatgccaatgagaagaacatcatctgggtgaactacctgctgagcaaccctgagtacaaggacacccccatggacatcgcccagctgccccacctgcctgagaagaccagcgagagcagcgagaccagtgacagcgagagtgacagcaaggacaccagcggcatcacagaggacaatgaaaacagcaagagtgatgagaagggcaaccagagtgaaaattctgaggaccctgagccagacaggaagaagtctggaaatgcctgtgacaatgacatgaactgcaatgatgatggccacagcagcagcaacccagacagccgggacagtgatgacagctttgagcacagcgactttgagaaccccaaggccggggaggatggctttggagccctgggcgccatgcagatcaaggtggagcgctacgtggagagcgagagtgacctgcggctgcagaactgtgagagcctgaccagtgacagcgccaaggacagcgacagcgctggggaggccggggcccaggccagcagcaagcaccagaagaggaagaagaggaggaagaggcagaagggcggcagcgccagcagaagaaggctgagcagcgccagcagccctgggggcctggatgctggcctggtggagcccccccggctgctgagcagccccaacagcgcctctgtgctgaagatcaagacagagatcagcgagcccatcaactttgacaatgacagcagcatctggaactacccacccaaccgggagatcagcagaaatgaaagcccctacagcatgaccaagccacccagcagcgagcacttccccagcccccagggcggcggcggcggcggcggcggcggcggcggcctgcacgtggccatcccagacagcgtgctgaccccacctggagcagatggagctgctgccaggaagacccagtttggagccagcgccacagctgccctggcccctgtggccagtgaccccctgagcccccccctgagcgccagcccccgggacaagcaccctggaaatggaggcggcggcggcggcggcggcggcggggccggcggcggcggccccagcgccagcaacagcctgctgtacacaggagacctggaggccctgcagaggctgcaggccggaaatgtggtgctgcccctggtgcaccgggtgacaggcaccctggccgccaccagcacagctgcccagagggtgtacaccaccggcaccatccgctatgccccagctgaggtgaccctggccatgcagagcaacctgctgcccaatgcccatgctgtgaactttgtggatgtgaacagccctggcttcggcctggaccccaagacccccatggagatgctgtaccaccacgtgcaccggctgaacatgagcggcccctttggaggagctgtgtctgctgccagcctgacccagatgcctgctggaaatgtgttcaccacagctgagggcctcttcagcaccctgcccttccctgtgtacagcaatggcatccacgccgcccagaccctggagaggaaggaggactag

SEQ ID NO: 161722 - DNA, 2763 bp, Artificial Sequence
  Description of Artificial Sequence: Synthetic coding sequence
atggcccccaccaagcccagcttccagcaggaccccagccggcgggagcggctgcaggccctgaggaaggagaagagcagagatgctgcccggagcagaagaggcaaggaaaattttgagttctatgagctggccaagctgctgcccctgcctgctgccatcaccagccagctggacaaggccagcatcatccggctgaccatctcctacctgaagatgagggactttgccaaccagggcgaccccccctggaacctgaggatggagggccccccacccaacacctctgtgaagggcatccagatgtggaagtctgagctgtgcatgaggaagaccccctgtgaggtgattggagcccagaggcggcgcagccccagcgccctggccatcgaggtgtttgaggcccacctgggcagccacatcctgcagagcctggatggctttgtgtttgccctgaaccaggagggcaagttcctgtacatcagcgagaccgtgtccatctacctgggcctgagccaggtggagctgaccggcagctctgtgtttgattatgtgcaccctggggaccacgtggagatggccgagcagctgggcatgaagctgcccccaggccggggcctgctgagccagggcacagcagaagatggagccagcagcgccagcagcagcagccagagcgagaccccagagcctgtggagagcaccagccccagcctgctgaccacagacaacaccctggagaggagcttcttcatccgcatgaagagcaccctgaccaagaggggcgtgcacatcaagagcagcggctacaaggtgatccacatcaccggccgcctgcggctgcgggtgtccctgagccacggccgcacagtgcccagccagatcatgggcctggtggtggtggcccacgccctgcccccacccaccatcaatgaggtgagaattgactgccacatgtttgtgaccagggtgaacatggacctgaacatcatctactgtgagaaccgcatcagtgactacatggacctgacccctgtggacatcgtgggcaagcgctgctaccacttcatccatgctgaagatgtggagggcatccgccacagccacctggacctgctgaacaagggccagtgtgtgaccaagtactaccgctggatgcagaagaatggaggctacatctggatccagagcagcgccaccatcgccatcaatgccaagaatgccaatgagaagaacatcatctgggtgaactacctgctgagcaaccctgagtacaaggacacccccatggacatcgcccagctgccccacctgcctgagaagaccagcgagagcagcgagaccagtgacagcgagagtgacagcaaggacaccagcggcatcacagaagataatgaaaacagcaagagtgatgagaagggcaaccagagcgagaacagtgaagatcctgagccagacaggaagaagtctggaaatgcctgtgacaatgacatgaactgcaatgatgatggccacagcagcagcaacccagacagccgggacagtgatgacagctttgagcacagcgactttgagaaccccaaggctggagaagatggctttggagccctgggcgccatgcagatcaaggtggagagatatgtggagagcgagagtgacctgcggctgcagaactgtgagagcctgaccagtgacagcgccaaggacagcgacagcgctggggaggccggggcccaggccagcagcaagcaccagaagaggaagaagaggaggaagaggcagaagggcggcagcgccagcagaagaaggctgagcagcgccagcagccctgggggcctggatgctggcctggtggagcccccccggctgctgagcagccccaacagcgcctctgtgctgaagatcaagacagagatcagcgagcccatcaactttgacaatgacagcagcatctggaactacccacccaaccgggagatcagcagaaatgaaagcccctacagcatgaccaagccacccagcagcgagcacttccccagcccccagggcggcggcggcggcggcggcggcggcggcggcctgcacgtggccatcccagattctgtgctgaccccacctggagcagatggagctgctgccaggaagacccagtttggagccagcgccacagctgccctggcccctgtggccagtgaccccctgagcccccccctgagcgccagcccccgggacaagcaccctggaaatggaggcggcggcggcggcggcggcggcggggccggcggcggcggccccagcgccagcaacagcctgctgtacaccggggacctggaggccctgcagaggctgcaggccggaaatgtggtgctgcccctggtgcaccgggtgacaggcaccctggccgccaccagcacagctgcccagagggtgtacaccaccggcaccatccgctatgccccagctgaggtgaccctggccatgcagagcaacctgctgcccaatgcccatgctgtgaactttgtggatgtgaacagccctggcttcggcctggaccccaagacccccatggagatgctgtaccaccacgtgcaccggctgaacatgagcggcccctttggaggagctgtgtctgctgccagcctgacccagatgcctgctggaaatgtgttcaccacagctgagggcctcttcagcaccctgcccttccctgtgtacagcaatggcatccatgctgcccagaccctggagaggaaagaagattag

SEQ ID NO: 161723 - DNA, 462 bp, Artificial Sequence
  Description of Artificial Sequence: Synthetic coding sequence
atgagggactttgccaaccagggcgaccccccctggaacctgaggatggagggccccccacccaacacctctgtgaagggggcccagaggagaagaagccccagcgccctggccatcgaggtgtttgaggcccacctgggcagccacatcctgcagagcctggatggctttgtgtttgccctgaaccaggagggcaagttcctgtacatcagcgagaccgtgtccatctacctgggcctgagccaggtggagctgaccggcagctctgtgtttgattatgtgcaccctggggaccacgtggagatggccgagcagctgggcatgaagctgcccccaggccggggcctgctgagccagggcacagcagaagatggagccagcagcgccagcagcagcagccagagcgagaccccagagcctgtggtgtgcttccccccagccagtgaccagttcctgctgtag

SEQ ID NO: 161724 - DNA, 2712 bp, Artificial Sequence
  Description of Artificial Sequence: Synthetic coding sequence
atggcccccaccaagcccagcttccagcaggaccccagccggcgggagcggctgcaggccctgaggaaggagaagagcagagatgctgcccggagcagaagaggcaaggaaaattttgagttctatgagctggccaagctgctgcccctgcctgctgccatcaccagccagctggacaaggccagcatcatccggctgaccatctcctacctgaagatgagggactttgccaaccagggcgaccccccctggaacctgaggatggagggccccccacccaacacctctgtgaaggtgattggagcccagaggagaagaagccccagcgccctggccatcgaggtgtttgaggcccacctgggcagccacatcctgcagagcctggatggctttgtgtttgccctgaaccaggagggcaagttcctgtacatcagcgagaccgtgtccatctacctgggcctgagccaggtggagctgaccggcagctctgtgtttgattatgtgcaccctggggaccacgtggagatggccgagcagctgggcatgaagctgcccccaggccggggcctgctgagccagggcacagcagaagatggagccagcagcgccagcagcagcagccagagcgagaccccagagcctgtggagagcaccagccccagcctgctgaccacagacaacaccctggagaggagcttcttcatccgcatgaagagcaccctgaccaagaggggcgtgcacatcaagagcagcggctacaaggtgatccacatcaccggccgcctgcggctgcgggtgtccctgagccacggccgcacagtgcccagccagatcatgggcctggtggtggtggcccacgccctgcccccacccaccatcaatgaggtgagaattgactgccacatgtttgtgaccagggtgaacatggacctgaacatcatctactgtgaaaatcgcatcagtgactacatggacctgacccctgtggacatcgtgggcaagcgctgctaccacttcatccacgcagaagatgtggagggcatccgccacagccacctggacctgctgaacaagggccagtgtgtgaccaagtactaccgctggatgcagaagaatggaggctacatctggatccagagcagcgccaccatcgccatcaatgccaagaatgccaatgagaagaacatcatctgggtgaactacctgctgagcaaccctgagtacaaggacacccccatggacatcgcccagctgccccacctgcctgagaagaccagcgagagcagcgagaccagtgacagcgagagtgacagcaaggacaccagcggcatcacagaggacaatgaaaacagcaagagtgatgagaagggcaaccagagtgaaaattctgaggaccctgagccagacaggaagaagtctggaaatgcctgtgacaatgacatgaactgcaatgatgatggccacagcagcagcaacccagacagccgggacagtgatgacagctttgagcacagcgactttgagaaccccaaggccggggaggatggctttggagccctgggcgccatgcagatcaaggtggagcgctacgtggagagcgagagtgacctgcggctgcagaactgtgagagcctgaccagtgacagcgccaaggacagcgacagcgctggggaggccggggcccaggccagcagcaagcaccagaagaggaagaagaggaggaagaggcagaagggcggcagcgccagcagaagaaggctgagcagcgccagcagccctgggggcctggatgctggcctggtggagcccccccggctgctgagcagccccaacagcgcctctgtgctgaagatcaagacagagatcagcgagcccatcaactttgacaatgacagcagcatctggaactacccacccaaccgggagatcagcagaaatgaaagcccctacagcatgaccaagccacccagcagcgagcacttccccagcccccagggcggcggcggcggcggcggcggcggcggcggcctgcacgtggccatcccagacagcgtgctgaccccacctggagcagatggagctgctgccaggaagacccagtttggagccagcgccacagctgccctggcccctgtggccagtgaccccctgagcccccccctgagcgccagcccccgggacaagcaccctggaaatggaggcggcggcggcggcggcggcggcggggccggcggcggcggccccagcgccagcaacagcctgctgtacacaggagacctggaggccctgcagaggctgcaggccggaaatgtggtgctgcccctggtgcaccgggtgacaggcaccctggccgccaccagcacagctgcccagagggtgtacaccaccggcaccatccgctatgccccagctgaggtgaccctggccatgcagagcaacctgctgcccaatgcccatgctgtgaactttgtggatgtgaacagccctggcttcggcctggaccccaagacccccatggagatgctgtaccaccacgtgcaccggctgaacatgagcggcccctttggaggagctgtgtctgctgccagcctgacccagatgcctgctggaaatgtgttcaccacagctgagggcctcttcagcaccctgcccttccctgtgtacagcaatggcatccacgccgcccagaccctggagaggaaggaggactag

SEQ ID NO: 161725 - DNA, 2409 bp, Artificial Sequence
  Description of Artificial Sequence: Synthetic coding sequence
atgtaccgcagcaccaagggggccagcaaggcccggcgggaccagatcaatgctgagatccggaacctgaaggagctgctgcccctggccgaggccgacaaggtgcggctgagctacctgcacatcatgagcctggcctgcatctacaccaggaagggcgtcttctttgctgggggcacccccctggccggccccaccggcctgctgagcgcccaggagctggaggacatcgtggccgccctgcccggcttcctgctggtgttcaccgctgagggcaagctgctgtacctgtctgagagcgtgtctgagcacctgggccacagcatggtggacctggtggcccagggcgacagcatctatgacatcattgatcctgctgaccacctgactgtgcggcagcagctgaccctgcccagcgccctggacacagacaggctcttccgctgccgcttcaacaccagcaagagcctgcggcggcagagcgctggcaacaagctggtgctgatccggggccgcttccacgcccaccccccaggggcctactgggccggcaaccctgtgttcaccgccttctgtgcccccctggagccccggcccaggcctggccctggccctggccctggccctgccagcctcttcctggccatgttccagagcagacatgccaaggacctggccctgctggacatcagcgagagcgtgctgatctacctgggctttgagaggtctgagctgctgtgcaagtcctggtacggcctgctgcaccctgaggacctggcccacgccagcgcccagcactaccgcctgctggccgagagcggggacatccaggccgagatggtggtgcggctgcaggccaagacaggaggctgggcctggatctactgcctgctgtacagcgagggccctgagggccccatcacagccaacaactaccccatcagtgacatggaggcctggagcctgcggcagcagctgaacagcgaggacacccaggccgcctacgtgctgggcacccccaccatgctgcccagcttccctgagaacatcctgagccaggaggagtgcagcagcaccaaccccctcttcaccgctgccctgggcgcccccaggagcaccagcttccccagcgcccctgagctgtctgtggtgtctgccagcgaggagctgccccggcccagcaaggagctggacttctcctacctgaccttccccagcggccctgagcccagcctgcaggccgagctgagcaaggacctggtgtgcaccccaccctacaccccccaccagcccggcggctgtgccttcctgttcagcctgcacgagcccttccagacccacctgcccacccccagcagcaccctgcaggagcagctgacccccagcacagccaccttcagtgaccagctgacccccagcagcgccaccttcccagaccccctgaccagccccctgcagggccagctgacagagacctctgtgcgctcctatgaggaccagctgaccccctgcaccagcaccttcccagaccagctgctgcccagcacagccaccttccctgagcccctgggcagccctgcccacgagcagctgaccccacccagcacagccttccaggcccacctggacagccccagccagaccttccctgagcagctgagccccaaccccaccaagacctactttgcccaggagggctgcagcttcctgtatgagaagctgccccccagccccagcagccctggaaatggagactgcaccctgctggccctggcccagctgcggggccccctgtctgtggatgtgcccctggtgcctgagggcctgctgaccccagaggccagccctgtgaagcagagcttcttccactacagcgagaaggagcagaatgaaattgacaggctcatccagcagatcagccagctggcccagggcatggaccggcccttctctgctgaggccggcaccggcggcctggagcccctgggcggcctggagcccctggacagcaacctgagcctgtctggagctggcccccctgtgctgagcctggacctgaagccctggaagtgccaggagctggacttcctggccgaccctgacaacatgttcctggaggagacccctgtggaggacatcttcatggacctgagcaccccagaccccagcgaggagtggggcagcggggaccctgaggccgagggccctgggggcgcccccagcccctgcaacaacctgagccctgaggaccacagcttcctggaggacctggccacctatgaaacagcctttgagaccggggtgtctgccttcccctatgatggcttcacagatgagctgcaccagctgcagagccaggtgcaggacagcttccatgaagatggcagcggcggggagcccaccttctag

SEQ ID NO: 161726 - DNA, 705 bp, Artificial Sequence
  Description of Artificial Sequence: Synthetic coding sequence
atgtaccgcagcaccaagggggccagcaaggcccggcgggaccagatcaatgctgagatccggaacctgaaggagctgctgcccctggccgaggccgacaaggtgcggctgagctacctgcacatcatgagcctggcctgcatctacaccaggaagggcgtcttctttgctgggggcacccccctggccggccccaccggcctgctgagcgcccaggagctggaggacatcgtggccgccctgcccggcttcctgctggtgttcaccgctgagggcaagctgctgtacctgtctgagagcgtgtctgagcacctgggccacagcatggtggacctggtggcccagggcgacagcatctatgacatcattgatcctgctgaccacctgactgtgcggcagcagctgaccctgcccagcgccctggacacagacaggctcttccgctgccgcttcaacaccagcaagagcctgcggcggcagagcgctggcaacaagctggtgctgatccggggccgcttccacgcccaccccccaggggcctactgggccggcaaccctgtgttcaccgccttctgtgcccccctggagccccggcccaggcctggccctggccctggccctggccctgccagcctcttcctggccatgttccagagcagacatgccaaggacctggccctgctggacatcagcgagagcggctag

SEQ ID NO: 161727 - DNA, 1299 bp, Artificial Sequence
  Description of Artificial Sequence: Synthetic coding sequence
atgcctgctggccgggccgcccggacctgtgccctgctggccctgtgcctgctgggcgctggggcccaggactttggccccacccgcttcatctgcacctctgtgcctgtggatgctgacatgtgtgccgcctctgtggccgccggcggcgctgaggagctgcggagctctgtgctgcagctgcgggagaccgtgctgcagcagaaggagaccatcctgagccagaaggagaccatccgggagctgacagccaagctgggccgctgtgagagccagagcaccctggaccctggagctggggaggcccgggccggcggcggcaggaagcagcccggcagcggcaagaacaccatgggagacctgagcaggaccccagctgctgagaccctgagccagctgggccagaccctgcagagcctgaagacccggctggagaacctggagcagtacagccggctgaacagcagcagccagaccaacagcctgaaggacctgctgcagagcaagattgatgagctggagcggcaggtgctgagccgggtgaacaccctggaggagggcaagggcggccccagaaatgacacagaggagcgggtgaagattgaaacagccctgaccagcctgcaccagaggatcagcgagctggagaagggccagaaggacaacagacctggggacaagttccagctgaccttccccctgcggaccaactacatgtatgccaaggtgaagaagagcctgcctgagatgtatgccttcaccgtgtgcatgtggctgaagagcagcgccaccccaggagtgggcacccccttctcctatgctgtgcccggccaggccaatgagctggtgctgattgagtggggcaacaaccccatggagatcctgatcaatgacaaggtggccaagctgccctttgtgatcaatgatggcaagtggcaccacatctgtgtgacctggaccaccagagatggagtgtgggaggcctaccaggacggcacccagggcggcagcggggagaacctggccccctaccaccccatcaagccccagggcgtgctggtgctgggccaggagcaggacaccctgggcggcggctttgatgccacccaggcctttgtgggggagctggcccacttcaacatctgggacaggaagctgaccccaggagaggtgtacaacctggccacctgcagcaccaaggccctgtctggaaatgtgattgcctgggccgagagccacatcgagatctatggaggagccaccaagtggacctttgaggcctgccggcagatcaactag

SEQ ID NO: 161728 - DNA, 585 bp, Artificial Sequence
  Description of Artificial Sequence: Synthetic coding sequence
atgtatgccaaggtgaagaagagcctgcctgagatgtatgccttcaccgtgtgcatgtggctgaagagcagcgccaccccaggagtgggcacccccttctcctatgctgtgcccggccaggccaatgagctggtgctgattgagtggggcaacaaccccatggagatcctgatcaatgacaaggtggccaagctgccctttgtgatcaatgatggcaagtggcaccacatctgtgtgacctggaccaccagagatggagtgtgggaggcctaccaggacggcacccagggcggcagcggggagaacctggccccctaccaccccatcaagccccagggcgtgctggtgctgggccaggagcaggacaccctgggcggcggctttgatgccacccaggcctttgtgggggagctggcccacttcaacatctgggacaggaagctgaccccaggagaggtgtacaacctggccacctgcagcaccaaggccctgtctggaaatgtgattgcctgggccgagagccacatcgagatctatggaggagccaccaagtggacctttgaggcctgccggcagatcaactag

SEQ ID NO: 161729 - DNA, 1296 bp, Artificial Sequence
  Description of Artificial Sequence: Synthetic coding sequence
atgctggccctgctggccgcctctgtggccctggccgtggccgccggggcccaggacagccctgcccctggcagcagatttgtgtgcacagccctgcccccagaggccgtgcatgctggctgccccctgcctgccatgcccatgcagggcggggcccagagccctgaggaggagctgcgggctgctgtgctgcagctgcgggagaccgtggtgcagcagaaggagaccctgggcgcccagcgggaggccatccgggagctgaccgggaagctggcccgctgtgagggcctggccggcggcaaggcccggggagctggggccaccgggaaggacaccatgggagacctgccccgggaccccggccacgtggtggagcagctgagccgcagcctgcagaccctgaaggaccggctggagagcctggagcaccagctgcgggccaacgtgtccaatgccggcctgcccggggacttccgggaggtgctgcagcagaggctgggggagctggagcggcagctgctgaggaaggtggccgagctggaggatgagaagagcctgctgcacaatgagaccagcgcccaccggcagaagacagagagcaccctgaatgccctgctgcagagggtgacagagctggagcggggcaacagcgccttcaagagcccagatgccttcaaggtgtccctgcccctgcggaccaactacctgtatggcaagatcaagaagaccctgcctgagctgtatgccttcaccatctgcctgtggctgcggagcagcgccagccctggcatcggcacccccttctcctatgctgtgcccggccaggccaatgaaattgtgctgattgagtggggcaacaaccccatcgagctgctgatcaatgacaaggtggcccagctgcccctgtttgtgtctgatggcaagtggcaccacatctgtgtgacctggaccaccagagatggcatgtgggaggccttccaggatggagagaagctgggcaccggggagaacctggccccctggcaccccatcaagccaggcggcgtgctgatcctgggccaggagcaggacacagtgggcggccgctttgatgccacccaggcctttgtgggggagctgagccagttcaacatctgggacagagtgctgcgggcccaggagatcgtgaacatcgccaactgcagcaccaacatgcctggcaacatcatcccctgggtggacaacaacgtggatgtgtttggaggagccagcaagtggcctgtggagacctgtgaggagcggctgctggacctgtag

SEQ ID NO: 161730 - DNA, 246 bp, Artificial Sequence
  Description of Artificial Sequence: Synthetic coding sequence
atggctgctgtggccgccgccagcgctgagctgctgatcatcggctggtacatcttccgggtgctgctgcaggtgttcctggagtgctgcatctactgggtgggctttgccttcagaaatcctcctggcacccagcccatcgcccggtctgaggtgttccgctacagcctgcagaagctggcctacacagtgtccaggacaggccggcaggtgctgggggagcggcggcagagggcccccaactag

SEQ ID NO: 161731 - DNA, 165 bp, Artificial Sequence
  Description of Artificial Sequence: Synthetic coding sequence
atggctgctgtggccgccgccagcgctgagctgctgatcatcggctggtacatcttccgggtgctgctgcaggtgttccgctacagcctgcagaagctggcctacacagtgtccaggacaggccggcaggtgctgggggagcggcggcagagggcccccaactag

SEQ ID NO: 161732 - DNA, 270 bp, Artificial Sequence
  Description of Artificial Sequence: Synthetic coding sequence
atgatcagctctgtgaagctgaacctgatcctggtgctgagcctgagcaccatgcacgtgttctggtgctaccctgtgcccagcagcaaggtgtctgggaagagtgactacttcctgatcctgctgaacagctgccccacccggctggacaggagcaaggagctggccttcctgaagcccatcctggagaagatgtttgtgaagaggagcttcagaaatggagtgggcaccggcatgaagaagaccagcttccagagggccaagagctag

SEQ ID NO: 161733 - DNA, 525 bp, Artificial Sequence
  Description of Artificial Sequence: Synthetic coding sequence
gtggtgctgctgtatgccagcacctacgtgctggtgtccctgagcattgaccgctaccacgccatcgtgtaccccatgaaggtgctgattgtcatcgcctggagcctgtccttcctgttcagcatccccaccctcatcatctttgggaagaggaccctgagcaatggagaggtgcagtgctgggccctgtggccagatgacagctactggaccccctacatgaccatcgtggccttcctgggcagcctcatcaccttcatctgctgctggagcccctacttcctgtttgacatcctggacaacttcaacctgctgcctgacacccaggagcgcttctacgccagcgtcatcatccagaacctgcctgccctgaacagcgccatcaaccccctcatctactgtgtgttcagcagcagcatctccttcccctgccgggagcagaggagccaggacagcaggatgaccttccgggagaggacagaaagacatgagatgcagatcctgagcaagccagagttcatctag

SEQ ID NO: 161734 - DNA, 1134 bp, Artificial Sequence
  Description of Artificial Sequence: Synthetic coding sequence
atgcctgccaacttcacagagggcagctttgacagcagcggcaccggccagaccctggacagcagccctgtggcctgcacagaaacagtgaccttcacagaggtggtggagggcaaggagtggggcagcttctactacagcttcaagacagagcagctgatcaccctgtgggtgctgtttgtgttcaccatcgtgggcaacagcgtggtgctcttcagcacctggaggaggaagaagaagagcaggatgaccttctttgtgacccagctggccatcacagacagcttcaccggcctggtgaacatcctgacagacatcaactggaggttcaccggggacttcaccgccccagacctggtgtgccgggtggtgcgctacctgcaggtggtgctgctgtatgccagcacctacgtgctggtgtccctgagcattgaccgctaccacgccatcgtgtaccccatgaagttcctgcagggcgagaagcaggcccgggtgctgattgtgattgcctggagcctgtccttcctgttcagcatccccaccctcatcatctttgggaagaggaccctgagcaatggagaggtgcagtgctgggccctgtggccagatgacagctactggaccccctacatgaccatcgtggccttcctggtgtacttcatccccctgaccatcatcagcatcatgtatggcatcgtcatccgcaccatctggatcaagagcaagacctatgagaccgtcatcagcaactgcagtgatggcaagctgtgcagcagctacaacagaggcctcatcagcaaggccaagatcaaggccatcaagtacagcatcatcatcatcctggccttcatctgctgctggagcccctacttcctgtttgacatcctggacaacttcaacctgctgcctgacacccaggagcgcttctacgccagcgtcatcatccagaacctgcctgccctgaacagcgccatcaaccccctcatctactgtgtgttcagcagcagcatctccttcccctgcagggtcatccggctgcggcagctgcaggaggccgccctgatgctgtgcccccagcgggagaactggaagggcacctggccaggagtgcccagctgggccctgcccaggtag

SEQ ID NO: 161735 - DNA, 1116 bp, Artificial Sequence
  Description of Artificial Sequence: Synthetic coding sequence
atgcctgccaacttcacagagggcagctttgacagcagcggcaccggccagaccctggacagcagccctgtggcctgcacagaaacagtgaccttcacagaggtggtggagggcaaggagtggggcagcttctactacagcttcaagacagagcagctgatcaccctgtgggtgctgtttgtgttcaccatcgtgggcaacagcgtggtgctcttcagcacctggaggaggaagaagaagagcaggatgaccttctttgtgacccagctggccatcacagacagcttcaccggcctggtgaacatcctgacagacatcaactggaggttcaccggggacttcaccgccccagacctggtgtgccgggtggtgcgctacctgcaggtggtgctgctgtatgccagcacctacgtgctggtgtccctgagcattgaccgctaccacgccatcgtgtaccccatgaagttcctgcagggcgagaagcaggcccgggtgctgattgtgattgcctggagcctgtccttcctgttcagcatccccaccctcatcatctttgggaagaggaccctgagcaatggagaggtgcagtgctgggccctgtggccagatgacagctactggaccccctacatgaccatcgtggccttcctggtgtacttcatccccctgaccatcatcagcatcatgtatggcatcgtcatccgcaccatctggatcaagagcaagacctatgagaccgtcatcagcaactgcagtgatggcaagctgtgcagcagctacaacagaggcctcatcagcaaggccaagatcaaggccatcaagtacagcatcatcatcatcctggccttcatctgctgctggagcccctacttcctgtttgacatcctggacaacttcaacctgctgcctgacacccaggagcgcttctacgccagcgtcatcatccagaacctgcctgccctgaacagcgccatcaaccccctcatctactgtgtgttcagcagcagcatctccttcccctgccgggagcagaggagccaggacagcaggatgaccttccgggagaggacagaaagacatgagatgcagatcctgagcaagccagagttcatctag

SEQ ID NO: 161736 - DNA, 1173 bp, Artificial Sequence
  Description of Artificial Sequence: Synthetic coding sequence
atgcctgccaacttcacagagggcagctttgacagcagcggcaccggccagaccctggacagcagccctgtggcctgcacagaaacagtgaccttcacagaggtggtggagggcaaggagtggggcagcttctactacagcttcaagacagagcagctgatcaccctgtgggtgctgtttgtgttcaccatcgtgggcaacagcgtggtgctcttcagcacctggaggaggaagaagaagagcaggatgaccttctttgtgacccagctggccatcacagacagcttcaccggcctggtgaacatcctgacagacatcaactggaggttcaccggggacttcaccgccccagacctggtgtgccgggtggtgcgctacctgcaggtggtgctgctgtatgccagcacctacgtgctggtgtccctgagcattgaccgctaccacgccatcgtgtaccccatgaagttcctgcagggcgagaagcaggcccgggtgctgattgtgattgcctggagcctgtccttcctgttcagcatccccaccctcatcatctttgggaagaggaccctgagcaatggagaggtgcagtgctgggccctgtggccagatgacagctactggaccccctacatgaccatcgtggccttcctggtgtacttcatccccctgaccatcatcagcatcatgtatggcatcgtcatccgcaccatctggatcaagagcaagacctatgagaccgtcatcagcaactgcagtgatggcaagctgtgcagcagctacaacagaggcctcatcagcaaggccaagatcaaggccatcaagtacagcatcatcatcatcctggccttcatctgctgctggagcccctacttcctgtttgacatcctggacaacttcaacctgctgcctgacacccaggagcgcttctacgccagcgtcatcatccagaacctgcctgccctgaacagcgccatcaaccccctcatctactgtgtgttcagcagcagcatctccttcccctgccgggccaacagctctgtgtacctgctggcctgtgatgtgtctgtgctgtgggccctggtgctgaccagcgagaaggagagctgtgagagctggaggaggaaaggagccaagatcaccggcttccagaatgatgtgcctggagaaaattag

SEQ ID NO: 161737 - DNA, 918 bp, Artificial Sequence
  Description of Artificial Sequence: Synthetic coding sequence
atgcctgccaacttcacagagggcagctttgacagcagcggcaccggccagaccctggacagcagccctgtggcctgcacagaaacagtgaccttcacagaggtggtggagggcaaggagtggggcagcttctactacagcttcaagacagagcagctgatcaccctgtgggtgctgtttgtgttcaccatcgtgggcaacagcgtggtgctcttcagcacctggaggaggaagaagaagagcaggatgaccttctttgtgacccagctggccatcacagagaagcaggcccgggtgctgattgtgattgcctggagcctgtccttcctgttcagcatccccaccctcatcatctttgggaagaggaccctgagcaatggagaggtgcagtgctgggccctgtggccagatgacagctactggaccccctacatgaccatcgtggccttcctggtgtacttcatccccctgaccatcatcagcatcatgtatggcatcgtcatccgcaccatctggatcaagagcaagacctatgagaccgtcatcagcaactgcagtgatggcaagctgtgcagcagctacaacagaggcctcatcagcaaggccaagatcaaggccatcaagtacagcatcatcatcatcctggccttcatctgctgctggagcccctacttcctgtttgacatcctggacaacttcaacctgctgcctgacacccaggagcgcttctacgccagcgtcatcatccagaacctgcctgccctgaacagcgccatcaaccccctcatctactgtgtgttcagcagcagcatctccttcccctgccgggagcagaggagccaggacagcaggatgaccttccgggagaggacagaaagacatgagatgcagatcctgagcaagccagagttcatctag

SEQ ID NO: 161738 - DNA, 432 bp, Artificial Sequence
  Description of Artificial Sequence: Synthetic coding sequence
atgcctgccaacttcacagagggcagctttgacagcagcggcaccggccagaccctggacagcagccctgtggcctgcacagaaacagtgaccttcacagaggtggtggagggcaaggagtggggcagcttctactacagcttcaagacagagcagctgatcaccctgtgggtgctgtttgtgttcaccatcgtgggcaacagcgtggtgctcttcagcacctggaggaggaagaagaagagcaggatgaccttctttgtgacccagctggccatcacagacagcttcaccggcctggtgaacatcctgacagacatcaactggaggttcaccggggacttcaccgccccagacctggtgtgccgggtggtgcgctacctgcaggtgatggtgatgaagctgttccacatccagaagatgaacatggagtag

SEQ ID NO: 161739 - DNA, 285 bp, Artificial Sequence
  Description of Artificial Sequence: Synthetic coding sequence
atgcctgccaacttcacagagggcagctttgacagcagcggcaccggccagaccctggacagcagccctgtggcctgcacagaaacagtgaccttcacagaggtggtggagggcaaggagtggggcagcttctactacagcttcaagacagagcagctgatcaccctgtgggtgctgtttgtgttcaccatcgtgggcaacagcgtggtgctcttcagcacctggaggaggaagaagaagagcaggatgaccttctttgtgacccagctggccatcaccgtgtag

SEQ ID NO: 161740 - DNA, 294 bp, Artificial Sequence
  Description of Artificial Sequence: Synthetic coding sequence
atgctgggcaacaagaggctgggcctgagcggcctgaccctggccctgagcctgctggtgtgcctgggcgccctggccgaggcctaccccagcaagccagacaaccctggagaagatgccccagctgaggacatggcccgctactacagcgccctgcggcactacatcaacctgatcacccggcagagatatggcaagaggagcagccctgagaccctcatcagtgacctgctgatgagggagagcacagaaaatgtgcccaggacccggctggaggaccctgccatgtggtag

SEQ ID NO: 161741 - DNA, 294 bp, Artificial Sequence; identical to SEQ ID NO: 161740
  Description of Artificial Sequence: Synthetic coding sequence

SEQ ID NO: 161742 - DNA, 294 bp, Artificial Sequence; identical to SEQ ID NO: 161740
  Description of Artificial Sequence: Synthetic coding sequence

SEQ ID NO: 161743 - DNA, 1155 bp, Artificial Sequence
  Description of Artificial Sequence: Synthetic coding sequence
atgaacagcaccctcttcagccaggtggagaaccacagcgtgcacagcaacttcagcgagaagaatgcccagctgctggcctttgaaaatgatgactgccacctgcccctggccatgatcttcaccctggccctggcctatggagctgtgatcatcctgggcgtgtctggcaacctggccctgatcatcatcatcctgaagcagaaggagatgagaaatgtgaccaacatcctgattgtgaacctgtccttcagtgacctgctggtggccatcatgtgcctgcccttcacctttgtgtacaccctgatggaccactgggtgtttggagaggccatgtgcaagctgaacccctttgtgcagtgtgtgtccatcaccgtgtccatcttcagcctggtgctgattgctgtggagcggcaccagctgatcatcaacccccggggctggaggcccaacaacagacatgcctacgtgggcattgctgtgatctgggtgctggccgtggccagcagcctgcccttcctgatctaccaggtgatgacagatgagcccttccagaatgtgaccctggatgcctacaaggacaagtatgtgtgctttgaccagttccccagcgacagccaccggctgagctacaccaccctgctgctggtgctgcagtacttcggccccctgtgcttcatcttcatctgctacttcaagatctacatccggctgaagagaagaaacaacatgatggacaagatgagggacaacaagtaccgcagcagcgagaccaagaggatcaacatcatgctgctgagcatcgtggtggcctttgctgtgtgctggctgcccctgaccatcttcaacacagtgtttgactggaaccaccagatcatcgccacctgcaaccacaacctgctcttcctgctgtgccacctgacagccatgatcagcacctgtgtgaaccccatcttctacggcttcctgaacaagaacttccagagggacctgcagttcttcttcaacttctgtgacttccgcagcagagatgatgattatgagaccatcgccatgagcaccatgcacacagatgtgtccaagaccagcctgaagcaggccagccctgtggccttcaagaagatcaacaacaatgatgacaatgagaagatctag

SEQ ID NO: 161744 - DNA, 186 bp, Artificial Sequence
  Description of Artificial Sequence: Synthetic coding sequence
atgaacagcaccctcttcagccaggtggagaaccacagcgtgcacagcaacttcagcgagaagaatgcccagctgctggcctttgaaaatgatgactgccacctgcccctggccatgatcttcaccctggccctggcctatggagctgtgatcatcctgggcgtgtctggcaacctggccctgtag

SEQ ID NO: 161745 - DNA, 426 bp, Artificial Sequence
  Description of Artificial Sequence: Synthetic coding sequence
atgatggacaagatgagggacaacaagtaccgcagcagcgagaccaagaggatcaacatcatgctgctgagcatcgtggtggcctttgctgtgtgctggctgcccctgaccatcttcaacacagtgtttgactggaaccaccagatcatcgccacctgcaaccacaacctgctcttcctgctgtgccacctgacagccatgatcagcacctgtgtgaaccccatcttctacggcttcctgaacaagaacttccagagggacctgcagttcttcttcaacttctgtgacttccgcagcagagatgatgattatgagaccatcgccatgagcaccatgcacacagatgtgtccaagaccagcctgaagcaggccagccctgtggccttcaagaagatcaacaacaatgatgacaatgagaagatctag

SEQ ID NO: 161746 - DNA, 78 bp, Artificial Sequence
  Description of Artificial Sequence: Synthetic coding sequence
atgaacagcaccctcttcagccaggtggagaaccacagcgtgcacagcaacttcagcgagaagaatgcccagctgtag

SEQ ID NO: 161747 - DNA, 183 bp, Artificial Sequence
  Description of Artificial Sequence: Synthetic coding sequence
atgaacagcaccctcttcagccaggtggagaaccacagcgtgcacagcaacttcagcgagaagaatgcccagctgctggcctttgaaaatgatgactgccacctgcccctggccatgatcttcaccctggccctggcctatggagctgtgatcatcctgggcgtgtctggcaacctggcctag

SEQ ID NO: 161748 - DNA, 1146 bp, Artificial Sequence
  Description of Artificial Sequence: Synthetic coding sequence
atgggccccatcggggctgaggctgatgagaaccagacagtggaggagatgaaggtggagcagtatggcccccagaccaccccaagaggagagctggtgcctgaccctgagcctgagctgattgacagcaccaagctgattgaggtgcaggtggtgctgatcctggcctactgcagcatcatcctgctgggcgtcatcggcaacagcctggtgattcatgtggtgatcaagttcaagtccatgaggacagtgaccaacttcttcatcgccaacctggccgtggccgacctgctggtgaacaccctgtgcctgcccttcaccctgacctacaccctgatgggagagtggaagatgggccctgtgctgtgccacctggtgccctatgcccagggcctggccgtgcaggtgtccaccatcaccctgaccgtcatcgccctggacagacaccgctgcatcgtgtaccacctggagagcaagatcagcaagaggatctccttcctgatcatcggcctggcctggggcatcagcgccctgctggccagccccctggccatcttccgggagtacagcctcatcgagatcatcccagactttgagatcgtggcctgcacagagaagtggccaggagaggagaagagcatctatggaacagtgtacagcctgagcagcctgctgatcctgtatgtgctgcccctgggcatcatctccttctcctacacccgcatctggagcaagctgaagaaccacgtgtcccctggggccgccaatgaccactaccaccagaggcggcagaagaccaccaagatgctggtgtgtgtggtggtggtgtttgctgtgtcctggctgcccctgcacgccttccagctggccgtggacatcgacagccaggtgctggacctgaaggagtacaagctgatcttcaccgtcttccacatcatcgccatgtgcagcacctttgccaaccccctgctgtatggctggatgaacagcaactacaggaaggccttcctgagcgccttccgctgtgagcagaggctggatgccatccacagcgaggtgtctgtgaccttcaaggccaagaagaacctggaggtgaggaagaacagcggccccaatgacagcttcacagaggccaccaacgtgtag

SEQ ID NO: 161749 - DNA, 1146 bp, Artificial Sequence; identical to SEQ ID NO: 161748
  Description of Artificial Sequence: Synthetic coding sequence

SEQ ID NO: 161750 - DNA, 1338 bp, Artificial Sequence
  Description of Artificial Sequence: Synthetic coding sequence
atggacctggagctggatgagtactacaacaagaccctggccacagagaacaacacagctgccaccaggaacagcgacttccctgtgtgggatgactacaagagctctgtggatgacctgcagtacttcctgattggcctgtacacctttgtgtccctgctgggcttcatgggcaacctgctgatcctgatggccctgatgaagaagaggaaccagaagaccaccgtgaacttcctgattggcaacctggccttcagtgacatcctggtggtgctcttctgcagccccttcaccctgacctctgtgctgctggaccagtggatgtttgggaaggtgatgtgccacatcatgcccttcctgcagtgtgtgtctgtgctggtgtccaccctcatcctgatcagcatcgccatcgtgcgctaccacatgatcaagcaccccatcagcaacaacctgacagccaaccacggctacttcctgattgccaccgtgtggaccctgggctttgccatctgcagccccctgcctgtgttccacagcctggtggagctgcaggagacctttggaagtgccctgctgagcagccgctacctgtgtgtggagagctggcccagcgacagctacagaattgccttcaccatcagcctgctgctggtgcagtacatcctgcccctggtgtgcctgactgtgagccacacctctgtgtgccgcagcatcagctgtggcctgagcaacaaggagaaccggctggaggagaatgagatgatcaacctgaccctgcaccccagcaagaagagcggcccccaggtgaagctgagcggcagccacaagtggagctacagcttcatcaagaagcacagaagacgctacagcaagaagacagcctgtgtgctgcctgcccctgagcggcccagccaggagaaccacagccgcatcctgcctgagaactttggatctgtgcgcagccagctgagcagcagcagcaagttcatccctggggtgcccacctgctttgagatcaagccagaagaaaattctgatgtgcatgagctgcgggtgaagaggtctgtgacccgcatcaagaagaggagccgctctgtgttctaccgcctgaccatcctgatcctggtgtttgctgtgtcctggatgcccctgcacctgttccacgtggtgacagacttcaatgacaacctgatcagcaacagacacttcaagctggtgtactgcatctgccacctgctgggcatgatgagctgctgcctgaaccccatcctgtatggcttcctgaacaacggcatcaaggctgacctggtgtccctcatccactgcctgcacatgtag

SEQ ID NO: 161751 - DNA, 1338 bp, Artificial Sequence; identical to SEQ ID NO: 161750
  Description of Artificial Sequence: Synthetic coding sequence

SEQ ID NO: 161752 - DNA, 1338 bp, Artificial Sequence; identical to SEQ ID NO: 161750
  Description of Artificial Sequence: Synthetic coding sequence

SEQ ID NO: 161753 - DNA, 987 bp, Artificial Sequence
  Description of Artificial Sequence: Synthetic coding sequence
atggacaatgccagcttcagcgagccctggccagccaatgccagcggccctgaccctgccctgagctgcagcaatgccagcaccctggcccccctgcctgcccccctggccgtggccgtgcctgtggtgtatgctgtgatctgtgctgtgggcctggccggcaacagcgctgtgctgtatgtgctgctgcgggcccccaggatgaagacagtgaccaacctcttcatcctgaacctggccatcgcagatgagctgttcaccctggtgctgcccatcaacattgctgacttcctgctgcggcagtggccctttggagagctgatgtgcaagctgattgtggccatcgaccagtacaacaccttcagcagcctgtacttcctgactgtgatgtctgctgaccgctacctggtggtgctggccacagctgagagcagaagagtggccggccgcacctacagcgctgcccgggctgtgtccctggccgtgtggggcatcgtgaccctggtggtgctgccctttgctgtgtttgcccggctggatgatgagcagggccggcggcagtgtgtgctggtgttcccccagcctgaggccttctggtggagggccagccggctgtacaccctggtgctgggctttgccatccctgtgtccaccatctgtgtgctgtacaccaccctgctgtgccgcctgcacgccatgaggctggacagccacgccaaggccctggagcgggccaagaagagggtgaccttcctggtggtggccatcctggccgtgtgcctgctgtgctggaccccctaccacctgagcacagtggtggccctgaccacagacctgccccagacccccctggtgattgccatctcctacttcatcaccagcctgtcctatgccaacagctgcctgaaccccttcctgtatgccttcctggatgccagcttcagaagaaacctgcggcagctgatcacctgcagagctgctgcctag

SEQ ID NO: 161754 - DNA, 1599 bp, Artificial Sequence
  Description of Artificial Sequence: Synthetic coding sequence
atgctggccgagcccttccccaaggtggtggccagcctcatcatcctgcacctgagcggggccaccaagaagggcacagagaagcagaccaccagcgagacccagaagtctgtgcagtgtggcacctggaccaagcatgctgagggcggcatcttcaccagccccaactaccccagcaagtaccccccagaccgggagtgcatctacatcattgaagctgccccccggcagtgcatcgagctgtactttgatgagaagtacagcattgagcccagctgggagtgcaagtttgaccacatcgaggtgagagatggccccttcggcttcagccccatcatcggccgcttctgtggccagcagaacccccctgtgatcaagagcagcggccgcttcctgtggatcaagttctttgctgatggagagctggagagcatgggcttcagcgcccgctacaacttcaccccagaccctgacttcaaggacctgggcgccctgaagcccctgcctgcctgtgaatttgagatgggcggcagcgagggcatcgtggagagcatccagatcatgaaggagggcaaggccacagccagcgaggccgtggactgcaagtggtacatccgggccccacccaggagcaagatctacctgcgcttcctggactatgagatgcagaacagcaatgaatgcaagaggaactttgtggccgtgtatgatggcagcagctctgtggaggacctgaaggccaagttctgcagcacagtggccaatgatgtgatgctgaggacaggcctgggcgtcatccgcatgtgggcagatgagggcagcaggaacagccgcttccagatgctgttcaccagcttccaggagcccccctgtgagggcaacaccttcttctgccacagcaacatgtgcatcaacaacaccctggtgtgcaatggcctgcagaactgtgtgtacccctgggatgagaaccactgcaaggagaagaggaagaccagcctgctggaccagctgaccaacaccagcggcaccgtgattggagtgaccagctgcatcgtcatcatcctgatcatcatctctgtgattgtgcagatcaagcagcccaggaagaagtatgtgcagaggaagagtgactttgaccagacagtgttccaggaggtgtttgagcccccccactatgagctgtgcaccctgcggggcaccggggccacagctgactttgctgatgtggctgatgactttgagaactaccacaagctgcggcgcagcagcagcaagtgcatccatgaccaccactgcggcagccagctgagcagcaccaagggcagccgcagcaacctgagcaccagagatgccagcatcctgacagagatgcccacccagcccgggaagcccctcatcccccccatgaacagaagaaacatcctggtgatgaagcacagctacagccaggatgctgctgatgcctgtgacattgatgaaattgaggaggtgcccaccaccagccaccggctgagcagacatgacaaggctgtgcagcgcttctgcctgattggcagcctgagcaagcatgaaagtgagtacaacaccaccagggtgtag

SEQ ID NO: 161755 - DNA, 1602 bp, Artificial Sequence
  Description of Artificial Sequence: Synthetic coding sequence
atgattcatggccgctctgtgctgcacatcgtggccagcctcatcatcctgcacctgagcggggccaccaagaagggcacagagaagcagaccaccagcgagacccagaagtctgtgcagtgtggcacctggaccaagcacgccgagggcggcatcttcaccagccccaactaccccagcaagtaccccccagaccgggagtgcatctacatcatcgaggccgccccccggcagtgcatcgagctgtactttgatgagaagtacagcattgagcccagctgggagtgcaagtttgaccacatcgaggtgagagatggccccttcggcttcagccccatcatcggccgcttctgtggccagcagaacccccctgtgatcaagagcagcggccgcttcctgtggatcaagttctttgctgatggagagctggagagcatgggcttcagcgcccgctacaacttcaccccagaccctgacttcaaggacctgggcgccctgaagcccctgcctgcctgtgaatttgagatgggcggcagcgagggcatcgtggagagcatccagatcatgaaggagggcaaggccacagccagcgaggccgtggactgcaagtggtacatccgggccccacccaggagcaagatctacctgcgcttcctggactatgagatgcagaacagcaatgaatgcaagaggaactttgtggccgtgtatgatggcagcagctctgtggaggacctgaaggccaagttctgcagcacagtggccaatgatgtgatgctgaggacaggcctgggcgtcatccgcatgtgggcagatgagggcagcaggaacagccgcttccagatgctgttcaccagcttccaggagcccccctgtgagggcaacaccttcttctgccacagcaacatgtgcatcaacaacaccctggtgtgcaatggcctgcagaactgtgtgtacccctgggatgagaaccactgcaaggagaagaggaagaccagcctgctggaccagctgaccaacaccagcggcaccgtcatcggcgtgaccagctgcatcgtcatcatcctgatcatcatcagcgtcatcgtgcagatcaagcagcccaggaagaagtatgtgcagaggaagagtgactttgaccagaccgtcttccaggaggtgtttgagcccccccactatgagctgtgcaccctgcggggcactggagccacagctgactttgctgatgtggctgatgactttgagaactaccacaagctgcggcgcagcagcagcaagtgcatccatgaccaccactgcggcagccagctgagcagcaccaagggcagccgcagcaacctgagcaccagagatgccagcatcctgacagagatgcccacccagcccgggaagcccctcatcccccccatgaacagaagaaacatcctggtgatgaagcacagctacagccaggatgctgctgatgcctgtgacattgatgaaattgaggaggtgcccaccaccagccaccggctgagcagacatgacaaggctgtgcagcgcttctgcctgattggcagcctgagcaagcatgagagcgagtacaacaccaccagggtgtag

SEQ ID NO: 161756 - DNA, 471 bp, Artificial Sequence
  Description of Artificial Sequence: Synthetic coding sequence
atgctggccgagcccttccccaaggtggtggccagcctcatcatcctgcacctgagcggggccaccaagaagggcacagagaagcagaccaccagcgagacccagaagtctgtgcagtgtggcacctggaccaagcatgctgagggcggcatcttcaccagccccaactaccccagcaagtaccccccagaccgggagtgcatctacatcattgaagctgccccccggcagtgcatcgagctgtactttgatgagaagtacagcattgagcccagctgggagtgcaagtttgaccacatcgaggtgagagatggccccttcggcttcagccccatcatcggccgcttctgtggccagcagaacccccctgtgatcaagagcagcggccgcttcctgtggatcaagttctttgctgatggagagctggagagcatgggcttcagcgcccgctacaacttcaccccagagtag

SEQ ID NO: 161757 - DNA, 1602 bp, Artificial Sequence; identical to SEQ ID NO: 161755
  Description of Artificial Sequence: Synthetic coding sequence

SEQ ID NO: 161758 - DNA, 1017 bp, Artificial Sequence
  Description of Artificial Sequence: Synthetic coding sequence
atgagcggcagcagcctgcccagcgccctggccctgagcctgctgctggtgtctggcagcctgctgcccggccctggagctgcccagaatgccggctttgtgaagagccccatgtctgagaccaagctgactggagatgcctttgagctgtactgtgatgtggtgggcagccccaccccagagatccagtggtggtatgcagaggtgaacagagctgagagcttccggcagctgtgggatggagccaggaagagaagagtgacagtgaacacagcctacggcagcaatggagtgtctgtgctgcgcatcacccggctgaccctggaggacagcggcacctatgaatgtcgggccagcaatgaccccaagagaaatgacctgcggcagaaccccagcatcacctggatccgggcccaggccaccatctctgtgctgcagaagccccgcatcgtgaccagcgaggaggtgatcatccgggacagccctgtgctgcctgtgaccctgcagtgcaacctgaccagcagcagccacaccctgacctacagctactggaccaagaatggagtggagctgagcgccaccaggaagaatgccagcaacatggagtaccgcatcaacaagcccagggcagaagattctggagagtaccactgtgtgtaccactttgtgtctgcccccaaggccaatgccaccatcgaggtgaaggccgccccagacatcaccggccacaagagaagtgagaacaagaatgaaggccaggatgccaccatgtactgcaagtctgtgggctacccccacccagactggatctggaggaagaaggaaaatggcatgcccatggacatcgtgaacaccagcggccgcttcttcatcatcaacaaggagaactacacagagctgaacatcgtgaacctgcagatcacagaagatcctggagaatatgagtggtgtggggccacctggccccacagcggcctgtcctgggagttctggctgaagctgagcagcctgtggtag

SEQ ID NO: 161759 - DNA, 1197 bp, Artificial Sequence
  Description of Artificial Sequence: Synthetic coding sequence
atgagcggcagcagcctgcccagcgccctggccctgagcctgctgctggtgtctggcagcctgctgcccggccctggagctgcccagaatgccggctttgtgaagagccccatgtctgagaccaagctgactggagatgcctttgagctgtactgtgatgtggtgggcagccccaccccagagatccagtggtggtatgcagaggtgaacagagctgagagcttccggcagctgtgggatggagccaggaagagaagagtgacagtgaacacagcctacggcagcaatggagtgtctgtgctgcgcatcacccggctgaccctggaggacagcggcacctatgaatgtcgggccagcaatgaccccaagagaaatgacctgcggcagaaccccagcatcacctggatccgggcccaggccaccatctctgtgctgcagaagccccgcatcgtgaccagcgaggaggtgatcatccgggacagccctgtgctgcctgtgaccctgcagtgcaacctgaccagcagcagccacaccctgacctacagctactggaccaagaatggagtggagctgagcgccaccaggaagaatgccagcaacatggagtaccgcatcaacaagcccagggcagaagattctggagagtaccactgtgtgtaccactttgtgtctgcccccaaggccaatgccaccatcgaggtgaaggccgccccagacatcaccggccacaagagaagtgagaacaagaatgaaggccaggatgccaccatgtactgcaagtctgtgggctacccccacccagactggatctggaggaagaaggaaaatggcatgcccatggacatcgtgaacaccagcggccgcttcttcatcatcaacaaggagaactacacagagctgaacatcgtgaacctgcagatcacagaagatcctggagaatatgaatgtaatgccaccaatgccatcggcagcgcctctgtggtgacagtgctgcgggtgcgcagccacctggcccccctgtggcccttcctgggcatcctggccgagatcatcatcctggtggtgatcatcgtggtgtatgagaagaggaagaggccagatgaggtgcctgatgatgatgagcccgccggccccatgaagaccaacagcaccaacaaccacaaggacaagaacctgcggcagaggaacaccaactag

SEQ ID NO: 161760 - DNA, 849 bp, Artificial Sequence
  Description of Artificial Sequence: Synthetic coding sequence
atgagcggcagcagcctgcccagcgccctggccctgagcctgctgctggtgtctggcagcctgctgcccggccctggagctgcccagaatgagccccgcatcgtgaccagcgaggaggtgatcatccgggacagccctgtgctgcctgtgaccctgcagtgcaacctgaccagcagcagccacaccctgacctacagctactggaccaagaatggagtggagctgagcgccaccaggaagaatgccagcaacatggagtaccgcatcaacaagcccagggcagaagattctggagagtaccactgtgtgtaccactttgtgtctgcccccaaggccaatgccaccatcgaggtgaaggccgccccagacatcaccggccacaagagaagtgagaacaagaatgaaggccaggatgccaccatgtactgcaagtctgtgggctacccccacccagactggatctggaggaagaaggaaaatggcatgcccatggacatcgtgaacaccagcggccgcttcttcatcatcaacaaggagaactacacagagctgaacatcgtgaacctgcagatcacagaagatcctggagaatatgaatgtaatgccaccaatgccatcggcagcgcctctgtggtgacagtgctgcgggtgcgcagccacctggcccccctgtggcccttcctgggcatcctggccgagatcatcatcctggtggtgatcatcgtggtgtatgagaagaggaagaggccagatgaggtgcctgatgatgatgagcccgccggccccatgaagaccaacagcaccaacaaccacaaggacaagaacctgcggcagaggaacaccaactag

SEQ ID NO: 161761 - DNA, 582 bp, Artificial Sequence
  Description of Artificial Sequence: Synthetic coding sequence
atgagcggcagcagcctgcccagcgccctggccctgagcctgctgctggtgtctggcagcctgctgcccggccctggagctgcccagaatgctgccccagacatcaccggccacaagaggtctgagaacaagaatgaaggccaggatgccaccatgtactgcaagtctgtgggctacccccacccagactggatctggaggaagaaggaaaatggcatgcccatggacatcgtgaacaccagcggccgcttcttcatcatcaacaaggagaactacacagagctgaacatcgtgaacctgcagatcacagaggaccccggggagtatgagtgcaatgccaccaatgccatcggcagcgcctctgtggtgacagtgctgcgggtgcgcagccacctggcccccctgtggcccttcctgggcatcctggccgagatcatcatcctggtggtgatcatcgtggtgtatgagaagaggaagaggccagatgaggtgcctgatgatgatgagcctgctggccccatgaagaccaacagcaccaacaaccacaaggacaagaacctgcggcagaggaacaccaactag

SEQ ID NO: 161762 - DNA, 1185 bp, Artificial Sequence
  Description of Artificial Sequence: Synthetic coding sequence
atgagcggcagcagcctgcccagcgccctggccctgagcctgctgctggtgtctggcagcctgctgcccggccctggagctgcccagaatgccggctttgtgaagagccccatgtctgagaccaagctgactggagatgcctttgagctgtactgtgatgtggtgggcagccccaccccagagatccagtggtggtatgcagaggtgaacagagctgagagcttccggcagctgtgggatggagccaggaagagaagagtgacagtgaacacagcctacggcagcaatggagtgtctgtgctgcgcatcacccggctgaccctggaggacagcggcacctatgaatgtcgggccagcaatgaccccaagagaaatgacctgcggcagaaccccagcatcacctggatccgggcccaggccaccatctctgtgctgcagaagccccgcatcgtgaccagcgaggaggtgatcatccgggacagccctgtgctgcctgtgaccctgcagtgcaacctgaccagcagcagccacaccctgacctacagctactggaccaagaatggagtggagctgagcgccaccaggaagaatgccagcaacatggagtaccgcatcaacaagcccagggcagaagattctggagagtaccactgtgtgtaccactttgtgtctgcccccaaggccaatgccaccatcgaggtgaaggccgccccagacatcaccggccacaagagaagtgagaacaagaatgaaggccaggatgccaccatgtactgcaagtctgtgggctacccccacccagactggatctggaggaagaaggaaaatggcatgcccatggacatcgtgaacaccagcggccgcttcttcatcatcaacaaggagaactacacagagctgaacatcgtgaacctgcagatcacagaagatcctggagaatatgaatgtaatgccaccaatgccatcggcagcgcctctgtggtgacagtgctgcgggtgcgcagccacctggcccccctgtggcccttcctgggcatcctggccgagatcatcatcctggtggtgatcatcgtggtgtatgagaagaggaagaggccagatgaggtgcctgatgtgccccccaggaagaccaacagcaccaacaaccacaaggacaagaacctgcggcagaggaacaccaactag

SEQ ID NO: 161763 - DNA, 513 bp, Artificial Sequence
  Description of Artificial Sequence: Synthetic coding sequence
atgatggccggcatgaagatccagctggtgtgcatgctgctgctggccttcagctcctggagcctgtgcagcgacagcgaggaggagatgaaggccctggaggccgacttcctgaccaacatgcacaccagcaagatcagcaaggcccacgtgcccagctggaagatgaccctgctgaatgtgtgcagcctggtgaacaacctgaacagccctgctgaggagactggagaggtgcatgaggaggagctggtggcccggaggaagctgcccacagccctggatggcttcagcctggaggccatgctgaccatctaccagctgcacaagatctgccacagccgggccttccagcactgggagctgatccaggaggacatcctggacacaggaaatgacaagaatggcaaggaggaggtgatcaagaggaagatcccctacatcctgaagaggcagctgtatgagaacaagccccggcggccctacatcctgaagagggacagctactactactag

SEQ ID NO: 161764 - DNA, 348 bp, Artificial Sequence
  Description of Artificial Sequence: Synthetic coding sequence
atgaccctgctgaatgtgtgcagcctggtgaacaacctgaacagccctgctgaggagaccggggaggtgcatgaggaggagctggtggcccggaggaagctgcccacagccctggatggcttcagcctggaggccatgctgaccatctaccagctgcacaagatctgccacagccgggccttccagcactgggagctgatccaggaggacatcctggacacaggaaatgacaagaatggcaaggaggaggtgatcaagaggaagatcccctacatcctgaagaggcagctgtatgagaacaagccccggcggccctacatcctgaagagggacagctactactactag

SEQ ID NO: 161765 - DNA, 288 bp, Artificial Sequence
  Description of Artificial Sequence: Synthetic coding sequence
atgatggccggcatgaagatccagctggtgtgcatgctgctgctggccttcagctcctggagcctgtgcagcgacagcgaggaggagatgaaggccctggaggccgacttcctgaccaacatgcacaccagcaagctgatccaggaggacatcctggacacaggaaatgacaagaatggcaaggaggaggtgatcaagaggaagatcccctacatcctgaagaggcagctgtatgagaacaagccccggcggccctacatcctgaagagggacagctactactactag

SEQ ID NO: 161766 - DNA, 1257 bp, Artificial Sequence
  Description of Artificial Sequence: Synthetic coding sequence
atgaggctgaacagcagcgcccctggcaccccaggcaccccagctgctgaccccttccagagggcccaggccggcctggaggaggccctgctggcccctggctttggaaatgccagcggaaatgccagcgagcgggtgctggccgcccccagcagcgagctggatgtgaacacagacatctacagcaaggtgctggtgacagctgtgtacctggccctgtttgtggtgggcaccgtgggcaacacagtgacagccttcaccctggccaggaagaagagcctgcagagcctgcagagcacagtgcactaccacctgggcagcctggccctgagtgacctgctgaccctgctgctggccatgcctgtggagctgtacaacttcatctgggtgcaccacccctgggcctttggagatgctggctgccggggctactacttcctgagagatgcctgcacctacgccacagccctgaatgtggccagcctgtctgtggagcgctacctggccatctgccaccccttcaaggccaagaccctgatgagccgcagcaggaccaagaagttcatcagcgccatctggctggccagcgccctgctggccgtgcccatgctgttcaccatgggagagcagaacagatctgcagatggccagcacgccggcggcctggtgtgcacccccaccatccacacagccaccgtgaaggtggtgatccaggtgaacaccttcatgtccttcatcttccccatggtggtgatctctgtgctgaacaccatcatcgccaacaagctgactgtgatggtgcggcaggccgctgagcagggccaggtgtgcaccgtgggcggggagcacagcaccttctccatggccatcgagcccggccgggtgcaggccctgcggcatggagtgcgggtgctgcgggctgtggtgattgcctttgtggtgtgctggctgccctaccacgtgcggcggctgatgttctgctacatcagtgatgagcagtggacccccttcctgtatgacttctaccactacttctacatggtgaccaatgccctcttctacgtgagcagcaccatcaaccccatcctgtacaacctggtgtctgccaacttccgccacatcttcctggccaccctggcctgcctgtgccctgtgtggaggagaagaaggaagaggcctgccttcagcaggaaggctgacagcgtgagcagcaaccacaccctgagcagcaatgccacccgggagaccctgtactag

SEQ ID NO: 161767 - DNA, 951 bp, Artificial Sequence
  Description of Artificial Sequence: Synthetic coding sequence
atgggcgtgtgtggctacctgttcctgccctggaagtgcctggtggtggtgtccctgcggctgctcttcctggtgcccactggagtgcctgtgcgctctggagatgccaccttccccaaggccatggacaacgtgacagtgcggcagggcgagagcgccaccctgcgctgcaccatcgacaacagagtgaccagggtggcctggctgaacagaagcaccatcctgtatgctggaaatgacaagtggtgcctggacccccgggtggtgctgctgagcaacacccagacccagtacagcattgagatccagaatgtggatgtgtatgatgagggcccctacacctgcagcgtgcagacagacaaccaccccaagaccagccgggtgcacctgattgtgcaggtgagccccaagatcgtggagatcagcagtgacatcagcatcaatgaaggcaacaacatcagcctgacctgcatcgccaccggccggcctgagcccaccgtgacctggaggcacatcagccccaaggctgtgggctttgtgtctgaagatgagtacctggagatccagggcatcacccgggagcagagcggggactatgagtgcagcgccagcaatgatgtggccgcccctgtggtgagaagagtgaaggtgacagtgaactacccaccctacatcagcgaggccaagggcactggagtgcctgtgggccagaagggcaccctgcagtgtgaggccagcgctgtgcccagcgctgagttccagtggtacaaggatgacaagaggctgattgagggcaagaagggcgtgaaggtggagaaccggcccttcctgagcaagctgatcttcttcaacgtgtctgaacatgactatggcaactacacctgtgtggccagcaacaagctgggccacaccaatgccagcatcatgctgtttggagagaccgtgctgtag

SEQ ID NO: 161768 - DNA, 1035 bp, Artificial Sequence
  Description of Artificial Sequence: Synthetic coding sequence
atgggcgtgtgtggctacctgttcctgccctggaagtgcctggtggtggtgtccctgcggctgctcttcctggtgcccactggagtgcctgtgcgctctggagatgccaccttccccaaggccatggacaacgtgacagtgcggcagggcgagagcgccaccctgcgctgcaccatcgacaacagagtgaccagggtggcctggctgaacagaagcaccatcctgtatgctggaaatgacaagtggtgcctggacccccgggtggtgctgctgagcaacacccagacccagtacagcattgagatccagaatgtggatgtgtatgatgagggcccctacacctgcagcgtgcagacagacaaccaccccaagaccagccgggtgcacctgattgtgcaggtgagccccaagatcgtggagatcagcagtgacatcagcatcaatgaaggcaacaacatcagcctgacctgcatcgccaccggccggcctgagcccaccgtgacctggaggcacatcagccccaaggctgtgggctttgtgtctgaagatgagtacctggagatccagggcatcacccgggagcagagcggggactatgagtgcagcgccagcaatgatgtggccgcccctgtggtgagaagagtgaaggtgacagtgaactacccaccctacatcagcgaggccaagggcactggagtgcctgtgggccagaagggcaccctgcagtgtgaggccagcgctgtgcccagcgctgagttccagtggtacaaggatgacaagaggctgattgagggcaagaagggcgtgaaggtggagaaccggcccttcctgagcaagctgatcttcttcaacgtgtctgaacatgactatggcaactacacctgtgtggccagcaacaagctgggccacaccaatgccagcatcatgctgtttggacctggagctgtgtctgaggtgtccaatggcaccagcagaagagctggctgtgtgtggctgctgcccctgctggtgctgcacctgctgctgaagttctag

SEQ ID NO: 161769 - DNA, 1035 bp, Artificial Sequence
  Description of Artificial Sequence: Synthetic coding sequence
atgaagaccatccagcccaagatgcacaacagcatctcctgggccatcttcaccggcctggccgccctgtgcctcttccagggcgtgcctgtgcgctctggagatgccaccttccccaaggccatggacaacgtgacagtgcggcagggcgagagcgccaccctgcgctgcaccatcgacaacagagtgaccagggtggcctggctgaacagaagcaccatcctgtatgctggaaatgacaagtggtgcctggacccccgggtggtgctgctgagcaacacccagacccagtacagcattgagatccagaatgtggatgtgtatgatgagggcccctacacctgcagcgtgcagacagacaaccaccccaagaccagccgggtgcacctgattgtgcaggtgagccccaagatcgtggagatcagcagtgacatcagcatcaatgaaggcaacaacatcagcctgacctgcatcgccaccggccggcctgagcccaccgtgacctggaggcacatcagccccaaggctgtgggctttgtgtctgaagatgagtacctggagatccagggcatcacccgggagcagagcggggactatgagtgcagcgccagcaatgatgtggccgcccctgtggtgagaagagtgaaggtgacagtgaactacccaccctacatcagcgaggccaagggcactggagtgcctgtgggccagaagggcaccctgcagtgtgaggccagcgctgtgcccagcgctgagttccagtggtacaaggatgacaagaggctgattgagggcaagaagggcgtgaaggtggagaaccggcccttcctgagcaagctgatcttcttcaacgtgtctgaacatgactatggcaactacacctgtgtggccagcaacaagctgggccacaccaatgccagcatcatgctgtttggacctggagctgtgtctgaggtgtccaatggcaccagcagaagagctggctgtgtgtggctgctgcccctgctggtgctgcacctgctgctgaagttctag

SEQ ID NO: 161770 - DNA, 1041 bp, Artificial Sequence
  Description of Artificial Sequence: Synthetic coding sequence
atgaatggcaagagaaatggagagggcggcaagcgctggaagtggaagggcaccggggtgcctgtgcgctctggagatgccaccttccccaaggccatggacaacgtgacagtgcggcagggcgagagcgccaccctgcgctgcaccatcgacaacagagtgaccagggtggcctggctgaacagaagcaccatcctgtatgctggaaatgacaagtggtgcctggacccccgggtggtgctgctgagcaacacccagacccagtacagcattgagatccagaatgtggatgtgtatgatgagggcccctacacctgcagcgtgcagacagacaaccaccccaagaccagccgggtgcacctgattgtgcaggtgagccccaagatcgtggagatcagcagtgacatcagcatcaatgaaggcaacaacatcagcctgacctgcatcgccaccggccggcctgagcccaccgtgacctggaggcacatcagccccaaggctgtgggctttgtgtctgaagatgagtacctggagatccagggcatcacccgggagcagagcggggactatgaatgttctgccagcaatgatgtggccgcccctgtggtgcggcgggtgaaggtgacagtgaactacccaccctacatcagcgaggccaagggcaccggggtgcctgtgggccagaagggcaccctgcagtgtgaggccagcgctgtgcccagcgctgagttccagtggtacaaggatgacaagaggctcatcgagggcaagaagggcgtgaaggtggagaaccggcccttcctgagcaagctgatcttcttcaacgtgtctgaacatgactatggcaactacacctgtgtggccagcaacaagctgggccacaccaatgccagcatcatgctgtttgaggtgaagaccacagccctgaccccctggaagggccctggagctgtgtctgaggtgtccaatggcaccagcagaagagctggctgtgtgtggctgctgcccctgctggtgctgcacctgctgctgaagttctag

SEQ ID NO: 161771 - DNA, 1068 bp, Artificial Sequence
  Description of Artificial Sequence: Synthetic coding sequence
atgaagaccatccagcccaagatgcacaacagcatctcctgggccatcttcaccggcctggccgccctgtgcctcttccagggcgtgcctgtgcgctctggagatgccaccttccccaaggccatggacaacgtgacagtgcggcagggcgagagcgccaccctgcgctgcaccatcgacaacagagtgaccagggtggcctggctgaacagaagcaccatcctgtatgctggaaatgacaagtggtgcctggacccccgggtggtgctgctgagcaacacccagacccagtacagcattgagatccagaatgtggatgtgtatgatgagggcccctacacctgcagcgtgcagacagacaaccaccccaagaccagccgggtgcacctgattgtgcaggtgagccccaagatcgtggagatcagcagtgacatcagcatcaatgaaggcaacaacatcagcctgacctgcatcgccaccggccggcctgagcccaccgtgacctggaggcacatcagccccaaggctgtgggctttgtgtctgaagatgagtacctggagatccagggcatcacccgggagcagagcggggactatgagtgcagcgccagcaatgatgtggccgcccctgtggtgagaagagtgaaggtgacagtgaactacccaccctacatcagcgaggccaagggcactggagtgcctgtgggccagaagggcaccctgcagtgtgaggccagcgctgtgcccagcgctgagttccagtggtacaaggatgacaagaggctgattgagggcaagaagggcgtgaaggtggagaaccggcccttcctgagcaagctgatcttcttcaacgtgtctgaacatgactatggcaactacacctgtgtggccagcaacaagctgggccacaccaatgccagcatcatgctgtttgaggtgaagaccacagccctgaccccctggaagggccctggagctgtgtctgaggtgtccaatggcaccagccggcgggccggctgtgtgtggctgctgcccctgctggtgctgcacctgctgctgaagttctag

SEQ ID NO: 161772 - DNA, 1068 bp, Artificial Sequence
  Description of Artificial Sequence: Synthetic coding sequence
atgggcgtgtgtggctacctgttcctgccctggaagtgcctggtggtggtgtccctgcggctgctcttcctggtgcccactggagtgcctgtgcgctctggagatgccaccttccccaaggccatggacaacgtgacagtgcggcagggcgagagcgccaccctgcgctgcaccatcgacaacagagtgaccagggtggcctggctgaacagaagcaccatcctgtatgctggaaatgacaagtggtgcctggacccccgggtggtgctgctgagcaacacccagacccagtacagcattgagatccagaatgtggatgtgtatgatgagggcccctacacctgcagcgtgcagacagacaaccaccccaagaccagccgggtgcacctgattgtgcaggtgagccccaagatcgtggagatcagcagtgacatcagcatcaatgaaggcaacaacatcagcctgacctgcatcgccaccggccggcctgagcccaccgtgacctggaggcacatcagccccaaggctgtgggctttgtgtctgaagatgagtacctggagatccagggcatcacccgggagcagagcggggactatgagtgcagcgccagcaatgatgtggccgcccctgtggtgagaagagtgaaggtgacagtgaactacccaccctacatcagcgaggccaagggcactggagtgcctgtgggccagaagggcaccctgcagtgtgaggccagcgctgtgcccagcgctgagttccagtggtacaaggatgacaagaggctgattgagggcaagaagggcgtgaaggtggagaaccggcccttcctgagcaagctgatcttcttcaacgtgtctgaacatgactatggcaactacacctgtgtggccagcaacaagctgggccacaccaatgccagcatcatgctgtttgaggtgaagaccacagccctgaccccctggaagggccctggagctgtgtctgaggtgtccaatggcaccagccggcgggccggctgtgtgtggctgctgcccctgctggtgctgcacctgctgctgaagttctag

SEQ ID NO: 161773 - DNA, 2373 bp, Artificial Sequence
  Description of Artificial Sequence: Synthetic coding sequence
atgctgcggggcggccggcggggccagctgggctggcacagctgggccgccggccctggcagcctgctggcctggctgatcctggccagcgctggagctgccccctgcccagatgcctgctgcccccacggcagcagcggcctgcgctgcaccagagatggagccctggacagcctgcaccacctgcctggagctgagaacctgacagagctgtacatcgagaaccagcagcacctgcagcacctggagctgcgggacctgcggggcctgggggagctgaggaacctgaccatcgtgaagagcggcctgcgctttgtggccccagatgccttccacttcaccccccggctgagccggctgaacctgtccttcaatgccctggagagcctgtcctggaagacagtgcagggcctgagcctgcaggagctggtgctgagcggcaaccccctgcactgcagctgtgccctgcgctggctgcagcgctgggaggaggagggcctgggcggcgtgcctgagcagaagctgcagtgccacggccagggccccctggcccacatgcccaatgccagctgtggggtgcccaccctgaaggtgcaggtgcccaatgcctctgtggatgtgggagatgatgtgctgctgcgctgccaggtggagggccggggcctggagcaggccggctggatcctgacagagctggagcagagcgccaccgtgatgaagagcggcggcctgcccagcctgggcctgaccctggccaacgtgaccagtgacctgaacaggaagaatgtgacctgctgggccgagaatgatgtgggccgggcagaggtgtctgtgcaggtgaatgtgtccttccctgcctctgtgcagctgcacacagctgtggagatgcaccactggtgcatccccttctctgtggatggccagcctgcccccagcctgcgctggctgttcaacggctctgtgctgaatgagaccagcttcatcttcacagagttcctggagcctgctgccaatgagaccgtgagacatggctgcctgcggctgaaccagcccacccacgtgaacaacggcaactacaccctgctggccgccaaccccttcggccaggccagcgccagcatcatggccgccttcatggacaacccctttgagttcaaccctgaggaccccatcccagacaccaacagcaccagcggggaccctgtggagaagaaggatgagacccccttcggcgtgtctgtggccgtgggcctggccgtgtttgcctgcctcttcctgagcaccctgctgctggtgctgaacaagtgtggcagaagaaacaagtttggcatcaacagacctgctgtgctggccccagaagatggcctggccatgagcctgcacttcatgaccctgggcggcagcagcctgagccccacagagggcaagggcagcggcctgcagggccacatcatcgagaacccccagtacttcagtgatgcctgtgtgcaccacatcaagagaagagacatcgtgctgaagtgggagctgggggagggcgccttcggcaaggtgttcctggccgagtgccacaacctgctgcctgagcaggacaagatgctggtggccgtgaaggccctgaaggaggccagcgagagcgcccggcaggacttccagcgggaggccgagctgctgaccatgctgcagcaccagcacatcgtgcgcttcttcggcgtgtgcacagagggccggcccctgctgatggtgtttgagtacatgagacatggagacctgaaccgcttcctgcggagccacggcccagatgccaagctgctggccggaggagaagatgtggcccctggccccctgggcctgggccagctgctggccgtggccagccaggtggccgccggcatggtgtacctggccggcctgcactttgtgcaccgggacctggccaccaggaactgcctggtgggccagggcctggtggtgaagatcggggactttggcatgagccgggacatctacagcacagactactacagagtgggcggccgcaccatgctgcccatccgctggatgcctcctgagagcatcctgtacaggaagttcaccacagaaagtgatgtgtggagctttggagtggtgctgtgggagatcttcacctacggcaagcagccctggtaccagctgagcaacacagaggccatcgactgcatcacccagggccgggagctggagcggccccgggcctgccccccagaggtgtatgccatcatgaggggctgctggcagcgggagccccagcagaggcacagcatcaaggatgtgcacgcccggctgcaggccctggcccaggcccctcctgtgtacctggatgtgctgggctag

SEQ ID NO: 161774 - DNA, 2283 bp, Artificial Sequence
  Description of Artificial Sequence: Synthetic coding sequence
atgaaggaggccgccctgatctgcctggcccccagcgtgccccccatcctgactgtgaagtcctgggacaccatgcagctgcgggccgcccggagccgctgcaccaacctgctggccgccagctacatcgagaaccagcagcacctgcagcacctggagctgcgggacctgcggggcctgggggagctgaggaacctgaccatcgtgaagagcggcctgcgctttgtggccccagatgccttccacttcaccccccggctgagccggctgaacctgtccttcaatgccctggagagcctgtcctggaagacagtgcagggcctgagcctgcaggagctggtgctgagcggcaaccccctgcactgcagctgtgccctgcgctggctgcagcgctgggaggaggagggcctgggcggcgtgcctgagcagaagctgcagtgccacggccagggccccctggcccacatgcccaatgccagctgtggggtgcccaccctgaaggtgcaggtgcccaatgcctctgtggatgtgggagatgatgtgctgctgcgctgccaggtggagggccggggcctggagcaggccggctggatcctgacagagctggagcagagcgccaccgtgatgaagagcggcggcctgcccagcctgggcctgaccctggccaacgtgaccagtgacctgaacaggaagaatgtgacctgctgggccgagaatgatgtgggccgggcagaggtgtctgtgcaggtgaatgtgtccttccctgcctctgtgcagctgcacacagctgtggagatgcaccactggtgcatccccttctctgtggatggccagcctgcccccagcctgcgctggctgttcaacggctctgtgctgaatgagaccagcttcatcttcacagagttcctggagcctgctgccaatgagaccgtgagacatggctgcctgcggctgaaccagcccacccacgtgaacaacggcaactacaccctgctggccgccaaccccttcggccaggccagcgccagcatcatggccgccttcatggacaacccctttgagttcaaccctgaggaccccatcccagacaccaacagcaccagcggggaccctgtggagaagaaggatgagacccccttcggcgtgtctgtggccgtgggcctggccgtgtttgcctgcctcttcctgagcaccctgctgctggtgctgaacaagtgtggcagaagaaacaagtttggcatcaacagacctgctgtgctggccccagaagatggcctggccatgagcctgcacttcatgaccctgggcggcagcagcctgagccccacagagggcaagggcagcggcctgcagggccacatcatcgagaacccccagtacttcagtgatgcctgtgtgcaccacatcaagagaagagacatcgtgctgaagtgggagctgggggagggcgccttcggcaaggtgttcctggccgagtgccacaacctgctgcctgagcaggacaagatgctggtggccgtgaaggccctgaaggaggccagcgagagcgcccggcaggacttccagcgggaggccgagctgctgaccatgctgcagcaccagcacatcgtgcgcttcttcggcgtgtgcacagagggccggcccctgctgatggtgtttgagtacatgagacatggagacctgaaccgcttcctgcggagccacggcccagatgccaagctgctggccggaggagaagatgtggcccctggccccctgggcctgggccagctgctggccgtggccagccaggtggccgccggcatggtgtacctggccggcctgcactttgtgcaccgggacctggccaccaggaactgcctggtgggccagggcctggtggtgaagatcggggactttggcatgagccgggacatctacagcacagactactacagagtgggcggccgcaccatgctgcccatccgctggatgcctcctgagagcatcctgtacaggaagttcaccacagaaagtgatgtgtggagctttggagtggtgctgtgggagatcttcacctacggcaagcagccctggtaccagctgagcaacacagaggccatcgactgcatcacccagggccgggagctggagcggccccgggcctgccccccagaggtgtatgccatcatgaggggctgctggcagcgggagccccagcagaggcacagcatcaaggatgtgcacgcccggctgcaggccctggcccaggcccctcctgtgtacctggatgtgctgggctag

SEQ ID NO: 161775 - DNA, 2391 bp, Artificial Sequence
  Description of Artificial Sequence: Synthetic coding sequence
atgctgcggggcggccggcggggccagctgggctggcacagctgggccgccggccctggcagcctgctggcctggctgatcctggccagcgctggagctgccccctgcccagatgcctgctgcccccacggcagcagcggcctgcgctgcaccagagatggagccctggacagcctgcaccacctgcctggagctgagaacctgacagagctgtacatcgagaaccagcagcacctgcagcacctggagctgcgggacctgcggggcctgggggagctgaggaacctgaccatcgtgaagagcggcctgcgctttgtggccccagatgccttccacttcaccccccggctgagccggctgaacctgtccttcaatgccctggagagcctgtcctggaagacagtgcagggcctgagcctgcaggagctggtgctgagcggcaaccccctgcactgcagctgtgccctgcgctggctgcagcgctgggaggaggagggcctgggcggcgtgcctgagcagaagctgcagtgccacggccagggccccctggcccacatgcccaatgccagctgtggggtgcccaccctgaaggtgcaggtgcccaatgcctctgtggatgtgggagatgatgtgctgctgcgctgccaggtggagggccggggcctggagcaggccggctggatcctgacagagctggagcagagcgccaccgtgatgaagagcggcggcctgcccagcctgggcctgaccctggccaacgtgaccagtgacctgaacaggaagaatgtgacctgctgggccgagaatgatgtgggccgggcagaggtgtctgtgcaggtgaatgtgtccttccctgcctctgtgcagctgcacacagctgtggagatgcaccactggtgcatccccttctctgtggatggccagcctgcccccagcctgcgctggctgttcaacggctctgtgctgaatgagaccagcttcatcttcacagagttcctggagcctgctgccaatgagaccgtgagacatggctgcctgcggctgaaccagcccacccacgtgaacaacggcaactacaccctgctggccgccaaccccttcggccaggccagcgccagcatcatggccgccttcatggacaacccctttgagttcaaccctgaggaccccatccctgtgtccttcagccctgtggacaccaacagcaccagcggggaccctgtggagaagaaggatgagacccccttcggcgtgtctgtggccgtgggcctggccgtgtttgcctgcctcttcctgagcaccctgctgctggtgctgaacaagtgtggcagaagaaacaagtttggcatcaacagacctgctgtgctggccccagaagatggcctggccatgagcctgcacttcatgaccctgggcggcagcagcctgagccccacagagggcaagggcagcggcctgcagggccacatcatcgagaacccccagtacttcagtgatgcctgtgtgcaccacatcaagagaagagacatcgtgctgaagtgggagctgggggagggcgccttcggcaaggtgttcctggccgagtgccacaacctgctgcctgagcaggacaagatgctggtggccgtgaaggccctgaaggaggccagcgagagcgcccggcaggacttccagcgggaggccgagctgctgaccatgctgcagcaccagcacatcgtgcgcttcttcggcgtgtgcacagagggccggcccctgctgatggtgtttgagtacatgagacatggagacctgaaccgcttcctgcggagccacggcccagatgccaagctgctggccggaggagaagatgtggcccctggccccctgggcctgggccagctgctggccgtggccagccaggtggccgccggcatggtgtacctggccggcctgcactttgtgcaccgggacctggccaccaggaactgcctggtgggccagggcctggtggtgaagatcggggactttggcatgagccgggacatctacagcacagactactacagagtgggcggccgcaccatgctgcccatccgctggatgcctcctgagagcatcctgtacaggaagttcaccacagaaagtgatgtgtggagctttggagtggtgctgtgggagatcttcacctacggcaagcagccctggtaccagctgagcaacacagaggccatcgactgcatcacccagggccgggagctggagcggccccgggcctgccccccagaggtgtatgccatcatgaggggctgctggcagcgggagccccagcagaggcacagcatcaaggatgtgcacgcccggctgcaggccctggcccaggcccctcctgtgtacctggatgtgctgggctag

SEQ ID NO: 161776 - DNA, 2517 bp, Artificial Sequence
  Description of Artificial Sequence: Synthetic coding sequence
atgagctcctggatccgctggcacggccctgccatggcccggctgtggggcttctgctggctggtggtgggcttctggagggctgcctttgcctgccccaccagctgcaagtgcagcgccagccgcatctggtgcagcgaccccagccctggcatcgtggccttcccccggctggagcccaacagcgtggaccctgagaacatcacagagatcttcatcgccaaccagaagaggctggagatcatcaatgaagatgatgtggaggcctacgtgggcctgaggaacctgaccatcgtggacagcggcctgaagtttgtggcccacaaggccttcctgaagaacagcaacctgcagcacatcaacttcaccaggaacaagctgaccagcctgagcaggaagcacttccgccacctggacctgtctgagctgatcctggtgggcaaccccttcacctgcagctgtgacatcatgtggatcaagaccctgcaggaggccaagagcagcccagacacccaggacctgtactgcctgaatgaaagcagcaagaacatccccctggccaacctgcagatccccaactgtggcctgcccagcgccaacctggccgcccccaacctgactgtggaggagggcaagagcatcaccctgagctgcagcgtggccggggaccctgtgcccaacatgtactgggatgtgggcaacctggtgtccaagcacatgaatgagaccagccacacccagggcagcctgcgcatcaccaacatcagcagtgatgacagcggcaagcagatcagctgtgtggccgagaacctggtgggggaggaccaggacagcgtgaacctgactgtgcactttgcccccaccatcaccttcctggagagccccaccagtgaccaccactggtgcatccccttcaccgtgaagggcaaccccaagccagccctgcagtggttctacaacggggccatcctgaatgaaagcaagtacatctgcaccaagatccacgtgaccaaccacacagagtaccacggctgcctgcagctggacaaccccacccacatgaacaacggggactacaccctcatcgccaagaatgaatatggcaaggatgagaagcagatcagcgcccacttcatgggctggccaggcattgatgatggagccaaccccaactacccagatgtgatctatgaggactatggaacagctgccaatgacattggagacaccaccaacagaagcaatgagatccccagcacagatgtgacagacaagacaggccgggagcacctgtctgtgtatgctgtggtggtgattgcctctgtggtgggcttctgcctgctggtgatgctgttcctgctgaagctggcccggcacagcaagtttggcatgaaggacttctcctggtttggatttgggaaggtgaagagccggcagggcgtgggccctgccagcgtcatcagcaatgatgatgattctgccagccccctgcaccacatcagcaatggcagcaacacccccagcagcagcgagggcggcccagatgctgtgatcatcggcatgaccaagatccctgtgattgagaacccccagtacttcggcatcaccaacagccagctgaagccagacacctttgtgcagcacatcaagaggcacaacatcgtgctgaagcgggagctgggggagggcgccttcggcaaggtgttcctggccgagtgctacaacctgtgcccagagcaggacaagatcctggtggccgtgaagaccctgaaggatgccagtgacaatgccaggaaggacttccaccgggaggccgagctgctgaccaacctgcagcacgagcacatcgtgaagttctacggcgtgtgtgtggagggggaccccctcatcatggtgtttgagtacatgaagcacggggacctgaacaagttcctgcgggcccacggcccagatgctgtgctgatggccgagggcaaccccccaacagagctgacccagagccagatgctgcacatcgcccagcagattgctgctggcatggtgtacctggccagccagcactttgtgcaccgggacctggccaccaggaactgcctggtgggggagaacctgctggtgaagatcggggactttggcatgagcagagatgtgtacagcacagactactacagagtgggcggccacaccatgctgcccatccgctggatgcctcctgagagcatcatgtacaggaagttcaccacagaaagtgatgtgtggagcctgggcgtggtgctgtgggagatcttcacctacggcaagcagccctggtaccagctgagcaacaatgaggtgattgagtgcatcacccagggccgggtgctgcagaggcccaggacctgcccccaggaggtgtatgagctgatgctgggctgctggcagcgggagccccacatgaggaagaacatcaagggcatccacaccctgctgcagaacctggccaaggccagccctgtgtacctggacatcctgggctag

SEQ ID NO: 161777 - DNA, 1662 bp, Artificial Sequence
  Description of Artificial Sequence: Synthetic coding sequence
atgagctcctggatccgctggcacggccctgccatggcccggctgtggggcttctgctggctggtggtgggcttctggagggctgcctttgcctgccccaccagctgcaagtgcagcgccagccgcatctggtgcagcgaccccagccctggcatcgtggccttcccccggctggagcccaacagcgtggaccctgagaacatcacagagatcttcatcgccaaccagaagaggctggagatcatcaatgaagatgatgtggaggcctacgtgggcctgaggaacctgaccatcgtggacagcggcctgaagtttgtggcccacaaggccttcctgaagaacagcaacctgcagcacatcaacttcaccaggaacaagctgaccagcctgagcaggaagcacttccgccacctggacctgtctgagctgatcctggtgggcaaccccttcacctgcagctgtgacatcatgtggatcaagaccctgcaggaggccaagagcagcccagacacccaggacctgtactgcctgaatgaaagcagcaagaacatccccctggccaacctgcagatccccaactgtggcctgcccagcgccaacctggccgcccccaacctgactgtggaggagggcaagagcatcaccctgagctgcagcgtggccggggaccctgtgcccaacatgtactgggatgtgggcaacctggtgtccaagcacatgaatgagaccagccacacccagggcagcctgcgcatcaccaacatcagcagtgatgacagcggcaagcagatcagctgtgtggccgagaacctggtgggggaggaccaggacagcgtgaacctgactgtgcactttgcccccaccatcaccttcctggagagccccaccagtgaccaccactggtgcatccccttcaccgtgaagggcaaccccaagccagccctgcagtggttctacaacggggccatcctgaatgaaagcaagtacatctgcaccaagatccacgtgaccaaccacacagagtaccacggctgcctgcagctggacaaccccacccacatgaacaacggggactacaccctcatcgccaagaatgaatatggcaaggatgagaagcagatcagcgcccacttcatgggctggccaggcattgatgatggagccaaccccaactacccagatgtgatctatgaggactatggaacagctgccaatgacattggagacaccaccaacagaagcaatgagatccccagcacagatgtgacagacaagacaggccgggagcacctgtctgtgtatgctgtggtggtgattgcctctgtggtgggcttctgcctgctggtgatgctgttcctgctgaagctggcccggcacagcaagtttggcatgaaggacttctcctggtttggatttgggaaggtgaagagccggcagggcgtgggccctgccagcgtcatcagcaatgatgatgattctgccagccccctgcaccacatcagcaatggcagcaacacccccagcagcagcgagggcggcccagatgctgtgatcatcggcatgaccaagatccctgtgattgagaacccccagtacttcggcatcaccaacagccagctgaagccagacacctggccccggggcagccccaagacagcctag

SEQ ID NO: 161778 - DNA, 2469 bp, Artificial Sequence
  Description of Artificial Sequence: Synthetic coding sequence
atgagctcctggatccgctggcacggccctgccatggcccggctgtggggcttctgctggctggtggtgggcttctggagggctgcctttgcctgccccaccagctgcaagtgcagcgccagccgcatctggtgcagcgaccccagccctggcatcgtggccttcccccggctggagcccaacagcgtggaccctgagaacatcacagagatcttcatcgccaaccagaagaggctggagatcatcaatgaagatgatgtggaggcctacgtgggcctgaggaacctgaccatcgtggacagcggcctgaagtttgtggcccacaaggccttcctgaagaacagcaacctgcagcacatcaacttcaccaggaacaagctgaccagcctgagcaggaagcacttccgccacctggacctgtctgagctgatcctggtgggcaaccccttcacctgcagctgtgacatcatgtggatcaagaccctgcaggaggccaagagcagcccagacacccaggacctgtactgcctgaatgaaagcagcaagaacatccccctggccaacctgcagatccccaactgtggcctgcccagcgccaacctggccgcccccaacctgactgtggaggagggcaagagcatcaccctgagctgcagcgtggccggggaccctgtgcccaacatgtactgggatgtgggcaacctggtgtccaagcacatgaatgagaccagccacacccagggcagcctgcgcatcaccaacatcagcagtgatgacagcggcaagcagatcagctgtgtggccgagaacctggtgggggaggaccaggacagcgtgaacctgactgtgcactttgcccccaccatcaccttcctggagagccccaccagtgaccaccactggtgcatccccttcaccgtgaagggcaaccccaagccagccctgcagtggttctacaacggggccatcctgaatgaaagcaagtacatctgcaccaagatccacgtgaccaaccacacagagtaccacggctgcctgcagctggacaaccccacccacatgaacaacggggactacaccctcatcgccaagaatgaatatggcaaggatgagaagcagatcagcgcccacttcatgggctggccaggcattgatgatggagccaaccccaactacccagatgtgatctatgaggactatggaacagctgccaatgacattggagacaccaccaacagaagcaatgagatccccagcacagatgtgacagacaagacaggccgggagcacctgtctgtgtatgctgtggtggtgattgcctctgtggtgggcttctgcctgctggtgatgctgttcctgctgaagctggcccggcacagcaagtttggcatgaagggccctgccagcgtcatcagcaatgatgatgattctgccagccccctgcaccacatcagcaatggcagcaacacccccagcagcagcgagggcggcccagatgctgtgatcatcggcatgaccaagatccctgtgattgagaacccccagtacttcggcatcaccaacagccagctgaagccagacacctttgtgcagcacatcaagaggcacaacatcgtgctgaagcgggagctgggggagggcgccttcggcaaggtgttcctggccgagtgctacaacctgtgcccagagcaggacaagatcctggtggccgtgaagaccctgaaggatgccagtgacaatgccaggaaggacttccaccgggaggccgagctgctgaccaacctgcagcacgagcacatcgtgaagttctacggcgtgtgtgtggagggggaccccctcatcatggtgtttgagtacatgaagcacggggacctgaacaagttcctgcgggcccacggcccagatgctgtgctgatggccgagggcaaccccccaacagagctgacccagagccagatgctgcacatcgcccagcagattgctgctggcatggtgtacctggccagccagcactttgtgcaccgggacctggccaccaggaactgcctggtgggggagaacctgctggtgaagatcggggactttggcatgagcagagatgtgtacagcacagactactacagagtgggcggccacaccatgctgcccatccgctggatgcctcctgagagcatcatgtacaggaagttcaccacagaaagtgatgtgtggagcctgggcgtggtgctgtgggagatcttcacctacggcaagcagccctggtaccagctgagcaacaatgaggtgattgagtgcatcacccagggccgggtgctgcagaggcccaggacctgcccccaggaggtgtatgagctgatgctgggctgctggcagcgggagccccacatgaggaagaacatcaagggcatccacaccctgctgcagaacctggccaaggccagccctgtgtacctggacatcctgggctag

SEQ ID NO: 161779 - DNA, 1434 bp, Artificial Sequence
  Description of Artificial Sequence: Synthetic coding sequence
atgagctcctggatccgctggcacggccctgccatggcccggctgtggggcttctgctggctggtggtgggcttctggagggctgcctttgcctgccccaccagctgcaagtgcagcgccagccgcatctggtgcagcgaccccagccctggcatcgtggccttcccccggctggagcccaacagcgtggaccctgagaacatcacagagatcttcatcgccaaccagaagaggctggagatcatcaatgaagatgatgtggaggcctacgtgggcctgaggaacctgaccatcgtggacagcggcctgaagtttgtggcccacaaggccttcctgaagaacagcaacctgcagcacatcaacttcaccaggaacaagctgaccagcctgagcaggaagcacttccgccacctggacctgtctgagctgatcctggtgggcaaccccttcacctgcagctgtgacatcatgtggatcaagaccctgcaggaggccaagagcagcccagacacccaggacctgtactgcctgaatgaaagcagcaagaacatccccctggccaacctgcagatccccaactgtggcctgcccagcgccaacctggccgcccccaacctgactgtggaggagggcaagagcatcaccctgagctgcagcgtggccggggaccctgtgcccaacatgtactgggatgtgggcaacctggtgtccaagcacatgaatgagaccagccacacccagggcagcctgcgcatcaccaacatcagcagtgatgacagcggcaagcagatcagctgtgtggccgagaacctggtgggggaggaccaggacagcgtgaacctgactgtgcactttgcccccaccatcaccttcctggagagccccaccagtgaccaccactggtgcatccccttcaccgtgaagggcaaccccaagccagccctgcagtggttctacaacggggccatcctgaatgaaagcaagtacatctgcaccaagatccacgtgaccaaccacacagagtaccacggctgcctgcagctggacaaccccacccacatgaacaacggggactacaccctcatcgccaagaatgaatatggcaaggatgagaagcagatcagcgcccacttcatgggctggccaggcattgatgatggagccaaccccaactacccagatgtgatctatgaggactatggaacagctgccaatgacattggagacaccaccaacagaagcaatgagatccccagcacagatgtgacagacaagacaggccgggagcacctgtctgtgtatgctgtggtggtgattgcctctgtggtgggcttctgcctgctggtgatgctgttcctgctgaagctggcccggcacagcaagtttggcatgaagggctttgtgctcttccacaagatccccctggatggatag

SEQ ID NO: 161780 - DNA, 1614 bp, Artificial Sequence
  Description of Artificial Sequence: Synthetic coding sequence
atgagctcctggatccgctggcacggccctgccatggcccggctgtggggcttctgctggctggtggtgggcttctggagggctgcctttgcctgccccaccagctgcaagtgcagcgccagccgcatctggtgcagcgaccccagccctggcatcgtggccttcccccggctggagcccaacagcgtggaccctgagaacatcacagagatcttcatcgccaaccagaagaggctggagatcatcaatgaagatgatgtggaggcctacgtgggcctgaggaacctgaccatcgtggacagcggcctgaagtttgtggcccacaaggccttcctgaagaacagcaacctgcagcacatcaacttcaccaggaacaagctgaccagcctgagcaggaagcacttccgccacctggacctgtctgagctgatcctggtgggcaaccccttcacctgcagctgtgacatcatgtggatcaagaccctgcaggaggccaagagcagcccagacacccaggacctgtactgcctgaatgaaagcagcaagaacatccccctggccaacctgcagatccccaactgtggcctgcccagcgccaacctggccgcccccaacctgactgtggaggagggcaagagcatcaccctgagctgcagcgtggccggggaccctgtgcccaacatgtactgggatgtgggcaacctggtgtccaagcacatgaatgagaccagccacacccagggcagcctgcgcatcaccaacatcagcagtgatgacagcggcaagcagatcagctgtgtggccgagaacctggtgggggaggaccaggacagcgtgaacctgactgtgcactttgcccccaccatcaccttcctggagagccccaccagtgaccaccactggtgcatccccttcaccgtgaagggcaaccccaagccagccctgcagtggttctacaacggggccatcctgaatgaaagcaagtacatctgcaccaagatccacgtgaccaaccacacagagtaccacggctgcctgcagctggacaaccccacccacatgaacaacggggactacaccctcatcgccaagaatgaatatggcaaggatgagaagcagatcagcgcccacttcatgggctggccaggcattgatgatggagccaaccccaactacccagatgtgatctatgaggactatggaacagctgccaatgacattggagacaccaccaacagaagcaatgagatccccagcacagatgtgacagacaagacaggccgggagcacctgtctgtgtatgctgtggtggtgattgcctctgtggtgggcttctgcctgctggtgatgctgttcctgctgaagctggcccggcacagcaagtttggcatgaagggccctgccagcgtcatcagcaatgatgatgattctgccagccccctgcaccacatcagcaatggcagcaacacccccagcagcagcgagggcggcccagatgctgtgatcatcggcatgaccaagatccctgtgattgagaacccccagtacttcggcatcaccaacagccagctgaagccagacacctggccccggggcagccccaagacagcctag

SEQ ID NO: 161781 - DNA, 2469 bp, Artificial Sequence; identical to SEQ ID NO: 161778
  Description of Artificial Sequence: Synthetic coding sequence

SEQ ID NO: 161782 - DNA, 2517 bp, Artificial Sequence; identical to SEQ ID NO: 161776
  Description of Artificial Sequence: Synthetic coding sequence

SEQ ID NO: 161783 - DNA, 966 bp, Artificial Sequence
  Description of Artificial Sequence: Synthetic coding sequence
atgtggatcaagaccctgcaggaggccaagagcagcccagacacccaggacctgtactgcctgaatgaaagcagcaagaacatccccctggccaacctgcagatccccaactgtggcctgcccagcgccaacctggccgcccccaacctgactgtggaggagggcaagagcatcaccctgagctgcagcgtggccggggaccctgtgcccaacatgtactgggatgtgggcaacctggtgtccaagcacatgaatgagaccagccacacccagggcagcctgcgcatcaccaacatcagcagtgatgacagcggcaagcagatcagctgtgtggccgagaacctggtgggggaggaccaggacagcgtgaacctgactgtgcactttgcccccaccatcaccttcctggagagccccaccagtgaccaccactggtgcatccccttcaccgtgaagggcaaccccaagccagccctgcagtggttctacaacggggccatcctgaatgaaagcaagtacatctgcaccaagatccacgtgaccaaccacacagagtaccacggctgcctgcagctggacaaccccacccacatgaacaacggggactacaccctcatcgccaagaatgaatatggcaaggatgagaagcagatcagcgcccacttcatgggctggccaggcattgatgatggagccaaccccaactacccagatgtgatctatgaggactatggaacagctgccaatgacattggagacaccaccaacagaagcaatgagatccccagcacagatgtgacagacaagacaggccgggagcacctgtctgtgtatgctgtggtggtgattgcctctgtggtgggcttctgcctgctggtgatgctgttcctgctgaagctggcccggcacagcaagtttggcatgaagggctttgtgctcttccacaagatccccctggatggatag

SEQ ID NO: 161784 - DNA, 1434 bp, Artificial Sequence; identical to SEQ ID NO: 161779
  Description of Artificial Sequence: Synthetic coding sequence

SEQ ID NO: 161785 - DNA, 1839 bp, Artificial Sequence
  Description of Artificial Sequence: Synthetic coding sequence
atggatgtgtccctgtgcccagccaagtgcagcttctggaggatcttcctgctgggctctgtgtggctggactatgtgggctctgtgctggcctgcccagccaactgtgtgtgcagcaagacagagatcaactgccggcggccagatgatggcaacctcttccccctgctggagggccaggacagcggcaacagcaatggaaatgccagcatcaacatcacagacatcagcaggaacatcaccagcatccacatcgagaactggaggagcctgcacaccctgaatgctgtggacatggagctgtacacaggcctgcagaagctgaccatcaagaacagcggcctgcggagcatccagccccgggcctttgccaagaacccccacctgcgctacatcaacctgagcagcaaccggctgaccaccctgtcctggcagctgttccagaccctgagcctgcgggagctgcagctggagcagaacttcttcaactgcagctgtgacatccgctggatgcagctgtggcaggagcagggcgaggccaagctgaacagccagaacctgtactgcatcaatgctgatggcagccagctgcccctcttcaggatgaacatcagccagtgtgacctgcctgagatctctgtgagccacgtgaacctgactgtgcgggagggggacaatgctgtgatcacctgcaatggcagcggcagccccctgcctgatgtggactggatcgtgacaggcctgcagagcatcaacacccaccagaccaacctgaactggaccaacgtgcacgccatcaacctgaccctggtgaatgtgaccagcgaggacaatggcttcaccctgacctgcatcgcagaaaatgtggtgggcatgagcaatgcctctgtggccctgactgtgtactacccaccccgggtggtgtccctggaggagcctgagctgcggctggagcactgcattgaatttgtggtgcggggcaaccccccacccaccctgcactggctgcacaacggccagcccctgcgggagagcaagatcatccacgtggagtactaccaggagggggagatcagcgagggctgcctgctcttcaacaagcccacccactacaacaatggaaactacaccctgattgccaagaaccccctgggcacagccaaccagaccatcaatggccacttcctgaaggagcccttccctgagagcacagacaacttcatcctgtttgatgaggtgagccccaccccacccatcaccgtgacccacaagccagaggaggacaccttcggcgtgtccattgctgtgggcctggccgcctttgcctgtgtgctgctggtggtgctgtttgtgatgatcaacaagtatggccgccgcagcaagtttggcatgaagggccctgtggccgtcatcagcggggaggaggacagcgccagccccctgcaccacatcaaccacggcatcaccacccccagcagcctggatgctggccctgacacagtggtgattggcatgacccgcatccctgtgattgagaacccccagtacttccggcagggccacaactgccacaagccagacacctgggtgttcagcaacatcgacaaccacggcatcctgaacctgaaggacaacagagaccacctggtgcccagcacccactacatctatgaggagcctgaggtgcagagcggggaggtgtcctaccccaggagccacggcttccgggagatcatgctgaaccccatcagcctgcccggccacagcaagcccctgaaccacggcatctacgtggaggatgtgaatgtgtacttcagcaagggccgccacggcttctag

SEQ ID NO: 161786 - DNA, 414 bp, Artificial Sequence
  Description of Artificial Sequence: Synthetic coding sequence
atgacccgcatccctgtgattgagaacccccagtacttccggcagggccacaactgccacaagccagacacctacgtgcagcacatcaagagaagagacatcgtgctgaagcgggagctgggggagggcgccttcggcaaggtgttcctggccgagtgctacaacctgagccccaccaaggacaagatgctggtggccgtgaaggccctgaaggaccccaccctggccgccaggaaggacttccagcgggaggccgagctgctgaccaacctgcagcacgagcacatcgtgaagttctacggcgtgtgtggagatggagaccccctcatcatggtgtttgagtacatgaagcacggggacctgaacaagttcctgagcagcatcagcagccccaagagccaccagcagggctag

SEQ ID NO: 161787 - DNA, 2478 bp, Artificial Sequence
  Description of Artificial Sequence: Synthetic coding sequence
atggatgtgtccctgtgcccagccaagtgcagcttctggaggatcttcctgctgggctctgtgtggctggactatgtgggctctgtgctggcctgcccagccaactgtgtgtgcagcaagacagagatcaactgccggcggccagatgatggcaacctcttccccctgctggagggccaggacagcggcaacagcaatggaaatgccagcatcaacatcacagacatcagcaggaacatcaccagcatccacatcgagaactggaggagcctgcacaccctgaatgctgtggacatggagctgtacacaggcctgcagaagctgaccatcaagaacagcggcctgcggagcatccagccccgggcctttgccaagaacccccacctgcgctacatcaacctgagcagcaaccggctgaccaccctgtcctggcagctgttccagaccctgagcctgcgggagctgcagctggagcagaacttcttcaactgcagctgtgacatccgctggatgcagctgtggcaggagcagggcgaggccaagctgaacagccagaacctgtactgcatcaatgctgatggcagccagctgcccctcttcaggatgaacatcagccagtgtgacctgcctgagatctctgtgagccacgtgaacctgactgtgcgggagggggacaatgctgtgatcacctgcaatggcagcggcagccccctgcctgatgtggactggatcgtgacaggcctgcagagcatcaacacccaccagaccaacctgaactggaccaacgtgcacgccatcaacctgaccctggtgaatgtgaccagcgaggacaatggcttcaccctgacctgcatcgcagaaaatgtggtgggcatgagcaatgcctctgtggccctgactgtgtactacccaccccgggtggtgtccctggaggagcctgagctgcggctggagcactgcattgaatttgtggtgcggggcaaccccccacccaccctgcactggctgcacaacggccagcccctgcgggagagcaagatcatccacgtggagtactaccaggagggggagatcagcgagggctgcctgctcttcaacaagcccacccactacaacaatggaaactacaccctgattgccaagaaccccctgggcacagccaaccagaccatcaatggccacttcctgaaggagcccttccctgagagcacagacaacttcatcctgtttgatgaggtgagccccaccccacccatcaccgtgacccacaagccagaggaggacaccttcggcgtgtccattgctgtgggcctggccgcctttgcctgtgtgctgctggtggtgctgtttgtgatgatcaacaagtatggccgccgcagcaagtttggcatgaagggccctgtggccgtcatcagcggggaggaggacagcgccagccccctgcaccacatcaaccacggcatcaccacccccagcagcctggatgctggccctgacacagtggtgattggcatgacccgcatccctgtgattgagaacccccagtacttccggcagggccacaactgccacaagccagacacctacgtgcagcacatcaagagaagagacatcgtgctgaagcgggagctgggggagggcgccttcggcaaggtgttcctggccgagtgctacaacctgagccccaccaaggacaagatgctggtggccgtgaaggccctgaaggaccccaccctggccgccaggaaggacttccagcgggaggccgagctgctgaccaacctgcagcacgagcacatcgtgaagttctacggcgtgtgtggagatggagaccccctcatcatggtgtttgagtacatgaagcacggggacctgaacaagttcctgcgggcccacggcccagatgccatgatcctggtggatggccagccccggcaggccaagggggagctgggcctgagccagatgctgcacatcgccagccagatcgccagcggcatggtgtacctggccagccagcactttgtgcaccgggacctggccaccaggaactgcctggtgggcgccaacctgctggtgaagattggagactttggcatgagcagagatgtgtacagcacagactactacagagtgggcggccacaccatgctgcccatccgctggatgcctcctgagagcatcatgtacaggaagttcaccacagaaagtgatgtgtggagctttggagtcatcctgtgggagatcttcacctacggcaagcagccctggttccagctgagcaacacagaggtgattgagtgcatcacccagggccgggtgctggagcggccccgggtgtgccccaaggaggtgtatgatgtgatgctgggctgctggcagcgggagccccagcagaggctgaacatcaaggagatctacaagatcctgcacgccctgggcaaggccacccccatctacctggacatcctgggctag

SEQ ID NO: 161788 - DNA, 2496 bp, Artificial Sequence
  Description of Artificial Sequence: Synthetic coding sequence
atggatgtgtccctgtgcccagccaagtgcagcttctggaggatcttcctgctgggctctgtgtggctggactatgtgggctctgtgctggcctgcccagccaactgtgtgtgcagcaagacagagatcaactgccggcggccagatgatggcaacctcttccccctgctggagggccaggacagcggcaacagcaatggaaatgccagcatcaacatcacagacatcagcaggaacatcaccagcatccacatcgagaactggaggagcctgcacaccctgaatgctgtggacatggagctgtacacaggcctgcagaagctgaccatcaagaacagcggcctgcggagcatccagccccgggcctttgccaagaacccccacctgcgctacatcaacctgagcagcaaccggctgaccaccctgtcctggcagctgttccagaccctgagcctgcgggagctgcagctggagcagaacttcttcaactgcagctgtgacatccgctggatgcagctgtggcaggagcagggcgaggccaagctgaacagccagaacctgtactgcatcaatgctgatggcagccagctgcccctcttcaggatgaacatcagccagtgtgacctgcctgagatctctgtgagccacgtgaacctgactgtgcgggagggggacaatgctgtgatcacctgcaatggcagcggcagccccctgcctgatgtggactggatcgtgacaggcctgcagagcatcaacacccaccagaccaacctgaactggaccaacgtgcacgccatcaacctgaccctggtgaatgtgaccagcgaggacaatggcttcaccctgacctgcatcgcagaaaatgtggtgggcatgagcaatgcctctgtggccctgactgtgtactacccaccccgggtggtgtccctggaggagcctgagctgcggctggagcactgcattgaatttgtggtgcggggcaaccccccacccaccctgcactggctgcacaacggccagcccctgcgggagagcaagatcatccacgtggagtactaccaggagggggagatcagcgagggctgcctgctcttcaacaagcccacccactacaacaatggaaactacaccctgattgccaagaaccccctgggcacagccaaccagaccatcaatggccacttcctgaaggagcccttccctgtggatgaggtgagccccaccccacccatcaccgtgacccacaagccagaggaggacaccttcggcgtgtccattgctgtgggcctggccgcctttgcctgtgtgctgctggtggtgctgtttgtgatgatcaacaagtatggccgccgcagcaagtttggcatgaagggccctgtggccgtcatcagcggggaggaggacagcgccagccccctgcaccacatcaaccacggcatcaccacccccagcagcctggatgctggccctgacacagtggtgattggcatgacccgcatccctgtgattgagaacccccagtacttccggcagggccacaactgccacaagccagacacctacgtgcagcacatcaagagaagagacatcgtgctgaagcgggagctgggggagggcgccttcggcaaggtgttcctggccgagtgctacaacctgagccccaccaaggacaagatgctggtggccgtgaaggccctgaaggaccccaccctggccgccaggaaggacttccagcgggaggccgagctgctgaccaacctgcagcacgagcacatcgtgaagttctacggcgtgtgtggagatggagaccccctcatcatggtgtttgagtacatgaagcacggggacctgaacaagttcctgcgggcccacggcccagatgccatgatcctggtggatggccagccccggcaggccaagggggagctgggcctgagccagatgctgcacatcgccagccagatcgccagcggcatggtgtacctggccagccagcactttgtgcaccgggacctggccaccaggaactgcctggtgggcgccaacctgctggtgaagattggagactttggcatgagcagagatgtgtacagcacagactactaccgcctcttcaaccccagcggaaatgacttctgcatctggtgtgaggtgggcggccacaccatgctgcccatccgctggatgcctcctgagagcatcatgtacaggaagttcaccacagaaagtgatgtgtggagctttggagtcatcctgtgggagatcttcacctacggcaagcagccctggttccagctgagcaacacagaggtgattgagtgcatcacccagggccgggtgctggagcggccccgggtgtgccccaaggaggtgtatgatgtgatgctgggctgctggcagcgggagccccagcagaggctgaacatcaaggagatctacaagatcctgcacgccctgggcaaggccacccccatctacctggacatcctgggctag

SEQ ID NO: 161789 - DNA, 2520 bp, Artificial Sequence
  Description of Artificial Sequence: Synthetic coding sequence
atggatgtgtccctgtgcccagccaagtgcagcttctggaggatcttcctgctgggctctgtgtggctggactatgtgggctctgtgctggcctgcccagccaactgtgtgtgcagcaagacagagatcaactgccggcggccagatgatggcaacctcttccccctgctggagggccaggacagcggcaacagcaatggaaatgccagcatcaacatcacagacatcagcaggaacatcaccagcatccacatcgagaactggaggagcctgcacaccctgaatgctgtggacatggagctgtacacaggcctgcagaagctgaccatcaagaacagcggcctgcggagcatccagccccgggcctttgccaagaacccccacctgcgctacatcaacctgagcagcaaccggctgaccaccctgtcctggcagctgttccagaccctgagcctgcgggagctgcagctggagcagaacttcttcaactgcagctgtgacatccgctggatgcagctgtggcaggagcagggcgaggccaagctgaacagccagaacctgtactgcatcaatgctgatggcagccagctgcccctcttcaggatgaacatcagccagtgtgacctgcctgagatctctgtgagccacgtgaacctgactgtgcgggagggggacaatgctgtgatcacctgcaatggcagcggcagccccctgcctgatgtggactggatcgtgacaggcctgcagagcatcaacacccaccagaccaacctgaactggaccaacgtgcacgccatcaacctgaccctggtgaatgtgaccagcgaggacaatggcttcaccctgacctgcatcgcagaaaatgtggtgggcatgagcaatgcctctgtggccctgactgtgtactacccaccccgggtggtgtccctggaggagcctgagctgcggctggagcactgcattgaatttgtggtgcggggcaaccccccacccaccctgcactggctgcacaacggccagcccctgcgggagagcaagatcatccacgtggagtactaccaggagggggagatcagcgagggctgcctgctcttcaacaagcccacccactacaacaatggaaactacaccctgattgccaagaaccccctgggcacagccaaccagaccatcaatggccacttcctgaaggagcccttccctgagagcacagacaacttcatcctgtttgatgaggtgagccccaccccacccatcaccgtgacccacaagccagaggaggacaccttcggcgtgtccattgctgtgggcctggccgcctttgcctgtgtgctgctggtggtgctgtttgtgatgatcaacaagtatggccgccgcagcaagtttggcatgaagggccctgtggccgtcatcagcggggaggaggacagcgccagccccctgcaccacatcaaccacggcatcaccacccccagcagcctggatgctggccctgacacagtggtgattggcatgacccgcatccctgtgattgagaacccccagtacttccggcagggccacaactgccacaagccagacacctacgtgcagcacatcaagagaagagacatcgtgctgaagcgggagctgggggagggcgccttcggcaaggtgttcctggccgagtgctacaacctgagccccaccaaggacaagatgctggtggccgtgaaggccctgaaggaccccaccctggccgccaggaaggacttccagcgggaggccgagctgctgaccaacctgcagcacgagcacatcgtgaagttctacggcgtgtgtggagatggagaccccctcatcatggtgtttgagtacatgaagcacggggacctgaacaagttcctgcgggcccacggcccagatgccatgatcctggtggatggccagccccggcaggccaagggggagctgggcctgagccagatgctgcacatcgccagccagatcgccagcggcatggtgtacctggccagccagcactttgtgcaccgggacctggccaccaggaactgcctggtgggcgccaacctgctggtgaagattggagactttggcatgagcagagatgtgtacagcacagactactaccgcctcttcaaccccagcggaaatgacttctgcatctggtgtgaggtgggcggccacaccatgctgcccatccgctggatgcctcctgagagcatcatgtacaggaagttcaccacagaaagtgatgtgtggagctttggagtcatcctgtgggagatcttcacctacggcaagcagccctggttccagctgagcaacacagaggtgattgagtgcatcacccagggccgggtgctggagcggccccgggtgtgccccaaggaggtgtatgatgtgatgctgggctgctggcagcgggagccccagcagaggctgaacatcaaggagatctacaagatcctgcacgccctgggcaaggccacccccatctacctggacatcctgggctag

SEQ ID NO: 161790 - DNA, 2478 bp, Artificial Sequence; identical to SEQ ID NO: 161787
  Description of Artificial Sequence: Synthetic coding sequence

SEQ ID NO: 161791 - DNA, 1839 bp, Artificial Sequence; identical to SEQ ID NO: 161785
  Description of Artificial Sequence: Synthetic coding sequence

SEQ ID NO: 161792 - DNA, 1854 bp, Artificial Sequence
  Description of Artificial Sequence: Synthetic coding sequence
atggagctgtacacaggcctgcagaagctgaccatcaagaacagcggcctgcggagcatccagccccgggcctttgccaagaacccccacctgcgctacatcaacctgagcagcaaccggctgaccaccctgtcctggcagctgttccagaccctgagcctgcgggagctgcagctggagcagaacttcttcaactgcagctgtgacatccgctggatgcagctgtggcaggagcagggcgaggccaagctgaacagccagaacctgtactgcatcaatgctgatggcagccagctgcccctcttcaggatgaacatcagccagtgtgacctgcctgagatctctgtgagccacgtgaacctgactgtgcgggagggggacaatgctgtgatcacctgcaatggcagcggcagccccctgcctgatgtggactggatcgtgacaggcctgcagagcatcaacacccaccagaccaacctgaactggaccaacgtgcacgccatcaacctgaccctggtgaatgtgaccagcgaggacaatggcttcaccctgacctgcatcgcagaaaatgtggtgggcatgagcaatgcctctgtggccctgactgtgtactacccaccccgggtggtgtccctggaggagcctgagctgcggctggagcactgcattgaatttgtggtgcggggcaaccccccacccaccctgcactggctgcacaacggccagcccctgcgggagagcaagatcatccacgtggagtactaccaggagggggagatcagcgagggctgcctgctcttcaacaagcccacccactacaacaatggaaactacaccctgattgccaagaaccccctgggcacagccaaccagaccatcaatggccacttcctgaaggagcccttccctgagagcacagacaacttcatcctgtttgatgaggtgagccccaccccacccatcaccgtgacccacaagccagaggaggacaccttcggcgtgtccattgctgtgggcctggccgcctttgcctgtgtgctgctggtggtgctgtttgtgatgatcaacaagtatggccgccgcagcaagtttggcatgaagggccctgtggccgtcatcagcggggaggaggacagcgccagccccctgcaccacatcaaccacggcatcaccacccccagcagcctggatgctggccctgacacagtggtgattggcatgacccgcatccctgtgattgagaacccccagtacttccggcagggccacaactgccacaagccagacacctacgtgcagcacatcaagagaagagacatcgtgctgaagcgggagctgggggagggcgccttcggcaaggtgttcctggccgagtgctacaacctgagccccaccaaggacaagatgctggtggccgtgaaggccctgaaggaccccaccctggccgccaggaaggacttccagcgggaggccgagctgctgaccaacctgcagcacgagcacatcgtgaagttctacggcgtgtgtggagatggagaccccctcatcatggtgtttgagtacatgaagcacggggacctgaacaagttcctgcgggcccacggcccagatgccatgatcctggtggatggccagccccggcaggccaagggggagctgggcctgagccagatgctgcacatcgccagccagatcgccagcggcatggtgtacctggccagccagcactttgtgcaccgggacctggccaccaggaactgcctggtgggcgccaacctgctggtgaagattggagactttggcatgagcagagatgtgtacagcacagactactacagagtggtgcaggcctag

SEQ ID NO: 161793 - DNA, 774 bp, Artificial Sequence
  Description of Artificial Sequence: Synthetic coding sequence
atgagcatcctcttctacgtgatcttcctggcctacctgcggggcatccagggcaacaacatggaccagaggagcctgcctgaggacagcctgaacagcctcatcatcaagctgatccaggccgacatcctgaagaacaagctgagcaagcagatggtggatgtgaaggagaactaccagagcaccctgcccaaggccgaggccccccgggagcctgagcggggcggccctgccaagagcgccttccagcccgtcatcgccatggacacagagctgctgcggcagcagaggcgctacaacagcccccgggtgctgctgagtgacagcacccccctggagcccccacccctgtacctgatggaggactatgtgggcagccctgtggtggccaacagaaccagcaggaggaagagatatgcagagcacaagagccacagaggagagtacagcgtgtgtgacagcgagagcctgtgggtgacagacaagagcagcgccatcgacatccggggccaccaggtgacagtgctgggggagatcaagacaggcaacagccctgtgaagcagtacttctatgagacccgctgcaaggaggcccggcctgtgaagaatggctgccggggcattgatgacaagcactggaacagccagtgcaagaccagccagacctacgtgcgggccctgaccagcgagaacaacaagctggtgggctggcgctggatcagaattgacaccagctgtgtgtgtgccctgagcaggaagattggccgcacctag

SEQ ID NO: 161794 - DNA, 813 bp, Artificial Sequence
  Description of Artificial Sequence: Synthetic coding sequence
atggtgacctttgccaccatcctgcaggtgaacaaggtgatgagcatcctcttctacgtgatcttcctggcctacctgcggggcatccagggcaacaacatggaccagaggagcctgcctgaggacagcctgaacagcctcatcatcaagctgatccaggccgacatcctgaagaacaagctgagcaagcagatggtggatgtgaaggagaactaccagagcaccctgcccaaggccgaggccccccgggagcctgagcggggcggccctgccaagagcgccttccagcctgtgattgccatggacacagagctgctgcggcagcagaggcgctacaacagcccccgggtgctgctgagtgacagcacccccctggagcccccacccctgtacctgatggaggactatgtgggcagccctgtggtggccaacagaaccagcaggaggaagagatatgcagagcacaagagccacagaggagagtacagcgtgtgtgacagcgagagcctgtgggtgacagacaagagcagcgccatcgacatccggggccaccaggtgacagtgctgggggagatcaagacaggcaacagccctgtgaagcagtacttctatgagacccgctgcaaggaggcccggcctgtgaagaatggctgccggggcattgatgacaagcactggaacagccagtgcaagaccagccagacctacgtgcgggccctgaccagcgagaacaacaagctggtgggctggcgctggatcagaattgacaccagctgtgtgtgtgccctgagcaggaagattggaagaacatag

SEQ ID NO: 161795 - DNA, 633 bp, Artificial Sequence
  Description of Artificial Sequence: Synthetic coding sequence
atgctgcccctgcccagctgcagcctgcccatcctgctgctcttcctgctgcccagcgtgcccatcgagagccagcccccacccagcaccctgccccccttcctggcccctgagtgggacctgctgagcccccgggtggtgctgagcagaggagccccagctggcccccccctgctcttcctgctggaggccggggccttccgggagagcgctggggccccagccaacagaagcagaagaggagtgtctgaaacagccccagccagccggcggggggagctggccgtgtgtgatgctgtgtctggctgggtgacagacagaagaacagctgtggacctgcggggccgggaggtggaggtgctgggggaggtgcctgctgctgggggcagccccctgcggcagtacttctttgagacccgctgcaaggctgacaatgctgaggagggcggccctggagctgggggcggcggctgccggggcgtggacagaagacactgggtgtctgagtgcaaggccaagcagagctatgtgcgggccctgacagcagatgcccagggccgggtgggctggcgctggatcagaattgacacagcctgtgtgtgcaccctgctgagcaggacaggccgggcctag

SEQ ID NO: 161796 - DNA, 594 bp, Artificial Sequence
  Description of Artificial Sequence: Synthetic coding sequence
atgcagcgctggaaggctgctgccctggcctctgtgctgtgcagctctgtgctgagcatctggatgtgccgggagggcctgctgctgagccaccggctgggccctgccctggtgcccctgcaccggctgcccaggaccctggatgccagaattgcccggctggcccagtaccgggccctgctgcagggcgccccagatgccatggagctgcgggagctgaccccctgggccggccggcccccaggccccaggagaagagctggccccaggagaagaagagcccgggcccggctgggcgcccggccctgtggcctgcgggagctggaggtgcgggtgtctgagctgggcctgggctacgccagtgatgagaccgtgctcttccgctactgtgccggggcctgtgaggccgccgcccgggtgtatgacctgggcctgcggcggctgcggcagaggcggcggctgcggcgggagcgggtgcgggcccagccctgctgccggcccacagcctatgaagatgaggtgtccttcctggatgcccacagccgctaccacacagtgcatgagctgagcgccagagaatgtgcctgtgtgtag

SEQ ID NO: 161797 - DNA, 1323 bp, Artificial Sequence
  Description of Artificial Sequence: Synthetic coding sequence
atgagcagctgccggggccagaaggtggccggcggcctgcgggtggtgagccccttccccctgtgccagcctgctggggagcccagccagggcaagatgaggagcagctgtgtgctgctgacagccctggtggccctggccgcctactacgtgtacatccccctgcccggctctgtgtctgacccctggaagctgatgctgctggatgccaccttccggggggcccagcaggtgagcaacctgatccactacctgggcctgagccaccacctgctggccctgaacttcatcatcgtgtcctttgggaagaagagcgcctggagcagcgcccaggtgaaggtgacagacacagactttgatggagtggaggtgcgggtgtttgagggcccccccaagccagaggagcccctgaagaggtctgtggtgtacatccatggaggcggctgggccctggccagcgccaagatccgctactatgatgagctgtgcacagccatggccgaggagctgaatgctgtgattgtgtccattgagtaccgcctggtgcccaaggtgtacttccctgagcagatccatgatgtggtgcgggccaccaagtacttcctgaagccagaggtgctgcagaagtacatggtggaccccggccgcatctgcatcagcggggacagcgctgggggcaacctggccgccgccctgggccagcagttcacccaggatgccagcctgaagaacaagctgaagctgcaggccctgatctaccctgtgctgcaggccctggacttcaacacccccagctaccagcagaatgtgaacacccccatcctgccccgctacgtgatggtgaagtactgggtggactacttcaagggcaactatgactttgtgcaggccatgattgtgaacaaccacaccagcctggatgtggaggaggccgctgctgtgcgggcccggctgaactggaccagcctgctgcctgccagcttcaccaagaactacaagcctgtggtgcagaccactggaaatgcccgcatcgtgcaggagctgccccagctgctggatgcccggagcgcccccctgattgctgaccaggccgtgctgcagctgctgcccaagacctacatcctgacctgtgaacatgatgtgctgagagatgatggcatcatgtatgccaagaggctggagagcgctggggtggaggtgaccctggaccactttgaagatggcttccacggctgcatgatcttcacctcctggcccaccaacttctctgtgggcatccgcaccagaaattcctacatcaagtggctggaccagaacctgtag

SEQ ID NO: 161798 - DNA, 1227 bp, Artificial Sequence
  Description of Artificial Sequence: Synthetic coding sequence
atgaggagcagctgtgtgctgctgacagccctggtggccctggccgcctactacgtgtacatccccctgcccggctctgtgtctgacccctggaagctgatgctgctggatgccaccttccggggggcccagcaggtgagcaacctgatccactacctgggcctgagccaccacctgctggccctgaacttcatcatcgtgtcctttgggaagaagagcgcctggagcagcgcccaggtgaaggtgacagacacagactttgatggagtggaggtgcgggtgtttgagggcccccccaagccagaggagcccctgaagaggtctgtggtgtacatccatggaggcggctgggccctggccagcgccaagatccgctactatgatgagctgtgcacagccatggccgaggagctgaatgctgtgattgtgtccattgagtaccgcctggtgcccaaggtgtacttccctgagcagatccatgatgtggtgcgggccaccaagtacttcctgaagccagaggtgctgcagaagtacatggtggaccccggccgcatctgcatcagcggggacagcgctgggggcaacctggccgccgccctgggccagcagttcacccaggatgccagcctgaagaacaagctgaagctgcaggccctgatctaccctgtgctgcaggccctggacttcaacacccccagctaccagcagaatgtgaacacccccatcctgccccgctacgtgatggtgaagtactgggtggactacttcaagggcaactatgactttgtgcaggccatgattgtgaacaaccacaccagcctggatgtggaggaggccgctgctgtgcgggcccggctgaactggaccagcctgctgcctgccagcttcaccaagaactacaagcctgtggtgcagaccactggaaatgcccgcatcgtgcaggagctgccccagctgctggatgcccggagcgcccccctgattgctgaccaggccgtgctgcagctgctgcccaagacctacatcctgacctgtgaacatgatgtgctgagagatgatggcatcatgtatgccaagaggctggagagcgctggggtggaggtgaccctggaccactttgaagatggcttccacggctgcatgatcttcacctcctggcccaccaacttctctgtgggcatccgcaccagaaattcctacatcaagtggctggaccagaacctgtag

SEQ ID NO: 161799 - DNA, 1347 bp, Artificial Sequence
  Description of Artificial Sequence: Synthetic coding sequence
atgagcagctgccggggccagaaggtggccggcggcctgcgggtggtgagccccttccccctgtgccagcctgctggggagcccagccagggcaagatgaggagcagctgtgtgctgctgacagccctggtggccctggccgcctactacgtgtacatccccctgcccggctctgtgtctgacccctggaagctgatgctgctggatgccaccttccggggggcccagcaggtgagcaacctgatccactacctgggcctgagccaccacctgctggccctgaacttcatcatcgtgtcctttgggaagaagagcgcctggagcagcgcccaggtgaaggtgacagacacagactttgatggagtggaggtgcgggtgtttgagggcccccccaagccagaggagcccctgaagaggtctgtggtgtacatccatggaggcggctgggccctggccagcgccagcgcctcctggagccccagtgatgagatccgctactatgatgagctgtgcacagccatggccgaggagctgaatgctgtgattgtgtccattgagtaccgcctggtgcccaaggtgtacttccctgagcagatccatgatgtggtgcgggccaccaagtacttcctgaagccagaggtgctgcagaagtacatggtggaccccggccgcatctgcatcagcggggacagcgctgggggcaacctggccgccgccctgggccagcagttcacccaggatgccagcctgaagaacaagctgaagctgcaggccctgatctaccctgtgctgcaggccctggacttcaacacccccagctaccagcagaatgtgaacacccccatcctgccccgctacgtgatggtgaagtactgggtggactacttcaagggcaactatgactttgtgcaggccatgattgtgaacaaccacaccagcctggatgtggaggaggccgctgctgtgcgggcccggctgaactggaccagcctgctgcctgccagcttcaccaagaactacaagcctgtggtgcagaccactggaaatgcccgcatcgtgcaggagctgccccagctgctggatgcccggagcgcccccctgattgctgaccaggccgtgctgcagctgctgcccaagacctacatcctgacctgtgaacatgatgtgctgagagatgatggcatcatgtatgccaagaggctggagagcgctggggtggaggtgaccctggaccactttgaagatggcttccacggctgcatgatcttcacctcctggcccaccaacttctctgtgggcatccgcaccagaaattcctacatcaagtggctggaccagaacctgtag

SEQ ID NO: 161800 - DNA, 828 bp, Artificial Sequence
  Description of Artificial Sequence: Synthetic coding sequence
atggccgaggagctgaatgctgtgattgtgtccattgagtaccgcctggtgcccaaggtgtacttccctgagcagatccatgatgtggtgcgggccaccaagtacttcctgaagccagaggtgctgcagaagtacatggtggaccccggccgcatctgcatcagcggggacagcgctgggggcaacctggccgccgccctgggccagcagttcacccaggatgccagcctgaagaacaagctgaagctgcaggccctgatctaccctgtgctgcaggccctggacttcaacacccccagctaccagcagaatgtgaacacccccatcctgcccaggtatgtgatggtgaagtactgggtggactacttcaagggcaactatgactttgtgcaggccatgattgtgaacaaccacaccagcctggatgtggaggaggccgctgctgtgcgggcccggctgaactggaccagcctgctgcctgccagcttcaccaagaactacaagcctgtggtgcagaccactggaaatgccagaattgtgcaggagctgccccagctgctggatgcccggagcgcccccctgattgctgaccaggccgtgctgcagctgctgcccaagacctacatcctgacctgtgaacatgatgtgctgagagatgatggcatcatgtatgccaagaggctggagagcgctggggtggaggtgaccctggaccactttgaagatggcttccacggctgcatgatcttcacctcctggcccaccaacttctctgtgggcatccgcaccaggaacagctacatcaagtggctggaccagaacctgtag

SEQ ID NO: 161801 - DNA, 2754 bp, Artificial Sequence
  Description of Artificial Sequence: Synthetic coding sequence
atggccttcatcaggaagaagcagcaggagcagcagctgcagctgtacagcaaggagcgcttcagcctgctgctgctgaacctggaggagtactactttgagcagcaccgggccaaccacatcctgcacaagggcagccaccacgagaggaagatccggggcagcctgaagatctgcagcaagagcgtcatctttgagccagacagcatcagccagcccatcatcaagatccccctgcgggactgcatcaagattggcaagcacggggagaatggagccaacagacacttcaccaaggccaagagcggcggcatcagcctcatcttcagccaggtgtacttcatcaaggagcacaacgtggtggccccctacaagattgaaagaggcaagatggagtatgtgtttgagctggatgtgcctgggaaggtggaggatgtggtggagaccctgctgcagctgcaccgggccagctgcctggacaagctgggggaccagacagccatgatcacagccatcctgcagagccggctggcccggaccagctttgacaagaaccgcttccagaacatcagcgagaagctgcacatggagtgcaaggccgagatggtgacccccctggtgaccaaccctggccacgtgtgcatcacagacaccaacctgtacttccagcccctgaatggctaccccaagcctgtggtgcagatcaccctgcaggatgtgcggcgcatctacaagagaagacatggcctgatgcccctgggcctggaggtgttctgcacagaagatgacctgtgcagcgacatctacctgaagttctatgagccccaggacagagatgacctgtacttctacatcgccacctacctggagcaccacgtggccgagcacacagctgagagctacatgctgcagtggcagaggggccacctgagcaactaccagtacctgctgcacctgaacaacctggccgacaggagctgcaatgacctgagccagtaccctgtgttcccctggatcatccatgactacagcagcagcgagctggacctgagcaaccctggcaccttccgggacctgagcaagcctgtgggcgccctgaacaaggagcggctggagcggctgctgacccgctaccaggagatgcctgagcccaagttcatgtatggcagccactacagcagccctggctacgtgctcttctacctggtgagaattgcccctgagtacatgctgtgcctgcagaatggccgctttgacaatgctgacaggatgttcaacagcattgctgagacctggaagaactgcctggatggagccacagacttcaaggagctgatccctgagttctatggagatgatgtgtccttcctggtgaacagcctgaagctggacctgggcaagaggcagggcggccagatggtggatgatgtggagctgcccccctgggccagcagccctgaggacttcctgcagaagagcaaggatgccctggagagcaactacgtgtctgagcacctgcacgagtggattgacctgatcttcggctacaagcagaagggcagtgatgctgtgggcgcccacaacgtgttccaccccctgacctatgaaggaggagtggacctgaacagcatccaggaccctgatgagaaggtggccatgctgacccagatcctggagtttggccagacccccaagcagctgtttgtgaccccccacccccggcgcatcacccccaagttcaagagcctgagccagaccagcagctacaatgcctccatggctgacagccctggagaggagagctttgaggacctgacagaggagagcaagaccctggcctggaacaacatcaccaagctgcagctgcacgagcactacaagatccacaaggaggccgtgacaggcatcaccgtgtccagaaatggcagcagcgtcttcaccaccagccaggacagcaccctgaagatgttcagcaaggagagcaagatgctgcagaggagcatctccttcagcaacatggccctgagcagctgcctgctgctgcctggagatgccaccgtcatcaccagctcctgggacaacaacgtgtacttctacagcatcgcctttggaagacggcaggacaccctgatgggccatgatgatgctgtgtccaagatctgctggcatgacaacagactctacagcgcctcctgggacagcacagtgaaggtgtggagcggcgtgcctgctgagatgcctggcaccaagaggcaccactttgacctgctggccgagctggagcatgatgtgtctgtggacaccatcagcctgaatgctgccagcaccctgctggtgtctggcaccaaggagggcaccgtgaacatctgggacctgaccacagccaccctgatgcaccagatcccctgccacagcggcatcgtgtgtgacacagccttctccccagacagcagacatgtgctgagcactggaacagatggctgcctgaatgtgattgatgtgcagacaggcatgctgatcagctccatgaccagtgatgagccccagcgctgctttgtgtgggatggcaacagcgtgctgagcggcagccagagcggggagctgctggtgtgggacctgctgggcgccaagatcagcgagcgcatccagggccacactggagctgtgacctgcatctggatgaatgagcagtgcagcagcatcatcactggaggagaggaccggcagatcatcttctggaagctgcagtactag

SEQ ID NO: 161802 - DNA, 2847 bp, Artificial Sequence
  Description of Artificial Sequence: Synthetic coding sequence
atgacaggccaggcccgcttccacagaggagctgaggcctgccgggccatccggcagtgccgcagcagaagacccagggctgcccaccctgagggccgggccggcagcggccggggcagcagacatgccagccctggggtgcggcggggcggcttcagcctgctgctgctgaacctggaggagtactactttgagcagcaccgggccaaccacatcctgcacaagggcagccaccacgagaggaagatccggggcagcctgaagatctgcagcaagagcgtcatctttgagccagacagcatcagccagcccatcatcaagatccccctgcgggactgcatcaagattggcaagcatggagaaaatggagccaacagacacttcaccaaggccaagagcggcggcatcagcctcatcttcagccaggtgtacttcatcaaggagcacaacgtggtggccccctacaagattgagcggggcaagatggagtatgtgtttgagctggatgtgcctgggaaggtggaggatgtggtggagaccctgctgcagctgcaccgggccagctgcctggacaagctgggggaccagacagccatgatcacagccatcctgcagagccggctggcccggaccagctttgacaagaaccgcttccagaacatcagcgagaagctgcacatggagtgcaaggccgagatggtgacccccctggtgaccaaccctggccacgtgtgcatcacagacaccaacctgtacttccagcccctgaatggctaccccaagcctgtggtgcagatcaccctgcaggatgtgcggcgcatctacaagagaagacatggcctgatgcccctgggcctggaggtgttctgcacagaagatgacctgtgcagcgacatctacctgaagttctatgagccccaggacagagatgacctgtacttctacatcgccacctacctggagcaccacgtggccgagcacacagctgagagctacatgctgcagtggcagaggggccacctgagcaactaccagtacctgctgcacctgaacaacctggccgacaggagctgcaatgacctgagccagtaccctgtgttcccctggatcatccatgactacagcagcagcgagctggacctgagcaaccctggcaccttccgggacctgagcaagcctgtgggcgccctgaacaaggagcggctggagcggctgctgacccgctaccaggagatgcctgagcccaagttcatgtatggcagccactacagcagccctggctacgtgctcttctacctggtgcgcatcgcccctgagtacatgctgtgcctgcagaatggccgctttgacaatgctgacaggatgttcaacagcattgctgagacctggaagaactgcctggatggagccacagacttcaaggagctgatccctgagttctatggagatgatgtgtccttcctggtgaacagcctgaagctggacctgggcaagaggcagggcggccagatggtggatgatgtggagctgcccccctgggccagcagccctgaggacttcctgcagaagagcaaggatgccctggagagcaactacgtgtctgagcacctgcacgagtggattgacctgatcttcggctacaagcagaagggcagtgatgctgtgggcgcccacaacgtgttccaccccctgacctatgagggcggcgtggacctgaacagcatccaggaccctgatgagaaggtggccatgctgacccagatcctggagtttggccagacccccaagcagctgtttgtgaccccccacccccggcgcatcacccccaagttcaagagcctgagccagaccagcagctacaatgcctccatggctgacagccctggagaggagagctttgaggacctgacagaggagagcaagaccctggcctggaacaacatcaccaagctgcagctgcacgagcactacaagatccacaaggaggccgtgacaggcatcaccgtgtccagaaatggcagctctgtgttcaccaccagccaggacagcaccctgaagatgttcagcaaggagagcaagatgctgcagaggagcatctccttcagcaacatggccctgagcagctgcctgctgctgcctggagatgccaccgtcatcaccagctcctgggacaacaacgtgtacttctacagcatcgccttcggccggcggcaggacaccctgatgggccatgatgatgctgtgtccaagatctgctggcatgacaaccggctgtacagcgcctcctgggacagcacagtgaaggtgtggagcggcgtgcctgctgagatgcctggcaccaagaggcaccactttgacctgctggccgagctggagcatgatgtgtctgtggacaccatcagcctgaatgctgccagcaccctgctggtgtctggcaccaaggagggcaccgtgaacatctgggacctgaccacagccaccctgatgcaccagatcccctgccacagcggcatcgtgtgtgacacagccttctccccagacagccgccacgtgctgagcactggaacagatggctgcctgaatgtgattgatgtgcagacaggcatgctgatcagctccatgaccagtgatgagccccagcgctgctttgtgtgggatggcaacagcgtgctgagcggcagccagagcggggagctgctggtgtgggacctgctgggcgccaagatcagcgagcgcatccagggccacactggagctgtgacctgcatctggatgaatgagcagtgcagcagcatcatcactggaggagaagatcggcagatcatcttctggaagctgcagtactag

SEQ ID NO: 161803 - DNA, 1173 bp, Artificial Sequence
  Description of Artificial Sequence: Synthetic coding sequence
atgggagacaccttcatccgccacatcgccctgctgggctttgagaagagatttgtgcccagccagcactacgtgtacatgttcctggtgaagtggcaggacctgtctgagaaggtggtgtaccgccgcttcacagagatctatgagttccacaagaccctgaaggagatgttccccatcgaggccggggccatcaaccctgagaaccgcatcatcccccacctgcctgcccccaagtggtttgatggccagagagctgctgagaaccggcagggcaccctgacagagtactgcggcaccctgatgagcctgcccaccaagatcagccgctgcccccacctgctggacttcttcaaggtgcggccagatgacctgaagctgcccacagacaaccagaccaagaagccagagacctacctgatgcccaaggatggcaagagcacagccacagacatcaccggccccatcatcctgcagacctaccgggccatcgccaactatgagaagaccagcggcagcgagatggccctgagcactggagatgtggtggaggtggtggagaagtctgagagcggctggtggttctgccagatgaaggccaagaggggctggatcccagccagcttcctggagcccctggacagcccagatgaaacagaggaccctgagcccaactatgctggggagccctacgtggccatcaaggcctacacagctgtggagggagatgaggtgtccctgctggagggggaggccgtggaggtgatccacaagctgctggatggctggtgggtgatcaggaaggatgatgtgacaggctacttccccagcatgtacctgcagaagagcggccaggatgtgtcccaggcccagaggcagatcaagagaggagcccccccaagaagaagcagcatcagaaatgcccacagcatccaccagaggagcaggaagaggctgagccaggatgcctacagaagaaacagcgtgcgcttcctgcagcagaggcggcggcaggcccggcccggcccccagagccctggcagccccctggaggaggagcggcagacccagaggagcaagccccagcctgctgtgcccccccggcccagcgctgacctgatcctgaaccgctgcagcgagagcaccaagaggaagctggccagcgctgtgtag

SEQ ID NO: 161804 - DNA, 444 bp, Artificial Sequence
  Description of Artificial Sequence: Synthetic coding sequence
atgaccaagaagccagagacctacctgatgcccaaggatggcaagagcacagccacagacatcaccggccccatcatcctgcagacctaccgggccatcgccaactatgagaagaccagcggcagcgagatggccctgagcactggagatgtggtggaggtggtggagaagtctgagagcggccagaccagccacctgaccggcctgctgcccctggtgctgaggaacccccagccccaggccccctgccagggcagcggcagcctggcccctggccgcaccccagccctgctgggcgccctgaatgtgctgcccaccctgtgggtggccttctgcctgtctgtgcaccctgtggtggccgtgggcatctgtgcctggcaggccggggccggccacgtgtgtgtgttctgcctggatggctatggaacagtgtgcagcctgtag

SEQ ID NO: 161805 - DNA, 759 bp, Artificial Sequence
  Description of Artificial Sequence: Synthetic coding sequence
atgggagacaccttcatccgccacatcgccctgctgggctttgagaagagatttgtgcccagccagcactacgtgcacgtgcctggagagatggccggccctgtgggggagggcggcctgcctgccctgcaccgggacctgcgggtgcccagccccaagtggtttgatggccagagagctgctgagaaccggcagggcaccctgacagagtactgcggcaccctgatgagcctgcccaccaagatcagccgctgcccccacctgctggacttcttcaaggtgcggccagatgacctgaagctgcccacagacaaccagaccaagaagccagagacctacctgatgcccaaggatggcaagagcacagccacagacatcaccggccccatcatcctgcagacctaccgggccatcgccaactatgagaagaccagcggcagcgagatggccctgagcactggagatgtggtggaggtggtggagaagtctgagagcggccagaccagccacctgaccggcctgctgcccctggtgctgaggaacccccagccccaggccccctgccagggcagcggcagcctggcccctggccgcaccccagccctgctgggcgccctgaatgtgctgcccaccctgtgggtggccttctgcctgtctgtgcaccctgtggtggccgtgggcatctgtgcctggcaggccggggccggccacgtgtgtgtgttctgcctggatggctacggcaccgtgtgcagcctgtag

SEQ ID NO: 161806 - DNA, 1581 bp, Artificial Sequence
  Description of Artificial Sequence: Synthetic coding sequence
atgagcctggtggaggccatcagcctgtggaatgaaggagtgctggccgctgacaagaaggactggaagggggccctggatgccttctctgctgtgcaggacccccacagccgcatctgcttcaacatcggctgcatgtacaccatcctgaagaacatgacagaggccgagaaggccttcaccaggagcatcaacagagacaagcacctggccgtggcctacttccagaggggcatgctgtactaccagacagagaagtatgacctggccatcaaggacctgaaggaggccctgatccagctgcggggcaaccagctgattgactacaagatcctgggcctgcagttcaagctgtttgcctgtgaggtgctgtacaacatcgccttcatgtatgccaagaaggaggagtggaagaaggccgaggagcagctggccctggccacctccatgaagtctgagcccaggcacagcaagattgacaaggccatggagtgtgtgtggaagcagaagctgtatgagcctgtggtgattcctgtgggcaagctgttccggcccaatgaaaggcaggtggcccagctggccaagaaggactacctgggcaaggccaccgtggtggcctctgtggtggaccaggacagcttcagcggctttgcccccctgcagccccaggccgctgagcccccaccccggcccaagaccccagagatcttccgggccctggagggggaggcccaccgggtgctgtttggatttgtgcctgagaccaaggaggagctgcaggtgatgcctggcaacatcgtgtttgtgctgaagaagggaaatgacaactgggccaccgtgatgtttaatggccagaagggcctggtgccctgcaactacctggagcctgtggagctgcgcatccacccccagcagcagccccaggaggagagcagcccccagagcgacatcccagccccacccagcagcaaggcccctggccggccccagctgagccctggccagaagcagaaggaggagcccaaggaggtgaagctgtctgtgcccatgccctacaccctgaaggtgcactacaagtacacagtggtgatgaagacccagcccggcctgccctacagccaggtgcgggacatggtgtccaagaagctggagctgcggctggagcacaccaagctgagctaccggccccgggacagcaatgagctggtgcccctgtctgaagattccatgaaggatgcctggggccaggtgaagaactactgcctgaccctgtggtgtgaaaatacagtgggggaccagggcttcccagatgagcccaaggagagcgagaaggcagatgccaacaaccagaccacagagccccagctgaagaagggcagccaggtggaggccctcttctcctatgaggccacccagcctgaggacctggagttccaggagggggacatcatcctggtgctgagcaaggtgaatgaggagtggctggagggggagtgcaagggcaaggtgggcatcttccccaaggtgtttgtggaggactgtgccaccacagacctggagagcacccggcgggaggtgtag

SEQ ID NO: 161807 - DNA, 1581 bp, Artificial Sequence; identical to SEQ ID NO: 161806
  Description of Artificial Sequence: Synthetic coding sequence

SEQ ID NO: 161808 - DNA, 1797 bp, Artificial Sequence
  Description of Artificial Sequence: Synthetic coding sequence
ggcagccctgcccggggagatgcccccacctgcctgctgtctgtgtcctggcagctgtcctggccacccagcttctacctgatcatgagcctggtggaggccatcagcctgtggaatgaaggagtgctggccgctgacaagaaggactggaagggggccctggatgccttctctgctgtgcaggacccccacagccgcatctgcttcaacatcggctgcatgtacaccatcctgaagaacatgacagaggccgagaaggccttcaccaggagcatcaacagagacaagcacctggccgtggcctacttccagaggggcatgctgtactaccagacagagaagtatgacctggccatcaaggacctgaaggaggccctgatccagctgcggggcaaccagctgattgactacaagatcctgggcctgcagttcaagctgtttgcctgtgaggtgctgtacaacatcgccttcatgtatgccaagaaggaggagtggaagaaggccgaggagcagctggccctggccacctccatgaagtctgagcccaggcacagcaagattgacaaggccatggagtgtgtgtggaagcagaagctgtatgagcctgtggtgattcctgtgggcaagctgttccggcccaatgaaaggcaggtggcccagctggccaagaaggactacctgggcaaggccaccgtggtggcctctgtggtggaccaggacagcttcagcggctttgcccccctgcagccccaggtgcggcagagcgacctgctgggcgcccaggccggctctgtgagcagccggcagctgcagctggatgtggagctggagcccggctggagccaggtgcccggcagcaagttctctgtgtttgccccctggcaccacgtgcggggctggggcctggacctggtgtccatcctgtgccgggccctggagggggaggcccaccgggtgctgtttggatttgtgcctgagaccaaggaggagctgcaggtgatgcctggcaacatcgtgtttgtgctgaagaagggaaatgacaactgggccaccgtgatgtttaatggccagaagggcctggtgccctgcaactacctggagcctgtggagctgcgcatccacccccagcagcagccccaggaggagagcagcccccagagcgacatcccagccccacccagcagcaaggcccctggccggccccagctgagccctggccagaagcagaaggaggagcccaaggaggtgaagctgtctgtgcccatgccctacaccctgaaggtgcactacaagtacacagtggtgatgaagacccagcccggcctgccctacagccaggtgcgggacatggtgtccaagaagctggagctgcggctggagcacaccaagctgagctaccggccccgggacagcaatgagctggtgcccctgtctgaagattccatgaaggatgcctggggccaggtgaagaactactgcctgaccctgtggtgtgaaaatacagtgggggaccagggcttcccagatgagcccaaggagagcgagaaggcagatgccaacaaccagaccacagagccccagctgaagaagggcagccaggtggaggccctcttctcctatgaggccacccagcctgaggacctggagttccaggagggggacatcatcctggtgctgagcaaggtgaatgaggagtggctggagggggagtgcaagggcaaggtgggcatcttccccaaggtgtttgtggaggactgtgccaccacagacctggagagcacccggcgggaggtgtag

SEQ ID NO: 161809 - DNA, 1446 bp, Artificial Sequence
  Description of Artificial Sequence: Synthetic coding sequence
atgagcctggtggaggccatcagcctgtggaatgaaggagtgctggccgctgacaagaaggactggaagggggccctggatgccttctctgctgtgcaggacccccacagccgcatctgcttcaacatcggctgcatgtacaccatcctgaagaacatgacagaggccgagaaggccttcaccaggagcatcaacagagacaagcacctggccgtggcctacttccagaggggcatgctgtactaccagacagagaagtatgacctggccatcaaggacctgaaggaggccctgatccagctgcggggcaaccagctgattgactacaagatcctgggcctgcagttcaagctgtttgcctgtgagaagcagaagctgtatgagcctgtggtgattcctgtgggcaagctgttccggcccaatgaaaggcaggtggcccagctggccaagaaggactacctgggcaaggccaccgtggtggcctctgtggtggaccaggacagcttcagcggctttgcccccctgcagccccaggccgctgagcccccaccccggcccaagaccccagagatcttccgggccctggagggggaggcccaccgggtgctgtttggatttgtgcctgagaccaaggaggagctgcaggtgatgcctggcaacatcgtgtttgtgctgaagaagggaaatgacaactgggccaccgtgatgttcaacggccagaagggcctggtgccctgcaactacctggagcctgtggagctgcgcatccacccccagcagcagccccaggaggagagcagcccccagagcgacatcccagccccacccagcagcaaggcccctggccggccccagctgagccctggccagaagcagaaggaggagcccaaggaggtgaagctgtctgtgcccatgccctacaccctgaaggtgcactacaagtacacagtggtgatgaagacccagcccggcctgccctacagccaggtgcgggacatggtgtccaagaagctggagctgcggctggagcacaccaagctgagctaccggccccgggacagcaatgagctggtgcccctgtctgaggacagcatgaaggatgcctggggccaggtgaagaactactgcctgaccctgtggtgtgagaacacagtgggggaccagggcttcccagatgagcccaaggagagcgagaaggcagatgccaacaaccagaccacagagccccagctgaagaagggcagccaggtggaggccctcttctcctatgaggccacccagcctgaggacctggagttccaggagggggacatcatcctggtgctgagcaaggtgaatgaggagtggctggagggagaatgtaaaggcaaggtgggcatcttccccaaggtgtttgtggaggactgtgccaccacagacctggagagcacccggcgggaggtgtag

SEQ ID NO: 161810 - DNA, 1338 bp, Artificial Sequence
  Description of Artificial Sequence: Synthetic coding sequence
atgagcctggtggaggccatcagcctgtggaatgaaggagtgctggccgctgacaagaaggactggaagggggccctggatgccttctctgctgtgcaggacccccacagccgcatctgcttcaacatcggctgcatgtacaccatcctgaagaacatgacagaggccgagaaggccttcaccaggagcatcaacagagacaagcacctggccgtggcctacttccagaggggcatgctgtactaccagacagagaagtatgacctggccatcaaggacctgaaggaggccctgatccagctgcggggcaaccagctgattgactacaagatcctgggcctgcagttcaagctgtttgcctgtgaggtggtggcctctgtggtggaccaggacagcttcagcggctttgcccccctgcagccccaggccgctgagcccccaccccggcccaagaccccagagatcttccgggccctggagggggaggcccaccgggtgctgtttggatttgtgcctgagaccaaggaggagctgcaggtgatgcctggcaacatcgtgtttgtgctgaagaagggaaatgacaactgggccaccgtgatgttcaacggccagaagggcctggtgccctgcaactacctggagcctgtggagctgcgcatccacccccagcagcagccccaggaggagagcagcccccagagcgacatcccagccccacccagcagcaaggcccctggccggccccagctgagccctggccagaagcagaaggaggagcccaaggaggtgaagctgtctgtgcccatgccctacaccctgaaggtgcactacaagtacacagtggtgatgaagacccagcccggcctgccctacagccaggtgcgggacatggtgtccaagaagctggagctgcggctggagcacaccaagctgagctaccggccccgggacagcaatgagctggtgcccctgtctgaggacagcatgaaggatgcctggggccaggtgaagaactactgcctgaccctgtggtgtgagaacacagtgggggaccagggcttcccagatgagcccaaggagagcgagaaggcagatgccaacaaccagaccacagagccccagctgaagaagggcagccaggtggaggccctcttctcctatgaggccacccagcctgaggacctggagttccaggagggggacatcatcctggtgctgagcaaggtgaatgaggagtggctggagggagaatgtaaaggcaaggtgggcatcttccccaaggtgtttgtggaggactgtgccaccacagacctggagagcacccggcgggaggtgtag

SEQ ID NO: 161811 - DNA, 432 bp, Artificial Sequence
  Description of Artificial Sequence: Synthetic coding sequence
atgcctggcaacatcgtgtttgtgctgaagaagggaaatgacaactgggccaccgtgatgttcaacggccagaagggcctggtgccctgcaactacctggagcctgtggagctgcgcatccacccccagcagcagccccaggaggagagcagcccccagagcgacatcccagccccacccagcagcaaggcccctggccggccccagctgagccctggccagaagcagaaggaggagcccaaggaggtgaagctgtctgtgcccatgccctacaccctgaaggtgcactacaagtacacagtggtgatgaagacccagcccggcctgccctacagccaggtgcgggacatggtgtccaagaagctggagctgcggctggagcacaccaagctgagctaccggccccgggacagcaatgagctggtgccctag

SEQ ID NO: 161812 - DNA, 171 bp, Artificial Sequence
  Description of Artificial Sequence: Synthetic coding sequence
atgccctacaccctgaaggtgcactacaagtacacagtggtgatgaagacccagcccggcctgccctacagccaggtgcgggacatggtgtccaagaagctggagctgcggctggagcacaccaagctgagctaccggccccgggacagcaatgagctggtgcccctgtag

SEQ ID NO: 161813 - DNA, 1020 bp, Artificial Sequence
  Description of Artificial Sequence: Synthetic coding sequence
atggctgtggcccagcagctgcgggcagagagtgactttgagcagctgcctgatgatgtggccatcagcgccaacattgctgacatcgaggagaagaggggcttcaccagccactttgtgtttgtgattgaggtgaagaccaagggcggcagcaagtacctgatctaccgccgctaccggcagttccacgccctgcagagcaagctggaggagagatttggaccagacagcaagagcagcgccctggcctgcaccctgcccaccctgcctgccaaggtgtatgtgggcgtgaagcaggagattgctgagatgaggatcccagccctgaatgcctacatgaagagcctgctgagcctgcctgtgtgggtgctgatggatgaagatgtgcgcatcttcttctaccagagcccctatgacagcgagcaggtgccccaggccctgcggcggctgcggcccaggaccaggaaggtgaagtctgtgagcccccagggcaacagcgtggacaggatggccgcccccagggctgaggccctgtttgacttcaccggcaacagcaagctggagctgaacttcaaggctggagatgtgatcttcctgctgagccgcatcaacaaggactggctggagggcaccgtgcggggggccaccggcatcttccccctgagctttgtgaagatcctgaaggacttcccagaagaagatgaccccaccaactggctgcgctgctactactatgaggacaccatcagcaccatcaaggacattgctgtggaggaggacctgagcagcacccccctgctgaaggacctgctggagctgacccggcgggagttccagagagaagatattgccctgaactacagagatgctgagggggacctggtgcggctgctgagtgatgaagatgtggccctgatggtgcggcaggcccggggcctgcccagccagaagaggctcttcccctggaagctgcacatcacccagaaggacaactacagagtgtacaacaccatgccctag

SEQ ID NO: 161814 - DNA, 1047 bp, Artificial Sequence
  Description of Artificial Sequence: Synthetic coding sequence
atggctgtggcccagcagctgcgggcagagagtgactttgagcagctgcctgatgatgtggccatcagcgccaacattgctgacatcgaggagaagaggggcttcaccagccactttgtgtttgtgattgaggtgaagaccaagggcggcagcaagtacctgatctaccgccgctaccggcagttccacgccctgcagagcaagctggaggagagatttggaccagacagcaagagcagcgccctggcctgcaccctgcccaccctgcctgccaaggtgtatgtgggcgtgaagcaggagattgctgagatgaggatcccagccctgaatgcctacatgaagagcctgctgagcctgcctgtgtgggtgctgatggatgaagatgtgcgcatcttcttctaccagagcccctatgacagcgagcaggtgccccaggccctgcggcggctgcggcccaggaccaggaaggtgaagtctgtgagcccccagggcaacagcgtggacaggatggccgcccccagggctgaggccctgtttgacttcaccggcaacagcaagctggagctgaacttcaaggctggagatgtgatcttcctgctgagccgcatcaacaaggactggctggagggcaccgtgcggggggccaccggcatcttccccctgagctttgtgaagatcctgaaggacttcccagaagaagatgaccccaccaactggctgcgctgctactactatgaggacaccatcagcaccatcaagtctgtggcctgggagggcggggcctgcccagccttcctgcccagcctgcggcccctgcccctgaccagccccagccacggcagcctgagccacagcaaggcccccagcggcagccagatgagccacaatgctgtgaccagccaccagaggcctggctggccaggccagccccacagccccttcccccaccccaccccccacttccagccagatgccagcctgctgcagcctgtgacccccctgggcaccagccgctggaggaagatctctgctgccctgccctactag

SEQ ID NO: 161815 - DNA, 501 bp, Artificial Sequence
  Description of Artificial Sequence: Synthetic coding sequence
atgaggatcccagccctgaatgcctacatgaagagcctgctgagcctgcctgtgtgggtgctgatggatgaagatgtgcgcatcttcttctaccagagcccctatgattctgagcaggtgccccaggccctgcggcggctgcggcccaggaccaggaaggtgaagtctgtgagcccccagggcaacagcgtggacaggatggccgcccccagggctgaggccctgtttgacttcaccggcaacagcaagctggagctgaacttcaaggctggagatgtgatcttcctgctgagccgcatcaacaaggactggctggagggcaccgtgcggggggccaccggcatcttccccctgagctttgtgaagatcctgaaggacttccctgaggaggatgaccccaccaactggctgcgctgctactactatgaggacaccatcagcaccatcaagtctgtggcctgggagggcggggcctgcccagccttcctgcccagcctgtag

SEQ ID NO: 161816 - DNA, 480 bp, Artificial Sequence
  Description of Artificial Sequence: Synthetic coding sequence
atgaatgacatcagccagaaggccgagatcctgctgagcagcagcaagcctgtgcccaagacctacgtgcccaagctgggcaaaggagatgtgaaggacaagtttgaggccatgcagagggcccgggaggagaggaaccagaggaggagcagagatgagaagcagaggaggaaggagcagtacatccgggagcgggagtggaacagaaggaagcaggagatcaaggagatgctggccagtgatgatgaggaggatgtgagcagcaaggtggagaaggcctacgtgcccaagctgactggaacagtgaagggccgctttgctgagatggagaagcagaggcaggaggagcagaggaagaggacagaggaggagaggaagagaagaattgagcaggacatgctggagaagaggaagatccagcgggagctggccaagagagctgagcagaagctggccaggagagatggagcccacctgtag

SEQ ID NO: 161817 - DNA, 1836 bp, Artificial Sequence
  Description of Artificial Sequence: Synthetic coding sequence
atgaatgacatcagccagaaggccgagatcaaggagatgctggccagtgatgatgaggaggatgtgagcagcaaggtggagaaggcctacgtgcccaagctgactggaacagtgaagggccgctttgctgagatggagaagcagaggcaggaggagcagaggaagaggacagaggaggagaggaagagaagaattgagcaggacatgctggagaagaggaagatccagcgggagctggccaagagagctgagcagatcgaggacatcaacaacacaggaacagagagcgccagcgaggagggagatgacagcctgctgatcaccgtggtgcctgtgaagagctacaagaccagcggcaagatgaagaagaactttgaggacctggagaaggagcgggaggagaaggagcgcatcaagtatgaggaggacaagaggatccgctatgaggagcagaggcccagcctgaaggaggccaagtgcctgagcctggtgatggatgatgaaattgaaagtgaggccaagaaggagagcctgagccctgggaagctgaagctgacctttgaggagctggagcggcagaggcaggagaacaggaagaagcaggccgaggaggaggccaggaagaggctggaggaggagaagagggcctttgaggaggcccggcggcagatggtgaatgaagatgaggagaaccaggacacagccaagatcttcaagggctacagacctgggaagctgaagctgagctttgaggagatggagcggcagaggagagaagatgagaagaggaaggccgaggaggaggccaggagaagaattgaggaggagaagaaggcctttgctgaggcccggaggaacatggtggtggatgatgacagccctgagatgtacaagaccatcagccaggagttcctgaccccaggcaagctggagatcaactttgaggagctgctgaagcagaagatggaggaggagaagagaagaacagaggaggagaggaagcacaagctggagatggagaagcaggagtttgagcagctgcggcaggagatgggagaggaggaggaggagaatgagaccttcggcctgagccgggagtatgaggagctgatcaagctgaagaggagcggcagcatccaggccaagaacctgaagagcaagtttgagaagattggccagctgtctgagaaggagatccagaagaagattgaggaggagcgggcccggcggcgggccatcgacctggagatcaaggagcgggaggccgagaacttccacgaggaggatgatgtggatgtgcggcctgccaggaagtctgaggcccccttcacccacaaggtgaacatgaaggccaggtttgagcagatggccaaggcccgggaggaggaggagcagaggcgcatcgaggagcagaagctgctgaggatgcagtttgagcagcgggagattgatgctgccctgcagaagaagcgggaggaggaggaggaggaggagggcagcatcatgaatggcagcacagcagaagatgaggagcagaccaggtctggggccccctggttcaagaagcccctgaagaacacctctgtggtggacagcgagcctgtgcgcttcaccgtgaaggtgactggagagcccaagccagagatcacctggtggtttgaaggagagatcctgcaggatggagaggactaccagtacatcgagcggggggagacctactgcctgtacctgcctgagaccttcccagaagatggaggagagtacatgtgcaaggctgtgaacaacaagggcagcgctgccagcacctgcatcctgaccatcgagagcaagaactag

SEQ ID NO: 161818 - DNA, 2028 bp, Artificial Sequence
  Description of Artificial Sequence: Synthetic coding sequence
atgaatgacatcagccagaaggccgagatcctgctgagcagcagcaagcctgtgcccaagacctacgtgcccaagctgggcaaaggagatgtgaaggacaagtttgaggccatgcagagggcccgggaggagaggaaccagaggaggagcagagatgagaagcagaggaggaaggagcagtacatccgggagcgggagtggaacagaaggaagcaggagatcaaggagatgctggccagtgatgatgaggaggatgtgagcagcaaggtggagaaggcctacgtgcccaagctgactggaacagtgaagggccgctttgctgagatggagaagcagaggcaggaggagcagaggaagaggacagaggaggagaggaagagaagaattgagcaggacatgctggagaagaggaagatccagcgggagctggccaagagagctgagcagatcgaggacatcaacaacacaggaacagagagcgccagcgaggagggagatgacagcctgctgatcaccgtggtgcctgtgaagagctacaagaccagcggcaagatgaagaagaactttgaggacctggagaaggagcgggaggagaaggagcgcatcaagtatgaggaggacaagaggatccgctatgaggagcagaggcccagcctgaaggaggccaagtgcctgagcctggtgatggatgatgaaattgaaagtgaggccaagaaggagagcctgagccctgggaagctgaagctgacctttgaggagctggagcggcagaggcaggagaacaggaagaagcaggccgaggaggaggccaggaagaggctggaggaggagaagagggcctttgaggaggcccggcggcagatggtgaatgaagatgaggagaaccaggacacagccaagatcttcaagggctacagacctgggaagctgaagctgagctttgaggagatggagcggcagaggagagaagatgagaagaggaaggccgaggaggaggccaggagaagaattgaggaggagaagaaggcctttgctgaggcccggaggaacatggtggtggatgatgacagccctgagatgtacaagaccatcagccaggagttcctgaccccaggcaagctggagatcaactttgaggagctgctgaagcagaagatggaggaggagaagagaagaacagaggaggagaggaagcacaagctggagatggagaagcaggagtttgagcagctgcggcaggagatgggagaggaggaggaggagaatgagaccttcggcctgagccgggagtatgaggagctgatcaagctgaagaggagcggcagcatccaggccaagaacctgaagagcaagtttgagaagattggccagctgtctgagaaggagatccagaagaagattgaggaggagcgggcccggcggcgggccatcgacctggagatcaaggagcgggaggccgagaacttccacgaggaggatgatgtggatgtgcggcctgccaggaagtctgaggcccccttcacccacaaggtgaacatgaaggccaggtttgagcagatggccaaggcccgggaggaggaggagcagaggcgcatcgaggagcagaagctgctgaggatgcagtttgagcagcgggagattgatgctgccctgcagaagaagcgggaggaggaggaggaggaggagggcagcatcatgaatggcagcacagcagaagatgaggagcagaccaggtctggggccccctggttcaagaagcccctgaagaacacctctgtggtggacagcgagcctgtgcgcttcaccgtgaaggtgactggagagcccaagccagagatcacctggtggtttgaaggagagatcctgcaggatggagaggactaccagtacatcgagcggggggagacctactgcctgtacctgcctgagaccttcccagaagatggaggagagtacatgtgcaaggctgtgaacaacaagggcagcgctgccagcacctgcatcctgaccatcgagagcaagaactag

SEQ ID NO: 161819 - DNA, 1731 bp, Artificial Sequence
  Description of Artificial Sequence: Synthetic coding sequence
tgagtgaagggccgctttgctgagatggagaagcagaggcaggaggagcagaggaagaggacagaggaggagaggaagagaagaattgagcaggacatgctggagaagaggaagatccagcgggagctggccaagagagctgagcagatcgaggacatcaacaacacaggaacagagagcgccagcgaggagggagatgacagcctgctgatcaccgtggtgcctgtgaagagctacaagaccagcggcaagatgaagaagaactttgaggacctggagaaggagcgggaggagaaggagcgcatcaagtatgaggaggacaagaggatccgctatgaggagcagaggcccagcctgaaggaggccaagtgcctgagcctggtgatggatgatgaaattgaaagtgaggccaagaaggagagcctgagccctgggaagctgaagctgacctttgaggagctggagcggcagaggcaggagaacaggaagaagcaggccgaggaggaggccaggaagaggctggaggaggagaagagggcctttgaggaggcccggcggcagatggtgaatgaagatgaggagaaccaggacacagccaagatcttcaagggctacagacctgggaagctgaagctgagctttgaggagatggagcggcagaggagagaagatgagaagaggaaggccgaggaggaggccaggagaagaattgaggaggagaagaaggcctttgctgaggcccggaggaacatggtggtggatgatgacagccctgagatgtacaagaccatcagccaggagttcctgaccccaggcaagctggagatcaactttgaggagctgctgaagcagaagatggaggaggagaagagaagaacagaggaggagaggaagcacaagctggagatggagaagcaggagtttgagcagctgcggcaggagatgggagaggaggaggaggagaatgagaccttcggcctgagccgggagtatgaggagctgatcaagctgaagaggagcggcagcatccaggccaagaacctgaagagcaagtttgagaagattggccagctgtctgagaaggagatccagaagaagattgaggaggagcgggcccggcggcgggccatcgacctggagatcaaggagcgggaggccgagaacttccacgaggaggatgatgtggatgtgcggcctgccaggaagtctgaggcccccttcacccacaaggtgaacatgaaggccaggtttgagcagatggccaaggcccgggaggaggaggagcagaggcgcatcgaggagcagaagctgctgaggatgcagtttgagcagcgggagattgatgctgccctgcagaagaagcgggaggaggaggaggaggaggagggcagcatcatgaatggcagcacagcagaagatgaggagcagaccaggtctggggccccctggttcaagaagcccctgaagaacacctctgtggtggacagcgagcctgtgcgcttcaccgtgaaggtgactggagagcccaagccagagatcacctggtggtttgaaggagagatcctgcaggatggagaggactaccagtacatcgagcggggggagacctactgcctgtacctgcctgagaccttcccagaagatggaggagagtacatgtgcaaggctgtgaacaacaagggcagcgctgccagcacctgcatcctgaccattgaaacagatgactactag

SEQ ID NO: 161820 - DNA, 966 bp, Artificial Sequence
  Description of Artificial Sequence: Synthetic coding sequence
atgaatgacatcagccagaaggccgagatcaaggagatgctggccagtgatgatgaggaggatgtgagcagcaaggtggagaaggcctacgtgcccaagctgactggaacagtgaagggccgctttgctgagatggagaagcagaggcaggaggagcagaggaagaggacagaggaggagaggaagagaagaattgagcaggacatgctggagaagaggaagatccagcgggagctggccaagagagctgagcagatcgaggacatcaacaacacaggaacagagagcgccagcgaggagggagatgacagcctgctgatcaccgtggtgcctgtgaagagctacaagaccagcggcaagatgaagaagaactttgaggacctggagaaggagcgggaggagaaggagcgcatcaagtatgaggaggacaagaggatccgctatgaggagcagaggcccagcctgaaggaggccaagtgcctgagcctggtgatggatgatgaaattgaaagtgaggccaagaaggagagcctgagccctgggaagctgaagctgacctttgaggagctggagcggcagaggcaggagaacaggaagaagcaggccgaggaggaggccaggaagaggctggaggaggagaagagggcctttgaggaggcccggcggcagatggtgaatgaagatgaggagaaccaggacacagccaagatcttcaagggctacagacctgggaagctgaagctgagctttgaggagatggagcggcagaggagagaagatgagaagaggaaggccgaggaggaggccaggagaagaattgaggaggagaagaaggcctttgctgaggcccggaggaacatggtggtggatgatgacagccctgagatgtacaagaccatcagccaggagttcctgaccccaggcaagctggagatcaactttgaggagctgctgaagcagaagtag

SEQ ID NO: 161821 - DNA, 1308 bp, Artificial Sequence
  Description of Artificial Sequence: Synthetic coding sequence
atgaatgacatcagccagaaggccgagatcctgctgagcagcagcaagcctgtgcccaagacctacgtgcccaagctgggcaaaggagatgtgaaggacaagtttgaggccatgcagagggcccgggaggagaggaaccagaggaggagcagagatgagaagcagaggaggaaggagcagtacatccgggagcgggagtggaacagaaggaagcaggagatcaaggagatgctggccagtgatgatgaggaggatgtgagcagcaaggtggagaaggcctacgtgcccaagctgactggaacagtgaagggccgctttgctgagatggagaagcagaggcaggaggagcagaggaagaggacagaggaggagaggaagagaagaattgagcaggacatgctggagaagaggaagatccagcgggagctggccaagagagctgagcaggagggagatgacagcctgctgatcaccgtggtgcctgtgaagagctacaagaccagcggcaagatgaagaagaactttgaggacctggagaaggagcgggaggagaaggagcgcatcaagtatgaggaggacaagaggatccgctatgaggagcagaggcccagcctgaaggaggccaagtgcctgagcctggtgatggatgatgaaattgaaagtgaggccaagaaggagagcctgagccctgggaagctgaagctgacctttgaggagctggagcggcagaggcaggagaacaggaagaagcaggccgaggaggaggccaggaagaggctggaggaggagaagagggcctttgaggaggcccggcggcagatggtgaatgaagatgaggagaaccaggacacagccaagatcttcaagggctacagacctgggaagctgaagctgagctttgaggagatggagcggcagaggagagaagatgagaagaggaaggccgaggaggaggccaggagaagaattgaggaggagaagaaggcctttgctgaggcccggaggaacatggtggtggatgatgacagccctgagatgtacaagaccatcagccaggagttcctgaccccaggcaagctggagatcaactttgaggagctgctgaagcagaagatggaggaggagaagagaagaacagaggaggagaggaagcacaagctggagatggagaagcaggagtttgagcagctgcggcaggagatgggagaggaggaggaggagaatgagaccttcggcctgagccgggagtatgaggagctgatcaagctgaagaggagcggcagcatccaggccaagaacctgaagtag

SEQ ID NO: 161822 - DNA, 1989 bp, Artificial Sequence
  Description of Artificial Sequence: Synthetic coding sequence
atgaatgacatcagccagaaggccgagatcctgctgagcagcagcaagcctgtgcccaagacctacgtgcccaagctgggcaaaggagatgtgaaggacaagtttgaggccatgcagagggcccgggaggagaggaaccagaggaggagcagagatgagaagcagaggaggaaggagcagtacatccgggagcgggagtggaacagaaggaagcaggagatcaaggagatgctggccagtgatgatgaggaggatgtgagcagcaaggtggagaaggcctacgtgcccaagctgactggaacagtgaagggccgctttgctgagatggagaagcagaggcaggaggagcagaggaagaggacagaggaggagaggaagagaagaattgagcaggacatgctggagaagaggaagatccagcgggagctggccaagagagctgagcaggagggagatgacagcctgctgatcaccgtggtgcctgtgaagagctacaagaccagcggcaagatgaagaagaactttgaggacctggagaaggagcgggaggagaaggagcgcatcaagtatgaggaggacaagaggatccgctatgaggagcagaggcccagcctgaaggaggccaagtgcctgagcctggtgatggatgatgaaattgaaagtgaggccaagaaggagagcctgagccctgggaagctgaagctgacctttgaggagctggagcggcagaggcaggagaacaggaagaagcaggccgaggaggaggccaggaagaggctggaggaggagaagagggcctttgaggaggcccggcggcagatggtgaatgaagatgaggagaaccaggacacagccaagatcttcaagggctacagacctgggaagctgaagctgagctttgaggagatggagcggcagaggagagaagatgagaagaggaaggccgaggaggaggccaggagaagaattgaggaggagaagaaggcctttgctgaggcccggaggaacatggtggtggatgatgacagccctgagatgtacaagaccatcagccaggagttcctgaccccaggcaagctggagatcaactttgaggagctgctgaagcagaagatggaggaggagaagagaagaacagaggaggagaggaagcacaagctggagatggagaagcaggagtttgagcagctgcggcaggagatgggagaggaggaggaggagaatgagaccttcggcctgagccgggagtatgaggagctgatcaagctgaagaggagcggcagcatccaggccaagaacctgaagagcaagtttgagaagattggccagctgtctgagaaggagatccagaagaagattgaggaggagcgggcccggcggcgggccatcgacctggagatcaaggagcgggaggccgagaacttccacgaggaggatgatgtggatgtgcggcctgccaggaagtctgaggcccccttcacccacaaggtgaacatgaaggccaggtttgagcagatggccaaggcccgggaggaggaggagcagaggcgcatcgaggagcagaagctgctgaggatgcagtttgagcagcgggagattgatgctgccctgcagaagaagcgggaggaggaggaggaggaggagggcagcatcatgaatggcagcacagcagaagatgaggagcagaccaggtctggggccccctggttcaagaagcccctgaagaacacctctgtggtggacagcgagcctgtgcgcttcaccgtgaaggtgactggagagcccaagccagagatcacctggtggtttgaaggagagatcctgcaggatggagaggactaccagtacatcgagcggggggagacctactgcctgtacctgcctgagaccttcccagaagatggaggagagtacatgtgcaaggctgtgaacaacaagggcagcgctgccagcacctgcatcctgaccattgaaacagatgactactag

SEQ ID NO: 161823 - DNA, 813 bp, Artificial Sequence
  Description of Artificial Sequence: Synthetic coding sequence
atggagaaccagcctgtgcgctggagggccctgcccggcctgcccaggcctcctggcctgcctgctgccccctggctgctgctgggcgtgctgctgctgcccggcaccctgcggctggccggcggccagagcgtgacccacacaggcctgcccatcatggccagcctggccaacacagccatctccttcagctgccgcatcacctacccctacaccccccagttcaaggtgttcaccgtgtcctacttccacgaggacctgcagggccagaggagccccaagaagcccaccaactgccaccctggcctgggcacagagaaccagagccacaccctggactgccaggtgaccctggtgctgcccggggccagcgccaccggcacctactactgcagcgtgcactggccccacagcacagtgcggggcagcggcaccttcatcctggtgagagatgctggctaccgggagcccccccagagcccccagaagctgctgctgtttggcttcaccggcctgctgtctgtgctgtctgtggtgggcacagccctgctgctgtggaacaagaagaggatgaggggccctgggaaggaccccaccaggaaatgtcctgaccccaggtctgccagcagccccaagcagcaccccagcgagagcgtgtacacagccctgcagaggcgggagacagaggtgtatgcctgcattgaaaatgaagatggcagcagccccacagccaagcagagccccctgagccaggagcggccccacagatttgaagatgatggagagctgaacctggtgtatgagaacctgtag

SEQ ID NO: 161824 - DNA, 1248 bp, Artificial Sequence
  Description of Artificial Sequence: Synthetic coding sequence
atggcccctgtgtctggcagccgcagcccagaccgggaggccagcggcagcggcggcagaagaagaagcagcagcaagagccccaagcccagcaagagcgcccggagcccccggggccgccgcagccgcagccacagctgcagccgcagcggggacagaaatggcctgacccaccagctgggcggcctgagccagggcagcaggaaccagagctaccgcagccgcagccgcagccgcagccgggagcggcccagcgccccccggggcatcccctttgccagcgccagcagctctgtgtactacggcagctacagccggccctacggcagtgacaagccctggcccagcctgctggacaaggagcgggaggagagcctgcggcagaagaggctgtctgagcgggagagaattggagagctgggcgcccctgaggtgtggggcctgagccccaagaaccctgagccagacagtgatgagcacacccctgtggaggatgaggagcccaagaagagcaccaccagcgccagcaccagcgaggaggagaagaagaagaagagcagccgcagcaaggagaggagcaagaagaggaggaagaagaagagcagcaagaggaagcacaagaagtacagtgaagattctgacagcgacagcgacagcgagacagacagcagtgatgaggacaacaagaggcgggccaagaaggccaagaagaaggagaagaagaagaagcacaggagcaagaagtacaagaagaagaggagcaagaagagcaggaaggagagcagtgacagcagcagcaaggagagccaggaggagttcctggagaacccctggaaggacaggaccaaggccgaggagcccagcgacctgattggccctgaggcccccaagaccctgaccagccaggatgacaagcccctgaactacggccacgccctgctgcctggagagggcgccgccatggccgagtatgtgaaggccggcaagaggatccccaggagaggagaaattggcctgaccagcgaggagatcgccagctttgagtgcagcggctacgtgatgagcggcagccgccacaggaggatggaggccgtgcggctgaggaaggagaaccagatctacagcgcagatgagaagagggccctggccagcttcaaccaggaggagaggaggaagcgggagaacaagatcctggccagcttccgggagatggtgtacaggaagaccaagggcaaggatgacaagtag

SEQ ID NO: 161825 - DNA, 2073 bp, Artificial Sequence
  Description of Artificial Sequence: Synthetic coding sequence
atggagaagatcctgcagatggccgagggcattgatattggagagatgcccagctatgacctggtgctgagcaagcccagcaagggccagaagaggcacctgagcacctgtgatggccagaacccccccaagaagcaggccggcagcaagttccacgcccggcccaggtttgagcctgtgcactttgtggccagcagcagcaaggatgagcggcaggaggacccctacggcccccagaccaaggaggtgaatgagcagacccactttgcctccatgccccgggacatctaccaggactacacccaggacagcttcagcatccaggacggcaacagccagtactgtgacagcagcggcttcatcctgaccaaggaccagcctgtgacagccaacatgtactttgacagcggcaacccagcccccagcaccaccagccagcaggccaacagccagagcaccccagagcccagccccagccagaccttccctgagagcgtggtggccgagaagcagtacttcatcgagaagctgacagccaccatctggaagaacctgagcaaccctgagatgaccagcggcagtgacaagatcaactacacctacatgctgacccgctgcatccaggcctgcaagaccaaccctgagtacatctatgcccccctgaaggagatccccccagctgacatccccaagaacaagaagctgctgacagatggctacgcctgtgaggtgcgctgccagaacatctacctgaccaccggctacgccggcagcaagaatggcagccgggaccgggccacagagctggccgtgaagctgctgcagaagagaattgaggtgcgggtggtgcggaggaagttcaagcacacctttggagaggacctggtggtgtgccagatcggcatgagcagctatgagttccccccagccctgaagcccccagaggacctggtggtgctgggcaaggatgccagcggccagcccatcttcaatgccagcgccaagcactggaccaacttcgtcatcacagaaaatgccaatgatgccatcggcatcctgaacaacagcgccagcttcaacaagatgagcattgagtacaagtatgagatgatgcccaacagaacctggcgctgcagggtcttcctgcaggaccactgcctggccgagggctacggcaccaagaagaccagcaagcacgccgctgctgatgaggccctgaagatcctgcagaagacccagcccacctaccccagcgtgaagagcagccagtgccacacaggcagcagcccccggggcagcggcaagaagaaggacatcaaggacctggtggtgtatgagaacagcagcaaccctgtgtgcaccctgaatgacacagcccagttcaacaggatgacagtggagtatgtgtatgaaagaatgacaggcctgcgctggaagtgcaaggtgatcctggagagcgaggtgattgctgaggccgtgggcgtgaagaagacagtgaagtatgaagctgctggggaggccgtgaagaccctgaagaagacccagcccaccgtcatcaacaacctgaagaagggagctgtggaggatgtgatcagcagaaatgagatccagggccgctctgctgaggaggcctacaagcagcagatcaaggaggacaacatcggcaaccagctgctgaggaagatgggctggacaggaggcggcctgggcaagagcggggagggcatccgggagcccatctctgtgaaggagcagcacaagcgggagggcctgggcctggatgtggagcgggtgaacaagatcgccaagagggacatcgagcagatcatcagaaattatgcccggtctgagagccacacagacctgaccttcagccgggagctgaccaatgatgagaggaagcagatccaccagatcgcccagaagtatggcctgaagagcaagagccacggcgtgggccatgaccgctacctggtggtgggcaggaagaggaggaaagaagacctgctggaccagctgaagcaggagggccaggtgggccactatgagctggtgatgccccaggccaactag

SEQ ID NO: 161826 - DNA, 2073 bp, Artificial Sequence; identical to SEQ ID NO: 161825
  Description of Artificial Sequence: Synthetic coding sequence

SEQ ID NO: 161827 - DNA, 2118 bp, Artificial Sequence
  Description of Artificial Sequence: Synthetic coding sequence
atgggcttcatgctgcccctcatcttccgctacagcccccggctgatggagaagatcctgcagatggccgagggcatcgacatcggggagatgcccagctatgacctggtgctgagcaagcccagcaagggccagaagaggcacctgagcacctgtgatggccagaacccccccaagaagcaggccggcagcaagttccacgcccggcccaggtttgagcctgtgcactttgtggccagcagcagcaaggatgagcggcaggaggacccctacggcccccagaccaaggaggtgaatgagcagacccactttgcctccatgccccgggacatctaccaggactacacccaggacagcttcagcatccaggacggcaacagccagtactgtgacagcagcggcttcatcctgaccaaggaccagcctgtgacagccaacatgtactttgattctggcaacccagcccccagcaccaccagccagcaggccaacagccagagcaccccagagcccagccccagccagaccttccctgagagcgtggtggccgagaagcagtacttcatcgagaagctgacagccaccatctggaagaacctgagcaaccctgagatgaccagcggcagtgacaagatcaactacacctacatgctgacccgctgcatccaggcctgcaagaccaaccctgagtacatctatgcccccctgaaggagatccccccagctgacatccccaagaacaagaagctgctgacagatggctacgcctgtgaggtgcgctgccagaacatctacctgaccaccggctacgccggcagcaagaatggcagccgggaccgggccacagagctggccgtgaagctgctgcagaagagaattgaggtgcgggtggtgcggaggaagttcaagcacaccttcggggaggacctggtggtgtgccagatcggcatgagcagctatgagttccccccagccctgaagcccccagaggacctggtggtgctgggcaaggatgccagcggccagcccatcttcaatgccagcgccaagcactggaccaactttgtgatcacagaaaatgccaatgatgccatcggcatcctgaacaacagcgccagcttcaacaagatgagcattgagtacaagtatgagatgatgcccaacagaacctggcgctgcagggtcttcctgcaggaccactgcctggccgagggctacggcaccaagaagaccagcaagcatgctgctgctgatgaggccctgaagatcctgcagaagacccagcccacctaccccagcgtgaagagcagccagtgccacacaggcagcagcccccggggcagcggcaagaagaaggacatcaaggacctggtggtgtatgagaacagcagcaaccctgtgtgcaccctgaatgacacagcccagttcaacaggatgacagtggagtatgtgtatgaaagaatgacaggcctgcgctggaagtgcaaggtgatcctggagagcgaggtgattgctgaggccgtgggcgtgaagaagacagtgaagtatgaggccgccggggaggccgtgaagaccctgaagaagacccagcccaccgtcatcaacaacctgaagaagggagctgtggaggatgtgatcagcagaaatgagatccagggccgctctgctgaggaggcctacaagcagcagatcaaggaggacaacatcggcaaccagctgctgaggaagatgggctggacaggaggcggcctgggcaagtctggagagggcatccgggagcccatctctgtgaaggagcagcacaagcgggagggcctgggcctggatgtggagcgggtgaacaagatcgccaagagggacatcgagcagatcatccggaactatgcccggtctgagagccacacagacctgaccttcagccgggagctgaccaatgatgagaggaagcagatccaccagatcgcccagaagtatggcctgaagagcaagagccatggagtgggccatgaccgctacctggtggtgggcaggaagaggaggaaggaggacctgctggaccagctgaagcaggagggccaggtgggccactatgagctggtgatgccccaggccaactag

SEQ ID NO: 161828 - DNA, 570 bp, Artificial Sequence
  Description of Artificial Sequence: Synthetic coding sequence
atgctgctgcgggccgcctggaggagagctgctgtggccgtgacagctgcccctggccccaagccagctgcccccacccggggcctgcggctgcgggtgggggaccgggccccccagagcgctgtgcctgctgacacagctgctgcccctgaggtgggccctgtgctgcggcccctgtacatggatgtgcaggccaccacccccctggacccccgggtgctggatgccatgctgccctacctgatcaactactacggcaacccccacagcaggacccacgcctacggctgggagagcgaggccgccatggagcgggcccggcagcaggtggccagcctcatcggggctgacccccgggagatcatcttcaccagcggggccacagagagcaacaacatcgccatcaagacagagagccacagcgtcatccaggccggcgtgcagtggcatgacctggacagcctgcaggcccctcctcctggcttcacccccttcagctgcctgagcctgctgagctcctgggactacagaagacctccaccccacccagccaacttcctgtacttctag

SEQ ID NO: 161829 - DNA, 1374 bp, Artificial Sequence
  Description of Artificial Sequence: Synthetic coding sequence
atgctgctgcgggccgcctggaggagagctgctgtggccgtgacagctgcccctggccccaagccagctgcccccacccggggcctgcggctgcgggtgggggaccgggccccccagagcgctgtgcctgctgacacagctgctgcccctgaggtgggccctgtgctgcggcccctgtacatggatgtgcaggccaccacccccctggacccccgggtgctggatgccatgctgccctacctgatcaactactacggcaacccccacagcaggacccacgcctacggctgggagagcgaggccgccatggagcgggcccggcagcaggtggccagcctcatcggggctgacccccgggagatcatcttcaccagcggggccacagagagcaacaacatcgccatcaagggcgtggcccgcttctaccgcagcaggaagaagcacctgatcaccacccagacagagcacaagtgtgtgctggacagctgccgcagcctggaggccgagggcttccaggtgacctacctgcctgtgcagaagagcggcatcatcgacctgaaggagctggaggccgccatccagcctgacaccagcctggtgtctgtgatgacagtgaacaatgaaattggagtgaagcagcccatcgccgagatcggccgcatctgcagcagcaggaaggtgtacttccacacagatgctgcccaggccgtgggcaagatccccctggatgtgaatgacatgaagattgacctgatgagcatcagcggccacaagatctacggccccaagggcgtgggcgccatctacatcagaagaagaccccgggtgcgggtggaggccctgcagagcggcggcggccaggagcggggcatgaggtctggaacagtgcccacccccctggtggtgggcctgggcgccgcctgtgaggtggcccagcaggagatggagtatgaccacaagaggatcagcaagctgtctgagcggctcatccagaacatcatgaagagcctgcctgatgtggtgatgaatggagaccccaagcaccactacccaggctgcatcaacctgagctttgcctacgtggagggggagagcctgctgatggccctgaaggatgtggccctgagcagcggcagcgcctgcaccagcgccagcctggagcccagctatgtgctgcgggccatcggcacagatgaggacctggcccacagcagcatccgcttcggcatcggccgcttcaccacagaggaggaggtggactacacagtggagaagtgcatccagcacgtgaagaggctgcgggagatgagccccctgtgggagatggtgcaggacggcatcgacctgaagagcatcaagtggacccagcactag

SEQ ID NO: 161830 - DNA, 486 bp, Artificial Sequence
  Description of Artificial Sequence: Synthetic coding sequence
atgctgctgcgggccgcctggaggagagctgctgtggccgtgacagctgcccctggccccaagccagctgcccccacccggggcctgcggctgcgggtgggggaccgggccccccagagcgctgtgcctgctgacacagctgctgcccctgaggtgggccctgtgctgcggcccctgtacatggatgtgcaggccaccacccccctggacccccgggtgctggatgccatgctgccctacctgatcaactactacggcaacccccacagcaggacccacgcctacggctgggagagcgaggccgccatggagcgggcccggcagcaggtggccagcctcatcggggctgacccccgggagatcatcttcaccagcggggccacagagagcaacaacatcgccatcaagggcgtggcccgcttctaccgcagcaggaagaagcacctgatcaccaccctgagcggcggggccggcggctgtgtgtag

SEQ ID NO: 161831 - DNA, 768 bp, Artificial Sequence
  Description of Artificial Sequence: Synthetic coding sequence
atgacagtgaacaatgaaattggagtgaagcagcccatcgccgagatcggccgcatctgcagcagcaggaaggtgtacttccacacagatgctgcccaggccgtgggcaagatccccctggatgtgaatgacatgaagattgacctgatgagcatcagcggccacaagatctacggccccaagggcgtgggcgccatctacatcagaagaagaccccgggtgcgggtggaggccctgcagagcggcggcggccaggagcggggcatgaggtctggaacagtgcccacccccctggtggtgggcctgggcgccgcctgtgaggtggcccagcaggagatggagtatgaccacaagaggatcagcaagctgtctgagcggctcatccagaacatcatgaagagcctgcctgatgtggtgatgaatggagaccccaagcaccactacccaggctgcatcaacctgagctttgcctacgtggagggggagagcctgctgatggccctgaaggatgtggccctgagcagcggcagcgcctgcaccagcgccagcctggagcccagctatgtgctgcgggccatcggcacagatgaggacctggcccacagcagcatccgcttcggcatcggccgcttcaccacagaggaggaggtggactacacagtggagaagtgcatccagcacgtgaagaggctgcgggagatgagccccctgtgggagatggtgcaggacggcatcgacctgaagagcatcaagtggacccagcactag

SEQ ID NO: 161832 - DNA, 1221 bp, Artificial Sequence
  Description of Artificial Sequence: Synthetic coding sequence
atgctgctgcgggccgcctggaggagagctgctgtggccgtgacagctgcccctggccccaagccagctgcccccacccggggcctgcggctgcgggtgggggaccgggccccccagagcgctgtgcctgctgacacagctgctgcccctgaggtgggccctgtgctgcggcccctgtacatggatgtgcaggccaccacccccctggacccccgggtgctggatgccatgctgccctacctgatcaactactacggcaacccccacagcaggacccacgcctacggctgggagagcgaggccgccatggagcgggcccggcagcaggtggccagcctcatcggggctgacccccgggagatcatcttcaccagcggggccacagagagcaacaacatcgccatcaaggagctggaggccgccatccagcctgacaccagcctggtgtctgtgatgacagtgaacaatgaaattggagtgaagcagcccatcgccgagatcggccgcatctgcagcagcaggaaggtgtacttccacacagatgctgcccaggccgtgggcaagatccccctggatgtgaatgacatgaagattgacctgatgagcatcagcggccacaagatctacggccccaagggcgtgggcgccatctacatcagaagaagaccccgggtgcgggtggaggccctgcagagcggcggcggccaggagcggggcatgaggagcggcaccgtgcccacccccctggtggtgggcctgggcgccgcctgtgaggtggcccagcaggagatggagtatgaccacaagaggatcagcaagctgtctgagcggctcatccagaacatcatgaagagcctgcctgatgtggtgatgaatggagaccccaagcaccactacccaggctgcatcaacctgagctttgcctacgtggagggggagagcctgctgatggccctgaaggatgtggccctgagcagcggcagcgcctgcaccagcgccagcctggagcccagctatgtgctgcgggccatcggcacagatgaggacctggcccacagcagcatccgctttggaattggccgcttcaccacagaggaggaggtggactacacagtggagaagtgcatccagcacgtgaagaggctgcgggagatgagccccctgtgggagatggtgcaggacggcatcgacctgaagagcatcaagtggacccagcactag

SEQ ID NO: 161833 - DNA, 693 bp, Artificial Sequence
  Description of Artificial Sequence: Synthetic coding sequence
atgctgaagaacccctacaccatcaagaagcagcccctgcaccagtttgtgcagaggcccctcttccccctgcctgctgccttctaccaccctgtgcgctacatgttcatccagacccaggacacccccaaccccaacagcctgaagttcatccctgggaagcctgtgctggagaccaggaccatggacttccccaccccagctgctgccttccgcagccccctggcccggcagctgttccgcatcgagggcgtgaagtctgtgttcttcggccctgacttcatcaccgtgaccaaggaaaatgaggagctggactggaacctgctgaagccagacatctatgccaccatcatggacttctttgccagcggcctgcccctggtgacagaggagacccccagcggggaggccggctctgaagaagatgatgaggtggtggccatgatcaaggagctgctggacacccgcatccggcccaccgtgcaggaggatggaggagatgtgatctacaagggctttgaagatggcatcgtgcagctgaagctgcagggcagctgcaccagctgccccagcagcatcatcaccctgaagaatggcatccagaacatgctgcagttctacatccctgaggtggagggcgtggagcaggtgatggatgatgaaagtgatgagaaggaggccaacagcccctag

SEQ ID NO: 161834 - DNA, 342 bp, Artificial Sequence
  Description of Artificial Sequence: Synthetic coding sequence
atggacttctttgccagcggcctgcccctggtgacagaggagaccccatctggagaggccggcagcgaggaggatgatgaggtggtggccatgatcaaggagctgctggacacccgcatccggcccaccgtgcaggaggatggaggagatgtgatctacaagggctttgaagatggcatcgtgcagctgaagctgcagggcagctgcaccagctgccccagcagcatcatcaccctgaagaatggcatccagaacatgctgcagttctacatccctgaggtggagggcgtggagcaggtgatggatgatgaaagtgatgagaaggaggccaacagcccctag

SEQ ID NO: 161835 - DNA, 765 bp, Artificial Sequence
  Description of Artificial Sequence: Synthetic coding sequence
atggccgccacagcccggcggggctggggcgctgctgctgtggccgccggcctgcggcggcgcttctgccacatgctgaagaacccctacaccatcaagaagcagcccctgcaccagtttgtgcagaggcccctcttccccctgcctgctgccttctaccaccctgtgcgctacatgttcatccagacccaggacacccccaaccccaacagcctgaagttcatccctgggaagcctgtgctggagaccaggaccatggacttccccaccccagctgctgccttccgcagccccctggcccggcagctgttccgcatcgagggcgtgaagtctgtgttcttcggccctgacttcatcaccgtgaccaaggaaaatgaggagctggactggaacctgctgaagccagacatctatgccaccatcatggacttctttgccagcggcctgcccctggtgacagaggagacccccagcggggaggccggctctgaagaagatgatgaggtggtggccatgatcaaggagctgctggacacccgcatccggcccaccgtgcaggaggatggaggagatgtgatctacaagggctttgaagatggcatcgtgcagctgaagctgcagggcagctgcaccagctgccccagcagcatcatcaccctgaagaatggcatccagaacatgctgcagttctacatccctgaggtggagggcgtggagcaggtgatggatgatgaaagtgatgagaaggaggccaacagcccctag

SEQ ID NO: 161836 - DNA, 300 bp, Artificial Sequence
  Description of Artificial Sequence: Synthetic coding sequence
atggacttctttgccagcggcctgcccctggtgacagaggagaccccatctggagaggccggcagcgaggaggatgatgaggtggtggccatgatcaaggagctgctggacacccgcatccggcccaccgtgcaggaggatggaggagatgtgatctacaagggctttgaagatggcatcgtgcagctgaagctgcagggcagctgcaccagctgccccagcagcatcatcaccctgaagaatggcatccagaacatgctgcagttctacatccctgaggtggagggcgtggagcagtag

SEQ ID NO: 161837 - DNA, 342 bp, Artificial Sequence; identical to SEQ ID NO: 161834
  Description of Artificial Sequence: Synthetic coding sequence

SEQ ID NO: 161838 - DNA, 291 bp, Artificial Sequence
  Description of Artificial Sequence: Synthetic coding sequence
atggacttctttgccagcggcctgcccctggtgacagaggagaccccatctggagaggccggcagcgaggaggatgatgaggtggtggccatgatcaaggagctgctggacacccgcatccggcccaccgtgcaggaggatggaggagatgtgatctacaagggctttgaagatggcatcgtgcagctgaagctgcagggcagctgcaccagctgccccagcagcatcatcaccctgaagaatggcatccagaacatgctgcagttctacatccctgaggtggagggctag

SEQ ID NO: 161839 - DNA, 1464 bp, Artificial Sequence
  Description of Artificial Sequence: Synthetic coding sequence
atggctgctgccctgcccaggaccctgggggagctgcagctgtaccgcatcctgcagaaggccaacctgctgagctactttgatgccttcatccagcagggcggagatgatgtgcagcagctgtgtgaggccggggaggaggagttcctggagatcatggccctggtgggcatggccagcaagcccctgcacgtgcggcggctgcagaaggccctgcgggactgggtgaccaaccctggcctcttcaaccagcccctgaccagcctgcctgtgagcagcatccccatctacaagctgcctgagggcagccccacctggctgggcatcagctgcagcagctatgaaagaagcagcaatgcccgggagccccacctgaagatccccaagtgtgccgccaccacctgtgtgcagagcctgggccagggcaagagtgatgtggtgggcagcctggccctgcagagcgtgggggagagccggctgtggcagggccaccacgccacagaaagtgagcacagcctgagccctgctgacctgggcagccctgccagccccaaggagagcagcgaggccctggatgctgctgctgccctgtctgtggctgaatgtgtggagaggatggcccccaccctgcccaagagtgacctgaatgaggtgaaggagctgctgaagaccaacaagaagctggccaagatgattggccacatctttgagatgaatgatgatgacccccacaaggaggaggagatcaggaagtacagcgccatctacggccgctttgacagcaagaggaaggatggcaagcacctgaccctgcacgagctgactgtgaatgaagctgctgcccagctgtgtgtgaaggacaatgccctgctgaccaggagagatgagctgtttgccctggcccggcagatcagccgggaggtgacctacaagtacacctaccgcaccaccaagagcaaatgtggggagagagatgagctgagccccaagaggatcaaggtggaggatggcttcccagacttccaggacagcgtgcagaccctcttccagcaggcccgggccaagtctgaggagctggccgccctgagcagccagcagcctgagaaggtgatggccaagcagatggagttcctgtgcaaccaggccggctatgaaaggctgcagcacgccgagcggcggctgtctgctggcctgtaccggcagagcagcgaggagcacagccccaacggcctgaccagtgacaacagtgatggccagggcgagcggcccctgaacctgaggatgcccaacctgcagaaccggcagccccaccactttgtggtggatggagagctgagccggctgtaccccagcgaggccaagagccacagcagcgagagcctgggcatcctgaaggactacccccacagcgccttcaccctggagaagaaggtgatcaagacagagcctgaggacagcaggtag

SEQ ID NO: 161840 - DNA, 1377 bp, Artificial Sequence
  Description of Artificial Sequence: Synthetic coding sequence
atggctgctgccctgcccaggaccctgggggagctgcagctgtaccgcatcctgcagaaggccaacctgctgagctactttgatgccttcatccagcagggcggagatgatgtgcagcagctgtgtgaggccggggaggaggagttcctggagatcatggccctggtgggcatggccagcaagcccctgcacgtgcggcggctgcagaaggccctgcgggactgggtgaccaaccctggcctcttcaaccagcccctgaccagcctgcctgtgagcagcatccccatctacaagctgcctgagggcagccccacctggctgggcatcagctgcagcagctatgaaagaagcagcaatgcccgggagccccacctgaagatccccaagtgtgccgccaccacctgtgtgcagagcctgggccagggcaagagtgatgtggtgggcagcctggccctgcagagcgtgggggagagccggctgtggcagggccaccacgccacagaaagtgagcacagcctgagccctgctgacctgggcagccctgccagccccaaggagagcagcgaggccctggatgctgctgctgccctgtctgtggctgaatgtgtggagaggatggcccccaccctgcccaagagtgacctgaatgaggtgaaggagctgctgaagaccaacaagaagctggccaagatgattggccacatctttgagatgaatgatgatgacccccacaaggaggaggagatcaggaagtacagcgccatctacggccgctttgacagcaagaggaaggatggcaagcacctgaccctgcacgagctgactgtgaatgaagctgctgcccagctgtgtgtgaaggacaatgccctgctgaccaggagagatgagctgtttgccctggcccggcagatcagccgggaggtgacctacaagtacacctaccgcaccaccaagagcaaatgtggggagagagatgagctgagccccaagaggatcaaggtggaggaccagcctgagaaggtgatggccaagcagatggagttcctgtgcaaccaggccggctatgagcggctgcagcacgccgagcggcggctgtctgctggcctgtaccggcagagcagcgaggagcacagccccaacggcctgaccagtgacaacagtgatggccagggcgagcggcccctgaacctgaggatgcccaacctgcagaaccggcagccccaccactttgtggtggatggagagctgagccggctgtaccccagcgaggccaagagccacagcagcgagagcctgggcatcctgaaggactacccccacagcgccttcaccctggagaagaaggtgatcaagacagagcctgaggacagcaggtag

SEQ ID NO: 161841 - DNA, 1464 bp, Artificial Sequence; identical to SEQ ID NO: 161839
  Description of Artificial Sequence: Synthetic coding sequence

SEQ ID NO: 161842 - DNA, 1461 bp, Artificial Sequence
  Description of Artificial Sequence: Synthetic coding sequence
atggctgctgccctgcccaggaccctgggggagctgcagctgtaccgcatcctgcagaaggccaacctgctgagctactttgatgccttcatccagcagggcggagatgatgtgcagcagctgtgtgaggccggggaggaggagttcctggagatcatggccctggtgggcatggccagcaagcccctgcacgtgcggcggctgcagaaggccctgcgggactgggtgaccaaccctggcctcttcaaccagcccctgaccagcctgcctgtgagcagcatccccatctacaagctgcctgagggcagccccacctggctgggcatcagctgcagcagctatgaaagaagcagcaatgcccgggagccccacctgaagatccccaagtgtgccgccaccacctgtgtgcagagcctgggccagggcaagagtgatgtggtgggcagcctggccctgcagagcgtgggggagagccggctgtggcagggccaccacgccacagaaagtgagcacagcctgagccctgctgacctgggcagccctgccagccccaaggagagcagcgaggccctggatgctgctgctgccctgtctgtggctgaatgtgtggagaggatggcccccaccctgcccaagagtgacctgaatgaggtgaaggagctgctgaagaccaacaagaagctggccaagatgattggccacatctttgagatgaatgatgatgacccccacaaggaggaggagatcaggaagtacagcgccatctacggccgctttgacagcaagaggaaggatggcaagcacctgaccctgcacgagctgactgtgaatgaagctgctgcccagctgtgtgtgaaggacaatgccctgctgaccaggagagatgagctgtttgccctggcccggcagatcagccgggaggtgacctacaagtacacctaccgcaccaccaagagcaaatgtggggagagagatgagctgagccccaagaggatcaaggtggaggatggcttcccagacttccaggacagcgtgcagaccctcttccagcaggcccgggccaagtctgaggagctggccgccctgagcagccagcctgagaaggtgatggccaagcagatggagttcctgtgcaaccaggccggctatgagcggctgcagcacgccgagcggcggctgtctgctggcctgtaccggcagagcagcgaggagcacagccccaacggcctgaccagtgacaacagtgatggccagggcgagcggcccctgaacctgaggatgcccaacctgcagaaccggcagccccaccactttgtggtggatggagagctgagccggctgtaccccagcgaggccaagagccacagcagcgagagcctgggcatcctgaaggactacccccacagcgccttcaccctggagaagaaggtgatcaagacagagcctgaggacagcaggtag

SEQ ID NO: 161843 - DNA, 474 bp, Artificial Sequence
  Description of Artificial Sequence: Synthetic coding sequence
atggctgctgccctgcccaggaccctgggggagctgcagctgtaccgcatcctgcagaaggccaacctgctgagctactttgatgccttcatccagcagggcggagatgatgtgcagcagctgtgtgaggccggggaggaggagttcctggagatcatggccctggtgggcatggccagcaagcccctgcacgtgcggcggctgcagaaggccctgcgggactgggtgaccaaccctggcctcttcaaccagcccctgaccagcctgcctgtgagcagcatccccatctacaagctgcctgagggcagccccacctggctgggcatcagctgcagcagctatgaaagaagcagcaatgcccgggagccccacctgaagatccccaagtgtgccgccaccacctgtgtgcagagcctgggccagggcaagagtgatgtggtgggcagcctggccctgcagagcgtgggggagtag

SEQ ID NO: 161844 - DNA, 189 bp, Artificial Sequence
  Description of Artificial Sequence: Synthetic coding sequence
atggctgctgccctgcccaggaccctgggggagctgcagctgtaccgcatcctgcagaaggccaacctgctgagctactttgatgccttcatccagcagggcggagatgatgtgcagcagctgtgtgaggccggggaggaggagttcctggagatcatggccctggtgggcatggccagcaagccctag

SEQ ID NO: 161845 - DNA, 303 bp, Artificial Sequence
  Description of Artificial Sequence: Synthetic coding sequence
atggctgctgccctgcccaggaccctgggggagctgcagctgtaccgcatcctgcagaaggccaacctgctgagctactttgatgccttcatccagcagggcggagatgatgtgcagcagctgtgtgaggccggggaggaggagttcctggagatcatggccctggtgggcatggccagcaagcccctgcacgtgcggcggctgcagaaggccctgcgggactgggtgaccaaccctggcctcttcaaccagcccctgaccagcctgcctgtgagcagcatccccatctacaagctgccctag

SEQ ID NO: 161846 - DNA, 723 bp, Artificial Sequence
  Description of Artificial Sequence: Synthetic coding sequence
tgaaaggagctgctgaagaccaacaagaagctggccaagatgattggccacatctttgagatgaatgatgatgacccccacaaggaggaggagatcaggaagtacagcgccatctacggccgctttgacagcaagaggaaggatggcaagcacctgaccctgcacgagctgactgtgaatgaggccgccgcccagctgtgtgtgaaggacaatgccctgctgaccaggagagatgagctgtttgccctggcccggcagatcagccgggaggtgacctacaagtacacctaccgcaccaccaagagcaaatgtggggagagagatgagctgagccccaagaggatcaaggtggagcagcctgagaaggtgatggccaagcagatggagttcctgtgcaaccaggccggctatgagcggctgcagcacgccgagcggcggctgtctgctggcctgtaccggcagagcagcgaggagcacagccccaacggcctgaccagtgacaacagtgatggccagggcgagcggcccctgaacctgaggatgcccaacctgcagaaccggcagccccaccactttgtggtggatggagagctgagccggctgtaccccagcgaggccaagagccacagcagcgagagcctgggcatcctgaaggactacccccacagcgccttcaccctggagaagaaggtgatcaagacagagcctgaggacagcaggtag

SEQ ID NO: 161847 - DNA, 459 bp, Artificial Sequence
  Description of Artificial Sequence: Synthetic coding sequence
atggctgctgccctgcccaggaccctgggggagctgcagctgtaccgcatcctgcagaaggccaacctgctgagctactttgatgccttcatccagcagggcggagatgatgtgcagcagctgtgtgaggccggggaggaggagttcctggagatcatggccctggtgggcatggccagcaagcccctgcacgtgcggcggctgcagaaggccctgcgggactgggtgaccaaccctggcctcttcaaccagcccctgaccagcctgcctgtgagcagcatccccatctacaagctgcctgagggcagccccacctggctgggcatcagctgcagcagctatgaaagaagcagcaatgcccgggagccccacctgaagatccccaagtgtgccgccaccacctgtgtgcagagcctgggccagggcaagagtgatgtggtgggcagcctggccctgtag

SEQ ID NO: 161848 - DNA, 684 bp, Artificial Sequence
  Description of Artificial Sequence: Synthetic coding sequence
atgattggccacatctttgagatgaatgatgatgacccccacaaggaggaggagatcaggaagtacagcgccatctacggccgctttgacagcaagaggaaggatggcaagcacctgaccctgcacgagctgactgtgaatgaagctgctgcccagctgtgtgtgaaggacaatgccctgctgaccaggagagatgagctgtttgccctggcccggcagatcagccgggaggtgacctacaagtacacctaccgcaccaccaagagcaaatgtggggagagagatgagctgagccccaagaggatcaaggtggagcagcctgagaaggtgatggccaagcagatggagttcctgtgcaaccaggccggctatgaaaggctgcagcacgccgagcggcggctgtctgctggcctgtaccggcagagcagcgaggagcacagccccaacggcctgaccagtgacaacagtgatggccagggcgagcggcccctgaacctgaggatgcccaacctgcagaaccggcagccccaccactttgtggtggatggagagctgagccggctgtaccccagcgaggccaagagccacagcagcgagagcctgggcatcctgaaggactacccccacagcgccttcaccctggagaagaaggtgatcaagacagagcctgaggacagcaggtag

SEQ ID NO: 161849 - DNA, 1578 bp, Artificial Sequence
  Description of Artificial Sequence: Synthetic coding sequence
atgcaccgggcccccagccccacagctgagcagcccccaggcggcggggacagcgcccggaggaccctgcagccccggctgaagcccagcgcccgggccatggccctgcccaggaccctgggggagctgcagctgtacagagtgctgcagagggccaacctgctgagctactatgagaccttcatccagcagggcggagatgatgtgcagcagctgtgtgaggccggggaggaggagttcctggagatcatggccctggtgggcatggccaccaagcccctgcacgtgcggcggctgcagaaggccctgcgggagtgggccaccaaccctggcctcttcagccagcctgtgcctgctgtgcctgtgagcagcatccccctcttcaagatcagcgagacagctggcaccaggaagggctccatgagcaatggacatggcagccctggagagaaggccggcagcgcccgctccttcagccccaagagccccctggagctgggggagaagctgagccccctgcccggcggccctggagctggggacccccgcatctggccaggccgcagcaccccagagagtgatgtgggcgccggcggggaggaggaggccggcagcccccccttcagccccccagctgggggcggcgtgcctgagggcaccggggccggcggcctggccgccggcggcaccggcggcggccctgaccggctggagcctgagatggtgaggatggtggtggagagcgtggagcgcatcttccgctccttccccagaggagatgctggggaggtgaccagcctgctgaagctgaacaagaagctggcccggtctgtgggccacatctttgagatggatgacaatgacagccagaaggaggaggagatcaggaagtacagcatcatctacggccgctttgacagcaagagaagagagggcaagcagctgagcctgcacgagctgaccatcaatgaagctgctgcccagttctgcatgagggacaacaccctgctgctgcggcgggtggagctgttcagcctgagccggcaggtggcccgggagagcacctacctgagcagcctgaagggcagccggctgcaccctgaggagctgggcggcccccccctgaagaagctgaagcaggaggtgggggagcagagccaccctgagatccagcagcccccacctggccctgagagctatgtgcccccctaccggcccagcctggaggaggacagcgccagcctgagcggggagagcctggatggccacctgcaggccgtgggcagctgcccccggctgaccccacctcctgctgacctgcccctggccctgcctgcccacggcctgtggagccgccacatcctgcagcagaccctgatggatgagggcctgcggctggcccggctggtgtcccatgacagagtgggccgcctgagcccctgtgtgcctgccaagccacccctggccgagtttgaggagggcctgctggaccgctgcccagcccctggcccccacccagccctggtggagggccgccgcagctctgtgaaggtggaggccgaggccagccggcagtag

SEQ ID NO: 161850 - DNA, 1386 bp, Artificial Sequence
  Description of Artificial Sequence: Synthetic coding sequence
atgcaccgggcccccagccccacagctgagcagcccccaggcggcggggacagcgcccggaggaccctgcagccccggctgaagcccagcgcccgggccatggccctgcccaggaccctgggggagctgcagctgtacagagtgctgcagagggccaacctgctgagctactatgagaccttcatccagcagggcggagatgatgtgcagcagctgtgtgaggccggggaggaggagttcctggagatcatggccctggtgggcatggccaccaagcccctgcacgtgcggcggctgcagaaggccctgcgggagtgggccaccaaccctggcctcttcagccagcctgtgcctgctgtgcctgtgagcagcatccccctcttcaagatcagcgagacagctggcaccaggaagggctccatgagcaatggacatggcagccctggagagaaggccggcagcgcccgctccttcagccccaagagccccctggagctgggggagaagctgagccccctgcccggcggccctggagctggggacccccgcatctggccaggccgcagcaccccagagagtgatgtgggcgccggcggggaggaggaggccggcagcccccccttcagccccccagctgggggcggcgtgcctgagggcaccggggccggcggcctggccgccggcggcaccggcggcggccctgaccggctggagcctgagatggtgaggatggtggtggagagcgtggagcgcatcttccgctccttccccagaggagatgctggggaggtgaccagcctgctgaagctgaacaagaagctggcccggtctgtgggccacatctttgagatggatgacaatgacagccagaaggaggaggagatcaggaagtacagcatcatctacggccgctttgacagcaagagaagagagggcaagcagctgagcctgcacgagctgaccatcaatgaagctgctgcccagttctgcatgagggacaacaccctgctgctgcggcgggtggagctgttcagcctgagccggcaggtggcccgggagagcacctacctgagcagcctgaagggcagccggctgcaccctgaggagctgggcggcccccccctgaagaagctgaagcaggaggtgggggagcagagccaccctgagatccagcagcccccacctggccctgagagctatgtgcccccctaccggcccagcctggaggaggacagcgccagcctgagcggggagagcctggatggccacctgcaggagtttgaggagggcctgctggaccgctgcccagcccctggcccccacccagccctggtggagggccgccgcagctctgtgaaggtggaggccgaggccagccggcagtag

SEQ ID NO: 161851 - DNA, 969 bp, Artificial Sequence
  Description of Artificial Sequence: Synthetic coding sequence
atgcaccgggcccccagccccacagctgagcagcccccaggcggcggggacagcgcccggaggaccctgcagccccggctgaagcccagcgcccgggccatggccctgcccaggaccctgggggagctgcagctgtacagagtgctgcagagggccaacctgctgagctactatgagaccttcatccagcagggcggagatgatgtgcagcagctgtgtgaggccggggaggaggagttcctggagatcatggccctggtgggcatggccaccaagcccctgcacgtgcggcggctgcagaaggccctgcgggagtgggccaccaaccctggcctcttcagccagcctgtgcctgctgtgcctgtgagcagcatccccctcttcaagatcagcgagacagctggcaccaggaagggctccatgagcaatggacatggcagccctggagagaaggccggcagcgcccgctccttcagccccaagagccccctggagctgggggagaagctgagccccctgcccggcggccctggagctggggacccccgcatctggccaggccgcagcaccccagagagtgatgtgggcgccggcggggaggaggaggccggcagcccccccttcagccccccagctgggggcggcgtgcctgagggcaccggggccggcggcctggccgccggcggcaccggcggcggccctgaccggctggagcctgagatggtgaggatggtggtggagagcgtggagcgcatcttccgctccttccccagaggagatgctggggaggtgaccagcctgctgaagctgaacaagaagctggcccggtctgtgggccacatctttgagatggatgacaatgacagccagaaggaggaggagatcaggaagtacagcatcatctacggccgctttgacagcaagagaagagagggcaagcagctgagcctgcacgaggccagcccctag

SEQ ID NO: 161852 - DNA, 723 bp, Artificial Sequence
  Description of Artificial Sequence: Synthetic coding sequence
tgaagcggcagcgccagccctgctgtggccgagctgtgccagaacaccccagagaccttcctggaggccagcaagctgctgctgacctatgctgacaacatcctgaggaaccccaatgatgagaagtaccgcagcatccgcatcggcaacacagccttcagcacccggctgctgcctgtgagaggagctgtggagtgcctgtttgagatgggctttgaggagggggagacccacctgatcttccccaagaaggcctctgtggagcagctgcagaagatccgggacctgattgccatcgagaggagcagccggctggatggcagcaacaagagccacaaggtgaagagcagccagcagcctgctgccagcacccagctgcccaccacccccagcagcaaccccagcggcctgaaccagcacaccaggaaccggcagggccagagcagtgaccccccatctgccagcacagtggccgctgacagcgccatcctggaggtgctgcagagcaacatccagcacgtgctggtgtatgagaacccagccctgcaggagaaggccctggcctgcatccctgtgcaggagctgaagaggaagagccaggagaagctgagccgggccaggaagctggacaaggacatcatcaccctgaggaacttctggaagcaggatgtggatggagtggccagcggccccatcgtgctgcactgtgccgctgagctgtag

SEQ ID NO: 161853 - DNA, 1965 bp, Artificial Sequence
  Description of Artificial Sequence: Synthetic coding sequence
atggctgctgctgccctgggcagcagcagcggcagcgccagccctgctgtggccgagctgtgccagaacaccccagagaccttcctggaggccagcaagctgctgctgacctatgctgacaacatcctgaggaaccccaatgatgagaagtaccgcagcatccgcatcggcaacacagccttcagcacccggctgctgcctgtgagaggagctgtggagtgcctgtttgagatgggctttgaggagggggagacccacctgatcttccccaagaaggcctctgtggagcagctgcagaagatccgggacctgattgccatcgagaggagcagccggctggatggcagcaacaagagccacaaggtgaagagcagccagcagcctgctgccagcacccagctgcccaccacccccagcagcaaccccagcggcctgaaccagcacaccaggaaccggcagggccagagcagtgaccccccatctgccagcacagtggccgctgacagcgccatcctggaggtgctgcagagcaacatccagcacgtgctggtgtatgagaacccagccctgcaggagaaggccctggcctgcatccctgtgcaggagctgaagaggaagagccaggagaagctgagccgggccaggaagctggacaagggcatcaacatcagtgatgaggacttcctgctgctggagctgctgcactggttcaaggaggagttcttccactgggtgaacaacgtgctgtgcagcaaatgtggcggccagaccaggagccgggacaggagcctgctgcccagtgatgatgagctgaagtggggcgccaaggaggtggaggaccactactgtgatgcctgccagttcagcaaccgcttcccccgctacaacaaccctgagaagctgctggagacccgctgtggccgctgtggggagtgggccaactgcttcaccctgtgctgcagagctgtgggctttgaggcccgctacgtgtgggactacacagaccacgtgtggacagaggtgtacagccccagccagcagcgctggctgcactgtgatgcctgtgaagatgtgtgtgacaagcccctgctgtatgaaattggctggggcaagaagctgtcctatgtgattgccttcagcaaggatgaggtggtggatgtgacctggagatacagctgcaagcatgaggaggtgattgcccggaggaccaaggtgaaggaggccctgctgcgggacaccatcaatggcctgaacaagcagaggcagctgttcctgtctgaaaatagaaggaaggagctgctgcagaggatcatcgtggagctggtggagttcatcagccccaagacccccaagccaggagagctgggcggccgcatcagcggctctgtggcctggagggtggcccggggggagatgggcctgcagaggaaggagaccctcttcatcccctgtgaaaatgagaagatcagcaagcagctgcacctgtgctacaacatcgtgaaggaccgctacgtgcgggtgagcaacaacaaccagaccatcagcggctgggagaatggagtgtggaagatggagagcatcttcaggaaggtggagacagactggcacatggtgtacctggccaggaaggagggcagcagctttgcctacatctcctggaagtttgaatgtggctctgtgggcctgaaggtggacagcatcagcatccgcaccagcagccagaccttccagacaggcaccgtggagtggaagctgcggagtgacacagcccaggtggagctgactggagacaacagcctgcacagctatgctgacttcagcggggccacagaggtgatcctggaggccgagctgagcagaggagatggagatgtggcctggcagcacacccagctgttccggcagagcctgaatgaccacgaggagaactgcctggagatcatcatcaagttcagtgacctgtag

SEQ ID NO: 161854 - DNA, 1902 bp, Artificial Sequence
  Description of Artificial Sequence: Synthetic coding sequence
gctgccctgggcagcagcagcggcagcgccagccctgctgtggccgagctgtgccagaacaccccagagaccttcctggaggccagcaagctgctgctgacctacgccgacaacatcctgaggaaccccaatgatgagaagtaccgcagcatcagaattggcaacacagccttcagcacccggctgctgcctgtgagaggagctgtggagtgcctgtttgagatgggctttgaggagggggagacccacctgatcttccccaagaaggcctctgtggagcagctgcagaagatccgggacctgattgccatcgagaggagcagccggctggatggcagcaacaagagccacaaggtgaagagcagccagcagcctgctgccagcacccagctgcccaccacccccagcagcaaccccagcggcctgaaccagcacaccaggaaccggcagggccagagcagtgacccccccagcgccagcacagtggccgctgacagcgccatcctggaggtgctgcagagcaacatccagcacgtgctggtgtatgaaaatcctgccctgcaggagaaggccctggcctgcatccctgtgcaggagctgaagaggaagagccaggagaagctgagccgggccaggaagctggacaagggcatcaacatcagtgatgaggacttcctgctgctggagctgctgcactggttcaaggaggagttcttccactgggtgaacaacgtgctgtgcagcaaatgtggcggccagaccaggagccgggacaggagcctgctgcccagtgatgatgagctgaagtggggcgccaaggaggtggaggaccactactgtgatgcctgccagttcagcaaccgcttcccccgctacaacaaccctgagaagctgctggagacccgctgtggccgctgtggggagtgggccaactgcttcaccctgtgctgcagagctgtgggctttgaggcccgctacgtgtgggactacacagagctgcagaggaccctgagcctgaagctgaccaccctgaaggagatcggcaagaccttcctgcgcatcagcaagaggcagaagctgatccaggtggtggatgtgacctggagatacagctgcaagcatgaggaggtgattgcccggaggaccaaggtgaaggaggccctgctgcgggacaccatcaatggcctgaacaagcagaggcagctgttcctgtctgagaacagaaggaaggagctgctgcagaggatcatcgtggagctggtggagttcatcagccccaagacccccaagccaggagagctgggcggccgcatcagcggctctgtggcctggagggtggcccggggggagatgggcctgcagaggaaggagaccctcttcatcccctgtgaaaatgagaagatcagcaagcagctgcacctgtgctacaacatcgtgaaggacagatatgtgcgggtgagcaacaacaaccagaccatcagcggctgggagaatggagtgtggaagatggagagcatcttcaggaaggtggagacagactggcacatggtgtacctggccaggaaggagggcagcagctttgcctacatctcctggaagtttgaatgtggctctgtgggcctgaaggtggacagcatcagcatccgcaccagcagccagaccttccagacaggaacagtggagtggaagctgcggagtgacacagcccaggtggagctgaccggggacaacagcctgcacagctatgctgacttcagcggggccacagaggtgatcctggaggccgagctgagcagaggagatggagatgtggcctggcagcacacccagctgttccggcagagcctgaatgaccacgaggagaactgcctggagatcatcatcaagttcagtgacctgtag

SEQ ID NO: 161855 - DNA, 1677 bp, Artificial Sequence
  Description of Artificial Sequence: Synthetic coding sequence
atggctgctgctgccctgggcagcagcagcggcagcgccagccctgctgtggccgagctgtgccagaacaccccagagaccttcctggaggccagcaagctgctgctgacctatgctgacaacatcctgaggaaccccaatgatgagaagtaccgcagcatccgcatcggcaacacagccttcagcacccggctgctgcctgtgagaggagctgtggagtgcctgtttgagatgggctttgaggagggggagacccacctgatcttccccaagaaggcctctgtggagcagctgcagaagatccgggacctgattgccatcgagaggagcagccggctggatggcagcaacaagagccacaaggtgaagagcagccagcagcctgctgccagcacccagctgcccaccacccccagcagcaaccccagcggcctgaaccagcacaccaggaaccggcagggccagagcagtgaccccccatctgccagcacagtggccgctgacagcgccatcctggaggtgctgcagagcaacatccagcacgtgctggtgtatgagaacccagccctgcaggagaaggccctggcctgcatccctgtgcaggagctgaagaggaagagccaggagaagctgagccgggccaggaagctggacaagggcatcaacatcagtgatgaggacttcctgctgctggagctgctgcactggttcaaggaggagttcttccactgggtgaacaacgtgctgtgcagcaaatgtggcggccagaccaggagccgggacaggagcctgctgcccagtgatgatgagctgaagtggggcgccaaggaggtggaggaccactactgtgatgcctgccagttcagcaaccgcttcccccgctacaacaaccctgagaagctgctggagacccgctgtggccgctgtggggagtgggccaactgcttcaccctgtgctgcagagctgtgggctttgaggcccgctacgtgtgggactacacagaccacgtgtggacagaggtgtacagccccagccagcagcgctggctgcactgtgatgcctgtgaagatgtgtgtgacaagcccctgctgtatgaaattggctggggcaagaagctgtcctatgtgattgccttcagcaaggatgaggtggtggatgtgacctggagatacagctgcaagcatgaggaggtgattgcccggaggaccaaggtgaaggaggccctgctgcgggacaccatcaatggcctgaacaagcagaggcagctgttcctgtctgaaaatagaaggaaggagctgctgcagaggatcatcgtggagctggtggagttcatcagccccaagacccccaagccaggagagctgggcggccgcatcagcggctctgtggcctggagggtggcccggggggagatgggcctgcagaggaaggagaccctcttcatcccctgtgaaaatgagaagatcagcaagcagctgcacctgtgctacaacatcgtgaaggaccgctacgtgcgggtgagcaacaacaaccagaccatcagcggctgggagaatggagtgtggaagatggagagcatcttcaggaaggtggagacagactggcacatgatcaccgtcttcacccccatgctgatcttcctggtgcccctgaagctgttctggaagcagaactag

SEQ ID NO: 161856 - DNA, 1839 bp, Artificial Sequence
  Description of Artificial Sequence: Synthetic coding sequence
atgaggaaccccaatgatgagaagtaccgcagcatccgcatcggcaacacagccttcagcacccggctgctgcctgtgagaggagctgtggagtgcctgtttgagatgggctttgaggagggggagacccacctgatcttccccaagaaggcctctgtggagcagctgcagaagatccgggacctgattgccatcgagaggagcagccggctggatggcagcaacaagagccacaaggtgaagagcagccagcagcctgctgccagcacccagctgcccaccacccccagcagcaaccccagcggcctgaaccagcacaccaggaaccggcagggccagagcagtgaccccccatctgccagcacagtggccgctgacagcgccatcctggaggtgctgcagagcaacatccagcacgtgctggtgtatgagaacccagccctgcaggagaaggccctggcctgcatccctgtgcaggagctgaagaggaagagccaggagaagctgagccgggccaggaagctggacaagggcatcaacatcagtgatgaggacttcctgctgctggagctgctgcactggttcaaggaggagttcttccactgggtgaacaacgtgctgtgcagcaaatgtggcggccagaccaggagccgggacaggagcctgctgcccagtgatgatgagctgaagtggggcgccaaggaggtggaggaccactactgtgatgcctgccagttcagcaaccgcttcccccgctacaacaaccctgagaagctgctggagacccgctgtggccgctgtggggagtgggccaactgcttcaccctgtgctgcagagctgtgggctttgaggcccgctacgtgtgggactacacagaccacgtgtggacagaggtgtacagccccagccagcagcgctggctgcactgtgatgcctgtgaagatgtgtgtgacaagcccctgctgtatgaaattggctggggcaagaagctgtcctatgtgattgccttcagcaaggatgaggtggtggatgtgacctggagatacagctgcaagcatgaggaggtgattgcccggaggaccaaggtgaaggaggccctgctgcgggacaccatcaatggcctgaacaagcagaggcagctgttcctgtctgaaaatagaaggaaggagctgctgcagaggatcatcgtggagctggtggagttcatcagccccaagacccccaagccaggagagctgggcggccgcatcagcggctctgtggcctggagggtggcccggggggagatgggcctgcagaggaaggagaccctcttcatcccctgtgaaaatgagaagatcagcaagcagctgcacctgtgctacaacatcgtgaaggaccgctacgtgcgggtgagcaacaacaaccagaccatcagcggctgggagaatggagtgtggaagatggagagcatcttcaggaaggtggagacagactggcacatggtgtacctggccaggaaggagggcagcagctttgcctacatctcctggaagtttgaatgtggctctgtgggcctgaaggtggacagcatcagcatccgcaccagcagccagaccttccagacaggcaccgtggagtggaagctgcggagtgacacagcccaggtggagctgactggagacaacagcctgcacagctatgctgacttcagcggggccacagaggtgatcctggaggccgagctgagcagaggagatggagatgtggcctggcagcacacccagctgttccggcagagcctgaatgaccacgaggagaactgcctggagatcatcatcaagttcagtgacctgtag

SEQ ID NO: 161857 - DNA, 516 bp, Artificial Sequence
  Description of Artificial Sequence: Synthetic coding sequence
atgggctttgaggagggggagacccacctgatcttccccaagaaggcctctgtggagcagctgcagaagatccgggacctgattgccatcgagaggagcagccggctggatggcagcaacaagagccacaaggtgaagagcagccagcagcctgctgccagcacccagctgcccaccacccccagcagcaaccccagcggcctgaaccagcacaccaggaaccggcagggccagagcagtgacccccccagcgccagcacagtggccgctgacagcgccatcctggaggtgctgcagagcaacatccagcacgtgctggtgtatgaaaatcctgccctgcaggagaaggccctggcctgcatccctgtgcaggagctgaagaggaagagccaggagaagctgagccgggccaggaagctggacaaggacatcatcaccctgaggaacttctggaagcaggatgtggatggagtggccagcggccccatcgtgctgcactgtgccgctgagctgtag

SEQ ID NO: 161858 - DNA, 1911 bp, Artificial Sequence
  Description of Artificial Sequence: Synthetic coding sequence
atggctgctgctgccctgggcagcagcagcggcagcgccagccctgctgtggccgagctgtgccagaacaccccagagaccttcctggaggccagcaagctgctgctgacctatgctgacaacatcctgaggaaccccaatgatgagaagtaccgcagcatccgcatcggcaacacagccttcagcacccggctgctgcctgtgagaggagctgtggagtgcctgtttgagatgggctttgaggagggggagacccacctgatcttccccaagaaggcctctgtggagcagctgcagaagatccgggacctgattgccatcgagaggagcagccggctggatggcagcaacaagagccacaaggtgaagagcagccagcagcctgctgccagcacccagctgcccaccacccccagcagcaaccccagcggcctgaaccagcacaccaggaaccggcagggccagagcagtgaccccccatctgccagcacagtggccgctgacagcgccatcctggaggtgctgcagagcaacatccagcacgtgctggtgtatgagaacccagccctgcaggagaaggccctggcctgcatccctgtgcaggagctgaagaggaagagccaggagaagctgagccgggccaggaagctggacaagggcatcaacatcagtgatgaggacttcctgctgctggagctgctgcactggttcaaggaggagttcttccactgggtgaacaacgtgctgtgcagcaaatgtggcggccagaccaggagccgggacaggagcctgctgcccagtgatgatgagctgaagtggggcgccaaggaggtggaggaccactactgtgatgcctgccagttcagcaaccgcttcccccgctacaacaaccctgagaagctgctggagacccgctgtggccgctgtggggagtgggccaactgcttcaccctgtgctgcagagctgtgggctttgaggcccgctacgtgtgggactacacagagctgcagaggaccctgagcctgaagctgaccaccctgaaggagatcggcaagaccttcctgcgcatcagcaagaggcagaagctgatccaggtggtggatgtgacctggagatacagctgcaagcatgaggaggtgattgcccggaggaccaaggtgaaggaggccctgctgcgggacaccatcaatggcctgaacaagcagaggcagctgttcctgtctgaaaatagaaggaaggagctgctgcagaggatcatcgtggagctggtggagttcatcagccccaagacccccaagccaggagagctgggcggccgcatcagcggctctgtggcctggagggtggcccggggggagatgggcctgcagaggaaggagaccctcttcatcccctgtgaaaatgagaagatcagcaagcagctgcacctgtgctacaacatcgtgaaggaccgctacgtgcgggtgagcaacaacaaccagaccatcagcggctgggagaatggagtgtggaagatggagagcatcttcaggaaggtggagacagactggcacatggtgtacctggccaggaaggagggcagcagctttgcctacatctcctggaagtttgaatgtggctctgtgggcctgaaggtggacagcatcagcatccgcaccagcagccagaccttccagacaggcaccgtggagtggaagctgcggagtgacacagcccaggtggagctgactggagacaacagcctgcacagctatgctgacttcagcggggccacagaggtgatcctggaggccgagctgagcagaggagatggagatgtggcctggcagcacacccagctgttccggcagagcctgaatgaccacgaggagaactgcctggagatcatcatcaagttcagtgacctgtag

SEQ ID NO: 161859 - DNA, 1188 bp, Artificial Sequence
  Description of Artificial Sequence: Synthetic coding sequence
atggctgctgaggccagcgagagcggccctgccctgcacgagctgatgagggaggccgagatcagcctgctggagtgcaaggtgtgctttgagaagtttggccaccggcagcagaggcggcccaggaacctgagctgtggccacgtggtgtgcctggcctgtgtggccgccctggcccaccccaggaccctggccctggagtgccccttctgccggcgggcctgccggggctgtgacaccagtgactgcctgcctgtgctgcacctgattgagctgctgggcagcgccctgcggcagagccctgctgcccaccgggccgcccccagcgcccctggggccctgacctgccaccacaccttcggcggctggggcaccctggtgaaccccaccggcctggccctgtgccccaagacaggccgggtggtggtggtgcatgatggaagaagaagagtgaagatctttgacagcggcggcggctgtgcccaccagtttggagagaagggagatgctgcccaggacatccgctaccctgtggatgtgaccatcaccaatgactgccacgtggtggtgacagatgctggggacaggagcatcaaggtgtttgacttcttcggccagatcaagctggtgattggaggccagttcagcctgccctggggcgtggagaccaccccccagaatggaattgtggtgacagatgctgaggccggcagcctgcacctgctggatgtggactttgctgagggcgtgctgcggaggacagagcggctgcaggcccacctgtgcaacccccggggcgtggccgtgtcctggctgactggagccatcgctgtgctggagcaccccctggccctgggcactggagtgtgcagcaccagggtgaaggtgttcagcagctccatgcagctggtgggccaggtggacaccttcggcctgagcctgtacttccccagcaagatcacagccagcgctgtgacctttgaccaccagggcaatgtcatcgtggccgacaccagcggccctgccatcctgtgcctgggcaagccagaggagttccctgtgcccaagcccatggtgacccacggcctgagccaccctgtggccctgaccttcaccaaggagaacagcctgctggtgctggacacagccagccacagcatcaaggtgtacaaggtggactggggctag

SEQ ID NO: 161860 - DNA, 903 bp, Artificial Sequence
  Description of Artificial Sequence: Synthetic coding sequence
atggctgctgctgctggagatgctgatgatgagcccaggagcggccacagcagcagcgagggggagtgtgctgtggcccctgagcccctgacagatgctgagggcctcttctcctttgctgactttggcagcgccctgggcggcggcggggccggcctgagcggccgggccagcggcggggcccagagccccctgcgctacctgcacgtgctgtggcagcaggatgctgagcccagagatgagctgcgctgcaagatcccagctggccgcctgcggcgggccgcccggccccaccggcggctgggccccaccgggaaggaggtgcacgccctgaagaggctgcgggacagcgccaatgccaatgatgtggagaccgtgcagcagctgctggaggatggagctgacccctgtgccgcagatgacaagggccgcacagccctgcactttgccagctgcaatggaaatgaccagatcgtgcagctgctgctggaccatggagctgaccccaaccagagagatggcctgggcaacacccccctgcacctggccgcctgcaccaaccacgtgcctgtgatcaccaccctgctgcggggcggggcccgggtggatgccctggaccgggccggccgcacccccctgcacctggccaagagcaagctgaacatcctgcaggagggccacgcccagtgcctggaggccgtgcggctggaggtgaagcagatcatccacatgctgcgggagtacctggagcggctgggccagcacgagcagcgggagcggctggatgacctgtgcacccggctgcagatgaccagcaccaaggagcaggtggatgaggtgacagacctgctggccagcttcaccagcctgagcctgcagatgcagagcatggagaagaggtag

SEQ ID NO: 161861 - DNA, 387 bp, Artificial Sequence
  Description of Artificial Sequence: Synthetic coding sequence
atgacagaagcagatgtgaaccccaaggcctaccccctggctgatgcccacctgaccaagaagctgctggacctggtgcagcagagctgcaactacaagcagctgaggaaaggagccaatgaggccaccaagaccctgaacagaggcatcagcgagttcatcgtgatggccgcagatgctgagcccctggagatcatcctgcacctgcccctgctgtgtgaggacaagaatgtgccctacgtgtttgtgcgcagcaagcaggccctgggccgggcctgtggggtgtccaggcctgtgattgcctgcagcgtgaccatcaaggagggcagccagctgaagcagcagatccagagcatccagcagagcattgagcggctgctggtgtag

SEQ ID NO: 161862 - DNA, 387 bp, Artificial Sequence; identical to SEQ ID NO: 161861
  Description of Artificial Sequence: Synthetic coding sequence

SEQ ID NO: 161863 - DNA, 399 bp, Artificial Sequence
  Description of Artificial Sequence: Synthetic coding sequence
atgctgctggtgcagacagaagcagatgtgaaccccaaggcctaccccctggctgatgcccacctgaccaagaagctgctggacctggtgcagcagagctgcaactacaagcagctgaggaaaggagccaatgaggccaccaagaccctgaacagaggcatcagcgagttcatcgtgatggccgcagatgctgagcccctggagatcatcctgcacctgcccctgctgtgtgaggacaagaatgtgccctacgtgtttgtgcgcagcaagcaggccctgggccgggcctgtggggtgtccaggcctgtgattgcctgcagcgtgaccatcaaggagggcagccagctgaagcagcagatccagagcatccagcagagcattgagcggctgctggtgtag

SEQ ID NO: 161864 - DNA, 2130 bp, Artificial Sequence
  Description of Artificial Sequence: Synthetic coding sequence
atggccacagctgggggcggcagcggggctgaccccggcagccggggcctgctgcggctgctgtccttctgtgtgctgctggccggcctgtgccggggcaacagcgtggagaggaagatctacatccccctgaacaagacagccccctgtgtgcggctgctgaatgccacccaccagatcggctgccagagcagcatcagcggggacaccggggtcatccacgtggtggagaaggaggaggacctgcagtgggtgctgacagatggccccaaccccccctacatggtgctgctggagagcaagcacttcacccgggacctgatggagaagctgaagggccgcaccagcagaattgctggcctggccgtgtccctgaccaagcccagccctgccagcggcttcagccccagcgtgcagtgccccaatgatggctttggagtgtacagcaacagctatggccctgagtttgcccactgccgggagatccagtggaacagcctgggcaatggcctggcctatgaggacttctccttccccatcttcctgctggaggatgaaaatgagaccaaggtgatcaagcagtgctaccaggaccacaacctgagccagaatggcagcgcccccaccttccccctgtgtgccatgcagctgttcagccacatgcatgctgtgatcagcacagccacctgcatgaggaggagcagcatccagagcaccttcagcatcaaccctgagatcgtgtgtgaccccctgagtgactacaacgtgtggagcatgctgaagcccatcaacaccaccggcaccctgaagccagatgacagagtggtggtggccgccacccggctggacagccgctccttcttctggaatgtggcccctggagctgagagcgctgtggccagctttgtgacccagctggccgctgctgaggccctgcagaaggccccagatgtgaccaccctgcccagaaatgtgatgtttgtgttcttccagggcgagacctttgactacatcggcagcagcaggatggtgtatgacatggagaagggcaagtttcctgtgcagctggagaatgtggacagctttgtggagctgggccaggtggccctgcggaccagcctggagctgtggatgcacacagatcctgtgtcccagaagaatgaatctgtgaggaaccaggtggaggacctgctggccaccctggagaagagcggggccggcgtgcctgctgtgatcctgcggcggcccaaccagagccagcccctgccccccagcagcctgcagcgcttcctgcgggccaggaacatctctggagtggtgctggccgaccacagcggggccttccacaacaagtactaccagagcatctatgacacagctgagaacatcaacgtgtcctacccagagtggctgagccctgaggaggacctgaactttgtgacagacacagccaaggccctggctgatgtggccaccgtgctgggccgggccctgtatgagctggccggcggcaccaacttcagtgacacagtgcaggccgacccccagacagtgacccggctgctgtatggcttcctgatcaaggccaacaacagctggttccagagcatcctgcggcaggacctgcggagctacctgggagatggccccctgcagcactacatcgctgtgagcagccccaccaacaccacctacgtggtgcagtatgccctggccaacctgactggaacagtggtgaacctgacccgggagcagtgccaggaccccagcaaggtgcccagcgagaacaaggacctgtatgagtacagctgggtgcagggccccctgcacagcaatgaaacagaccggctgccccgctgtgtgcgcagcacagcccggctggcccgggccctgagccctgcctttgagctgagccagtggagcagcacagagtacagcacctggacagagagccgctggaaggacatccgggcccgcatcttcctgattgccagcaaggagctggagctgatcaccctgactgtgggcttcggcatcctgatcttcagcctgattgtgacctactgcatcaatgccaaggcagatgtgctcttcatcgccccccgggagcccggggctgtgtcctactag

SEQ ID NO: 161865 - DNA, 2070 bp, Artificial Sequence
  Description of Artificial Sequence: Synthetic coding sequence
atggacttcaacctgatcctggagagcctgtgccggggcaacagcgtggagaggaagatctacatccccctgaacaagacagccccctgtgtgcggctgctgaatgccacccaccagatcggctgccagagcagcatcagcggggacaccggggtcatccacgtggtggagaaggaggaggacctgcagtgggtgctgacagatggccccaaccccccctacatggtgctgctggagagcaagcacttcacccgggacctgatggagaagctgaagggccgcaccagcagaattgctggcctggccgtgtccctgaccaagcccagccctgccagcggcttcagccccagcgtgcagtgccccaatgatggctttggagtgtacagcaacagctatggccctgagtttgcccactgccgggagatccagtggaacagcctgggcaatggcctggcctatgaggacttctccttccccatcttcctgctggaggatgaaaatgagaccaaggtgatcaagcagtgctaccaggaccacaacctgagccagaatggcagcgcccccaccttccccctgtgtgccatgcagctgttcagccacatgcatgctgtgatcagcacagccacctgcatgaggaggagcagcatccagagcaccttcagcatcaaccctgagatcgtgtgtgaccccctgagtgactacaacgtgtggagcatgctgaagcccatcaacaccaccggcaccctgaagccagatgacagagtggtggtggccgccacccggctggacagccgctccttcttctggaatgtggcccctggagctgagagcgctgtggccagctttgtgacccagctggccgctgctgaggccctgcagaaggccccagatgtgaccaccctgcccagaaatgtgatgtttgtgttcttccagggcgagacctttgactacatcggcagcagcaggatggtgtatgacatggagaagggcaagtttcctgtgcagctggagaatgtggacagctttgtggagctgggccaggtggccctgcggaccagcctggagctgtggatgcacacagatcctgtgtcccagaagaatgaatctgtgaggaaccaggtggaggacctgctggccaccctggagaagagcggggccggcgtgcctgctgtgatcctgcggcggcccaaccagagccagcccctgccccccagcagcctgcagcgcttcctgcgggccaggaacatctctggagtggtgctggccgaccacagcggggccttccacaacaagtactaccagagcatctatgacacagctgagaacatcaacgtgtcctacccagagtggctgagccctgaggaggacctgaactttgtgacagacacagccaaggccctggctgatgtggccaccgtgctgggccgggccctgtatgagctggccggcggcaccaacttcagtgacacagtgcaggccgacccccagacagtgacccggctgctgtatggcttcctgatcaaggccaacaacagctggttccagagcatcctgcggcaggacctgcggagctacctgggagatggccccctgcagcactacatcgctgtgagcagccccaccaacaccacctacgtggtgcagtatgccctggccaacctgactggaacagtggtgaacctgacccgggagcagtgccaggaccccagcaaggtgcccagcgagaacaaggacctgtatgagtacagctgggtgcagggccccctgcacagcaatgaaacagaccggctgccccgctgtgtgcgcagcacagcccggctggcccgggccctgagccctgcctttgagctgagccagtggagcagcacagagtacagcacctggacagagagccgctggaaggacatccgggcccgcatcttcctgattgccagcaaggagctggagctgatcaccctgactgtgggcttcggcatcctgatcttcagcctgattgtgacctactgcatcaatgccaaggcagatgtgctcttcatcgccccccgggagcccggggctgtgtcctactag

SEQ ID NO: 161866 - DNA, 1356 bp, Artificial Sequence
  Description of Artificial Sequence: Synthetic coding sequence
atgctgaagcccatcaacaccaccggcaccctgaagccagatgacagagtggtggtggccgccacccggctggacagccgctccttcttctggaatgtggcccctggagctgagagcgctgtggccagctttgtgacccagctggccgctgctgaggccctgcagaaggccccagatgtgaccaccctgcccagaaatgtgatgtttgtgttcttccagggcgagacctttgactacatcggcagcagcaggatggtgtatgacatggagaagggcaagtttcctgtgcagctggagaatgtggacagctttgtggagctgggccaggtggccctgcggaccagcctggagctgtggatgcacacagatcctgtgtcccagaagaatgaatctgtgaggaaccaggtggaggacctgctggccaccctggagaagagcggggccggcgtgcctgctgtgatcctgcggcggcccaaccagagccagcccctgccccccagcagcctgcagcgcttcctgcgggccaggaacatctctggagtggtgctggccgaccacagcggggccttccacaacaagtactaccagagcatctatgacacagctgagaacatcaacgtgtcctacccagagtggctgagccctgaggaggacctgaactttgtgacagacacagccaaggccctggctgatgtggccaccgtgctgggccgggccctgtatgagctggccggcggcaccaacttcagtgacacagtgcaggccgacccccagacagtgacccggctgctgtatggcttcctgatcaaggccaacaacagctggttccagagcatcctgcggcaggacctgcggagctacctgggagatggccccctgcagcactacatcgctgtgagcagccccaccaacaccacctacgtggtgcagtatgccctggccaacctgactggaacagtggtgaacctgacccgggagcagtgccaggaccccagcaaggtgcccagcgagaacaaggacctgtatgagtacagctgggtgcagggccccctgcacagcaatgaaacagaccggctgccccgctgtgtgcgcagcacagcccggctggcccgggccctgagccctgcctttgagctgagccagtggagcagcacagagtacagcacctggacagagagccgctggaaggacatccgggcccgcatcttcctgattgccagcaaggagctggagctgatcaccctgactgtgggcttcggcatcctgatcttcagcctgattgtgacctactgcatcaatgccaaggcagatgtgctcttcatcgccccccgggagcccggggctgtgtcctactag

SEQ ID NO: 161867 - DNA, 918 bp, Artificial Sequence
  Description of Artificial Sequence: Synthetic coding sequence
atgctgaagcccatcaacaccaccggcaccctgaagccagatgacagagtggtggtggccgccacccggctggacagccgctccttcttctggaatgtggcccctggagctgagagcgctgtggccagctttgtgacccagctggccgctgctgaggccctgcagaaggccccagatgtgaccaccctgcccagaaatgtgatgtttgtgttcttccagggcgtggccctgcggaccagcctggagctgtggatgcacacagatcctgtgtcccagaagaatgaatctgtgaggaaccaggtggaggacctgctggccaccctggagaagtctggagctggggtgcctgctgtgatcctgcggcggcccaaccagagccagcccctgccccccagcagcctgcagcgcttcctgcgggccaggaacatcagcggcgtggtgctggccgaccacagcggggccttccacaacaagtactaccagagcatctatgacacagctgagaacatcaacgtgtcctacccagagtggctgagccctgaggaggacctgaactttgtgacagacacagccaaggccctggctgatgtggccaccgtgctgggccgggccctgtatgagctggccggcggcaccaacttcagtgacacagtgcaggccgacccccagacagtgacccggctgctgtatggcttcctgatcaaggccaacaacagctggttccagagcatcctgcggcaggacctgcggagctacctgggagatggccccctgcagcactacatcgctgtgagcagccccaccaacaccacctacgtggtgcagtatgccctggccaacctgaccggcaccgtggtgaacctgacccgggagcagtgccaggaccccagcaaggtgcccagcgagaacaaggactag

SEQ ID NO: 161868 - DNA, 2070 bp, Artificial Sequence; identical to SEQ ID NO: 161865
  Description of Artificial Sequence: Synthetic coding sequence

SEQ ID NO: 161869 - DNA, 768 bp, Artificial Sequence
  Description of Artificial Sequence: Synthetic coding sequence
atggccacagctgggggcggcagcggggctgaccccggcagccggggcctgctgcggctgctgtccttctgtgtgctgctggccggcctgtgccggggcaacagcgtggagaggaagatctacatccccctgaacaagacagccccctgtgtgcggctgctgaatgccacccaccagatcggctgccagagcagcatcagcggggacaccggggtcatccacgtggtggagaaggaggaggacctgcagtgggtgctgacagatggccccaaccccccctacatggtgctgctggagagcaagcacttcacccgggacctgatggagaagctgaagggccgcaccagcagaattgctggcctggccgtgtccctgaccaagcccagccctgccagcggcttcagccccagcgtgcagtgccccaatgatggctttggagtgtacagcaacagctatggccctgagtttgcccactgccgggagatccagtggaacagcctgggcaatggcctggcctatgaggacttctccttccccatcttcctgctggaggatgaaaatgagaccaaggtgatcaagcaggagacctttgactacatcggcagcagcaggatggtgtatgacatggagaagggcaagtttcctgtgcagctggagaatgtggacagctttgtggagctgggccaggtggccctgcggaccagcctggagctgtggatgcacacagatcctgtgtcccagaagaatgaatctgtgaggaaccagtag

SEQ ID NO: 161870 - DNA, 963 bp, Artificial Sequence
  Description of Artificial Sequence: Synthetic coding sequence
tgaggatttggagtgtacagcaacagctatggccctgagtttgcccactgccgggagatccagtggaacagcctgggcaatggcctggcctatgaggacttctccttccccatcttcctgctggaggatgaaaatgagaccaaggtgatcaagcagctgttcagccacatgcatgctgtgatcagcacagccacctgcatgaggaggagcagcatccagagcaccttcagcatcaaccctgagatcgtgtgtgaccccctgagtgactacaacgtgtggagcatgctgaagcccatcaacaccaccggcaccctgaagccagatgacagagtggtggtggccgccacccggctggacagccgctccttcttctggaatgtggcccctggagctgagagcgctgtggccagctttgtgacccagctggccgctgctgaggccctgcagaaggccccagatgtgaccaccctgcccagaaatgtgatgtttgtgttcttccagggcgagacctttgactacatcggcagcagcaggatggtgtatgacatggagaagggcaagtttcctgtgcagctggagaatgtggacagctttgtggagctgggccaggtggccctgcggaccagcctggagctgtggatgcacacagatcctgtgtcccagaagaatgaatctgtgaggaaccaggtggaggacctgctggccaccctggagaagagcggggccggcgtgcctgctgtgatcctgcggcggcccaaccagagccagcccctgccccccagcagcctgcagcgcttcctgcgggccaggaacatctctggagtggtgctggccgaccacagcggggccttccacaacaagtactaccagagcatctatgacacagctgagaacatcaacgtgtcctacccagagtggctgagccctgaggaggacctgaactttgtgacagacacagcctag

SEQ ID NO: 161871 - DNA, 660 bp, Artificial Sequence
  Description of Artificial Sequence: Synthetic coding sequence
cgcagcagcatccagagcaccttcagcatcaaccctgagatcgtgtgtgaccccctgagtgactacaacgtgtggagcatgctgaagcccatcaacaccaccggcaccctgaagccagatgacagagtggtggtggccgccacccggctggccgctgctgaggccctgcagaaggccccagatgtgaccaccctgcccagaaatgtgatgtttgtgttcttccagggcgagacctttgactacatcggcagcagcaggatggtgtatgacatggagaagggcaagtttcctgtgcagctggagaatgtggacagctttgtggagctgggccaggtggccctgcggaccagcctggagctgtggatgcacacagatcctgtgtcccagaagaatgaatctgtgaggaaccaggtggaggacctgctggccaccctggagaagagcggggccggcgtgcctgctgtgatcctgcggcggcccaaccagagccagcccctgccccccagcagcctgcagcgcttcctgcgggccaggaacatctctggagtggtgctggccgaccacagcggggccttccacaacaagtactaccagagcatctatgacacagctgagaacatcaacgtgtcctacccagagtggctgagccctgaggagtag

SEQ ID NO: 161872 - DNA, 828 bp, Artificial Sequence
  Description of Artificial Sequence: Synthetic coding sequence
tgaaatgtggcccctggagctgagagcgctgtggccagctttgtgacccagctggccgctgctgaggccctgcagaaggccccagatgtgaccaccctgcccagaaatgtgatgtttgtgttcttccagggcgtggccctgcggaccagcctggagctgtggatgcacacagatcctgtgtcccagaagaatgaatctgtgaggaaccaggtggaggacctgctggccaccctggagaagtctggagctggggtgcctgctgtgatcctgcggcggcccaaccagagccagcccctgccccccagcagcctgcagcgcttcctgcgggccaggaacatcagcggcgtggtgctggccgaccacagcggggccttccacaacaagtactaccagagcatctatgacacagctgagaacatcaacgtgtcctacccagagtggctgagccctgaggaggacctgaactttgtgacagacacagccaaggccctggctgatgtggccaccgtgctgggccgggccctgtatgagctggccggcggcaccaacttcagtgacacagtgcaggccgacccccagacagtgacccggctgctgtatggcttcctgatcaaggccaacaacagctggttccagagcatcctgcggcaggacctgcggagctacctgggagatggccccctgcagcactacatcgctgtgagcagccccaccaacaccacctacgtggtgcagtatgccctggccaacctgaccggcaccgtggtgaacctgacccgggagcagtgccaggaccccagcaaggtgcccagcgagaacaaggactag

SEQ ID NO: 161873 - DNA, 405 bp, Artificial Sequence
  Description of Artificial Sequence: Synthetic coding sequence
atggccacagctgggggcggcagcggggctgaccccggcagccggggcctgctgcggctgctgtccttctgtgtgctgctggccggcctgtgccggggcaacagcgtggagaggaagatctacatccccctgaacaagacagccccctgtgtgcggctgctgaatgccacccaccagatcggctgccagagcagcatcagcggggacaccggggtcatccacgtggtggagaaggaggaggacctgcagtgggtgctgacagatggccccaaccccccctacatggtgctgctggagagcaagcacttcacccggcagaatgtgcggctgagtgacaccttcctgtgcagcttcatggagttcctgagctacagccgggacctgatggagaagctgaagggctag

SEQ ID NO: 161874 - DNA, 699 bp, Artificial Sequence
  Description of Artificial Sequence: Synthetic coding sequence
atggccacagctgggggcggcagcggggctgaccccggcagccggggcctgctgcggctgctgtccttctgtgtgctgctggccggcctcttcctggactttgagccagaccccctgcccctgtgcccagatgtgtccttcttcccccagccccagccccccaccccccagagcaaaggaacaggcctgtgccggggcaacagcgtggagaggaagatctacatccccctgaacaagacagccccctgtgtgcggctgctgaatgccacccaccagatcggctgccagagcagcatcagcggggacacaggagtcatccacgtggtggagaaggaggaggacctgcagtgggtgctgacagatggccccaaccccccctacatggtgctgctggagagcaagcacttcacccgggacctgatggagaagctgaagggccgcaccagcagaattgctggcctggccgtgtccctgaccaagcccagccctgccagcggcttcagccccagcgtgcagtgccccaatgatggcttcggcgtgtacagcaacagctatggccctgagtttgcccactgccgggagatccagtggaacagcctgggcaatggcctggcctatgaggacttctccttccccatcttcctgctggaggatgaaaatgagaccaaggtgatcaagcagtgctaccaggaccactag

SEQ ID NO: 161875 - DNA, 1716 bp, Artificial Sequence
  Description of Artificial Sequence: Synthetic coding sequence
atggccacagctgggggcggcagcggggctgaccccggcagccggggcctgctgcggctgctgtccttctgtgtgctgctggccggcctgtgccggggcaacagcgtggagaggaagatctacatccccctgaacaagacagccccctgtgtgcggctgctgaatgccacccaccagatcggctgccagagcagcatcagcggggacaccggggtcatccacgtggtggagaaggaggaggacctgcagtgggtgctgacagatggccccaaccccccctacatggtgctgctggagagcaagcacttcacccgggacctgatggagaagctgaagggccgcaccagcagaattgctggcctggccgtgtccctgaccaagcccagccctgccagcggcttcagccccagcgtgcagtgccccaatgatggctttggagtgtacagcaacagctatggccctgagtttgcccactgccgggagatccagtggaacagcctgggcaatggcctggcctatgaggacttctccttccccatcttcctgctggaggatgaaaatgagaccaaggtgatcaagcaggagacctttgactacatcggcagcagcaggatggtgtatgacatggagaagggcaagtttcctgtgcagctggagaatgtggacagctttgtggagctgggccaggtggccctgcggaccagcctggagctgtggatgcacacagatcctgtgtcccagaagaatgaatctgtgaggaaccaggtggaggacctgctggccaccctggagaagagcggggccggcgtgcctgctgtgatcctgcggcggcccaaccagagccagcccctgccccccagcagcctgcagcgcttcctgcgggccaggaacatctctggagtggtgctggccgaccacagcggggccttccacaacaagtactaccagagcatctatgacacagctgagaacatcaacgtgtcctacccagagtggctgagccctgaggaggacctgaactttgtgacagacacagccaaggccctggctgatgtggccaccgtgctgggccgggccctgtatgagctggccggcggcaccaacttcagtgacacagtgcaggccgacccccagacagtgacccggctgctgtatggcttcctgatcaaggccaacaacagctggttccagagcatcctgcggcaggacctgcggagctacctgggagatggccccctgcagcactacatcgctgtgagcagccccaccaacaccacctacgtggtgcagtatgccctggccaacctgactggaacagtggtgaacctgacccgggagcagtgccaggaccccagcaaggtgcccagcgagaacaaggacctgtatgagtacagctgggtgcagggccccctgcacagcaatgaaacagaccggctgccccgctgtgtgcgcagcacagcccggctggcccgggccctgagccctgcctttgagctgagccagtggagcagcacagagtacagcacctggacagagagccgctggaaggacatccgggcccgcatcttcctgattgccagcaaggagctggagctgatcaccctgactgtgggcttcggcatcctgatcttcagcctgattgtgacctactgcatcaatgccaaggcagatgtgctcttcatcgccccccgggagcccggggctgtgtcctactag

SEQ ID NO: 161876 - DNA, 642 bp, Artificial Sequence
  Description of Artificial Sequence: Synthetic coding sequence
atgagccgggtgctggtgccctgccacgtgaagggctctgtggccctgcaggtgggagatgtgaggaccagccagggccggcctggggtgctggtgattgatgtgaccttccccagcgtggccccctttgagctgcaggagatcaccttcaagaactactacacagccttcctgagcatccgggtgcggcagtacaccagcgcccacaccccagccaagtgggtgacctgcctgcgggactactgcctgatgccagacccccacagcgaggagggcgcccaggagtatgtgtccctcttcaagcaccagatgctgtgtgacatggcccgcatcagcgagctgcggctcatcctgcggcagcccagccccctgtggctgtccttcaccgtggaggagctgcagatctaccagcagggccccaagagccccagcgtgaccttccccaagtggctgagccaccctgtgccctgtgagcagcctgccctgctgcgggagggcctgcctgaccccagccgggtgtcctctgaggtgcagcagatgtgggccctgacagagatgatccgggccagccacaccagcgcccgcatcggccgctttgatgtggatggctgctatgacctgaacctgctgagctacacctag

SEQ ID NO: 161877 - DNA, 642 bp, Artificial Sequence; identical to SEQ ID NO: 161876
  Description of Artificial Sequence: Synthetic coding sequence

SEQ ID NO: 161878 - DNA, 528 bp, Artificial Sequence
  Description of Artificial Sequence: Synthetic coding sequence
atgagccgggtgctggtgccctgccacgtgaagggctctgtggccctgcaggtgggagatgtgaggaccagccagggccggcctggggtgctggtgattgatgtgaccttccccagcgtggccccctttgagctgcaggagatcaccttcaagaactactacacagccttcctgagcatccgggtgcggcagtacaccagcgcccacaccccagccaagtgggtgacctgcctgcgggactactgcctgatgccagacccccacagcgaggagggcgcccaggagtatgtgtccctcttcaagcaccagagccccagcgtgaccttccccaagtggctgagccaccctgtgccctgtgagcagcctgccctgctgcgggagggcctgcctgaccccagccgggtgtcctctgaggtgcagcagatgtgggccctgacagagatgatccgggccagccacaccagcgcccgcatcggccgctttgatgtggatggctgctatgacctgaacctgctgagctacacctag

SEQ ID NO: 161879 - DNA, 795 bp, Artificial Sequence
  Description of Artificial Sequence: Synthetic coding sequence
atggagagcggcttcaccagcaaggacacctacctgagccacttcaacccccgggactacctggagaagtactacaagtttggcagccgccacagcgctgagagccagatcctgaagcacctgctgaagaacctcttcaagatcttctgcctggatggagtgaagggggacctgctgattgacatcggcagcggccccaccatctaccagctgctgagcgcctgtgagagcttcaaggagatcgtggtgacagactacagcgaccagaacctgcaggagctggagaagtggctgaagaaggagcctgaggcctttgactggagccctgtggtgacctacgtgtgtgacctggagggcaacagagtgaagggccctgagaaggaggagaagctgcggcaggccgtgaagcaggtgctgaagtgtgatgtgacccagagccagcccctgggcgctgtgcccctgcccccagctgactgtgtgctgagcaccctgtgcctggatgctgcctgcccagacctgcccacctactgccgggccctgaggaacctgggcagcctgctgaagccaggcggcttcctggtgatcatggatgccctgaagagcagctactacatgattggagagcagaagttcagcagcctgcccctgggccgggaggccgtggaggccgctgtgaaggaggccggctacaccatcgagtggtttgaagtcatcagccagagctacagcagcaccatggccaacaatgaaggcctcttcagcctggtggccaggaagctgagccggcccctgtag

SEQ ID NO: 161880 - DNA, 795 bp, Artificial Sequence; identical to SEQ ID NO: 161879
  Description of Artificial Sequence: Synthetic coding sequence

SEQ ID NO: 161881 - DNA, 759 bp, Artificial Sequence
  Description of Artificial Sequence: Synthetic coding sequence
atgaagagccgcatccctgtggtgctgctggcctgtggcagcttcaaccccatcaccaacatgcacctgaggatgtttgaggtggcccgggaccacctgcaccagacaggcatgtaccaggtgatccagggcatcatcagccctgtgaatgacacctacggcaagaaggacctggccgccagccaccaccgggtggccatggcccggctggccctgcagaccagtgactggatccgggtggacccctgggagagcgagcaggcccagtggatggagaccgtgaaggtgctgcggcaccaccacagcaagctgctgcggagccccccccagatggagggccctgaccacggcaaggccctcttcagcaccccagctgctgtgcctgagctgaagctgctgtgtggggctgatgtgctgaagaccttccagacccccaacctgtggaaggatgcccacatccaggagatcgtggagaagtttggcctggtgtgtgtgggccgggtgggccatgaccccaagggctacatcgccgagagccccatcctgaggatgcaccagcacaacatccacctggccaaggagcctgtgcagaatgagatcagcgccacctacatccggcgggccctgggccagggccagagcgtgaagtacctgatcccagatgctgtgatcacctacatcaaggaccacggcctgtacaccaagggcagcacctggaagggcaagagcacccagagcacagagggcaagaccagctag

SEQ ID NO: 161882 - DNA, 648 bp, Artificial Sequence
  Description of Artificial Sequence: Synthetic coding sequence
atgtaccaggtgatccagggcatcatcagccctgtgaatgacacctacggcaagaaggacctggccgccagccaccaccgggtggccatggcccggctggccctgcagaccagtgactggatccgggtggacccctgggagagcgagcaggcccagtggatggagaccgtgaaggtgctgcggcaccaccacagcaagctgctgcggagccccccccagatggagggccctgaccacggcaaggccctcttcagcaccccagctgctgtgcctgagctgaagctgctgtgtggggctgatgtgctgaagaccttccagacccccaacctgtggaaggatgcccacatccaggagatcgtggagaagtttggcctggtgtgtgtgggccgggtgggccatgaccccaagggctacatcgccgagagccccatcctgaggatgcaccagcacaacatccacctggccaaggagcctgtgcagaatgagatcagcgccacctacatcagaagagccctgggccagggccagagcgtgaagtacctgatcccagatgctgtgatcacctacatcaaggaccacggcctgtacaccaagggcagcacctggaagggcaagagcacccagagcacagagggcaagaccagctag

SEQ ID NO: 161883 - DNA, 648 bp, Artificial Sequence; identical to SEQ ID NO: 161882
  Description of Artificial Sequence: Synthetic coding sequence

SEQ ID NO: 161884 - DNA, 429 bp, Artificial Sequence
  Description of Artificial Sequence: Synthetic coding sequence
atggagggccctgaccacggcaaggccctcttcagcaccccagctgctgtgcctgagctgaagctgctgtgtggggctgatgtgctgaagaccttccagacccccaacctgtggaaggatgcccacatccaggagatcgtggagaagtttggcctggtgtgtgtgggccgggtgggccatgaccccaagggctacatcgccgagagccccatcctgaggatgcaccagcacaacatccacctggccaaggagcctgtgcagaatgagatcagcgccacctacatccggcgggccctgggccagggccagagcgtgaagtacctgatcccagatgctgtgatcacctacatcaaggaccacggcctgtacaccaagggcagcacctggaagggcaagagcacccagagcacagagggcaagaccagctag

SEQ ID NO: 161885 - DNA, 345 bp, Artificial Sequence
  Description of Artificial Sequence: Synthetic coding sequence
atgaagagccgcatccctgtggtgctgctggcctgtggcagcttcaaccccatcaccaacatgcacctgaggatgtttgaggtggcccgggaccacctgcaccagacaggcatgtaccaggtgatccagggcatcatcagccctgtgaatgacacctacggcaagaaggacctggccgccagccaccaccgggtggccatggcccggctggccctgcagaccagtgactggatccgggtggacccctgggagagcgagcaggcccagtggatggagaccgtgaaggtgctgcggcaccaccacagcaagctgctgcggagccccccccagatggagggcccctag

SEQ ID NO: 161886 - DNA, 492 bp, Artificial Sequence
  Description of Artificial Sequence: Synthetic coding sequence
atgaagagccgcatccctgtggtgctgctggcctgtggcagcttcaaccccatcaccaacatgcacctgaggatgtttgaggtggcccgggaccacctgcaccagacagctgtgcctgagctgaagctgctgtgtggggctgatgtgctgaagaccttccagacccccaacctgtggaaggatgcccacatccaggagatcgtggagaagtttggcctggtgtgtgtgggccgggtgggccatgaccccaagggctacatcgccgagagccccatcctgaggatgcaccagcacaacatccacctggccaaggagcctgtgcagaatgagatcagcgccacctacatcagaagagccctgggccagggccagagcgtgaagtacctgatcccagatgctgtgatcacctacatcaaggaccacggcctgtacaccaagggcagcacctggaagggcaagagcacccagagcacagagggcaagaccagctag

SEQ ID NO: 161887 - DNA, 3261 bp, Artificial Sequence
  Description of Artificial Sequence: Synthetic coding sequence
atggccaacctgctgaagacagtggtgacaggctgcagctgccccctgctgagcaacctgggcagctgcaagggcctgcgggtgaagaaggacttcctgcggaccttctacacccaccaggagctgtggtgcaaggcccctgtgaagccaggcatcccctacaagcagctgactgtgggcgtgcccaaggagatcttccagaatgagaagagggtggccctgagccctgctggggtgcagaacctggtgaagcagggcttcaacgtggtggtggagagcggggccggggaggccagcaagttcagtgatgaccactacagagtggccggggcccagatccagggcgccaaggaggtgctggccagtgacctggtggtgaaggtgcgggcccccatggtgaaccccaccctgggcgtgcatgaggccgacctgctgaagaccagcggcaccctcatctccttcatctacccagcccagaaccctgagctgctgaacaagctgagccagaggaagaccaccgtgctggccatggaccaggtgccccgggtgaccatcgcccagggctatgatgccctgagctccatggccaacattgctggctacaaggctgtggtgctggccgccaaccacttcggccgcttcttcaccggccagatcacagctgctgggaaggtgcccccagccaagatcctgattgtgggcggcggcgtggccggcctggccagcgctggagctgccaagtccatgggcgccatcgtgcggggctttgacaccagggctgctgccctggagcagttcaagagcctgggcgctgagcccctggaggtggacctgaaggagagcggggagggccagggcggctacgccaaggagatgagcaaggagttcattgaagctgagatgaagctgtttgcccagcagtgcaaggaggtggacatcctgatcagcacagccctgatccctgggaagaaggcccctgtgctcttcaacaaggagatgattgagagcatgaaggagggctctgtggtggtggacctggccgctgaggccggcggcaactttgagaccaccaagccaggagagctgtacatccacaagggcatcacccacatcggctacacagacctgcccagcaggatggccacccaggccagcaccctgtacagcaacaacatcaccaagctgctgaaggccatcagcccagacaaggacaacttctactttgatgtgaaggatgactttgattttggcaccatgggccacgtgatccggggcaccgtggtgatgaaggatggcaaggtgatcttccctgcccccacccccaagaacatcccccagggcgcccctgtgaagcagaagacagtggccgagctggaggccgagaaggccgccaccatcacccccttcaggaagaccatgagcacagccagcgcctacacagctggcctgaccggcatcctgggcctgggcattgctgcccccaacctggccttcagccagatggtgaccaccttcggcctggccggcatcgtgggctaccacacagtgtggggcgtgaccccagccctgcacagccccctgatgtctgtgaccaatgccatcagcggcctgacagctgtgggcggcctggccctgatgggcggccacctgtaccccagcaccaccagccagggcctggccgccctggccgccttcatcagctctgtgaacattgctgggggcttcctggtgacccagaggatgctggacatgttcaagaggcccacagatcctcctgagtacaactacctgtacctgctgcctgctggcacctttgtgggcggctacctggccgccctgtacagcggctacaacatcgagcagatcatgtacctgggcagcggcctgtgctgcgtgggcgccctggccggcctgagcacccagggcacagcccggctgggcaatgccctgggcatgattggagtggccggcggcctggccgccaccctgggcgtgctgaagccaggccctgagctgctggcccagatgtctggggccatggccctgggcggcaccatcggcctgaccatcgccaagaggatccagatcagtgacctgccccagctggtggccgccttccacagcctggtgggcctggccgctgtgctgacctgcatcgccgagtacatcatcgagtacccccactttgccacagatgctgctgccaacctgaccaagatcgtggcctacctgggcacctacatcggcggcgtgaccttcagcggcagcctcatcgcctacggcaagctgcagggcctgctgaagagcgcccccctgctgctgcccggccgccacctgctgaatgccggcctgctggccgcctctgtgggcggcatcatccccttcatggtggaccccagcttcaccaccggcatcacctgcctgggctctgtgtctgccctgtctgctgtgatgggcgtgaccctgacagctgccatcggcggcgctgacatgcctgtggtgatcaccgtgctgaacagctacagcggctgggccctgtgtgccgagggcttcctgctgaacaacaacctgctgaccatcgtgggcgccctgattggcagcagcggggccatcctgagctacatcatgtgtgtggccatgaacagaagcctggccaacgtcatcctgggcggctacggcaccaccagcacagctgggggcaagcccatggagatcagcggcacccacacagagatcaacctggacaatgccatcgacatgatccgggaggccaacagcatcatcatcaccccaggctacggcctgtgtgccgccaaggcccagtaccccatcgctgacctggtgaagatgctgacagagcagggcaagaaggtgcgcttcggcatccaccctgtggccggccgcatgcctggccagctgaatgtgctgctggccgaggccggcgtgccctatgacatcgtgctggagatggatgagatcaaccacgacttcccagacacagacctggtgctggtgattggagccaatgacacagtgaacagcgctgcccaggaggaccccaacagcatcatcgccggcatgcctgtgctggaggtgtggaagagcaagcaggtgattgtgatgaagaggagcctgggcgtgggctacgccgctgtggacaaccccatcttctacaagcccaacacagccatgctgctgggagatgccaagaagacctgtgatgccctgcaggccaaggtgcgggagagctaccagaagtag

SEQ ID NO: 161888 - DNA, 3261 bp, Artificial Sequence; identical to SEQ ID NO: 161887
  Description of Artificial Sequence: Synthetic coding sequence

SEQ ID NO: 161889 - DNA, 600 bp, Artificial Sequence
  Description of Artificial Sequence: Synthetic coding sequence
atggccaacctgctgaagacagtggtgacaggctgcagctgccccctgctgagcaacctgggcagctgcaagggcctgcgggtgaagaaggacttcctgcggaccttctacacccaccaggagctgtggtgcaaggcccctgtgaagccaggcatcccctacaagcagctgactgtgggcgtgcccaaggagatcttccagaatgagaagagggtggccctgagccctgctggggtgcagaacctggtgaagcagggcttcaacgtggtggtggagagcggggccggggaggccagcaagttcagtgatgaccactacagagtggccggggcccagatccagggcgccaaggaggtgctggccagtgacctggtggtgaaggtgcgggcccccatggtgaaccccaccctgggcgtgcatgaggccgacctgctgaagaccagcggcaccctcatctccttcatctacccagcccagaaccctgagctgctgaacaagctgagccagaggaagaccaccgtgctggccatggaccaggtgccccgggtgaccatcgcccagggctatgatgccctgagctccatggccaacatcgcctag

SEQ ID NO: 161890 - DNA, 654 bp, Artificial Sequence
  Description of Artificial Sequence: Synthetic coding sequence
atggccaacctgctgaagacagtggtgacaggctgcagctgccccctgctgagcaacctgggcagctgcaagggcctgcgggtgaagaaggacttcctgcggaccttctacacccaccaggagctgtggtgcaaggcccctgtgaagccaggcatcccctacaagcagctgactgtgggcgtgcccaaggagatcttccagaatgagaagagggtggccctgagccctgctggggtgcagaacctggtgaagcagggcttcaacgtggtggtggagagcggggccggggaggccagcaagttcagtgatgaccactacagagtggccggggcccagatccagggcgccaaggaggtgctggccagtgacctggtggtgaaggtgcgggcccccatggtgaaccccaccctgggcgtgcatgaggccgacctgctgaagaccagcggcaccctcatctccttcatctacccagcccagaaccctgagctgctgaacaagctgagccagaggaagaccaccgtgctggccatggaccaggtgccccgggtgaccatcgcccagggctatgatgccctgagctccatggccaacattgctggctacaaggctgtggtgctggccgccaaccacttcggccgcttcttcaccggctag

SEQ ID NO: 161891 - DNA, 1806 bp, Artificial Sequence
  Description of Artificial Sequence: Synthetic coding sequence
atgctgtcctggaacagagtgcgggccaagctgcccagcagccagatggtgaccaccttcggcctggccggcatcgtgggctaccacacagtgtggggcgtgaccccagccctgcacagccccctgatgtctgtgaccaatgccatcagcggcctgacagctgtgggcggcctggccctgatgggcggccacctgtaccccagcaccaccagccagggcctggccgccctggccgccttcatcagctctgtgaacattgctgggggcttcctggtgacccagaggatgctggacatgttcaagaggcccacagaccccccagagtacaactacctgtacctgctgcctgctggcacctttgtgggcggctacctggccgccctgtacagcggctacaacatcgagcagatcatgtacctgggcagcggcctgtgctgcgtgggcgccctggccggcctgagcacccagggcacagcccggctgggcaatgccctgggcatgattggagtggccggcggcctggccgccaccctgggcgtgctgaagccaggccctgagctgctggcccagatgtctggggccatggccctgggcggcaccatcggcctgaccatcgccaagaggatccagatcagtgacctgccccagctggtggccgccttccacagcctggtgggcctggccgctgtgctgacctgcatcgccgagtacatcatcgagtacccccactttgccacagatgctgctgccaacctgaccaagatcgtggcctacctgggcacctacatcggcggcgtgaccttcagcggcagcctgattgcctacggcaagctgcagggcctgctgaagagcgcccccctgctgctgcccggccgccacctgctgaatgccggcctgctggccgcctctgtgggcggcatcatccccttcatggtggaccccagcttcaccaccggcatcacctgcctgggctctgtgtctgccctgtctgctgtgatgggcgtgaccctgacagctgccatcggcggcgctgacatgcctgtggtgatcaccgtgctgaacagctacagcggctgggccctgtgtgccgagggcttcctgctgaacaacaacctgctgaccatcgtgggcgccctgattggcagcagcggggccatcctgagctacatcatgtgtgtggccatgaacagaagcctggccaacgtcatcctgggcggctacggcaccaccagcacagctgggggcaagcccatggagatcagcggcacccacacagagatcaacctggacaatgccatcgacatgatccgggaggccaacagcatcatcatcaccccaggctacggcctgtgtgccgccaaggcccagtaccccatcgctgacctggtgaagatgctgacagagcagggcaagaaggtgcgcttcggcatccaccctgtggccggccgcatgcctggccagctgaatgtgctgctggccgaggccggcgtgccctatgacatcgtgctggagatggatgagatcaaccacgacttcccagacacagacctggtgctggtgattggagccaatgacacagtgaacagcgctgcccaggaggaccccaacagcatcatcgccggcatgcctgtgctggaggtgtggaagagcaagcaggtgattgtgatgaagaggagcctgggcgtgggctatgctgctgtggacaaccccatcttctacaagcccaacacagccatgctgctgggagatgccaagaagacctgtgatgccctgcaggccaaggtgcgggagagctaccagaagtag

SEQ ID NO: 161892 - DNA, 357 bp, Artificial Sequence
  Description of Artificial Sequence: Synthetic coding sequence
atgaggcgggccggcctgggggagggcgtgcccccaggcaactacggcaactacggctacgccaacagcggctacagcgcctgtgaggaggagaatgaaaggctgacagagagcctgcggagcaaggtgacagccatcaagagcctgagcattgaaattggacatgaggtgaagacccagaacaagctgctggccgagatggacagccagtttgacagcaccaccggcttcctgggcaagaccatgggcaagctgaagatcctgagccggggcagccagaccaagctgctgtgctacatgatgctgttcagcctgtttgtgttcttcatcatctactggatcatcaagctgaggtag

SEQ ID NO: 161893 - DNA, 1107 bp, Artificial Sequence
  Description of Artificial Sequence: Synthetic coding sequence
atgaacccagctgctgaggccgagttcaacatcctgctggccacagacagctacaaggtgacccactacaagcagtacccacccaacaccagcaaggtgtacagctactttgagtgccgggagaagaagacagagaacagcaagctgaggaaggtgaagtatgaggagaccgtcttctacggcctgcagtacatcctgaacaagtacctgaagggcaaggtggtgaccaaggagaagatccaggaggccaaggatgtgtacaaggagcacttccaggatgatgtgttcaatgagaagggctggaactacatcctggagaagtatgatggccacctgcccatcgagatcaaggctgtgcctgagggctttgtgatccccagaggaaatgtgctcttcaccgtggagaacacagatcctgagtgctactggctgaccaactggattgagaccatcctggtgcagagctggtaccccatcaccgtggccaccaacagccgggagcagaagaagatcctggccaagtacctgctggagaccagcggcaacctggatggcctggagtacaagctgcatgactttggctacagaggagtgagcagccaggagacagctggcatcggggccagcgcccacctggtgaacttcaagggcacagacacagtggccggcctggccctgatcaagaagtactacggcaccaaggaccctgtgcccggctacagcgtgcctgctgctgagcacagcaccatcacagcctggggcaaggaccacgagaaggatgcctttgagcacatcgtgacccagttcagctctgtgcctgtgtctgtggtgtctgacagctatgacatctacaatgcctgtgagaagatctggggcgaggacctgcggcacctgattgtgagccgcagcacccaggcccccctcatcatccggccagacagcggcaaccccctggacacagtgctgaaggtgctggagatcctgggcaagaagtttcctgtgacagagaacagcaagggctacaagctgctgcccccctacctgcgggtcatccagggagatggagtggacatcaacaccctgcaggaggtgtgtgtgctgtactag

SEQ ID NO: 161894 - DNA, 183 bp, Artificial Sequence
  Description of Artificial Sequence: Synthetic coding sequence
atgaacccagctgctgaggccgagttcaacatcctgctggccacagacagctacaaggtgacccactacaagcagtacccacccaacaccagcaaggtgtacagctactttgagtgccgggagaagaagacagagaacagcaagctgaggaaggtgaagtatgaggagaccgtcttctactag

SEQ ID NO: 161895 - DNA, 267 bp, Artificial Sequence
  Description of Artificial Sequence: Synthetic coding sequence
atgaacccagctgctgaggccgagttcaacatcctgctggccacagacagctacaaggtgacccactacaagcagtacccacccaacaccagcaaggtgtacagctactttgagtgccgggagaagaagacagagaacagcaagctgaggaaggtgaagtatgaggagaccgtcttctacggcctgcagtacatcctgaacaagtacctgaagggcaaggtggtgaccaaggagaagatccaggaggccaaggatgtgtacaagtag

SEQ ID NO: 161896 - DNA, 1701 bp, Artificial Sequence
  Description of Artificial Sequence: Synthetic coding sequence
atggctgctgagcaggaccctgaggcccgggccgccgcccggcccctgctgacagacctgtaccaggccaccatggccctgggctactggagggctggccgggccagagatgctgctgagtttgagctgttcttccgccgctgcccctttggaggagcctttgccctggccgccggcctgcgggactgtgtgcgcttcctgcgggccttccggctgagagatgctgatgtgcagttcctggcctctgtgctgcccccagacacagatcctgccttctttgagcacctgcgggccctggactgcagcgaggtgacagtgcgggccctgcctgagggcagcctggccttccctggggtgcccctgctgcaggtgtctggccccctgctggtggtgcagctgctggagacccccctgctgtgcctggtgtcctatgccagcctggtggccaccaatgctgcccggctgcggctgattgctggccctgagaagaggctgctggagatgggcctgcggcgggcccagggcccagatggcggcctgacagccagcacctacagctacctgggcggctttgacagcagcagcaatgtgctggccggccagctgcggggcgtgcctgtggccggcaccctggcccacagctttgtgaccagcttcagcggcagcgaggtgcccccagaccccatgctggccccagctgctggggagggccctggggtggacctggccgccaaggcccaggtgtggctggagcaggtgtgtgcccacctgggcctgggcgtgcaggagccccaccctggagagcgggccgcctttgtggcctatgccctggccttcccccgggccttccagggcctgctggacacctacagcgtgtggaggagcggcctgcccaacttcctggccgtggccctggccctgggggagctgggctacagagctgtgggcgtgcggctggacagcggggacctgctgcagcaggcccaggagatcaggaaggtgttccgggctgctgctgcccagttccaggtgccctggctggagagcgtgctgattgtggtgagcaacaacattgatgaggaggccctggcccggctggcccaggagggcagcgaggtgaatgtcatcggcatcggcacctctgtggtgacctgcccccagcagcccagcctgggcggcgtgtacaagctggtggccgtgggcggccagcccaggatgaagctgacagaggaccctgagaagcagaccctgcccggcagcaaggccgccttccggctgctgggcagtgatggcagccccctgatggacatgctgcagctggccgaggagcctgtgccccaggccggccaggagctgcgggtgtggcccccaggggcccaggagccctgcaccgtgcggcctgcccaggtggagcccctgctgcggctgtgcctgcagcagggccagctgtgtgagcccctgcccagcctggccgagagccgggccctggcccagctgagcctgagccggctgagccctgagcaccggcggctgcggagccctgcccagtaccaggtgggcggcggccccccctgccacagcgccctgtgtgccccagccctgaccctgcccacagcccctgtgctgtgcagcctgcaggtggtgctgtctgagcggctgcaggccctggtgaacagcctgtgtgccggccagagcccctag

SEQ ID NO: 161897 - DNA, 1578 bp, Artificial Sequence
  Description of Artificial Sequence: Synthetic coding sequence
atggctgctgagcaggaccctgaggcccgggccgccgcccggcccctgctgacagacctgtaccaggccaccatggccctgggctactggagggctggccgggccagagatgctgctgagtttgagctgttcttccgccgctgcccctttggaggagcctttgccctggccgccggcctgcgggactgtgtgcgcttcctgcgggccttccggctgagagatgctgatgtgcagttcctggcctctgtgctgcccccagacacagatcctgccttctttgagcacctgcgggccctggactgcagcgaggtgacagtgcgggccctgcctgagggcagcctggccttccctggggtgcccctgctgcaggtgtctggccccctgctggtggtgcagctgctggagacccccctgctgtgcctggtgtcctatgccagcctggtggccaccaatgctgcccggctgcggctgattgctggccctgagaagaggctgctggagatgggcctgcggcgggcccagggcccagatggcggcctgacagccagcacctacagctacctgggcggctttgacagcagcagcaatgtgctggccggccagctgcggggcgtgcctgtggccggcaccctggcccacagctttgtgaccagcttcagcggcagcgaggtgcccccagaccccatgctggccccagctgctggggagggccctggggtggacctggccgccaaggcccaggtgtggctggagcaggtgtgtgcccacctgggcctgggcgtgcaggagccccaccctggagagcgggccgcctttgtggcctatgccctggccttcccccgggccttccagggcctgctggacacctacagcgtgtggaggagcggcctgcccaacttcctggccgtggccctggccctgggggagctgggctacagagctgtgggcgtgcggctggacagcggggacctgctgcagcaggcccaggagatcaggaaggtgttccgggctgctgctgcccagttccaggtgccctggctggagagcgtgctgattgtggtgagcaacaacattgatgaggaggccctggcccggctggcccaggagggcagcgaggtgaatgtcatcggcatcggcacctctgtggtgacctgcccccagcagcccagcctgggcggcgtgtacaagctggtggccgtgggcggccagcccaggatgaagctgacagaggaccctgagaagcagaccctgcccggcagcaaggccgccttccggctgctgggcagtgatggcagccccctgatggacatgctgcagctggccgaggagcctgtgccccaggccggccaggagctgcgggtgtggcccccaggggcccaggagccctgcaccgtgcggcctgcccagctgtgtgagcccctgcccagcctggccgagagccgggccctggcccagctgagcctgagccggctgagccctgagcaccggcggctgcggagccctgcccagtaccaggtggtgctgtctgagcggctgcaggccctggtgaacagcctgtgtgccggccagagcccctag

SEQ ID NO: 161898 - DNA, 1473 bp, Artificial Sequence
  Description of Artificial Sequence: Synthetic coding sequence
atggctgctgagcaggaccctgaggcccgggccgccgcccggcccctgctgacagacctgtaccaggccaccatggccctgggctactggagggctggccgggccagagatgctgctgagtttgagctgttcttccgccgctgcccctttggaggagcctttgccctggccgccggcctgcgggactgtgtgcgcttcctgcgggccttccggctgagagatgctgatgtgcagttcctggcctctgtgctgcccccagacacagatcctgccttctttgagcacctgcgggccctggactgcagcgaggtgacagtgcgggccctgcctgagggcagcctggccttccctggggtgcccctgctgcaggtgtctggccccctgctggtggtgcagctgctggagacccccctgctgtgcctggtgtcctatgccagcctggtggccaccaatgctgcccggctgcggctgattgctggccctgagaagaggctgctggagatgggcctgcggcgggcccagggcccagatggcggcctgacagccagcacctacagctacctgggcggctttgacagcagcagcaatgtgctggccggccagctgcggggcgtgcctgtggccggcaccctggcccacagctttgtgaccagcttcagcggcagcgaggtgcccccagaccccatgctggccccagctgctggggagggccctggggtggacctggccgccaaggcccaggtgtggctggagcaggtgtgtgcccacctgggcctgggcgtgcaggagccccaccctggagagcgggccgcctttgtggcctatgccctggccttcccccgggccttccagggcctgctggacacctacagcgtgtggaggagcggcctgcccaacttcctggccgtggccctggccctgggggagctgggctacagagctgtgggcgtgcggctggacagcggggacctgctgcagcaggcccaggagatcaggaaggtgttccgggctgctgctgcccagttccaggtgccctggctggagagcgtgctgattgtggtgagcaacaacattgatgaggaggccctggcccggctggcccaggagggcagcgaggtgaatgtcatcggcatcggcacctctgtggtgacctgcccccagcagcccagcctgggcggcgtgtacaagctggtggccgtgggcggccagcccaggatgaagctgacagaggaccctgagaagcagaccctgcccggcagcaaggccgccttccggctgctgggcagtgatggcagccccctgatggacatgctgcagctggccgaggagcctgtgccccaggccggccaggagctgcgggtgtggcccccaggggcccaggagccctgcaccgtgcggcctgcccaggtggagcccctgctgcggctgtgcctgcagcagggccaggtggccgcccccccacccagcagctag

SEQ ID NO: 161899 - DNA, 1617 bp, Artificial Sequence
  Description of Artificial Sequence: Synthetic coding sequence
atggctgctgagcaggaccctgaggcccgggccgccgcccggcccctgctgacagacctgtaccaggccaccatggccctgggctactggagggctggccgggccagagatgctgctgagtttgagctgttcttccgccgctgcccctttggaggagcctttgccctggccgccggcctgcgggactgtgtgcgcttcctgcgggccttccggctgagagatgctgatgtgcagttcctggcctctgtgctgcccccagacacagatcctgccttctttgagcacctgcgggccctggactgcagcgaggtgacagtgcgggccctgcctgagggcagcctggccttccctggggtgcccctgctgcaggtgtctggccccctgctggtggtgcagctgctggagacccccctgctgtgcctggtgtcctatgccagcctggtggccaccaatgctgcccggctgcggctgattgctggccctgagaagaggctgctggagatgggcctgcggcgggcccagggcccagatggcggcctgacagccagcacctacagctacctgggcggctttgacagcagcagcaatgtgctggccggccagctgcggggcgtgcctgtggccggcaccctggcccacagctttgtgaccagcttcagcggcagcgaggtgcccccagaccccatgctggccccagctgctggggagggccctggggtggacctggccgccaaggcccaggtgtggctggagcaggtgtgtgcccacctgggcctgggcgtgcaggagccccaccctggagagcgggccgcctttgtggcctatgccctggccttcccccgggccttccagggcctgctggacacctacagcgtgtggaggagcggcctgcccaacttcctggccgtggccctggccctgggggagctgggctacagagctgtgggcgtgcggctggacagcggggacctgctgcagcaggcccaggagatcaggaaggtgttccgggctgctgctgcccagttccaggtgccctggctggagagcgtgctgattgtggtgagcaacaacattgatgaggaggccctggcccggctggcccaggagggcagcgaggtgaatgtcatcggcatcggcacctctgtggtgacctgcccccagcagcccagcctgggcggcgtgtacaagctggtggccgtgggcggccagcccaggatgaagctgacagaggaccctgagaagcagaccctgcccggcagcaaggccgccttccggctgctgggcagtgatggcagccccctgatggacatgctgcagctggccgaggagcctgtgccccaggccggccaggagctgcgggtgtggcccccaggggcccaggagccctgcaccgtgcggcctgcccaggtggagcccctgctgcggctgtgcctgcagcagggccagctgtgtgagcccctgcccagcctggccgagagccgggccctggcccagctgagcctgagccggctgagccctgagcaccggcggctgcggagccctgcccagtaccaggtggtgctgtctgagcggctgcaggccctggtgaacagcctgtgtgccggccagagcccctag

SEQ ID NO: 161900 - DNA, 2199 bp, Artificial Sequence
  Description of Artificial Sequence: Synthetic coding sequence
atgcctgaggagacccagacccaggaccagcccatggaggaggaggaggtggagacctttgccttccaggccgagatcgcccagctgatgagcctcatcatcaacaccttctacagcaacaaggagatcttcctgcgggagctgatcagcaacagcagtgatgccctggacaagatccgctatgagagcctgacagaccccagcaagctggacagcggcaaggagctgcacatcaacctgatccccaacaagcaggacaggaccctgaccatcgtggacaccggcatcggcatgaccaaggctgacctgatcaacaacctgggcaccatcgccaagagcggcaccaaggccttcatggaggccctgcaggccggggctgacatctccatgattggccagtttggagtgggcttctacagcgcctacctggtggccgagaaggtgaccgtcatcaccaagcacaatgatgatgagcagtatgcctgggagagcagcgctgggggcagcttcaccgtgaggacagacaccggggagcccatgggccggggcaccaaggtgatcctgcacctgaaggaggaccagacagagtacctggaggagcggcgcatcaaggagatcgtgaagaagcacagccagttcatcggctaccccatcaccctgtttgtggagaaggagcgggacaaggaggtgtctgatgatgaagctgaggagaaggaggacaaggaggaggagaaggagaaggaggagaaggagagcgaggacaagccagaaattgaagatgtgggcagtgatgaggaggaggagaagaaggatggagacaagaagaagaagaagaagatcaaggagaagtacatcgaccaggaggagctgaacaagaccaagcccatctggaccagaaatccagatgacatcaccaatgaggagtatggagagttctacaagagcctgaccaatgactgggaggaccacctggccgtgaagcacttctctgtggagggccagctggagttccgggccctgctgtttgtgccccggcgggccccctttgacctgtttgaaaataggaagaagaagaacaacatcaagctgtatgtgcggcgggtcttcatcatggacaactgtgaggagctgatccctgagtacctgaacttcatccggggcgtggtggacagcgaggacctgcccctgaacatcagccgggagatgctgcagcagagcaagatcctgaaggtgatcaggaagaacctggtgaagaagtgcctggagctgttcacagagctggccgaggacaaggagaactacaagaagttctatgagcagttcagcaagaacatcaagctgggcatccacgaggacagccagaacaggaagaagctgtctgagctgctgcgctactacaccagcgccagcggagatgagatggtgtccctgaaggactactgcaccaggatgaaggagaaccagaagcacatctactacatcactggagagaccaaggaccaggtggccaacagcgcctttgtggagcggctgaggaagcacggcctggaggtgatctacatgattgagcccattgatgagtactgtgtgcagcagctgaaggagtttgagggcaagaccctggtgtctgtgaccaaggagggcctggagctgcctgaagatgaggaggagaagaagaagcaggaggagaagaagaccaagtttgagaacctgtgcaagatcatgaaggacatcctggagaagaaggtggagaaggtggtggtgagcaaccggctggtgaccagcccctgctgcatcgtgaccagcacctacggctggacagccaacatggagcgcatcatgaaggcccaggccctgcgggacaacagcaccatgggctacatggccgccaagaagcacctggagatcaacccagaccacagcatcatcgagaccctgcggcagaaggccgaggccgacaagaatgacaagtctgtgaaggacctggtgatcctgctgtatgaaacagccctgctgagcagcggcttcagcctggaggacccccagacccacgccaaccgcatctacaggatgatcaagctgggcctgggcattgatgaagatgaccccacagcagatgacaccagcgctgctgtgacagaggagatgccacccctggagggagatgatgacaccagcaggatggaggaggtggactag

SEQ ID NO: 161901 - DNA, 2910 bp, Artificial Sequence
  Description of Artificial Sequence: Synthetic coding sequence
atggagggggacagagtggccggccggcctgtgctgagcagcctgcctgtgctgctgctgctgcccctgctgatgctgcgggctgctgccctgcacccagatgagctgttcccccatggagagagctggggagaccagctgctgcaggagggagatgatgagagcagcgctgtggtgaagctggccaaccccctgcacttctatgaggcccgcttcagcaacctgtatgtgggcaccaacggcatcatcagcacccaggacttcccccgggagacccagtatgtggactatgacttccccacagacttccctgccatcgcccccttcctggccgacatcgacaccagccacggccggggccgggtgctgtacagagtgaatggcaaggtgtctggccacctgcacgtgggccacacccctgtgcacttcacagatgtggacctgcacgcctacatcgtgggcaatgatggccgggcctacacagccatcagccacatcccccagcctgctgcccaggccctgctgcccctgacccccatcggcggcctgtttggctggctgtttgccctggagaagccaggctctgaaaatggcttcagcctggccggggccgccttcacccatgacatggaggtgaccttctacccaggagaggagaccgtgcgcatcacccagacagctgagggcctggaccctgagaactacctgagcatcaagaccaacatccagggccaggtgccctacgtgtctgccaacttcaccgcccacatcagcccctacaaggagctgtaccactacagcgacagcacagtgaccagcaccagcagccgggactacagcctgacctttggagccatcaaccagacctggagctaccgcatccaccagaacatcacctaccaggtgtgcagacatgcccccaggcaccccagcttccccaccacccagcagctgaatgtggacagagtgtttgccctgtacaatgatgaggagcgggtgctgcgctttgctgtgaccaaccagatcggccctgtgaaggaggacagcgaccccaccccaggcaacccctgctatgatggcagccacatgtgtgacaccacagcccgctgccaccctggcaccggggtggactacacctgtgaatgtgccagcggctaccagggagatggaagaaactgtgtggatgaaaatgaatgtgccaccggcttccaccgctgtggccccaacagcgtgtgcatcaacctgcccggcagctaccgctgtgagtgccgcagcggctatgaatttgctgatgacagacacacctgcatcctgatcaccccaccagccaacccctgtgaagatggcagccacacctgtgccccagctggccaggcccgctgtgtgcaccacggcggcagcaccttcagctgtgcctgcctgcccggctatgctggagatggccaccagtgcacagatgtggatgaatgttctgagaaccgctgccaccctgctgccacctgctacaacaccccaggcagcttcagctgccgctgccagcccggctactatggagatggcttccagtgcatcccagacagcaccagcagcctgaccccctgtgagcagcagcagagacatgcccaggcccagtatgcctacccaggggcccgcttccacatcccccagtgtgatgagcagggcaacttcctgcccctgcagtgccacggcagcacaggcttctgctggtgtgtggaccctgatggccacgaggtgcccggcacccagaccccacctggcagcaccccaccccactgcggccccagccctgagcccacccagaggcctcccaccatctgtgagcgctggagggagaacctgctggagcactacggcggcaccccaagagatgaccagtatgtgccccagtgtgatgacctgggccacttcatccccctgcagtgccacggcaagagtgacttctgctggtgtgtggacaaggatggccgggaggtgcagggcaccaggagccagcccggcaccaccccagcctgcatccccaccgtggccccacccatggtgcggcccacccccaggccagatgtgaccccaccttctgtgggcaccttcctgctgtacacccagggccagcagatcggctacctgcccctgaatggcacccggctgcagaaggatgctgccaagaccctgctgagcctgcacggcagcatcatcgtgggcattgattatgactgccgggagaggatggtgtactggacagatgtggccggccgcaccatcagcagagctggcctggagctgggcgctgagcctgagaccatcgtgaacagcggcctcatcagccctgagggcctggccatcgaccacatccggaggaccatgtactggacagattctgtgctggacaagattgagagcgccctgctggatggcagcgagaggaaggtgctcttctacacagacctggtgaacccccgggccatcgctgtggaccccatccggggcaacctgtactggacagactggaaccgggaggcccccaagattgagaccagcagcctggatggagaaaatcgccgcatcctgatcaacacagacatcggcctgcccaacggcctgacctttgaccccttcagcaagctgctgtgctgggcagatgctggcaccaagaagctggagtgcaccctgcctgatggcaccggccggcgggtcatccagaacaacctgaagtaccccttcagcatcgtgtcctatgctgaccacttctaccacacagactggaggagagatggagtggtgtctgtgaacaagcacagcggccagttcacagatgagtacctgcctgagcagaggagccacctgtatggcatcacagctgtgtacccctactgccccaccggcaggaagtag

SEQ ID NO: 161902 - DNA, 3543 bp, Artificial Sequence
  Description of Artificial Sequence: Synthetic coding sequence
accccccagacagagcgcatcacccacagcagcatctcctggagcttcctgctgcgcttcagccggggcaagctgctgatgctgcgggctgctgccctgcacccagatgagctgttcccccatggagagagctggggagaccagctgctgcaggagggagatgatgagagcagcgctgtggtgaagctggccaaccccctgcacttctatgaggcccgcttcagcaacctgtatgtgggcaccaacggcatcatcagcacccaggacttcccccgggagacccagtatgtggactatgacttccccacagacttccctgccatcgcccccttcctggccgacatcgacaccagccacggccggggccgggtgctgtaccgggaggacaccagccctgctgtgctgggcctggccgcccgctacgtgcgggccggcttccccaggtctgcccgcttcacccccacccacgccttcctggccacctgggagcaggtgggcgcctatgaggaggtgaagagaggagccctgcccagcggggagctgaacaccttccaggccgtgctggccagtgatggcagtgacagctatgccctcttcctgtacccagccaacggcctgcagttcctgggcacccggcccaaggagagctacaacgtgcagctgcagctgcctgcccgggtgggcttctgccgcggggaggctgatgacctgaagtctgagggcccctacttcagcctgaccagcacagagcagagcgtgaagaacctgtaccagctgagcaacctgggcatccctggggtgtgggccttccacatcggcagcaccagccccctggacaacgtgcggcctgctgctgtgggggacctgtctgctgcccacagctctgtgcccctgggccgctccttcagccacgccacagccctggagagtgactacaatgaagacaacctggactactatgatgtgaatgaggaggaggccgagtacctgcctggagagcctgaggaggccctgaatggccacagcagcattgatgtgtccttccagagcaaggtggacaccaagcccctggaggagagcagcaccctggacccccacaccaaggagggcaccagcctgggggaggtgggcggccctgacctgaagggccaggtggagccctgggatgagcgggagaccaggagccctgcccctcctgaggtggaccgggacagcctggcccccagctgggagaccccaccaccctacccagaaaatggcagcatccagccctacccagatggcggccctgtgcccagcgagatggatgtgcccccagcccaccctgaggaggagatcgtgctgcggagctacccagccagcggccacaccacccccctgagccggggcacctatgaggtgggcctggaggacaacatcggcagcaacacagaggtgttcacctacaatgctgccaacaaggagacctgtgagcacaaccaccggcagtgcagcagacatgccttctgcacagattatgccaccggcttctgctgccactgccagagcaagttctatggaaatggcaagcactgcctgcctgagggcgccccccaccgggtgaatggcaaggtgtctggccacctgcacgtgggccacacccctgtgcacttcacagatgtggacctgcacgcctacatcgtgggcaatgatggccgggcctacacagccatcagccacatcccccagcctgctgcccaggccctgctgcccctgacccccatcggcggcctgtttggctggctgtttgccctggagaagccaggctctgaaaatggcttcagcctggccggggccgccttcacccatgacatggaggtgaccttctacccaggagaggagaccgtgcgcatcacccagacagctgagggcctggaccctgagaactacctgagcatcaagaccaacatccagggccaggtgccctacgtgtctgccaacttcaccgcccacatcagcccctacaaggagctgtaccactacagcgacagcacagtgaccagcaccagcagccgggactacagcctgacctttggagccatcaaccagacctggagctaccgcatccaccagaacatcacctaccaggtgtgcagacatgcccccaggcaccccagcttccccaccacccagcagctgaatgtggacagagtgtttgccctgtacaatgatgaggagcgggtgctgcgctttgctgtgaccaaccagatcggccctgtgaaggaggacagcgaccccaccccaggcaacccctgctatgatggcagccacatgtgtgacaccacagcccgctgccaccctggcaccggggtggactacacctgtgaatgtgccagcggctaccagggagatggaagaaactgtgtggatgaaaatgaatgtgccaccggcttccaccgctgtggccccaacagcgtgtgcatcaacctgcccggcagctaccgctgtgagtgccgcagcggctatgaatttgctgatgacagacacacctgcatcctgatcaccccaccagccaacccctgtgaagatggcagccacacctgtgccccagctggccaggcccgctgtgtgcaccacggcggcagcaccttcagctgtgcctgcctgcccggctatgctggagatggccaccagtgcacagatgtggatgaatgttctgagaaccgctgccaccctgctgccacctgctacaacaccccaggcagcttcagctgccgctgccagcccggctactatggagatggcttccagtgcatcccagacagcaccagcagcctgaccccctgtgagcagcagcagagacatgcccaggcccagtatgcctacccaggggcccgcttccacatcccccagtgtgatgagcagggcaacttcctgcccctgcagtgccacggcagcacaggcttctgctggtgtgtggaccctgatggccacgaggtgcccggcacccagaccccacctggcagcaccccaccccactgcggccccagccctgagcccacccagaggcctcccaccatctgtgagcgctggagggagaacctgctggagcactacggcggcaccccaagagatgaccagtatgtgccccagtgtgatgacctgggccacttcatccccctgcagtgccacggcaagagtgacttctgctggtgtgtggacaaggatggccgggaggtgcagggcaccaggagccagcccggcaccaccccagcctgcatccccaccgtggccccacccatggtgcggcccacccccaggccagatgtgaccccaccttctgtgggcaccttcctgctgtacacccagggccagcagatcggctacctgcccctgaatggcacccggctgcagaaggatgctgccaagaccctgctgagcctgcacgtgaagtggatcagccctgtgggcggccgggccgcctggctgagccagtgggagcccccccaccggccctgctgcagcgaggtggactggtgccgggaggtgctggagggcttctag

SEQ ID NO: 161903 - DNA, 3825 bp, Artificial Sequence
  Description of Artificial Sequence: Synthetic coding sequence
atggagggggacagagtgaagctggccaaccccctgcacttctatgaggcccgcttcagcaacctgtatgtgggcaccaacggcatcatcagcacccaggacttcccccgggagacccagtatgtggactatgacttccccacagacttccctgccatcgcccccttcctggccgacatcgacaccagccacggccggggccgggtgctgtaccgggaggacaccagccctgctgtgctgggcctggccgcccgctacgtgcgggccggcttccccaggtctgcccgcttcacccccacccacgccttcctggccacctgggagcaggtgggcgcctatgaggaggtgaagagaggagccctgcccagcggggagctgaacaccttccaggccgtgctggccagtgatggcagtgacagctatgccctcttcctgtacccagccaacggcctgcagttcctgggcacccggcccaaggagagctacaacgtgcagctgcagctgcctgcccgggtgggcttctgccgcggggaggctgatgacctgaagtctgagggcccctacttcagcctgaccagcacagagcagagcgtgaagaacctgtaccagctgagcaacctgggcatccctggggtgtgggccttccacatcggcagcaccagccccctggacaacgtgcggcctgctgctgtgggggacctgtctgctgcccacagctctgtgcccctgggccgctccttcagccacgccacagccctggagagtgactacaatgaagacaacctggactactatgatgtgaatgaggaggaggccgagtacctgcccggggagcctgaggaggccctgaatggccacagcagcattgatgtgtccttccagagcaaggtggacaccaagcccctggaggagagcagcaccctggacccccacaccaaggagggcaccagcctgggggaggtgggcggccctgacctgaagggccaggtggagccctgggatgagcgggagaccaggagccctgcccctcctgaggtggaccgggacagcctggcccccagctgggagaccccaccaccctacccagaaaatggcagcatccagccctacccagatggcggccctgtgcccagcgagatggatgtgcccccagcccaccctgaggaggagatcgtgctgcggagctacccagccagcggccacaccacccccctgagccggggcacctatgaggtgggcctggaggacaacatcggcagcaacacagaggtgttcacctacaatgctgccaacaaggagacctgtgagcacaaccaccggcagtgcagcagacatgccttctgcacagattatgccaccggcttctgctgccactgccagagcaagttctatggaaatggcaagcactgcctgcctgagggcgccccccaccgggtgaatggcaaggtgtctggccacctgcacgtgggccacacccctgtgcacttcacagatgtggacctgcacgcctacatcgtgggcaatgatggccgggcctacacagccatcagccacatcccccagcctgctgcccaggccctgctgcccctgacccccatcggcggcctgtttggctggctgtttgccctggagaagccaggctctgaaaatggcttcagcctggccggggccgccttcacccatgacatggaggtgaccttctacccaggagaggagaccgtgcgcatcacccagacagctgagggcctggaccctgagaactacctgagcatcaagaccaacatccagggccaggtgccctacgtgtctgccaacttcaccgcccacatcagcccctacaaggagctgtaccactacagcgacagcacagtgaccagcaccagcagccgggactacagcctgaccttcggggccatcaaccagacctggagctaccgcatccaccagaacatcacctaccaggtgtgcagacatgcccccaggcaccccagcttccccaccacccagcagctgaatgtggacagagtgtttgccctgtacaatgatgaggagcgggtgctgcgctttgctgtgaccaaccagatcggccctgtgaaggaggacagcgaccccaccccaggcaacccctgctatgatggcagccacatgtgtgacaccacagcccgctgccaccctggcactggagtggactacacctgtgaatgtgccagcggctaccagggagatggcaggaactgtgtggatgaaaatgaatgtgccaccggcttccaccgctgtggccccaacagcgtgtgcatcaacctgcccggcagctaccgctgtgaatgtcgcagcggctatgaatttgctgatgacagacacacctgcatctacgtggatgagtgcagtgaaaatcgctgccaccctgctgccacctgctacaacaccccaggcagcttcagctgccgctgccagcccggctactatggagatggcttccagtgcatcccagacagcaccagcagcctgaccccctgtgagcagcagcagagacatgcccaggcccagtatgcctacccaggggcccgcttccacatcccccagtgtgatgagcagggcaacttcctgcccctgcagtgccacggcagcacaggcttctgctggtgtgtggaccctgatggccacgaggtgcccggcacccagaccccacctggcagcaccccaccccactgcggccccagccctgagcccacccagaggcctcccaccatctgtgagcgctggagggagaacctgctggagcactatggaggcaccccaagagatgaccagtatgtgccccagtgtgatgacctgggccacttcatccccctgcagtgccacggcaagagtgacttctgctggtgtgtggacaaggatggccgggaggtgcagggcaccaggagccagcccggcaccaccccagcctgcatccccaccgtggccccacccatggtgcggcccacccccaggccagatgtgaccccacccagcgtgggcaccttcctgctgtacacccagggccagcagatcggctacctgcccctgaatggcacccggctgcagaaggatgctgccaagaccctgctgagcctgcacggcagcatcatcgtgggcatcgactatgactgccgggagaggatggtgtactggacagatgtggccggccgcaccatcagccgggccggcctggagctgggcgctgagcctgagaccatcgtgaacagcggcctcatcagccctgagggcctggccatcgaccacatccggaggaccatgtactggacagacagcgtgctggacaagattgaaagtgccctgctggatggcagcgagaggaaggtgctcttctacacagacctggtgaacccccgggccatcgctgtggaccccatccggggcaacctgtactggacagactggaaccgggaggcccccaagattgagaccagcagcctggatggagagaacagacgcatcctgatcaacacagacatcggcctgcccaacggcctgacctttgaccccttcagcaagctgctgtgctgggcagatgctggcaccaagaagctggagtgcaccctgcctgatggcactggaagaagagtcatccagaacaacctgaagtaccccttcagcatcgtgtcctatgctgaccacttctaccacacagactggaggagagatggagtggtgtctgtgaacaagcacagcggccagttcacagatgagtacctgcctgagcagaggagccacctgtatggcatcacagctgtgtacccctactgccccactggaaggaagtag

SEQ ID NO: 161904 - DNA, 3837 bp, Artificial Sequence
  Description of Artificial Sequence: Synthetic coding sequence
atgacagcccggggcctggccctgggcctgctgctgctgctgctgtgcccagcccaggtgttcagccagagctgtgtgtggtacggggagtgtggcatcgcctatggagacaagcgctacaactgtgagtacagcggcccccccaagcccctgcccaaggatggctatgacctggtgcaggagctgtgccccggcttcttctttggaaatgtgtccctgtgctgtgatgtgcggcagctgcagaccctgaaggacaacctgcagctgcccctgcagttcctgagccgctgccccagctgcttctacaacctgctgaacctcttctgtgagctgacctgcagcccccggcagagccagttcctgaatgtgacagccacagaagattatgtggaccctgtgaccaaccagaccaagaccaacgtgaaggagctgcagtactacgtgggccagagctttgccaatgccatgtacaatgcctgcagagatgtggaggcccccagcagcaatgacaaggccctgggcctgctgtgtgggaaggatgctgatgcctgcaatgccaccaactggattgagtacatgttcaacaaggacaatggccaggcccccttcaccatcacccctgtgttcagtgacttccctgtgcacggcatggagcccatgaacaatgccaccaagggctgtgatgagagcgtggatgaggtgacagccccctgcagctgccaggactgcagcatcgtgtgtggccccaagccccagcccccacctcctccagccccctggaccatcctgggcctggatgccatgtatgtgatcatgtggatcacctacatggccttcctgctggtgttcttcggggccttctttgctgtgtggtgctacaggaagcgctactttgtgtctgagtacacccccatcgacagcaacatcgccttctctgtgaatgccagtgacaagggggaggccagctgctgtgaccctgtgtctgctgcctttgagggctgcctgcggcggctcttcacccgctggggcagcttctgtgtgaggaaccctggctgcgtcatcttcttcagcctggtgttcatcacagcctgcagcagcggcctggtgtttgtgcgggtgaccaccaaccctgtggacctgtggagcgcccccagcagccaggcccggctggagaaggagtactttgaccagcacttcggccccttcttcagaacagagcagctgatcatccgggcccccctgacagacaagcacatctaccagccctaccccagcggggctgatgtgccctttggaccacccctggacatccagatcctgcaccaggtgctggacctgcagatcgccatcgagaacatcacagccagctatgacaatgaaacagtgaccctgcaggacatctgcctggcccccctgagcccctacaacaccaactgcaccatcctgtctgtgctgaactacttccagaacagccacagcgtgctggaccacaagaagggagatgacttctttgtgtatgctgactaccacacccacttcctgtactgtgtgcgggccccagccagcctgaatgacaccagcctgctgcatgacccctgcctgggcacctttggaggccctgtgttcccctggctggtgctgggcggctatgatgaccagaactacaacaatgccacagccctggtgatcaccttccctgtgaacaactactacaatgacacagagaagctgcagagggcccaggcctgggagaaggagttcatcaactttgtgaagaactacaagaaccccaacctgaccatctccttcaccgctgagaggagcattgaagatgagctgaaccgggagagtgacagtgatgtgttcaccgtggtgatctcctatgccatcatgttcctgtacatcagcctggccctgggccacatgaagagctgccggcggctgctggtggacagcaaggtgtccctgggcattgctggcatcctgattgtgctgagctctgtggcctgcagcctgggcgtcttctcctacatcggcctgcccctgaccctgattgtgattgaagtcatccccttcctggtgctggccgtgggcgtggacaacatcttcatcctggtgcaggcctaccagagagatgagcggctgcagggcgagaccctggaccagcagctgggccgggtgctgggggaggtggcccccagcatgttcctgagcagcttcagcgagaccgtggccttcttcctgggcgccctgtctgtgatgcctgctgtgcacaccttcagcctgtttgctggcctggccgtgttcatcgacttcctgctgcagatcacctgctttgtgtccctgctgggcctggacatcaagaggcaggagaagaaccggctggacatcttctgctgcgtgagaggagcagaagatggcacctctgtgcaggccagcgagagctgcctcttccgcttcttcaagaacagctacagccccctgctgctgaaggactggatgaggcccatcgtgattgccatctttgtgggcgtgctgtccttcagcattgctgtgctgaacaaggtggacatcggcctggaccagagcctgtccatgccagatgacagctacatggtggactacttcaagagcatcagccagtacctgcatgctggcccccctgtgtactttgtgctggaggagggccatgactacaccagcagcaagggccagaacatggtgtgtggcggcatgggctgcaacaatgacagcctggtgcagcagatcttcaatgctgcccagctggacaactacaccagaattggatttgcccccagctcctggattgatgactactttgactgggtgaagccccagagcagctgctgccgggtggacaacatcacagaccagttctgcaatgcctctgtggtggaccctgcctgtgtgcgctgccggcccctgaccccagagggcaagcagaggccccagggcggggacttcatgaggttcctgcccatgttcctgagtgacaaccccaaccccaagtgtgggaaaggaggccatgctgcctacagcagcgctgtgaacatcctgctgggccacggcaccagggtgggcgccacctacttcatgacctaccacacagtgctgcagaccagcgctgacttcattgatgccctgaagaaggcccggctgattgccagcaatgtgacagagaccatgggcatcaatggcagcgcctacagagtcttcccctacagcgtcttctacgtgttctatgagcagtacctgaccatcattgatgacaccatcttcaacctgggcgtgtccctgggcgccatcttcctggtgaccatggtgctgctgggctgtgagctgtggagcgctgtgatcatgtgtgccaccatcgccatggtgctggtgaacatgtttggagtgatgtggctgtggggcatcagcctgaatgctgtgtccctggtgaacctggtgatgagctgtggcatctctgtggagttctgcagccacatcacccgggccttcaccgtgtccatgaagggcagccgggtggagagagctgaggaggccctggcccacatgggcagctctgtgttcagcggcatcaccctgaccaagtttggaggcatcgtggtgctggcctttgccaagagccagatcttccagatcttctacttcaggatgtacctggccatggtgctgctgggcgccacccacggcctcatcttcctgcctgtgctgctgagctacatcggccccagcgtgaacaaggccaagagctgtgccacagaggagcgctacaagggcacagagcgggagcggctgctgaacttctag

SEQ ID NO: 161905 - DNA, 2883 bp, Artificial Sequence
  Description of Artificial Sequence: Synthetic coding sequence
atgtatgtgatcatgtggatcacctacatggccttcctgctggtgttctttggagccttctttgctgtgtggtgctacaggaagcgctactttgtgtctgagtacacccccatcgacagcaacatcgccttctctgtgaatgccagtgacaagggcacagcctggctgctgaccagcaccttccccagcagccctgtgctgcccggggaggccagctgctgtgaccctgtgtctgctgcctttgagggctgcctgcggcggctcttcacccgctggggcagcttctgtgtgaggaaccctggctgcgtcatcttcttcagcctggtgttcatcacagcctgcagcagcggcctggtgtttgtgcgggtgaccaccaaccctgtggacctgtggagcgcccccagcagccaggcccggctggagaaggagtactttgaccagcacttcggccccttcttcagaacagagcagctgatcatccgggcccccctgacagacaagcacatctaccagccctaccccagcggggctgatgtgccctttggaccacccctggacatccagatcctgcaccaggtgctggacctgcagatcgccatcgagaacatcacagccagctatgacaatgaaacagtgaccctgcaggacatctgcctggcccccctgagcccctacaacaccaactgcaccatcctgtctgtgctgaactacttccagaacagccacagcgtgctggaccacaagaagggagatgacttctttgtgtatgctgactaccacacccacttcctgtactgtgtgcgcttcatcaactttgtgaagaactacaagaaccccaacctgaccatctccttcaccgctgagaggagcattgaagatgagctgaaccgggagagtgacagtgatgtgttcaccgtggtgatctcctatgccatcatgttcctgtacatcagcctggccctgggccacatgaagagctgccggcggctgctggtggacagcaaggtgtccctgggcattgctggcatcctgattgtgctgagctctgtggcctgcagcctgggcgtcttctcctacatcggcctgcccctgaccctgattgtgattgaagtcatccccttcctggtgctggccgtgggcgtggacaacatcttcatcctggtgcaggcctaccagagagatgagcggctgcagggcgagaccctggaccagcagctgggccgggtgctgggggaggtggcccccagcatgttcctgagcagcttcagcgagaccgtggccttcttcctgggcgccctgtctgtgatgcctgctgtgcacaccttcagcctgtttgctggcctggccgtgttcatcgacttcctgctgcagatcacctgctttgtgtccctgctgggcctggacatcaagaggcaggagaagaaccggctggacatcttctgctgcgtgagaggagcagaagatggcacctctgtgcaggccagcgagagctgcctcttccgcttcttcaagaacagctacagccccctgctgctgaaggactggatgaggcccatcgtgattgccatctttgtgggcgtgctgtccttcagcattgctgtgctgaacaaggtggacatcggcctggaccagagcctgtccatgccagatgacagctacatggtggactacttcaagagcatcagccagtacctgcatgctggcccccctgtgtactttgtgctggaggagggccatgactacaccagcagcaagggccagaacatggtgtgtggcggcatgggctgcaacaatgacagcctggtgcagcagatcttcaatgctgcccagctggacaactacaccagaattggatttgcccccagctcctggattgatgactactttgactgggtgaagccccagagcagctgctgccgggtggacaacatcacagaccagttctgcaatgcctctgtggtggaccctgcctgtgtgcgctgccggcccctgaccccagagggcaagcagaggccccagggcggggacttcatgaggttcctgcccatgttcctgagtgacaaccccaaccccaagtgtgggaaaggaggccatgctgcctacagcagcgctgtgaacatcctgctgggccacggcaccagggtgggcgccacctacttcatgacctaccacacagtgctgcagaccagcgctgacttcattgatgccctgaagaaggcccggctgattgccagcaatgtgacagagaccatgggcatcaatggcagcgcctacagagtcttcccctacagcgtcttctacgtgttctatgagcagtacctgaccatcattgatgacaccatcttcaacctgggcgtgtccctgggcgccatcttcctggtgaccatggtgctgctgggctgtgagctgtggagcgctgtgatcatgtgtgccaccatcgccatggtgctggtgaacatgtttggagtgatgtggctgtggggcatcagcctgaatgctgtgtccctggtgaacctggtgatgagctgtggcatctctgtggagttctgcagccacatcacccgggccttcaccgtgtccatgaagggcagccgggtggagagagctgaggaggccctggcccacatgggcagctctgtgttcagcggcatcaccctgaccaagtttggaggcatcgtggtgctggcctttgccaagagccagatcttccagatcttctacttcaggatgtacctggccatggtgctgctgggcgccacccacggcctcatcttcctgcctgtgctgctgagctacatcggccccagcgtgaacaaggccaagagctgtgccacagaggagcgctacaagggcacagagcgggagcggctgctgaacttctag

SEQ ID NO: 161906 - DNA, 2331 bp, Artificial Sequence
  Description of Artificial Sequence: Synthetic coding sequence
atgtacaatgcctgcagagatgtggaggcccccagcagcaatgacaaggccctgggcctgctgtgtgggaaggatgctgatgcctgcaatgccaccaactggattgagtacatgttcaacaaggacaatggccaggcccccttcaccatcacccctgtgttcagtgacttccctgtgcacggcatggagcccatgaacaatgccaccaagggctgtgatgaatctgtggatgaggtgacagccccctgcagctgccaggactgcagcatcgtgtgtggccccaagccccagcccccacctcctccagccccctggaccatcctgggcctggatgccatgtatgtgatcatgtggatcacctacatggccttcctgctggtgttctttggagccttctttgctgtgtggtgctacaggaagcgctactttgtgtctgagtacacccccatcgacagcaacatcgccttctctgtgaatgccagtgacaagggggaggccagctgctgtgaccctgtgtctgctgcctttgagggctgcctgcggcggctcttcacccgctggggcagcttctgtgtgagaaatcctggctgtgtgatcttcttcagcctggtgttcatcacagcctgcagcagcggcctggtgtttgtgcgggtgaccaccaaccctgtggacctgtggagcgcccccagcagccaggcccggctggagaaggagtactttgaccagcacttcggccccttcttcagaacagagcagctgatcatccgggcccccctgacagacaagcacatctaccagccctaccccagcggggctgatgtgcccttcggcccccccctggacatccagatcctgcaccaggtgctggacctgcagatcgccatcgagaacatcacagccagctatgacaatgagaccgtgaccctgcaggacatctgcctggcccccctgagcccctacaacaccaactgcaccatcctgtctgtgctgaactacttccagaacagccacagcgtgctggaccacaagaagggagatgacttctttgtgtatgctgactaccacacccacttcctgtactgtgtgcgggccccagccagcctgaatgacaccagcctgctgcatgacccctgcctgggcaccttcggcggccctgtgttcccctggctggtgctgggcggctatgatgaccagaactacaacaatgccacagccctggtgatcaccttccctgtgaacaactactacaatgacacagagaagctgcagagggcccaggcctgggagaaggagttcatcaactttgtgaagaactacaagaaccccaacctgaccatctccttcaccgctgagaggagcattgaagatgagctgaaccgggagagtgacagtgatgtgttcaccgtggtgatctcctatgccatcatgttcctgtacatcagcctggccctgggccacatgaagagctgccggcggctgctggtggacagcaaggtgtccctgggcattgctggcatcctgattgtgctgagctctgtggcctgcagcctgggcgtcttctcctacatcggcctgcccctgaccctcatcgtcatcgaggtgatccccttcctggtgctggccgtgggcgtggacaacatcttcatcctggtgcaggcctaccagagagatgagcggctgcagggcgagaccctggaccagcagctgggccgggtgctgggggaggtggcccccagcatgttcctgagcagcttcagcgagaccgtggccttcttcctgggcgccctgtctgtgatgcctgctgtgcacaccttcagcctgtttgctggcctggccgtgttcatcgacttcctgctgcagatcacctgctttgtgtccctgctgggcctggacatcaagaggcaggagaagaaccggctggacatcttctgctgcgtgagaggagcagaagatggcacctctgtgcaggccagcgagagctgcctcttccgcttcttcaagaacagctacagccccctgctgctgaaggactggatgaggcccatcgtcatcgccatctttgtgggcgtgctgtccttcagcattgctgtgctgaacaaggtggacatcggcctggaccagagcctgtccatgccagatgacagctacatggtggactacttcaagagcatcagccagtacctgcacgccggcccccctgtgtactttgtgctggaggagggccatgactacaccagcagcaagggccagaacatggtgtgtggcggcatgggctgcaacaatgacagcctggtgcagcagatcttcaatgctgcccagctggacaactag

SEQ ID NO: 161907 - DNA, 369 bp, Artificial Sequence
  Description of Artificial Sequence: Synthetic coding sequence
atgaggttcctggccgccaccttcctgctgctggccctgagcacagctgcccaggccgagcctgtgcagttcaaggactgtggctctgtggatggagtcatcaaggaggtgaatgtgagcccctgccccacccagccctgccagctgagcaagggccagagctacagcgtgaatgtgaccttcaccagcaacatccagagcaagagcagcaaggctgtggtgcacggcatcctgatgggcgtgcctgtgcccttccccatccctgagccagatggctgcaagagcggcatcaactgccccatccagaaggacaagacctacagctacctgaacaagctgcctgtgaagtctgagtaccccagcgtgtag

SEQ ID NO: 161908 - DNA, 456 bp, Artificial Sequence
  Description of Artificial Sequence: Synthetic coding sequence
atgaggttcctggccgccaccttcctgctgctggccctgagcacagctgcccaggccgagcctgtgcagttcaaggactgtggctctgtggatggagtcatcaaggaggtgaatgtgagcccctgccccacccagccctgccagctgagcaagggccagagctacagcgtgaatgtgaccttcaccagcaacatccagagcaagagcagcaaggctgtggtgcacggcatcctgatgggcgtgcctgtgcccttccccatccctgagccagatggctgcaagagcggcatcaactgccccatccagaaggacaagacctacagctacctgaacaagctgcctgtgaagtctgagtaccccagcatcaagctggtggtggagtggcagctgcaggatgacaagaaccagagcctcttctgctgggagatccctgtgcagatcgtgagccacctgtag

SEQ ID NO: 161909 - DNA, 1053 bp, Artificial Sequence
  Description of Artificial Sequence: Synthetic coding sequence
atggacctgaaggccctgctgagcagcctgaatgactttgccagcctgagctttgctgagagctgggacaacgtgggcctgctggtggagcccagccccccccacacagtgaacaccctcttcctgaccaatgacctgacagaggaggtgatggaggaggtgctgcagaagaaggctgacctgatcctgagctaccacccccccatcttccggcccatgaagaggatcacctggaacacctggaaggagcggctggtgatccgggccctggagaacagagtgggcatctacagcccccacacagcctatgatgctgccccccagggcgtgaacaactggctggccaagggcctgggcgcctgcaccagccggcccatccaccccagcaaggcccccaactaccccacagagggcaaccaccgggtggagttcaacgtgaactacacccaggacctggacaaggtgatgtctgctgtgaagggcattgatggagtgtctgtgaccagcttcagcgccaggactggaaatgaggagcagacccgcatcaacctgaactgcacccagaaggccctgatgcaggtggtggacttcctgagcaggaacaagcagctgtaccagaagacagagatcctgagcctggagaagcccctgctgctgcacacaggcatgggccgcctgtgcaccctggatgagagcgtgtccctggccaccatgattgaccgcatcaagaggcacctgaagctgagccacatccggctggccctgggcgtgggccgcaccctggagagccaggtgaaggtggtggccctgtgtgccggcagcggcagctctgtgctgcagggcgtggaggccgacctgtacctgactggagagatgagccaccacgacaccctggatgctgccagccagggcatcaacgtcatcctgtgtgagcacagcaacacagagcggggcttcctgagtgacctgcgggacatgctggacagccacctggagaacaagatcaacatcatcctgtctgaaacagaccgggaccccctgcaggtggtgtag

SEQ ID NO: 161910 - DNA, 759 bp, Artificial Sequence
  Description of Artificial Sequence: Synthetic coding sequence
atgctgagcagctgtgtgcggcctgtgcccaccaccgtgcgctttgtggacagcctcatctgcaacagcagccgctccttcatggacctgaaggccctgctgagcagcctgaatgactttgccagcctgagctttgctgagagctgggacaacgtgggcctgctggtggagcccagccccccccacacagtgaacaccctcttcctgaccaatgacctgacagaggaggtgatggaggaggtgctgcagaagaaggctgacctgatcctgagctaccacccccccatcttccggcccatgaagaggatcacctggaacacctggaaggagcggctggtgatccgggccctggagaacagagtgggcatctacagcccccacacagcctatgatgctgccccccagggcgtgaacaactggctggccaagggcctgggcgcctgcaccagccggcccatccaccccagcaaggcccccaactaccccacagagggcaaccaccgggtggagttcaacgtgaactacacccaggacctggacaaggtgatgtctgctgtgaagggcattgatggagtgtctgtgaccagcttcagcgccaggactggaaatgaggagcagacccgcatcaacctgaactgcacccagaaggccctgatgcaggtggtggacttcctgagcaggaacaagcagctgtaccagaagcaccaggacaacaccttctacaagtctgctggctgccagctgaagtttgtgacctag

SEQ ID NO: 161911 - DNA, 1134 bp, Artificial Sequence
  Description of Artificial Sequence: Synthetic coding sequence
atgctgagcagctgtgtgcggcctgtgcccaccaccgtgcgctttgtggacagcctcatctgcaacagcagccgctccttcatggacctgaaggccctgctgagcagcctgaatgactttgccagcctgagctttgctgagagctgggacaacgtgggcctgctggtggagcccagccccccccacacagtgaacaccctcttcctgaccaatgacctgacagaggaggtgatggaggaggtgctgcagaagaaggctgacctgatcctgagctaccacccccccatcttccggcccatgaagaggatcacctggaacacctggaaggagcggctggtgatccgggccctggagaacagagtgggcatctacagcccccacacagcctatgatgctgccccccagggcgtgaacaactggctggccaagggcctgggcgcctgcaccagccggcccatccaccccagcaaggcccccaactaccccacagagggcaaccaccgggtggagttcaacgtgaactacacccaggacctggacaaggtgatgtctgctgtgaagggcattgatggagtgtctgtgaccagcttcagcgccaggactggaaatgaggagcagacccgcatcaacctgaactgcacccagaaggccctgatgcaggtggtggacttcctgagcaggaacaagcagctgtaccagaagacagagatcctgagcctggagaagcccctgctgctgcacacaggcatgggccgcctgtgcaccctggatgaatctgtgtccctggccaccatgattgaccgcatcaagaggcacctgaagctgagccacatccggctggccctgggcgtgggccgcaccctggagagccaggtgaaggtggtggccctgtgtgccggcagcggcagctctgtgctgcagggcgtggaggccgacctgtacctgaccggggagatgagccaccacgacaccctggatgctgccagccagggcatcaacgtcatcctgtgtgagcacagcaacacagagcggggcttcctgagtgacctgcgggacatgctggacagccacctggagaacaagatcaacatcatcctgtctgaaacagaccgggaccccctgcaggtggtgtag

SEQ ID NO: 161912 - DNA, 489 bp, Artificial Sequence
  Description of Artificial Sequence: Synthetic coding sequence
atggacctgaaggccctgctgagcagcctgaatgactttgccagcctgagctttgctgagagctgggacaacgtgggcctgctggtggagcccagccccccccacacagtgaacaccctcttcctgaccaatgacctgacagaggaggtgatggaggaggtgctgcagaagaaggctgacctgatcctgagctaccacccccccatcttccggcccatgaagaggatcacctggaacacctggaaggagcggctggtgatccgggccctggagaacagagtgggcatctacagcccccacacagcctatgatgctgccccccagggcgtgaacaactggctggccaagggcctgggcgcctgcaccagccggcccatccaccccagcaaggcccccaactaccccacagagggcaaccaccgggtggagttcaacgtgaactacacccaggacctggacaaggtgatgtctgctgtgaagggcatctag

SEQ ID NO: 161913 - DNA, 1134 bp, Artificial Sequence; identical to SEQ ID NO: 161911
  Description of Artificial Sequence: Synthetic coding sequence

SEQ ID NO: 161914 - DNA, 858 bp, Artificial Sequence
  Description of Artificial Sequence: Synthetic coding sequence
atgctgagcagctgtgtgcggcctgtgcccaccaccgtgcgctttgtggacagcctcatctgcaacagcagccgctccttcatggacctgaaggccctgctgagcagcctgaatgactttgccagcctgagctttgctgagagctgggacaacgtgggcctgctggtggagcccagccccccccacacagtgaacaccctcttcctgaccaatgacctgacagaggaggtgatggaggaggtgctgcagaagaaggctgacctgatcctgagctaccacccccccatcttccggcccatgaagaggatcacctggaacacctggaaggagcggctggtgatccgggccctggagaacagagtgggcatctacagcccccacacagcctatgatgctgccccccagggcgtgaacaactggctggccaagggcctgggcgcctgcaccagccggcccatccaccccagcaaggcccccaactaccccacagagggcaaccaccgggtggagttcaacgtgaactacacccaggacctggacaaggtgatgtctgctgtgaagggcattgatggagtgtctgtgaccagcttcagcgccaggactggaaatgaggagcagacccgcatcaacctgaactgcacccagaaggccctgatgcaggtggtggacttcctgagcaggaacaagcagctgtaccagaagacagagatcctgagcctggagaagagcctgaagagcaagtcctggccctgtgtgctggtgctgggcgccgccttctgccgggtgctgcggctgaccttcaccagccaggtgcgctgccccatcatgatcctgtggatgctgctgcccaaggagtag

SEQ ID NO: 161915 - DNA, 1134 bp, Artificial Sequence; identical to SEQ ID NO: 161911
  Description of Artificial Sequence: Synthetic coding sequence

SEQ ID NO: 161916 - DNA, 630 bp, Artificial Sequence
  Description of Artificial Sequence: Synthetic coding sequence
atggacctgaaggccctgctgagcagcctgaatgactttgccagcctgagctttgctgagagctgggacaacgtgggcctgctggtggagcccagccccccccacacagtgaacaccctcttcctgaccaatgacctgacagaggaggtgatggaggaggtgctgcagaagaaggctgacctgatcctgagctaccacccccccatcttccggcccatgaagaggatcacctggaacacctggaaggagcggctggtgatccgggccctggagaacagagtgggcatctacagcccccacacagcctatgatgctgccccccagggcgtgaacaactggctggccaagggcctgggcgcctgcaccagccggcccatccaccccagcaaggcccccaactaccccacagagggcaaccaccgggtggagttcaacgtgaactacacccaggacctggacaaggtgatgtctgctgtgaagggcattgatggagtgtctgtgaccagcttcagcgccaggactggaaatgaggagcagacccgcatcaacctgaactgcacccagaaggccctgatgcaggtggtggacttcctgagcaggaacaagcagctgtaccagaagacagaatag

SEQ ID NO: 161917 - DNA, 492 bp, Artificial Sequence
  Description of Artificial Sequence: Synthetic coding sequence
atgctgagcagctgtgtgcggcctgtgcccaccaccgtgcgctttgtggacagcctcatctgcaacagcagccgctccttcatggacctgaaggccctgctgagcagcctgaatgactttgccagcctgagctttgctgagagctgggacaacgtgggcctgctggtggagcccagccccccccacacagtgaacaccctcttcctgaccaatgacctgacagaggaggtgatggaggaggtgctgcagaagaaggctgacctgatcctgagctaccacccccccatcttccggcccatgaagaggatcacctggaacacctggaaggagcggctggtgatccgggccctggagaacagagtgggcatctacagcccccacacagcctatgatgctgccccccagggcgtgaacaactggctggccaagggcctgggcgcctgcaccagccggcccatccaccccagcaaggcccccaactaccccacctag

SEQ ID NO: 161918 - DNA, 4749 bp, Artificial Sequence
  Description of Artificial Sequence: Synthetic coding sequence
atggccggccctgggggctggagggaccgggaggtgacagacctgggccacctgcctgaccccaccggcatcttcagcctggacaagaccatcggcctgggcacctacggccgcatctacctgggcctgcacgagaagacaggagccttcaccgctgtgaaggtgatgaatgccaggaagacccccctgcctgagatcggccggcgggtgcgggtgaacaagtaccagaagtctgtgggctggagatacagtgatgaggaggaggacctgaggacagagctgaacctgctgaggaagtacagcttccacaagaacatcgtgtccttctacggggccttcttcaagctgagccccccaggccagaggcaccagctgtggatggtgatggagctgtgtgccgccggctctgtgacagatgtggtgaggatgaccagcaaccagagcctgaaggaggactggatcgcctacatctgccgggagatcctgcagggcctggcccacctgcacgcccacagggtcatccaccgggacatcaagggccagaatgtgctgctgacccacaatgctgaggtgaagctggtggactttggagtgtctgcccaggtgtccaggaccaacggcagaagaaattccttcatcggcaccccctactggatggcccctgaggtgattgactgtgatgaggaccccaggaggagctatgactacagaagtgatgtgtggagcgtgggcatcacagccatcgagatggccgagggcgccccacccctgtgcaacctgcagcccctggaggccctgtttgtgatcctgcgggagagcgcccccaccgtgaagagcagcggctggagcaggaagttccacaacttcatggagaagtgcaccatcaagaacttcctgttccggcccaccagcgccaacatgctgcagcacccctttgtgcgggacatcaagaatgaaagacatgtggtggagagcctgaccaggcacctgaccggcatcatcaagaagaggcagaagaagggcatccccctcatctttgagcgggaggaggccatcaaggagcagtacacagtgcggcgcttccggggccccagctgcacccatgagctgctgcggctgcccaccagcagccgctgccggcccctgcgggtgctgcacggggagcccagccagccccgctggctgcctgaccgggaggagccccaggtgcaggccctgcagcagctgcagggcgccgcccgggtcttcatgcccctgcaggccctggacagcgcccccaagcccctgaagggccaggcccaggccccccagaggctgcagggcgccgcccgggtcttcatgcccctgcaggcccaggtgaaggccaaggccagcaagcccctgcagatgcagatcaaggccccaccccggctgcggcgggccgcccgggtgctgatgcccctgcaggcccaggtgcgggccccccggctgctgcaggtgcagagccaggtgtccaagaagcagcaggcccagacccagaccagcgagccccaggacctggaccaggtgcctgaggagttccagggccaggaccaggtgcctgagcagcagaggcagggccaggcccctgagcagcagcagaggcacaaccaggtgcctgagcaggagctggagcagaaccaggcccctgagcagcctgaggtgcaggagcaggccgctgagcccgcccaggccgagacagaagctgaggagcctgagagcctgcgggtgaatgcccaggtgttcctgcccctgctgagccaggaccaccacgtgctgctgcccctgcacctggacacccaggtgctgatccctgtggagggccagacagagggcagcccccaggcccaggcctggaccctggagcccccccaggccatcggctctgtgcaggccctgattgagggcctgagccgggacctgctgcgggcccccaacagcaacaacagcaagcccctgggccccctgcagaccctgatggagaacctgagcagcaaccgcttctacagccagcctgagcaggcccgggagaagaagagcaaggtgtccaccctgcggcaggccctggccaagaggctgagccccaagcgcttccgggccaagagctcctggaggcctgagaagctggagctgagtgacctggaggcccggcggcagaggcggcagaggcgctgggaggacatcttcaaccagcacgaggaggagctgcggcaggtggacaaggacaaggaggatgagagcagtgacaatgatgaggtgttccacagcatccaggccgaggtgcagatcgagcccctgaagccctacatcagcaaccccaagaagattgaggtgcaggagaggagccccagcgtgcccaacaaccaggaccacgcccaccacgtgaagttcagcagctctgtgccccagaggagcctgctggagcaggcccagaagcccatcgacatccggcagaggagcagccagaaccggcagaactggctggccgccagcgagagcagcagcgaggaggagagccctgtgacaggccgccgcagccagagcagccccccctacagcaccatcgaccagaagctgctggtggacatccacgtgcctgatggcttcaaggtgggcaagatcagcccccctgtgtacctgaccaatgagtgggtgggctacaatgccctgtctgagatcttcagaaatgactggctgaccccagcccctgtgatccagcccccagaggaggatggagactatgtggagctgtatgatgccagcgctgacacagatggagatgatgatgatgagagcaatgacacctttgaggacacctatgaccacgccaatggaaatgatgacctggacaaccaggtggaccaggccaatgatgtgtgcaaggaccatgatgatgacaacaacaagtttgtggatgatgtgaacaacaactactatgaggcccccagctgcccccgggccagctatggaagagatggcagctgcaagcaggacggctatgatggcagccggggcaaggaggaggcctaccggggctacggcagccacacagccaacagaagccacggcggcagcgctgcctctgaagataatgctgccatcggggaccaggaggagcacgccgccaacatcggcagcgagcggcggggctctgaaggagatggcggcaaaggagtggtgaggaccagcgaggagagcggggccctgggcctgaatggagaggagaactgcagcgagacagatggccctggcctgaagaggcctgccagccaggactttgagtacctgcaggaggagcccggcggcggcaatgaggccagcaatgccatcgacagcggggccgcccccagcgccccagaccatgaaagtgacaacaaggacatcagcgagagcagcacccagagcgacttcagcgccaaccacagcagccccagcaagggcagcggcatgtctgcagatgccaactttgccagcgccatcctgtatgccggctttgtggaggtgcctgaggagagccccaagcagcccagcgaggtgaatgtgaaccccctgtatgtgtccccagcctgcaagaagcccctcatccacatgtatgagaaggagttcaccagcgagatctgctgcggcagcctgtggggcgtgaacctgctgctgggcaccaggagcaacctgtacctgatggacagaagtggcaaggctgacatcaccaagctgatcagaagaagacccttccggcagatccaggtgctggagcccctgaacctgctgatcaccatcagcggccacaagaaccggctgcgggtgtaccacctgacctggctgaggaacaagatcctgaacaatgaccctgagagcaagaggcggcaggaggagatgctgaagacagaggaggcctgcaaggccatcgacaagctgaccggctgtgagcacttctctgtgctgcagcacgaggagaccacctacatcgccatcgccctgaagagcagcatccacctgtatgcctgggcccccaagagctttgatgagagcacagccatcaaggtgtgcatcgaccagagcgctgacagcgagggggactacatgagctaccaggcctacatccgcatcctggccaagatccaggccgctgaccctgtgaaccgcttcaagaggccagatgagctgctgcacctgctgaagctgaaggtgttccccaccctggaccacaagcctgtgacagtggacctggccatcggcagcgagaagaggctgaagatcttcttcagcagcgcagatggctaccacctgattgatgctgagagcgaggtgatgtctgatgtgaccctgcccaagaaccccctggagatcatcatcccccagaacatcatcatcctgcctgactgcctgggcatcggcatgatgctgaccttcaatgctgaggccctgtctgtggaggccaatgagcagctgttcaagaagatcctggagatgtggaaggacatccccagcagcatcgcctttgaatgtacccagaggaccaccggctggggccagaaggccatcgaggtgcgcagcctgcagagccgggtgctggagagcgagctgaagaggaggagcatcaagaagctgcgcttcctgtgcaccaggggggacaagctgttcttcaccagcaccctgaggaaccaccacagccgggtgtacttcatgaccctgggcaagctggaggagctgcagagcaactatgatgtgtag

SEQ ID NO: 161919 - DNA, 4752 bp, Artificial Sequence
  Description of Artificial Sequence: Synthetic coding sequence
atggccggccctgggggctggagggaccgggaggtgacagacctgggccacctgcctgaccccaccggcatcttcagcctggacaagaccatcggcctgggcacctacggccgcatctacctgggcctgcacgagaagacaggagccttcaccgctgtgaaggtgatgaatgccaggaagacccccctgcctgagatcggccggcgggtgcgggtgaacaagtaccagaagtctgtgggctggagatacagtgatgaggaggaggacctgaggacagagctgaacctgctgaggaagtacagcttccacaagaacatcgtgtccttctacggggccttcttcaagctgagccccccaggccagaggcaccagctgtggatggtgatggagctgtgtgccgccggctctgtgacagatgtggtgaggatgaccagcaaccagagcctgaaggaggactggatcgcctacatctgccgggagatcctgcagggcctggcccacctgcacgcccacagggtcatccaccgggacatcaagggccagaatgtgctgctgacccacaatgctgaggtgaagctggtggactttggagtgtctgcccaggtgtccaggaccaacggcagaagaaattccttcatcggcaccccctactggatggcccctgaggtgattgactgtgatgaggaccccaggaggagctatgactacagaagtgatgtgtggagcgtgggcatcacagccatcgagatggccgagggcgccccacccctgtgcaacctgcagcccctggaggccctgtttgtgatcctgcgggagagcgcccccaccgtgaagagcagcggctggagcaggaagttccacaacttcatggagaagtgcaccatcaagaacttcctgttccggcccaccagcgccaacatgctgcagcacccctttgtgcgggacatcaagaatgaaagacatgtggtggagagcctgaccaggcacctgaccggcatcatcaagaagaggcagaagaagaagggcatccccctcatctttgagcgggaggaggccatcaaggagcagtacacagtgcggcgcttccggggccccagctgcacccatgagctgctgcggctgcccaccagcagccgctgccggcccctgcgggtgctgcatggagagcccagccagccccgctggctgcctgaccgggaggagccccaggtgcaggccctgcagcagctgcagggcgccgcccgggtcttcatgcccctgcaggccctggacagcgcccccaagcccctgaagggccaggcccaggccccccagaggctgcagggcgccgcccgggtcttcatgcccctgcaggcccaggtgaaggccaaggccagcaagcccctgcagatgcagatcaaggccccaccccggctgcggcgggccgcccgggtgctgatgcccctgcaggcccaggtgcgggccccccggctgctgcaggtgcagagccaggtgtccaagaagcagcaggcccagacccagaccagcgagccccaggacctggaccaggtgcctgaggagttccagggccaggaccaggtgcctgagcagcagaggcagggccaggcccctgagcagcagcagaggcacaaccaggtgcctgagcaggagctggagcagaaccaggcccctgagcagcctgaggtgcaggagcaggccgctgagcccgcccaggccgagacagaggccgaggagcctgagagcctgcgggtgaatgcccaggtgttcctgcccctgctgagccaggaccaccacgtgctgctgcccctgcacctggacacccaggtgctgatccctgtggagggccagacagagggcagcccccaggcccaggcctggaccctggagcccccccaggccatcggctctgtgcaggccctgattgagggcctgagccgggacctgctgcgggcccccaacagcaacaacagcaagcccctgggccccctgcagaccctgatggagaacctgagcagcaaccgcttctacagccagcctgagcaggcccgggagaagaagagcaaggtgtccaccctgcggcaggccctggccaagaggctgagccccaagcgcttccgggccaagagctcctggaggcctgagaagctggagctgagtgacctggaggcccggcggcagaggcggcagaggcgctgggaggacatcttcaaccagcacgaggaggagctgcggcaggtggacaaggacaaggaggatgagagcagtgacaatgatgaggtgttccacagcatccaggccgaggtgcagatcgagcccctgaagccctacatcagcaaccccaagaagattgaggtgcaggagaggagccccagcgtgcccaacaaccaggaccacgcccaccacgtgaagttcagcagctctgtgccccagaggagcctgctggagcaggcccagaagcccatcgacatccggcagaggagcagccagaaccggcagaactggctggccgccagcgagagcagcagcgaggaggagagccctgtgactggaagaagaagccagagcagccccccctacagcaccatcgaccagaagctgctggtggacatccacgtgcctgatggcttcaaggtgggcaagatcagcccccctgtgtacctgaccaatgagtgggtgggctacaatgccctgtctgagatcttcagaaatgactggctgaccccagcccctgtgatccagcccccagaagaagatggagactatgtggagctgtatgatgccagcgctgacacagatggagatgatgatgatgagagcaatgacacctttgaggacacctatgaccacgccaatggaaatgatgacctggacaaccaggtggaccaggccaatgatgtgtgcaaggaccatgatgatgacaacaacaagtttgtggatgatgtgaacaacaactactatgaggcccccagctgcccccgggccagctatggaagagatggcagctgcaagcaggacggctatgatggcagccggggcaaggaggaggcctaccggggctacggcagccacacagccaacagaagccatggaggcagcgctgccagcgaggacaatgctgccatcggggaccaggaggagcacgccgccaacatcggcagcgagcggcggggctctgaaggagatggcggcaagggcgtggtgaggaccagcgaggagagcggggccctgggcctgaatggagaggagaactgcagcgagacagatggccctggcctgaagaggcctgccagccaggactttgagtacctgcaggaggagcccggcggcggcaatgaggccagcaatgccattgattctggagctgcccccagcgccccagaccacgagagtgacaacaaggacatcagcgagagcagcacccagagcgacttcagcgccaaccacagcagccccagcaaaggaagtggcatgtctgcagatgccaactttgccagcgccatcctgtatgccggctttgtggaggtgcctgaggagagccccaagcagcccagcgaggtgaatgtgaaccccctgtatgtgtccccagcctgcaagaagcccctcatccacatgtatgagaaggagttcaccagcgagatctgctgcggcagcctgtggggcgtgaacctgctgctgggcaccaggagcaacctgtacctgatggacagaagtggcaaggctgacatcaccaagctgatcagaagaagacccttccggcagatccaggtgctggagcccctgaacctgctgatcaccatcagcggccacaagaaccggctgcgggtgtaccacctgacctggctgaggaacaagatcctgaacaatgaccctgagagcaagaggcggcaggaggagatgctgaagacagaggaggcctgcaaggccatcgacaagctgaccggctgtgagcacttctctgtgctgcagcacgaggagaccacctacatcgccatcgccctgaagagcagcatccacctgtatgcctgggcccccaagagctttgatgagagcacagccatcaaggtgtgcatcgaccagagcgctgacagcgagggggactacatgagctaccaggcctacatccgcatcctggccaagatccaggccgctgaccctgtgaaccgcttcaagaggccagatgagctgctgcacctgctgaagctgaaggtgttccccaccctggaccacaagcctgtgacagtggacctggccatcggcagcgagaagaggctgaagatcttcttcagcagcgcagatggctaccacctgattgatgctgagagcgaggtgatgtctgatgtgaccctgcccaagaaccccctggagatcatcatcccccagaacatcatcatcctgcctgactgcctgggcatcggcatgatgctgaccttcaatgctgaggccctgtctgtggaggccaatgagcagctgttcaagaagatcctggagatgtggaaggacatccccagcagcatcgcctttgagtgcacccagaggaccaccggctggggccagaaggccatcgaggtgcgcagcctgcagagccgggtgctggagagcgagctgaagagaagaagcatcaagaagctgcgcttcctgtgcaccaggggggacaagctgttcttcaccagcaccctgaggaaccaccacagccgggtgtacttcatgaccctgggcaagctggaggagctgcagagcaactatgatgtgtag

SEQ ID NO: 161920 - DNA, 567 bp, Artificial Sequence
  Description of Artificial Sequence: Synthetic coding sequence
atggccggccctgggggctggagggaccgggaggtgacagacctgggccacctgcctgaccccaccggcatcttcagcctggacaagaccatcggcctgggcacctacggccgcatctacctgggcctgcacgagaagacaggagccttcaccgctgtgaaggtgatgaatgccaggaagacccccctgcctgagatcggccggcgggtgcgggtgaacaagtaccagaagtctgtgggctggagatacagtgatgaggaggaggacctgaggacagagctgaacctgctgaggaagtacagcttccacaagaacatcgtgtccttctacggggccttcttcaagctgagccccccaggccagaggcaccagctgtggatggtgatggagctgtgtgccgccggctctgtgacagatgtggtgaggatgaccagcaaccagagcctgaaggaggactggatcgcctacatctgccgggagatcctgcagcccaaggtgatcttcctgggcaccggctgcagcgacagcagcctgaagaaggagctgtgcctgaagcaccagaactag

SEQ ID NO: 161921 - DNA, 492 bp, Artificial Sequence
  Description of Artificial Sequence: Synthetic coding sequence
atgcaggtgccccgggagcgcatcaagatcgccttccggctgtggatccccatcctggtgatcagaattgtggtggccggcacctggccccaggcccctggcctgagcaccctgggcctgaacatcatcatcctgcctgactgcctgggcatcggcatgatgctgaccttcaatgctgaggccctgtctgtggaggccaatgagcagctgttcaagaagatcctggagatgtggaaggacatccccagcagcatcgcctttgagtgcacccagaggaccaccggctggggccagaaggccatcgaggtgcgcagcctgcagagccgggtgctggagagcgagctgaagagaagaagcatcaagaagctgcgcttcctgtgcaccaggggggacaagctgttcttcaccagcaccctgaggaaccaccacagccgggtgtacttcatgaccctgggcaagctggaggagctgcagagcaactatgatgtgtag

SEQ ID NO: 161922 - DNA, 1449 bp, Artificial Sequence
  Description of Artificial Sequence: Synthetic coding sequence
atgctgaagttccaggaggccgccaagtgtgtgtctggcagcacagccatcagcacctaccccaagaccctgattgccaggagatatgtgctgcagcagaagctgggcagcggcagctttggcaccgtgtacctggtgtctgacaagaaggccaagagaggagaggagctgaaggtgctgaaggagatctctgtgggggagctgaaccccaatgaaacagtgcaggccaacctggaggcccagctgctgagcaagctggaccacccagccatcgtgaagttccacgccagctttgtggagcaggacaacttctgcatcatcacagagtactgtgagggccgggacctggatgacaagatccaggagtacaagcaggccggcaagatcttccctgagaaccagatcatcgagtggttcatccagctgctgctgggcgtggactacatgcatgagcggcgcatcctgcaccgggacctgaagagcaagaatgtgttcctgaagaacaacctgctgaagattggagactttggagtgtcccggctgctgatgggcagctgtgacctggccaccaccctgaccggcaccccccactacatgagccctgaggccctgaagcaccagggctatgacaccaagagtgacatctggagcctggcctgcatcctgtatgagatgtgctgcatgaaccacgcctttgctggcagcaacttcctgagcatcgtgctgaagatcgtggagggggacacccccagcctgcctgagcgctaccccaaggagctgaatgccatcatggagagcatgctgaacaagaaccccagcctgcggcccagcgccatcgagatcctgaagatcccctacctggatgagcagctgcagaacctgatgtgccgctacagcgagatgaccctggaggacaagaacctggactgccagaaggaggccgcccacatcatcaatgccatgcagaagaggatccacctgcagaccctgcgggccctgtctgaggtgcagaagatgaccccccgggagaggatgaggctgaggaagctgcaggccgcagatgagaaggccaggaagctgaagaagatcgtggaggagaagtatgaggagaacagcaagaggatgcaggagctgcggagcaggaacttccagcagctgtctgtggatgtgctgcacgagaagacccacctgaagggcatggaggagaaggaggagcagcctgagggccgcctgagctgcagcccccaggatgaagatgaggagcgctggcagggccgggaggaggagagtgatgagcccaccctggagaacctgcctgagagccagcccatccccagcatggacctgcacgagctggagagcatcgtggaggatgccaccagtgacctgggctaccacggggactgcaacctgatcagcctggatgagtactggaagaatgagaagtag

SEQ ID NO: 161923 - DNA, 1938 bp, Artificial Sequence
  Description of Artificial Sequence: Synthetic coding sequence
atgctgaagttccaggaggccgccaagtgtgtgtctggcagcacagccatcagcacctaccccaagaccctgattgccaggagatatgtgctgcagcagaagctgggcagcggcagctttggcaccgtgtacctggtgtctgacaagaaggccaagagaggagaggagctgaaggtgctgaaggagatctctgtgggggagctgaaccccaatgaaacagtgcaggccaacctggaggcccagctgctgagcaagctggaccacccagccatcgtgaagttccacgccagctttgtggagcaggacaacttctgcatcatcacagagtactgtgagggccgggacctggatgacaagatccaggagtacaagcaggccggcaagatcttccctgagaaccagatcatcgagtggttcatccagctgctgctgggcgtggactacatgcatgagcggcgcatcctgcaccgggacctgaagagcaagaatgtgttcctgaagaacaacctgctgaagattggagactttggagtgtcccggctgctgatgggcagctgtgacctggccaccaccctgaccggcaccccccactacatgagccctgaggccctgaagcaccagggctatgacaccaagagtgacatctggagcctggcctgcatcctgtatgagatgtgctgcatgaaccacgcctttgctggcagcaacttcctgagcatcgtgctgaagatcgtggagggggacacccccagcctgcctgagcgctaccccaaggagctgaatgccatcatggagagcatgctgaacaagaaccccagcctgcggcccagcgccatcgagatcctgaagatcccctacctggatgagcagctgcagaacctgatgtgccgctacagcgagatgaccctggaggacaagaacctggactgccagaaggaggccgcccacatcatcaatgccatgcagaagaggatccacctgcagaccctgcgggccctgtctgaggtgcagaagatgaccccccgggagaggatgaggctgaggaagctgcaggccgcagatgagaaggccaggaagctgaagaagatcgtggaggagaagtatgaggagaacagcaagaggatgcaggagctgcggagcaggaacttccagcagctgtctgtggatgtgctgcacgagaagacccacctgaagggcatggaggagaaggaggagcagcctgagggccgcctgagctgcagcccccaggatgaagatgaggagcgctggcagggccgggaggaggagagtgatgagcccaccctggagaacctgcctgagagccagcccatccccagcatggacctgcacgagctggagagcatcgtggaggatgccaccagtgacctgggctaccacgagatccctgaggaccccctggtggccgaggagtactatgcagatgcctttgacagctactgtgaggagagtgatgaggaggaggaggagatcgccctggagaggcctgagaaggagatcagaaatgaaggcagccagcctgcctaccgcaccaaccagcaggacagcgacatcgaggccctggcccgctgcctggagaatgtgctgggctgcaccagcctggacaccaagaccatcaccaccatggccgaggacatgagccctggcccccccatcttcaacagcgtgatggcccggaccaagatgaagaggatgagggagagcgccatgcagaagctgggcacagaggtgtttgaggaggtgtacaactacctgaagagggcccggcaccagaatgccagcgaggccgagatccgggagtgcctggagaaggtggtgccccaggccagtgactgctttgaggtggaccagctgctgtactttgaggagcagctgctgatcaccatgggcaaggagcccaccctgcagaaccacctgtag

SEQ ID NO: 161924 - DNA, 1386 bp, Artificial Sequence
  Description of Artificial Sequence: Synthetic coding sequence
atgcatgagcggcgcatcctgcaccgggacctgaagagcaagaatgtgttcctgaagaacaacctgctgaagattggagactttggagtgtcccggctgctgatgggcagctgtgacctggccaccaccctgaccggcaccccccactacatgagccctgaggccctgaagcaccagggctatgacaccaagagtgacatctggagcctggcctgcatcctgtatgagatgtgctgcatgaaccacgcctttgctggcagcaacttcctgagcatcgtgctgaagatcgtggagggggacacccccagcctgcctgagcgctaccccaaggagctgaatgccatcatggagagcatgctgaacaagaaccccagcctgcggcccagcgccatcgagatcctgaagatcccctacctggatgagcagctgcagaacctgatgtgccgctacagcgagatgaccctggaggacaagaacctggactgccagaaggaggccgcccacatcatcaatgccatgcagaagaggatccacctgcagaccctgcgggccctgtctgaggtgcagaagatgaccccccgggagaggatgaggctgaggaagctgcaggccgcagatgagaaggccaggaagctgaagaagatcgtggaggagaagtatgaggagaacagcaagaggatgcaggagctgcggagcaggaacttccagcagctgtctgtggatgtgctgcacgagagtgatgagcccaccctggagaacctgcctgagagccagcccatccccagcatggacctgcacgagctggagagcatcgtggaggatgccaccagtgacctgggctaccacgagatccctgaggaccccctggtggccgaggagtactatgcagatgcctttgacagctactgtgaggagagtgatgaggaggaggaggagatcgccctggagaggcctgagaaggagatcagaaatgaaggcagccagcctgcctaccgcaccaaccagcaggacagcgacatcgaggccctggcccgctgcctggagaatgtgctgggctgcaccagcctggacaccaagaccatcaccaccatggccgaggacatgagccctggcccccccatcttcaacagcgtgatggcccggaccaagatgaagaggatgagggagagcgccatgcagaagctgggcacagaggtgtttgaggaggtgtacaactacctgaagagggcccggcaccagaatgccagcgaggccgagatccgggagtgcctggagaaggtggtgccccaggccagtgactgctttgaggtggaccagctgctgtactttgaggagcagctgctgatcaccatgggcaaggagcccaccctgcagaaccacctgtag

SEQ ID NO: 161925 - DNA, 1938 bp, Artificial Sequence; identical to SEQ ID NO: 161923
  Description of Artificial Sequence: Synthetic coding sequence

SEQ ID NO: 161926 - DNA, 1449 bp, Artificial Sequence; identical to SEQ ID NO: 161922
  Description of Artificial Sequence: Synthetic coding sequence

SEQ ID NO: 161927 - DNA, 1938 bp, Artificial Sequence; identical to SEQ ID NO: 161923
  Description of Artificial Sequence: Synthetic coding sequence

SEQ ID NO: 161928 - DNA, 1413 bp, Artificial Sequence
  Description of Artificial Sequence: Synthetic coding sequence
atgctgaagttccaggaggccgccaagtgtgtgtctggcagcacagccatcagcacctaccccaagaccctgattgccaggagatatgtgctgcagcagaagctgggcagcggcagctttggcaccgtgtacctggtgtctgacaagaaggccaagagaggagaggagctgaaggtgctgaaggagatctctgtgggggagctgaaccccaatgaaacagtgcaggccaacctggaggcccagctgctgagcaagctggaccacccagccatcgtgaagttccacgccagctttgtggagcaggacaacttctgcatcatcacagagtactgtgagggccgggacctggatgacaagatccaggagtacaagcaggccggcaagatcttccctgagaaccagatcatcgagtggttcatccagctgctgctgggcgtggactacatgcatgagcggcgcatcctgcaccgggacctgaagagcaagaatgtgttcctgaagaacaacctgctgaagattggagactttggagtgtcccggctgctgatgggcagctgtgacctggccaccaccctgaccggcaccccccactacatgagccctgaggccctgaagcaccagggctatgacaccaagagtgacatctggagcctggcctgcatcctgtatgagatgtgctgcatgaaccacgcctttgctggcagcaacttcctgagcatcgtgctgaagatcgtggagggggacacccccagcctgcctgagcgctaccccaaggagctgaatgccatcatggagagcatgctgaacaagaaccccagcctgcggcccagcgccatcgagatcctgaagatcccctacctggatgagcagctgcagaacctgatgtgccgctacagcgagatgaccctggaggacaagaacctggactgccagaaggaggccgcccacatcatcaatgccatgcagaagaggatccacctgcagaccctgcgggccctgtctgaggtgcagaagatgaccccccgggagaggatgaggctgaggaagctgcaggccgcagatgagaaggccaggaagctgaagaagatcgtggaggagaagtatgaggagaacagcaagaggatgcaggagctgcggagcaggaacttccagcagctgtctgtggatgtgctgcacgagaagacccacctgaagggcatggaggagaaggaggagcagcctgagggccgcctgagctgcagcccccaggatgaagatgaggagcgctggcagggccgggaggaggagagtgatgagcccaccctggagaacctgcctgagagccagcccatccccagcatggacctgcacgagctggagagcatcgtggaggatgccaccagtgacctgggctaccacgccacccacagctag

SEQ ID NO: 161929 - DNA, 2079 bp, Artificial Sequence
  Description of Artificial Sequence: Synthetic coding sequence
atggagaagtatgaaagaatccgggtggtgggccgcggggcctttggaattgtgcacctgtgcctgaggaaggctgaccagaagctggtgatcatcaagcagatccctgtggagcagatgaccaaggaggagcggcaggccgcccagaatgaatgccaggtgctgaagctgctgaaccaccccaacgtcatcgagtactatgagaacttcctggaggacaaggccctgatgattgccatggagtatgcccctgggggcaccctggccgagttcatccagaagcgctgcaacagcctgctggaggaggagaccatcctgcacttctttgtgcagatcctgctggccctgcaccacgtgcacacccacctgatcctgcaccgggacctgaagacccagaacatcctgctggacaagcacaggatggtggtgaagattggagactttggcatcagcaagatcctgagcagcaagagcaaggcctacacagtggtgggcaccccctgctacatcagccctgagctgtgtgagggcaagccctacaaccagaagagtgacatctgggccctgggctgtgtgctgtatgagctggccagcctgaagagggcctttgaagctgccaacctgcctgccctggtgctgaagatcatgagcggcacctttgcccccatcagtgaccgctacagccctgagctgcggcagctggtgctgagcctgctgagcctggagcccgcccagaggcctcccctgagccacatcatggcccagcccctgtgcatccgggccctgctgaacctgcacacagatgtgggctctgtgaggatgagaagagctgagaagtctgtggcccccagcaacacaggcagcaggaccacctctgtgcgctgccggggcatcccccggggccctgtgcggcctgccatccccccacccctgagctctgtgtatgcctggggcggcggcctgggcacccccctgcggctgcccatgctgaacacagaggtggtgcaggtggccgccggccgcacccagaaggccggcgtgaccaggagcggccgcctcatcctgtgggaggccccacccctgggcgccggcggcggcagcctgctgcccggggctgtggagcagccccagccccagttcatcagccgcttcctggagggccagagcggcgtgaccatcaagcacgtggcctgtggggacttcttcaccgcctgcctgacagaccggggcatcatcatgacctttggaagtggcagcaatggctgcctgggccacggcagcctgacagacatcagccagcccaccatcgtggaggccctgctgggctatgagatggtgcaggtggcctgtggggccagccacgtgctggccctgagcacagagcgggagctgtttgcctggggccgcggggacagcggccgcctgggcctgggcacccgggagagccacagctgcccccagcaggtgcccatgcctcctggccaggaggcccagagggtggtgtgtggcatcgacagctccatgatcctgactgtgcccggccaggccctggcctgtggcagcaaccgcttcaacaagctgggcctggaccacctgagcctgggggaggagcctgtgccccaccagcaggtggaggaggccctgtccttcaccctgctgggcagcgcccccctggaccaggagcccctgctgagcattgacctgggcacagcccacagcgctgctgtgacagccagcggggactgctacaccttcggcagcaaccagcacggccagctgggcaccaacacccggcggggcagccgggccccctgcaaggtgcagggcctggagggcatcaagatggccatggtggcctgtggagatgccttcaccgtggccatcggggctgagagcgaggtgtacagctggggcaaaggagcccggggccgcctgggcagaagagatgaagatgctggcctgcccaggcctgtgcagctggatgagacccacccctacacagtgacctctgtgtcctgctgccacggcaacaccctgctggccgtgcgctctgtgacagatgagcctgtgcccccatag

SEQ ID NO: 161930 - DNA, 1383 bp, Artificial Sequence
  Description of Artificial Sequence: Synthetic coding sequence
atggagaagtatgaaagaatccgggtggtgggccgcggggcctttggaattgtgcacctgtgcctgaggaaggctgaccagaagctggtgatcatcaagcagatccctgtggagcagatgaccaaggaggagcggcaggccgcccagaatgaatgccaggtgctgaagctgctgaaccaccccaacgtcatcgagtactatgagaacttcctggaggacaaggccctgatgattgccatggagtatgcccctgggggcaccctggccgagttcatccagaagcgctgcaacagcctgctggaggaggagaccatcctgcacttctttgtgcagatcctgctggccctgcaccacgtgcacacccacctgatcctgcaccgggacctgaagacccagaacatcctgctggacaagcacaggatggtggtgaagattggagactttggcatcagcaagatcctgagcagcaagagcaaggcctacacagtggtgggcaccccctgctacatcagccctgagctgtgtgagggcaagccctacaaccagaagagtgacatctgggccctgggctgtgtgctgtatgagctggccagcctgaagagggcctttgaagctgccaacctgcctgccctggtgctgaagatcatgagcggcacctttgcccccatcagtgaccgctacagccctgagctgcggcagctggtgctgagcctgctgagcctggagcccgcccagaggcctcccctgagccacatcatggcccagcccctgtgcatccgggccctgctgaacctgcacacagatgtgggctctgtgaggatgagaagacctgtgcagggccagagagctgtgctgggcggccgggtgtgggcccccagcggcagcactggaggcctgcggcagcgggagacctggggcaagagcagcctgcctgcctgcagaaatgtgagaagagtgtttgtgctgcggccccccagcgtgctgcagggccgggaggtgcggggcccccagcagcaccgggagcaggaccaccagtgccccctgcagcgctacccacctggcacctgtgaggccagccaccccaccaccaccgtggtgtctgtgtgcctgggctggtgggccggccaccccccagctgctgccaatgcccagcacagaggaggccctgggggctcctgggcccacgccgagagcagaagacatgccctgtgggccagccaccctgtgggcggccccaccccccgctgcagaagacggcagagccccagctggggcagcggggccgccacagcccctgtgcacctggccttccctgggggccctgtgggctgtgaccaccaggcccggggcctgtggggcctgctgcactgcctgcctgactag

SEQ ID NO: 161931 - DNA, 2940 bp, Artificial Sequence
  Description of Artificial Sequence: Synthetic coding sequence
atgtctgtgctgggggagtatgagcggcactgtgacagcatcaacagcgactttggcagcgagagcggcggctgtggggacagcagccctggccccagcgccagccagggcccccgggccggcggcggcgctgctgagcaggaggagctgcactacatccccatccgggtgctgggccgcggggcctttggagaggccaccctgtacagaagaacagaagatgacagcctggtggtgtggaaggaggtggacctgacccggctgtctgagaaggagaggagagatgccctgaatgagatcgtcatcctggccctgctgcagcacgacaacatcatcgcctactacaaccacttcatggacaacaccaccctgctgattgagctggagtactgcaatggaggcaacctgtatgacaagatcctgcggcagaaggacaagctgtttgaggaggagatggtggtgtggtacctgttccagatcgtgtctgctgtgtcctgcatccacaaggccggcatcctgcaccgggacatcaagaccctgaacatcttcctgaccaaggccaacctgatcaagctgggggactatggcctggccaagaagctgaacagcgagtacagcatggccgagaccctggtgggcaccccctactacatgagccctgagctgtgccagggcgtgaagtacaacttcaagagtgacatctgggccgtgggctgtgtgatctttgagctgctgaccctgaagaggacctttgatgccaccaaccccctgaacctgtgtgtgaagatcgtgcagggcatccgggccatggaggtggacagcagccagtacagcctggagctgatccagatggtgcacagctgcctggaccaggaccctgagcagaggcccacagcagatgagctgctggaccggcccctgctgaggaagagaagaagagagatggaggagaaggtgaccctgctgaatgcccccaccaagaggcccaggagcagcacagtgacagaggcccccatcgctgtggtgaccagcaggaccagcgaggtgtatgtgtggggcggcggcaagagcaccccccagaagctggatgtgatcaagagcggctgcagcgcccggcaggtgtgtgccggcaacacccactttgctgtggtgacagtggagaaggagctgtacacctgggtgaacatgcagggcggcaccaagctgcacggccagctgggccacggggacaaggccagctaccggcagcccaagcacgtggagaagctgcagggcaaggccatccggcaggtgtcctgtggagatgacttcaccgtgtgtgtgacagatgagggccagctgtatgccttcggcagtgactactacggctgcatgggcgtggacaaggtggccggccctgaggtgctggagcccatgcagctgaacttcttcctgagcaaccctgtggagcaggtgtcctgtggggacaaccacgtggtggtgctgaccaggaacaaggaggtgtacagctggggctgtggggagtatggccgcctgggcctggacagcgaggaggactactacaccccccagaaggtggatgtgcccaaggccctgatcatcgtggccgtgcagtgtggctgtgatggcaccttcctgctgacccagagcggcaaggtgctggcctgtggcctgaatgagttcaacaagctgggcctgaaccagtgcatgagcggcatcatcaaccacgaggcctaccacgaggtgccctacaccaccagcttcaccctggccaagcagctgtccttctacaagatccgcaccatcgcccctgggaagacccacacagctgccattgatgagcggggccgcctgctgaccttcggctgcaacaagtgtggccagctgggcgtgggcaactacaagaagaggctgggcatcaacctgctgggcggccccctgggcggcaagcaggtgatccgggtgtcctgtggagatgagttcaccatcgccgccacagatgacaaccacatctttgcctggggcaatggaggaaatggccgcctggccatgacccccacagagcggccccacggcagtgacatctgcacctcctggccccggcccatcttcggcagcctgcaccacgtgcctgacctgagctgccggggctggcacaccatcctgattgtggagaaggtgctgaacagcaagaccatccgcagcaacagcagcggcctgagcatcggcaccgtcttccagagcagcagccctgggggcggcggcggcggcggcggcggggaggaggaggacagccagcaggagagcgagaccccagaccccagcggcggcttccggggcaccatggaggccgaccggggcatggagggcctcatcagccccacagaggccatgggcaacagcaatggagccagcagcagctgccccggctggctgaggaaggagctggagaatgctgagttcatccccatgccagacagccccagccccctgtctgctgccttcagcgagagcgagaaggacaccctgccctatgaggagctgcagggcctgaaggtggccagcgaggcccccctggagcacaagccccaggtggaggccagcagcccccggctgaacccagctgtgacctgtgccggcaagggcacccccctgaccccaccagcctgtgcctgcagcagcctgcaggtggaggtggagcggctgcagggcctggtgctgaagtgcctggccgagcagcagaagctgcagcaggagaacctgcagatcttcacccagctgcagaagctgaacaagaagctggagggcggccagcaggtgggcatgcacagcaagggcacccagacagccaaggaggagatggagatggaccccaagccagacctggacagcgacagctggtgcctgctgggcacagacagctgccggcccagcctgtag

SEQ ID NO: 161932 - DNA, 1545 bp, Artificial Sequence
  Description of Artificial Sequence: Synthetic coding sequence
atgtctgtgctgggggagtatgagcggcactgtgacagcatcaacagcgactttggcagcgagagcggcggctgtggggacagcagccctggccccagcgccagccagggcccccgggccggcggcggggcctttggagaggccaccctgtacagaagaacagaagatgacagcctggtggtgtggaaggaggtggacctgacccggctgtctgagaaggagaggagagatgccctgaatgagatcgtcatcctggccctgctgcagcacgacaacatcatcgcctactacaaccacttcatggacaacaccaccctgctgattgagctggagtactgcaatggaggcaacctgtatgacaagatcctgcggcagaaggacaagctgtttgaggaggagatggtggtgtggtacctgttccagatcgtgtctgctgtgtcctgcatccacaaggccggcatcctgcaccgggacatcaagaccctgaacatcttcctgaccaaggccaacctgatcaagctgggggactatggcctggccaagaagctgaacagcgagtacagcatggccgagaccctggtgggcaccccctactacatgagccctgagctgtgccagggcgtgaagtacaacttcaagagtgacatctgggccgtgggctgtgtgatctttgagctgctgaccctgaagaggacctttgatgccaccaaccccctgaacctgtgtgtgaagatcgtgcagggcatccgggccatggaggtggacagcagccagtacagcctggagctgatccagatggtgcacagctgcctggaccaggaccctgagcagaggcccacagcagatgagctgctggaccggcccctgctgaggaagagaagaagagagatggaggagaaggtgaccctgctgaatgcccccaccaagaggcccaggagcagcacagtgacagaggcccccatcgctgtggtgaccagcaggaccagcgaggtgtatgtgtggggcggcggcaagagcaccccccagaagctggatgtgatcaagagcggctgcagcgcccggcaggtgtgtgccggcaacacccactttgctgtggtgacagtggagaaggagctgtacacctgggtgaacatgcagggcggcaccaagctgcacggccagctgggccacggggacaaggccagctaccggcagcccaagcacgtggagaagctgcagggcaaggccatccggcaggtgtcctgtggagatgacttcaccgtgtgtgtgacagatgagggccagctgtatgccttcggcagtgactactacggctgcatgggcgtggacaaggtggccggccctgaggtgctggagcccatgcagctgaacttcttcctgagcaaccctgtggagcaggtgtcctgtggggacaaccacgtggtggtgctgaccaggaacaaggaggtgtacagctggggctgtggggagtatggccggggcagcctggtgtctgtgcacttcttcaccggcatccagcctgacttcaaggtggtgtgcatctag

SEQ ID NO: 161933 - DNA, 3777 bp, Artificial Sequence
  Description of Artificial Sequence: Synthetic coding sequence
atggagaagtatgtgcggctgcagaagatcggggagggcagctttgggaaggccatcctggtgaagagcacagaagatggccggcagtatgtgatcaaggagatcaacatcagcaggatgagcagcaaggagcgggaggagagcagaagagaggtggccgtgctggccaacatgaagcaccccaacatcgtgcagtaccgggagagctttgaggagaatggcagcctgtacatcgtgatggactactgtgagggcggggacctcttcaagaggatcaatgcccagaagggcgtgctcttccaggaggaccagatcctggactggtttgtgcagatctgcctggccctgaagcacgtgcatgacaggaagatcctgcaccgggacatcaagagccagaacatcttcctgaccaaggatggcaccgtgcagctgggggactttggaattgcccgggtgctgaacagcacagtggagctggcccggacctgcatcggcaccccctactacctgagccctgagatctgtgagaacaagccctacaacaacaagagtgacatctgggccctgggctgtgtgctgtatgagctgtgcaccctgaagcacgcctttgaagctggctccatgaagaacctggtgctgaagatcatcagcggcagcttcccccctgtgtccctgcactacagctatgacctgcggagcctggtgtcccagctgttcaagaggaacccccgggaccggcccagcgtgaacagcatcctggagaagggcttcatcgccaagagaattgagaagttcctgagcccccagctgattgctgaggagttctgcctgaagaccttcagcaagtttggcagccagcccatcccagccaagaggcctgccagcggccagaacagcatctctgtgatgcctgcccagaagatcaccaagccagctgccaagtatggcatccccctggcctacaagaagtacggggacaagaagctgcacgagaagaagcccctgcagaagcacaagcaggcccaccagaccccagagaagagggtgaacacaggagaggagaggaggaagatcagcgaggaggccgccaggaagaggcggctggagttcatcgagaaggagaagaagcagaaggaccagatcatcagcctgatgaaggccgagcagatgaagaggcaggagaaggagcggctggagcgcatcaacagagcccgggagcagggctggagaaatgtgctgtctgctgggggcagcggggaggtgaaggcccccttcctgggcagcggcggcaccatcgcccccagcagcttcagcagccggggccagtatgagcactaccacgccatctttgaccagatgcagcagcagagagcagaagataatgaggccaagtggaagcgggagatctacggccggggcctgcctgagcggggcatcctgcccggggtgcggcccggcttcccctatggagctgctggccaccaccacttcccagatgctgatgacatcaggaagaccctgaagaggctgaaggctgtgtccaagcaggccaatgccaaccggcagaagggccagctggccgtggagcgggccaagcaggtggaggagttcctgcagaggaagcgggaggccatgcagaacaaggcccgggcagagggccacatggtgtacctggcccggctgcggcagatccggctgcagaacttcaatgaaaggcagcagatcaaggccaagctgcggggggagaagaaggaggccaaccacagcgagggccaggagggcagcgaggaggccgacatgaggaggaagaagattgagagcctgaaggcccacgccaatgcccgggctgctgtgctgaaggagcagctggagaggaagaggaaggaggcctatgagcgggagaagaaggtgtgggaggagcacctggtggccaagggcgtgaagagcagtgatgtgagcccccccctgggccagcatgaaacaggaggcagccccagcaagcagcagatgaggagcgtcatctctgtgaccagcgccctgaaggaggtgggcgtggacagcagcctgacagacacccgggagaccagcgaggagatgcagaagaccaacaatgccatcagcagcaagcgggagatcctgcggcggctgaatgaaaacctgaaggcccaggaggatgagaagggcaagcagaacctgagtgacacctttgagatcaacgtgcatgaagatgccaaggagcacgagaaggagaagtctgtgtccagtgacaggaagaagtgggaggccggcggccagctggtgatccccctggatgagctgaccctggacaccagcttcagcaccacagagcggcacacagtgggggaggtgatcaagctgggccccaacggcagcccccggcgggcctggggcaagagccccacagacagcgtgctgaagatcctgggggaggccgagctgcagctgcagacagagctgctggagaacaccaccatccgctctgagatcagccctgagggggagaagtacaagcccctcatcaccggggagaagaaggtgcagtgcatcagccatgagatcaaccccagcgccatcgtggacagccctgtggagaccaagagccctgagttcagcgaggccagcccccagatgagcctgaagctggagggcaacctggaggagccagatgacctggagacagagatcctgcaggagcccagcggcaccaacaaggatgagagcctgccctgcaccatcacagatgtgtggatcagcgaggagaaggagaccaaggagacccagagcgctgaccgcatcaccatccaggagaatgaggtgtctgaagatggagtgagcagcacagtggaccagctgagtgacatccacatcgagcccggcaccaatgacagccagcacagcaaatgtgatgtggacaagtctgtgcagcctgagcccttcttccacaaggtggtgcacagcgagcacctgaacctggtgccccaggtgcagagcgtgcagtgcagccctgaggagagctttgccttccgcagccacagccacctgccccccaagaacaagaacaagaacagcctgctgattggcctgagcacaggcctgtttgatgccaacaaccccaagatgctgcggacctgcagcctgcctgacctgagcaagctgttccgcaccctgatggatgtgcccaccgtgggagatgtgcggcaggacaacctggagattgatgaaattgaagatgagaacatcaaggagggccccagcgacagtgaagatattgtgtttgaggagacagacacagacctgcaggagctgcaggcctccatggagcagctgctgcgggagcagcctggagaggagtacagcgaggaggaggagagcgtgctgaagaacagtgatgtggagcccacagccaatggaacagatgtggctgatgaagatgacaaccccagcagcgagagcgccctgaatgaggagtggcacagcgacaacagtgatggagaaattgcctctgaatgtgaatgtgacagcgtcttcaaccacctggaggagctgcggctgcacctggagcaggagatgggctttgagaagttctttgaggtgtatgagaagatcaaggccatccatgaagatgaagatgagaacatcgagatctgcagcaagatcgtgcagaacatcctgggcaatgagcaccagcacctgtatgccaagatcctgcacctggtgatggctgatggagcctaccaggaggacaatgatgaatag

SEQ ID NO: 161934 - DNA, 3861 bp, Artificial Sequence
  Description of Artificial Sequence: Synthetic coding sequence
atggagaagtatgtgcggctgcagaagatcggggagggcagctttgggaaggccatcctggtgaagagcacagaagatggccggcagtatgtgatcaaggagatcaacatcagcaggatgagcagcaaggagcgggaggagagcagaagagaggtggccgtgctggccaacatgaagcaccccaacatcgtgcagtaccgggagagctttgaggagaatggcagcctgtacatcgtgatggactactgtgagggcggggacctcttcaagaggatcaatgcccagaagggcgtgctcttccaggaggaccagatcctggactggtttgtgcagatctgcctggccctgaagcacgtgcatgacaggaagatcctgcaccgggacatcaagagccagaacatcttcctgaccaaggatggcaccgtgcagctgggggactttggaattgcccgggtgctgaacagcacagtggagctggcccggacctgcatcggcaccccctactacctgagccctgagatctgtgagaacaagccctacaacaacaagagtgacatctgggccctgggctgtgtgctgtatgagctgtgcaccctgaagcacgcctttgaagctggctccatgaagaacctggtgctgaagatcatcagcggcagcttcccccctgtgtccctgcactacagctatgacctgcggagcctggtgtcccagctgttcaagaggaacccccgggaccggcccagcgtgaacagcatcctggagaagggcttcatcgccaagagaattgagaagttcctgagcccccagctgattgctgaggagttctgcctgaagaccttcagcaagtttggcagccagcccatcccagccaagaggcctgccagcggccagaacagcatctctgtgatgcctgcccagaagatcaccaagccagctgccaagtatggcatccccctggcctacaagaagtacggggacaagaagctgcacgagaagaagcccctgcagaagcacaagcaggcccaccagaccccagagaagagggtgaacacaggagaggagaggaggaagatcagcgaggaggccgccaggaagaggcggctggagttcatcgagaaggagaagaagcagaaggaccagatcatcagcctgatgaaggccgagcagatgaagaggcaggagaaggagcggctggagcgcatcaacagagcccgggagcagggctggagaaatgtgctgtctgctgggggcagcggggaggtgaaggcccccttcctgggcagcggcggcaccatcgcccccagcagcttcagcagccggggccagtatgagcactaccacgccatctttgaccagatgcagcagcagagagcagaagataatgaggccaagtggaagcgggagatctacggccggggcctgcctgagcggggcatcctgcccggggtgcggcccggcttcccctatggagctgctggccaccaccacttcccagatgctgatgacatcaggaagaccctgaagaggctgaaggctgtgtccaagcaggccaatgccaaccggcagaagggccagctggccgtggagcgggccaagcaggtggaggagttcctgcagaggaagcgggaggccatgcagaacaaggcccgggcagagggccacatgggcatcctgcagaacctggccgccatgtatggaggccggcccagcagcagccggggcggcaagcccaggaacaaggaggaggaggtgtacctggcccggctgcggcagatccggctgcagaacttcaatgaaaggcagcagatcaaggccaagctgcggggggagaagaaggaggccaaccacagcgagggccaggagggcagcgaggaggccgacatgaggaggaagaagattgagagcctgaaggcccacgccaatgcccgggctgctgtgctgaaggagcagctggagaggaagaggaaggaggcctatgagcgggagaagaaggtgtgggaggagcacctggtggccaagggcgtgaagagcagtgatgtgagcccccccctgggccagcatgaaacaggaggcagccccagcaagcagcagatgaggagcgtcatctctgtgaccagcgccctgaaggaggtgggcgtggacagcagcctgacagacacccgggagaccagcgaggagatgcagaagaccaacaatgccatcagcagcaagcgggagatcctgcggcggctgaatgaaaacctgaaggcccaggaggatgagaagggcaagcagaacctgagtgacacctttgagatcaacgtgcatgaagatgccaaggagcacgagaaggagaagtctgtgtccagtgacaggaagaagtgggaggccggcggccagctggtgatccccctggatgagctgaccctggacaccagcttcagcaccacagagcggcacacagtgggggaggtgatcaagctgggccccaacggcagcccccggcgggcctggggcaagagccccacagacagcgtgctgaagatcctgggggaggccgagctgcagctgcagacagagctgctggagaacaccaccatccgctctgagatcagccctgagggggagaagtacaagcccctcatcaccggggagaagaaggtgcagtgcatcagccatgagatcaaccccagcgccatcgtggacagccctgtggagaccaagagccctgagttcagcgaggccagcccccagatgagcctgaagctggagggcaacctggaggagccagatgacctggagacagagatcctgcaggagcccagcggcaccaacaaggatgagagcctgccctgcaccatcacagatgtgtggatcagcgaggagaaggagaccaaggagacccagagcgctgaccgcatcaccatccaggagaatgaggtgtctgaagatggagtgagcagcacagtggaccagctgagtgacatccacatcgagcccggcaccaatgacagccagcacagcaaatgtgatgtggacaagtctgtgcagcctgagcccttcttccacaaggtggtgcacagcgagcacctgaacctggtgccccaggtgcagagcgtgcagtgcagccctgaggagagctttgccttccgcagccacagccacctgccccccaagaacaagaacaagaacagcctgctgattggcctgagcacaggcctgtttgatgccaacaaccccaagatgctgcggacctgcagcctgcctgacctgagcaagctgttccgcaccctgatggatgtgcccaccgtgggagatgtgcggcaggacaacctggagattgatgaaattgaagatgagaacatcaaggagggccccagcgacagtgaagatattgtgtttgaggagacagacacagacctgcaggagctgcaggcctccatggagcagctgctgcgggagcagcctggagaggagtacagcgaggaggaggagagcgtgctgaagaacagtgatgtggagcccacagccaatggaacagatgtggctgatgaagatgacaaccccagcagcgagagcgccctgaatgaggagtggcacagcgacaacagtgatggagaaattgcctctgaatgtgaatgtgacagcgtcttcaaccacctggaggagctgcggctgcacctggagcaggagatgggctttgagaagttctttgaggtgtatgagaagatcaaggccatccatgaagatgaagatgagaacatcgagatctgcagcaagatcgtgcagaacatcctgggcaatgagcaccagcacctgtatgccaagatcctgcacctggtgatggctgatggagcctaccaggaggacaatgatgaatag

SEQ ID NO: 161935 - DNA, 3645 bp, Artificial Sequence
  Description of Artificial Sequence: Synthetic coding sequence
atggagaagtatgtgcggctgcagaagatcggggagggcagctttgggaaggccatcctggtgaagagcacagaagatggccggcagtatgtgatcaaggagatcaacatcagcaggatgagcagcaaggagcgggaggagagcagaagagaggtggccgtgctggccaacatgaagcaccccaacatcgtgcagtaccgggagagctttgaggagaatggcagcctgtacatcgtgatggactactgtgagggcggggacctcttcaagaggatcaatgcccagaagggcgtgctcttccaggaggaccagatcctggactggtttgtgcagatctgcctggccctgaagcacgtgcatgacaggaagatcctgcaccgggacatcaagagccagaacatcttcctgaccaaggatggcaccgtgcagctgggggactttggaattgcccgggtgctgaacagcacagtggagctggcccggacctgcatcggcaccccctactacctgagccctgagatctgtgagaacaagccctacaacaacaagagtgacatctgggccctgggctgtgtgctgtatgagctgtgcaccctgaagcacgcctttgaagctggctccatgaagaacctggtgctgaagatcatcagcggcagcttcccccctgtgtccctgcactacagctatgacctgcggagcctggtgtcccagctgttcaagaggaacccccgggaccggcccagcgtgaacagcatcctggagaagggcttcatcgccaagagaattgagaagttcctgagcccccagctgattgctgaggagttctgcctgaagaccttcagcaagtttggcagccagcccatcccagccaagaggcctgccagcggccagaacagcatctctgtgatgcctgcccagaagatcaccaagccagctgccaagtatggcatccccctggcctacaagaagtacggggacaagaagctgcacgagaagaagcccctgcagaagcacaagcaggcccaccagaccccagagaagagggtgaacacaggagaggagaggaggaagatcagcgaggaggccgccaggaagaggcggctggagttcatcgagaaggagaagaagcagaaggaccagatcatcagcctgatgaaggccgagcagatgaagaggcaggagaaggagcggctggagcgcatcaacagagcccgggagcagggctggagaaatgtgctgtctgctgggggcagcggggaggtgaaggcccccttcctgggcagcggcggcaccatcgcccccagcagcttcagcagccggggccagtatgagcactaccacgccatctttgaccagatgcagcagcagagagcagaagataatgaggccaagtggaagcgggagatctacggccggggcctgcctgagcggcagaagggccagctggccgtggagcgggccaagcaggtggaggagttcctgcagaggaagcgggaggccatgcagaacaaggcccgggcagagggccacatggtgtacctggcccggctgcggcagatccggctgcagaacttcaatgaaaggcagcagatcaaggccaagctgcggggggagaagaaggaggccaaccacagcgagggccaggagggcagcgaggaggccgacatgaggaggaagaagattgagagcctgaaggcccacgccaatgcccgggctgctgtgctgaaggagcagctggagaggaagaggaaggaggcctatgagcgggagaagaaggtgtgggaggagcacctggtggccaagggcgtgaagagcagtgatgtgagcccccccctgggccagcatgaaacaggaggcagccccagcaagcagcagatgaggagcgtcatctctgtgaccagcgccctgaaggaggtgggcgtggacagcagcctgacagacacccgggagaccagcgaggagatgcagaagaccaacaatgccatcagcagcaagcgggagatcctgcggcggctgaatgaaaacctgaaggcccaggaggatgagaagggcaagcagaacctgagtgacacctttgagatcaacgtgcatgaagatgccaaggagcacgagaaggagaagtctgtgtccagtgacaggaagaagtgggaggccggcggccagctggtgatccccctggatgagctgaccctggacaccagcttcagcaccacagagcggcacacagtgggggaggtgatcaagctgggccccaacggcagcccccggcgggcctggggcaagagccccacagacagcgtgctgaagatcctgggggaggccgagctgcagctgcagacagagctgctggagaacaccaccatccgctctgagatcagccctgagggggagaagtacaagcccctcatcaccggggagaagaaggtgcagtgcatcagccatgagatcaaccccagcgccatcgtggacagccctgtggagaccaagagccctgagttcagcgaggccagcccccagatgagcctgaagctggagggcaacctggaggagccagatgacctggagacagagatcctgcaggagcccagcggcaccaacaaggatgagagcctgccctgcaccatcacagatgtgtggatcagcgaggagaaggagaccaaggagacccagagcgctgaccgcatcaccatccaggagaatgaggtgtctgaagatggagtgagcagcacagtggaccagctgagtgacatccacatcgagcccggcaccaatgacagccagcacagcaaatgtgatgtggacaagtctgtgcagcctgagcccttcttccacaaggtggtgcacagcgagcacctgaacctggtgccccaggtgcagagcgtgcagtgcagccctgaggagagctttgccttccgcagccacagccacctgccccccaagaacaagaacaagaacagcctgctgattggcctgagcacaggcctgtttgatgccaacaaccccaagatgctgcggacctgcagcctgcctgacctgagcaagctgttccgcaccctgatggatgtgcccaccgtgggagatgtgcggcaggacaacctggagattgatgaaattgaagatgagaacatcaaggagggccccagcgacagtgaagatattgtgtttgaggagacagacacagacctgcaggagctgcaggcctccatggagcagctgctgcgggagcagcctggagaggagtacagcgaggaggaggagagcgtgctgaagaacagtgatgtggagcccacagccaatggaacagatgtggctgatgaagatgacaaccccagcagcgagagcgccctgaatgaggagtggcacagcgacaacagtgatggagaaattgcctctgaatgtgaatgtgacagcgtcttcaaccacctggaggagctgcggctgcacctggagcaggagatgggctttgagaagttctttgaggtgtatgagaagatcaaggccatccatgaagatgaagatgagaacatcgagatctgcagcaagatcgtgcagaacatcctgggcaatgagcaccagcacctgtatgccaagatcctgcacctggtgatggctgatggagcctaccaggaggacaatgatgaatag

SEQ ID NO: 161936 - DNA, 3570 bp, Artificial Sequence
  Description of Artificial Sequence: Synthetic coding sequence
atggagaagtatgtgcggctgcagaagatcggggagggcagctttgggaaggccatcctggtgaagagcacagaagatggccggcagtatgtgatcaaggagatcaacatcagcaggatgagcagcaaggagcgggaggagagcagaagagaggtggccgtgctggccaacatgaagcaccccaacatcgtgcagtaccgggagagctttgaggagaatggcagcctgtacatcgtgatggactactgtgagggcggggacctcttcaagaggatcaatgcccagaagggcgtgctcttccaggaggaccagatcctggactggtttgtgcagatctgcctggccctgaagcacgtgcatgacaggaagatcctgcaccgggacatcaagagccagaacatcttcctgaccaaggatggcaccgtgcagctgggggactttggaattgcccgggtgctgaacagcacagtggagctggcccggacctgcatcggcaccccctactacctgagccctgagatctgtgagaacaagccctacaacaacaagagtgacatctgggccctgggctgtgtgctgtatgagctgtgcaccctgaagcacgcctttgaagctggctccatgaagaacctggtgctgaagatcatcagcggcagcttcccccctgtgtccctgcactacagctatgacctgcggagcctggtgtcccagctgttcaagaggaacccccgggaccggcccagcgtgaacagcatcctggagaagggcttcatcgccaagagaattgagaagttcctgagcccccagctgattgctgaggagttctgcctgaagaccttcagcaagtttggcagccagcccatcccagccaagaggcctgccagcggccagaacagcatctctgtgatgcctgcccagaagatcaccaagccagctgccaagtatggcatccccctggcctacaagaagtacggggacaagaagctgcacgagaagaagcccctgcagaagcacaagcaggcccaccagaccccagagaagagggtgaacacaggagaggagaggaggaagatcagcgaggaggccgccaggaagaggcggctggagttcatcgagaaggagaagaagcagaaggaccagatcatcagcctgatgaaggccgagcagatgaagaggcaggagaaggagcgggcccccttcctgggcagcggcggcaccatcgcccccagcagcttcagcagccggggccagtatgagcactaccacgccatctttgaccagatgcagcagcagagagctgaggacaatgaggccaagtggaagcgggagatctacggccggggcctgcctgagcggcagaagggccagctggccgtggagcgggccaagcaggtggaggagttcctgcagaggaagcgggaggccatgcagaacaaggcccgggcagagggccacatggtgtacctggcccggctgcggcagatccggctgcagaacttcaatgaaaggcagcagatcaaggccaagctgcggggggagaagaaggaggccaaccacagcgagggccaggagggcagcgaggaggccgacatgaggaggaagaagattgagagcctgaaggcccacgccaatgcccgggctgctgtgctgaaggagcagctggagaggaagaggaaggaggcctatgaaagagagaagaaggtgtgggaggagcacctggtggccaagggcgtgaagagcagtgatgtgtccccacccctgggccagcacgagaccggcggcagccccagcaagcagcagatgaggagcgtcatctctgtgaccagcgccctgaaggaggtgggcgtggacagcagcctgacagacacccgggagaccagcgaggagatgcagaagaccaacaatgccatcagcagcaagcgggagatcctgcggcggctgaatgaaaacctgaaggcccaggaggatgagaagggcaagcagaacctgagtgacacctttgagatcaacgtgcatgaagatgccaaggagcacgagaaggagaagtctgtgtccagtgacaggaagaagtgggaggccggcggccagctggtgatccccctggatgagctgaccctggacaccagcttcagcaccacagagcggcacacagtgggggaggtgatcaagctgggccccaacggcagcccccggcgggcctggggcaagagccccacagattctgtgctgaagatcctgggggaggccgagctgcagctgcagacagagctgctggagaacaccaccatccgctctgagatcagccctgagggggagaagtacaagcccctcatcactggagagaagaaggtgcagtgcatcagccatgagatcaaccccagcgccatcgtggacagccctgtggagaccaagagccctgagttcagcgaggccagcccccagatgagcctgaagctggagggcaacctggaggagccagatgacctggagacagagatcctgcaggagcccagcggcaccaacaaggatgagagcctgccctgcaccatcacagatgtgtggatcagcgaggagaaggagaccaaggagacccagagcgctgaccgcatcaccatccaggagaatgaggtgtctgaagatggagtgagcagcacagtggaccagctgagtgacatccacatcgagcccggcaccaatgacagccagcacagcaaatgtgatgtggacaagtctgtgcagcctgagcccttcttccacaaggtggtgcacagcgagcacctgaacctggtgccccaggtgcagagcgtgcagtgcagccctgaggagagctttgccttccgcagccacagccacctgccccccaagaacaagaacaagaacagcctgctgattggcctgagcacaggcctgtttgatgccaacaaccccaagatgctgcggacctgcagcctgcctgacctgagcaagctgttccgcaccctgatggatgtgcccaccgtgggagatgtgcggcaggacaacctggagattgatgaaattgaagatgagaacatcaaggagggccccagcgacagcgaggacatcgtgtttgaggagacagacacagacctgcaggagctgcaggcctccatggagcagctgctgcgggagcagcccggggaggagtacagcgaggaggaggagagcgtgctgaagaacagtgatgtggagcccacagccaacggcacagatgtggctgatgaagatgacaaccccagcagcgagagcgccctgaatgaggagtggcacagcgacaacagtgatggagagatcgcctctgaatgtgaatgtgacagcgtcttcaaccacctggaggagctgcggctgcacctggagcaggagatgggctttgagaagttctttgaggtgtatgagaagatcaaggccatccatgaagatgaagatgaaaatattgagatctgcagcaagatcgtgcagaacatcctgggcaatgagcaccagcacctgtatgccaagatcctgcacctggtgatggctgatggagcctaccaggaggacaatgatgaatag

SEQ ID NO: 161937 - DNA, 1155 bp, Artificial Sequence
  Description of Artificial Sequence: Synthetic coding sequence
atgcccagcagagctgaggactatgaggtgctgtacaccatcggcaccggcagctatggccgctgccagaagatccggaggaagagtgatggcaagatcctggtgtggaaggagctggactatggctccatgacagaagctgagaagcagatgctggtgtctgaggtgaacctgctgcgggagctgaagcaccccaacatcgtgcgctactatgaccgcatcatcgacaggaccaacaccaccctgtacatcgtgatggagtactgtgagggcggggacctggccagcgtcatcaccaagggcaccaaggagcggcagtacctggatgaggagtttgtgctgcgggtgatgacccagctgaccctggccctgaaggagtgccacagaagaagtgatggcggccacacagtgctgcaccgggacctgaagccagccaacgtgttcctggatggcaagcagaatgtgaagctgggggactttggcctggcccgcatcctgaaccacgacaccagctttgccaagacctttgtgggcaccccctactacatgagccctgagcagatgaacaggatgagctacaatgagaagagtgacatctggagcctgggctgcctgctgtatgagctgtgtgccctgatgccacccttcaccgccttcagccagaaggagctggccggcaagatccgggagggcaagttccgccgcatcccctaccgctacagtgatgagctgaatgagatcatcaccaggatgctgaacctgaaggactaccaccggcccagcgtggaggagatcctggagaaccccctgattgctgacctggtggctgatgagcagaggaggaacctggagcggcggggccggcagctgggggagcctgagaagagccaggacagcagccctgtgctgtctgagctgaagctgaaggagatccagctgcaggagcgggagcgggccctgaaggcccgggaggagcggctggagcagaaggagcaggagctgtgtgtgcgggagcggctggccgaggacaagctggcccgggcagagaacctgctgaagaactacagcctgctgaaggagaggaagttcctgagcctggccagcaaccctggcatgaggatcaacctggtgaacagatcctggtgctacaagtag

SEQ ID NO: 161938 - DNA, 1338 bp, Artificial Sequence
  Description of Artificial Sequence: Synthetic coding sequence
atgcccagcagagctgaggactatgaggtgctgtacaccatcggcaccggcagctatggccgctgccagaagatccggaggaagagtgatggcaagatcctggtgtggaaggagctggactatggctccatgacagaagctgagaagcagatgctggtgtctgaggtgaacctgctgcgggagctgaagcaccccaacatcgtgcgctactatgaccgcatcatcgacaggaccaacaccaccctgtacatcgtgatggagtactgtgagggcggggacctggccagcgtcatcaccaagggcaccaaggagcggcagtacctggatgaggagtttgtgctgcgggtgatgacccagctgaccctggccctgaaggagtgccacagaagaagtgatggcggccacacagtgctgcaccgggacctgaagccagccaacgtgttcctggatggcaagcagaatgtgaagctgggggactttggcctggcccgcatcctgaaccacgacaccagctttgccaagacctttgtgggcaccccctactacatgagccctgagcagatgaacaggatgagctacaatgagaagagtgacatctggagcctgggctgcctgctgtatgagctgtgtgccctgatgccacccttcaccgccttcagccagaaggagctggccggcaagatccgggagggcaagttccgccgcatcccctaccgctacagtgatgagctgaatgagatcatcaccaggatgctgaacctgaaggactaccaccggcccagcgtggaggagatcctggagaaccccctgattgctgacctggtggctgatgagcagaggaggaacctggagcggcggggccggcagctgggggagcctgagaagagccaggacagcagccctgtgctgtctgagctgaagctgaaggagatccagctgcaggagcgggagcgggccctgaaggcccgggaggagcggctggagcagaaggagcaggagctgtgtgtgcgggagcggctggccgaggacaagctggcccgggcagagaacctgctgaagaactacagcctgctgaaggagaggaagttcctgagcctggccagcaaccctgagctgctgaacctgcccagcagcgtcatcaagaagaaggtgcacttctctggagagagcaaggagaacatcatgaggtctgagaacagcgagagccagctgaccagcaagagcaagtgcaaggacctgaagaagaggctgcatgctgcccagctgcgggcccaggccctgagtgacatcgagaagaactaccagctgaagagccggcagatcctgggcatgaggtag

SEQ ID NO: 161939 - DNA, 1209 bp, Artificial Sequence
  Description of Artificial Sequence: Synthetic coding sequence
atgacagaggccgagaagcagatgctggtgtctgaggtgaacctgctgcgggagctgaagcaccccaacatcgtgcgctactatgaccgcatcatcgacaggaccaacaccaccctgtacatcgtgatggagtactgtgagggcggggacctggccagcgtcatcaccaagggcaccaaggagcggcagtacctggatgaggagtttgtgctgcgggtgatgacccagctgaccctggccctgaaggagtgccaccggcggagtgatggcggccacacagtgctgcaccgggacctgaagccagccaacgtgttcctggatggcaagcagaatgtgaagctgggggactttggcctggcccgcatcctgaaccacgacaccagctttgccaagacctttgtgggcaccccctactacatgagccctgagcagatgaacaggatgagctacaatgagaagagtgacatctggagcctgggctgcctgctgtatgagctgtgtgccctgatgccacccttcaccgccttcagccagaaggagctggccggcaagatccgggagggcaagttccgccgcatcccctaccgctacagtgatgagctgaatgagatcatcaccaggatgctgaacctgaaggactaccaccggcccagcgtggaggagatcctggagaaccccctgattgctgacctggtggctgatgagcagaggaggaacctggagcggcggggccggcagctgggggagcctgagaagagccaggacagcagccctgtgctgtctgagctgaagctgaaggagatccagctgcaggagcgggagcgggccctgaaggcccgggaggagcggctggagcagaaggagcaggagctgtgtgtgcgggagcggctggccgaggacaagctggcccgggcagagaacctgctgaagaactacagcctgctgaaggagaggaagttcctgagcctggccagcaaccctgagctgctgaacctgcccagcagcgtcatcaagaagaaggtgcacttcagcggggagagcaaagaaaacatcatgagaagtgaaaattctgagagccagctgaccagcaagagcaagtgcaaggacctgaagaagaggctgcacgccgcccagctgcgggcccaggccctgagtgacatcgagaagaactaccagctgaagagccggcagatcctgggcatgaggtag

SEQ ID NO: 161940 - DNA, 1521 bp, Artificial Sequence
  Description of Artificial Sequence: Synthetic coding sequence
atggatgactacatggtgctgaggatgattggagagggcagctttggccgggccctgctggtgcagcacgagagcagcaaccagatgtttgccatgaaggagatccggctgcccaagagcttcagcaacacccagaacagcaggaaggaggccgtgctgctggccaagatgaagcaccccaacatcgtggccttcaaggagagctttgaagctgagggccacctgtacatcgtgatggagtactgtgatggaggagacctgatgcagaagatcaagcagcagaagggcaagctgtttcctgaggacatgatcctgaactggttcacccagatgtgcctgggcgtgaaccacatccacaagaagagggtgctgcaccgggacatcaagagcaagaacatcttcctgacccagaatggcaaggtgaagctgggggactttggcagcgcccggctgctgagcaaccccatggcctttgcctgcacctacgtgggcaccccctactacgtgcccccagagatctgggagaacctgccctacaacaacaagagtgacatctggagcctgggctgcatcctgtatgagctgtgcaccctgaagcaccccttccaggccaacagctggaagaacctgatcctgaaggtgtgccagggctgcatcagccccctgcccagccactacagctatgagctgcagttcctggtgaagcagatgttcaagaggaaccccagccaccggcccagcgccaccaccctgctgagccggggcatcgtggcccggctggtgcagaagtgcctgcccccagagatcatcatggagtatggagaggaggtgctggaggagatcaagaacagcaagcacaacacccccaggaagaaggccaaccccagccgcatccgcatcgccctgggcaatgaggccagcacagtgcaggaggaggagcaggacaggaagggcagccacacagacctggagagcatcaatgaaaacctggtggagagcgccctgcggcgggtgaaccgggaggagaagggcaacaagtctgtgcacctgaggaaggccagcagccccaacctgcaccggcggcagtgggagaagaatgtgcccaacacagccctgacagccctggagaatgccagcatcctgaccagcagcctgacagcagaagatgaccggggcggcagcgtcatcaagtacagcaagaacaccaccaggaagcagtggctgaaggagaccccagacaccctgctgaacatcctgaagaatgctgacctgagcctggccttccagacctacaccatctaccggcccggcagcgagggcttcctgaagggccccctgtctgaggagacagaggccagtgacagcgtggatggcggccatgacagcgtcatcctggaccctgagcggctggagcccggcctggatgaggaggacacagactttgaggaggaggatgacaacccagactgggtgtctgagctgaagaagagagctggctggcagggcctgtgtgacagatag

SEQ ID NO: 161941 - DNA, 1521 bp, Artificial Sequence; identical to SEQ ID NO: 161940
  Description of Artificial Sequence: Synthetic coding sequence

SEQ ID NO: 161942 - DNA, 1470 bp, Artificial Sequence
  Description of Artificial Sequence: Synthetic coding sequence
atggatgactacatggtgctgaggatgattggagagggcagctttggccgggccctgctggtgcagcacgagagcagcaaccagatgtttgccatgaaggagatccggctgcccaagagcttcagcaacacccagaacagcaggaaggaggccgtgctgctggccaagatgaagcaccccaacatcgtggccttcaaggagagctttgaagctgagggccacctgtacatcgtgatggagtactgtgatggaggagacctgatgcagaagatcaagcagcagaagggcaagctgtttcctgaggacatgatcctgaactggttcacccagatgtgcctgggcgtgaaccacatccacaagaagagggtgctgcaccgggacatcaagagcaagaacatcttcctgacccagaatggcaaggtgaagctgggggactttggcagcgcccggctgctgagcaaccccatggcctttgcctgcacctacgtgggcaccccctactacgtgcccccagagatctgggagaacctgccctacaacaacaagagtgacatctggagcctgggctgcatcctgtatgagctgtgcaccctgaagcaccccttccaggccaacagctggaagaacctgatcctgaaggtgtgccagggctgcatcagccccctgcccagccactacagctatgagctgcagttcctggtgaagcagatgttcaagaggaaccccagccaccggcccagcgccaccaccctgctgagccggggcatcgtggcccggctggtgcagaagtgcctgcccccagagatcatcatggagtatggagaggaggtgctggaggagatcaagaacagcaagcacaacacccccaggaagaagcaggaggaggagcaggacaggaagggcagccacacagacctggagagcatcaatgaaaacctggtggagagcgccctgcggcgggtgaaccgggaggagaagggcaacaagtctgtgcacctgaggaaggccagcagccccaacctgcaccggcggcagtgggagaagaatgtgcccaacacagccctgacagccctggagaatgccagcatcctgaccagcagcctgacagcagaagatgacagaggaggcagcgtcatcaagtacagcaagaacaccaccaggaagcagtggctgaaggagaccccagacaccctgctgaacatcctgaagaatgctgacctgagcctggccttccagacctacaccatctacagacctggcagcgagggcttcctgaagggccccctgtctgaggagacagaggccagtgacagcgtggatggcggccatgattctgtcatcctggaccctgagcggctggagcccggcctggatgaggaggacacagactttgaggaggaggatgacaacccagactgggtgtctgagctgaagaagagagctggctggcagggcctgtgtgacagatag

SEQ ID NO: 161943 - DNA, 1533 bp, Artificial Sequence
  Description of Artificial Sequence: Synthetic coding sequence
atgcagtttggccgggcccatggagactgtgtgtctggggcccagctgtgtggctgccccagcatggatgactacatggtgctgaggatgattggagagggcagctttggccgggccctgctggtgcagcacgagagcagcaaccagatgtttgccatgaaggagatccggctgcccaagagcttcagcaacacccagaacagcaggaaggaggccgtgctgctggccaagatgaagcaccccaacatcgtggccttcaaggagagctttgaggccgagggccacctgtacatcgtgatggagtactgtgatggaggagacctgatgcagaagatcaagcagcagaagggcaagctgtttcctgaggacatgatcctgaactggttcacccagatgtgcctgggcgtgaaccacatccacaagaagagggtgctgcaccgggacatcaagagcaagaacatcttcctgacccagaatggcaaggtgaagctgggggactttggaagtgcccggctgctgagcaaccccatggcctttgcctgcacctacgtgggcaccccctactacgtgcccccagagatctgggagaacctgccctacaacaacaagagtgacatctggagcctgggctgcatcctgtatgagctgtgcaccctgaagcaccccttccaggccaacagctggaagaacctgatcctgaaggtgtgccagggctgcatcagccccctgcccagccactacagctatgagctgcagttcctggtgaagcagatgttcaagaggaaccccagccaccggcccagcgccaccaccctgctgagccggggcatcgtggcccggctggtgcagaagtgcctgcccccagagatcatcatggagtatggagaggaggtgctggaggagatcaagaacagcaagcacaacacccccaggaagaagcaggaggaggagcaggacaggaagggcagccacacagacctggagagcatcaatgaaaacctggtggagagcgccctgcggcgggtgaaccgggaggagaagggcaacaagtctgtgcacctgaggaaggccagcagccccaacctgcaccggcggcagtgggagaagaatgtgcccaacacagccctgacagccctggagaatgccagcatcctgaccagcagcctgacagcagaagatgaccggggcggcagcgtcatcaagtacagcaagaacaccaccaggaagcagtggctgaaggagaccccagacaccctgctgaacatcctgaagaatgctgacctgagcctggccttccagacctacaccatctaccggcccggcagcgagggcttcctgaagggccccctgtctgaggagacagaggccagtgacagcgtggatggcggccatgacagcgtcatcctggaccctgagcggctggagcccggcctggatgaggaggacacagactttgaggaggaggatgacaacccagactgggtgtctgagctgaagaagagagctggctggcagggcctgtgtgacagatag

SEQ ID NO: 161944 - DNA, 177 bp, Artificial Sequence
  Description of Artificial Sequence: Synthetic coding sequence
atggatgactacatggtgctgaggatgattggagagggcagctttggccgggccctgctggtgcagcacgagagcagcaaccagatgtttgccatgaaggagatccggctgcccaagagcttcagcaacacccagaacagcaggaaggaggccgtgctgctggccaagatgaagtag

SEQ ID NO: 161945 - DNA, 510 bp, Artificial Sequence
  Description of Artificial Sequence: Synthetic coding sequence
atggcccggggcggggacaccggctgcaccggccccagcgagaccagcgccagcggggctgctgccatcgccctgcccggcctggagggccctgccacagatgcccagtgccagaccctgcccctgactgtgctgaagagccgcagccccagccccaggagcctgcccccagccctgagctgccccccaccccagcctgccatgctggagcacctgagcagcctgcccacccagatggactacaagggccagaagctggccgagcagatgttccagggcatcatcctcttcagcgccatcgtgggcttcatctacggctacgtggccgagcagtttggctggacagtgtacatcgtgatggccggctttgccttcagctgcctgctgaccctgcccccctggcccatctaccgccgccaccccctgaagtggctgcctgtgcaggagagcagcacagatgacaagaagccaggagagaggaagatcaagagacatgccaagaacaactag

SEQ ID NO: 161946 - DNA, 2259 bp, Artificial Sequence
  Description of Artificial Sequence: Synthetic coding sequence
atgcccctggccgcctactgctacctgcgggtggtgggcaagggcagctatggagaggtgaccctggtgaagcacagaagagatggcaagcagtacctgcacgagaagcacatcctgcaccgggacctgaagacccagaatgtgttcctgaccaggaccaacatcatcaaggtgggggacctgggcatcgcccgggtgctggagaaccactgtgacatggccagcaccctcatcggcaccccctactacatgagccctgagctgttcagcaacaagccctacaactacaagagtgatgtgtgggccctgggctgctgcgtgtatgagatggccaccctgaagcacgccttcaatgccaaggacatgaacagcctggtgtaccgcatcatcgagggcaagctgccccccatgccccgggactacagccctgagctggccgagctgatccgcaccatgctgagcaagaggcctgaggagcggcccagcgtgcgcagcatcctgcggcagccctacatcaagaggcagatctccttcttcctggaggccaccaagatcaagaccagcaagaacaacatcaagaatggagacagccagagcaagccctttgccaccgtggtgtctggagaggccgagagcaaccacgaggtgatccacccccagcccctgagcagcgagggcagccagacctacatcatgggagagggcaagtgcctgagccaggagaagccccgggccagcggcctgctgaagagccctgccagcctgaaggcccacacctgcaagcaggacctgagcaacaccacagagctggccaccatcagctctgtgaacatcgacatcctgcctgccaagggccgggacagcgtgtctgatggctttgtgcaggagaaccagccccgctacctggatgccagcaatgagctgggcggcatctgcagcatcagccaggtggaggaggagatgctgcaggacaacaccaagagcagcgcccagccagaaaatctcatccccatgtggagcagtgacatcgtgactggagagaagaatgaacctgtgaagcccctgcagcccctcatcaaggagcagaagcccaaggaccagagcctggccctgagccccaagctggagtgcagcggcaccatcctggcccacagcaacctgcggctgctgggcagcagtgacagccctgccagcgccagccgggtggccggcatcaccggggtgtgccaccacgcccaggaccaggtggccggggagtgcatcatcgagaagcagggccgcatccacccagacctgcagccccacaacagcggcagcgagcccagcctgagccggcagaggcggcagaagagaagagagcagacagagcacagaggagagaagaggcaggtgagaagagacctgtttgccttccaggagagccccccacgcttcctgcccagccaccccatcgtgggcaaggtggatgtgaccagcacccagaaggaggccgagaaccagaggagagtggtgactggatctgtgagcagcagccgcagcagcgagatgagcagcagcaaggaccggcccctgagcgcccgggagcggcggcggctgaagcagagccaggaggagatgagcagcagcggccccagcgtgaggaaggccagcctgtctgtggccggccctgggaagccccaggaggaggaccagcccctgcctgcccggcggctgagcagtgactgcagcgtgacccaggagaggaagcagatccactgcctgtctgaagatgagctgagcagcagcaccagcagcacagacaagagtgatggagactatggagagggcaagggccagaccaatgagatcaatgccctggtgcagctgatgacccagaccctgaagctggacagcaaggagagctgtgaagatgtgcctgtggccaaccctgtgtctgagttcaagctgcacaggaagtacagagacaccctcatcctgcacggcaaggtggccgaggaggccgaggagatccacttcaaggagctgcccagcgccatcatgcctggcagcgagaagatccggcggctggtggaggtgctgaggacagatgtgatccggggcctgggcgtgcagctgctggagcaggtgtatgacctgctggaggaggaggatgaatttgaccgggaggtgcggctgcgggagcacatgggagagaagtacaccacctacagcgtgaaggcccggcagctgaagttctttgaggagaacatgaacttctag

SEQ ID NO: 161947 - DNA, 942 bp, Artificial Sequence
  Description of Artificial Sequence: Synthetic coding sequence
atggccggccagcccggccacatgccccacggcggcagcagcaacaacctgtgccacaccctgggccctgtgcaccccccagacccccagaggcaccccaacaccctgtccttccgctgcagcctggccgacttccagatcgagaagaagattggccggggccagttcagcgaggtgtacaaggccacctgcctgctggacaggaagacagtggccctgaagaaggtgcagatctttgagatgatggatgccaaggcccggcaggactgtgtgaaggagatcggcctgctgaagcagctgaaccaccccaacatcatcaagtacctggacagcttcatcgaggacaatgagctgaacatcgtgctggagctggctgatgctggggacctgagccagatgatcaagtacttcaagaagcagaagaggctcatccctgagaggacagtgtggaagtactttgtgcagctgtgcagcgctgtggagcacatgcacagccggcgggtgatgcaccgggacatcaagccagccaacgtgttcatcacagccactggagtggtgaagctgggggacctgggcctgggccgcttcttcagcagcgagaccacagctgcccacagcctggtgggcaccccctactacatgagccctgagcgcatccatgaaaatggctacaacttcaagagtgacatctggagcctgggctgcctgctgtatgagatggccgccctgcagagccccttctacggggacaagatgaacctcttcagcctgtgccagaagattgagcagtgtgactacccacccctgcccggggagcactacagcgagaagctgcgggagctggtgtccatgtgcatctgcccagacccccaccagaggccagacatcggctacgtgcaccaggtggccaagcagatgcacatctggatgagcagcacctag

SEQ ID NO: 161948 - DNA, 624 bp, Artificial Sequence
  Description of Artificial Sequence: Synthetic coding sequence
atggccggccagcccggccacatgccccacggcggcagcagcaacaacctgtgccacaccctgggccctgtgcaccccccagacccccagaggcaccccaacaccctgtccttccgctgcagcctggccgacttccagatcgagaagaagattggccggggccagttcagcgaggtgtacaaggccacctgcctgctggacaggaagacagtggccctgaagaaggtgcagatctttgagatgatggatgccaaggcccggcaggactgtgtgaaggagatcggcctgctgaagcagctgaaccaccccaacatcatcaagtacctggacagcttcatcgaggacaatgagctgaacatcgtgctggagctggctgatgctggggacctgagccagatgatcaagtacttcaagaagcagaagaggctcatccctgagaggacagtgtggaagtactttgtgcagctgtgcagcgctgtggagcacatgcacagccggcgggtgatgcaccgggacatcaagccagccaacgtgttcatcacagccactggagtggtgaagctgggggacctgggcctgggccgcttcttcagcagcgagaccacagctgcccacagcctgtag

SEQ ID NO: 161949 - DNA, 1044 bp, Artificial Sequence
  Description of Artificial Sequence: Synthetic coding sequence
atgccccggcgggaggtgtgctgggaggccgcccacttccggcaggaggagcagagcctgccccggccccgggtgcgggccctggtgcggctggcctgcaggatggccggccagcccggccacatgccccacggcggcagcagcaacaacctgtgccacaccctgggccctgtgcaccccccagacccccagaggcaccccaacaccctgtccttccgctgcagcctggccgacttccagatcgagaagaagattggccggggccagttcagcgaggtgtacaaggccacctgcctgctggacaggaagacagtggccctgaagaaggtgcagatctttgagatgatggatgccaaggcccggcaggactgtgtgaaggagatcggcctgctgaagcagctgaaccaccccaacatcatcaagtacctggacagcttcatcgaggacaatgagctgaacatcgtgctggagctggctgatgctggggacctgagccagatgatcaagtacttcaagaagcagaagaggctcatccctgagaggacagtgtggaagtactttgtgcagctgtgcagcgctgtggagcacatgcacagccggcgggtgatgcaccgggacatcaagccagccaacgtgttcatcacagccactggagtggtgaagctgggggacctgggcctgggccgcttcttcagcagcgagaccacagctgcccacagcctggtgggcaccccctactacatgagccctgagcgcatccatgaaaatggctacaacttcaagagtgacatctggagcctgggctgcctgctgtatgagatggccgccctgcagagccccttctacggggacaagatgaacctcttcagcctgtgccagaagattgagcagtgtgactacccacccctgcccggggagcactacagcgagaagctgcgggagctggtgtccatgtgcatctgcccagacccccaccagaggccagacatcggctacgtgcaccaggtggccaagcagatgcacatctggatgagcagcacctag

SEQ ID NO: 161950 - DNA, 738 bp, Artificial Sequence
  Description of Artificial Sequence: Synthetic coding sequence
atggccggccagcccggccacatgccccacggcggcagcagcaacaacctgtgccacaccctgggccctgtgcaccccccagacccccagcagctgaaccaccccaacatcatcaagtacctggacagcttcatcgaggacaatgagctgaacatcgtgctggagctggctgatgctggggacctgagccagatgatcaagtacttcaagaagcagaagaggctcatccctgagaggacagtgtggaagtactttgtgcagctgtgcagcgctgtggagcacatgcacagccggcgggtgatgcaccgggacatcaagccagccaacgtgttcatcacagccactggagtggtgaagctgggggacctgggcctgggccgcttcttcagcagcgagaccacagctgcccacagcctggtgggcaccccctactacatgagccctgagcgcatccatgaaaatggctacaacttcaagagtgacatctggagcctgggctgcctgctgtatgagatggccgccctgcagagccccttctacggggacaagatgaacctcttcagcctgtgccagaagattgagcagtgtgactacccacccctgcccggggagcactacagcgagaagctgcgggagctggtgtccatgtgcatctgcccagacccccaccagaggccagacatcggctacgtgcaccaggtggccaagcagatgcacatctggatgagcagcacctag

SEQ ID NO: 161951 - DNA, 942 bp, Artificial Sequence; identical to SEQ ID NO: 161947
  Description of Artificial Sequence: Synthetic coding sequence

SEQ ID NO: 161952 - DNA, 1044 bp, Artificial Sequence; identical to SEQ ID NO: 161949
  Description of Artificial Sequence: Synthetic coding sequence

SEQ ID NO: 161953 - DNA, 663 bp, Artificial Sequence
  Description of Artificial Sequence: Synthetic coding sequence
atggccggccagcccggccacatgccccacggcggcagcagcaacaacctgtgccacaccctgggccctgtgcaccccccagacccccagaggcaccccaacaccctgtccttccgctgcagcctggccgacttccagatcgagaagaagattggccggggccagttcagcgaggtgtacaaggccacctgcctgctggacaggaagacagtggccctgaagaaggtgcagatctttgagatgatggatgccaaggcccggcaggactgtgtgaaggagatcggcctgctgaagcagctgaaccaccccaacatcatcaagtacctggacagcttcatcgaggacaatgagctgaacatcgtgctggagctggctgatgctggggacctgagccagatgatcaagtacttcaagaagcagaagaggctcatccctgagaggacagtgtggaagtactttgtgcagctgtgcagcgctgtggagcacatgcacagccggcgggtgatgcaccgggacatcaagccagccaacgtgttcatcacagccactggagtggtgaagctgggggacctgggcctgggccgcttcttcagcagcgagaccacagctgcccacagcctggtgggcaccccctactacatgagccctgagcgcatccactag

SEQ ID NO: 161954 - DNA, 585 bp, Artificial Sequence
  Description of Artificial Sequence: Synthetic coding sequence
atgccccggcgggaggtgtgctgggaggccgcccacttccggcaggaggagcagagcctgccccggccccgggtgcgggccctggtgcggctggcctgcaggatggccggccagcccggccacatgccccacggcggcagcagcaacaacctgtgccacaccctgggccctgtgcaccccccagacccccagaggcaccccaacaccctgtccttccgctgcagcctggccgacttccagatcgagaagaagattggccggggccagttcagcgaggtgtacaaggccacctgcctgctggacaggaagacagtggccctgaagaaggtgcagatctttgagatgatggatgccaaggcccggcaggactgtgtgaaggagatcggcctgctgaagcagctgaaccaccccaacatcatcaagtacctggacagcttcatcgaggacaatgagctgaacatcgtgctggagctggctgatgctggggacctgagccagatgatcaagtacttcaagaagcagaagaggctcatccctgagaggacagtgtggaagtactttgtgcagctgtgcagcgctgtgtag

SEQ ID NO: 161955 - DNA, 669 bp, Artificial Sequence
  Description of Artificial Sequence: Synthetic coding sequence
atggccggccagcccggccacatgccccacggcggcagcagcaacaacctgtgccacaccctgggccctgtgcaccccccagacccccagaggcaccccaacaccctgtccttccgctgcagcctggccgacttccagatcgagaagaagattggccggggccagttcagcgaggtgtacaaggccacctgcctgctggacaggaagacagtggccctgaagaaggtgcagatctttgagatgatggatgccaaggcccggcaggactgtgtgaaggagatcggcctgctgaagcagctgaaccaccccaacatcatcaagtacctggacagcttcatcgaggacaatgagctgaacatcgtgctggagctggctgatgctggggacctgagccagatgatcaagtacttcaagaagcagaagaggctcatccctgagaggacagtgtggaagtactttgtgcagctgtgcagcgctgtggagcacatgcacagccggcgggtgatgcaccgggacatcaagccagccaacgtgttcatcacagccactggagtggtgaagctgggggacctgggcctgggccgcttcttcagcagcgagaccacagctgcccacagcctggtgggcaccccctactacatgagccctgagcgcatccatgaaaattag

SEQ ID NO: 161956 - DNA, 660 bp, Artificial Sequence
  Description of Artificial Sequence: Synthetic coding sequence
atggccggccagcccggccacatgccccacggcggcagcagcaacaacctgtgccacaccctgggccctgtgcaccccccagacccccagaggcaccccaacaccctgtccttccgctgcagcctggccgacttccagatcgagaagaagattggccggggccagttcagcgaggtgtacaaggccacctgcctgctggacaggaagacagtggccctgaagaaggtgcagatctttgagatgatggatgccaaggcccggcaggactgtgtgaaggagatcggcctgctgaagcagctgaaccaccccaacatcatcaagtacctggacagcttcatcgaggacaatgagctgaacatcgtgctggagctggctgatgctggggacctgagccagatgatcaagtacttcaagaagcagaagaggctcatccctgagaggacagtgtggaagtactttgtgcagctgtgcagcgctgtggagcacatgcacagccggcgggtgatgcaccgggacatcaagccagccaacgtgttcatcacagccactggagtggtgaagctgggggacctgggcctgggccgcttcttcagcagcgagaccacagctgcccacagcctggtgggcaccccctactacatgagccctgagcgcatctag

SEQ ID NO: 161957 - DNA, 516 bp, Artificial Sequence
  Description of Artificial Sequence: Synthetic coding sequence
atggccggccagcccggccacatgccccacggcggcagcagcaacaacctgtgccacaccctgggccctgtgcaccccccagacccccagaggcaccccaacaccctgtccttccgctgcagcctggccgacttccagatcgagaagaagattggccggggccagttcagcgaggtgtacaaggccacctgcctgctggacaggaagacagtggccctgaagaaggtgcagatctttgagatgatggatgccaaggcccggcaggactgtgtgaaggagatcggcctgctgaagcagctgaaccaccccaacatcatcaagtacctggacagcttcatcgaggacaatgagctgaacatcgtgctggagctggctgatgctggggacctgagccagatgatcaagtacttcaagaagcagaagaggctcatccctgagaggacagtgtggaagtactttgtgcagctgtgcagcgctgtggagcacatgcacagccggcgggtgatgcacaggtag

SEQ ID NO: 161958 - DNA, 606 bp, Artificial Sequence
  Description of Artificial Sequence: Synthetic coding sequence
atggccggccagcccggccacatgccccacggcggcagcagcaacaacctgtgccacaccctgggccctgtgcaccccccagacccccagcagctgaaccaccccaacatcatcaagtacctggacagcttcatcgaggacaatgagctgaacatcgtgctggagctggctgatgctggggacctgagccagatgatcaagtacttcaagaagcagaagaggctcatccctgagaggacagtgtggaagtactttgtgcagctgtgcagcgctgtggagcacatgcacagccggcgggtgatgcaccgggacatcaagccagccaacgtgttcatcacagccactggagtggtgaagctgggggacctgggcctgggccgcttcttcagcagcgagaccacagctgcccacagcctggtgggcaccccctactacatgagccctgagcgcatccatgaaaatggctacaacttcaagagtgacatctggagcctgggctgcctgctgtatgagatggccgccctgcagagccccttctacggggacaagatgaacctcttcagcctgtgccagaagattgagcagtgtgactacccacccctgtag

SEQ ID NO: 161959 - DNA, 1017 bp, Artificial Sequence
  Description of Artificial Sequence: Synthetic coding sequence
atggaggccaccggctgggacagccgctgcagccctggcacccaggtgcgggccctggtgcggctggcctgcaggatggccggccagcccggccacatgcctcatggaggcagcagcaacaacctgtgccacaccctgggccctgtgcaccccccagacccccagaggcaccccaacaccctgtccttccgctgcagcctggccgacttccagatcgagaagaagattggccggggccagttcagcgaggtgtacaaggccacctgcctgctggacaggaagacagtggccctgaagaaggtgcagatctttgagatgatggatgccaaggcccggcaggactgtgtgaaggagatcggcctgctgaagcagctgaaccaccccaacatcatcaagtacctggacagcttcattgaagataatgagctgaacatcgtgctggagctggctgatgctggggacctgagccagatgatcaagtacttcaagaagcagaagaggctcatccctgagaggacagtgtggaagtactttgtgcagctgtgcagcgctgtggagcacatgcacagcagaagagtgatgcaccgggacatcaagccagccaacgtgttcatcacagccaccggggtggtgaagctgggggacctgggcctgggccgcttcttcagcagcgagaccacagctgcccacagcctggtgggcaccccctactacatgagccctgagcgcatccatgaaaatggctacaacttcaagagtgacatctggagcctgggctgcctgctgtatgagatggccgccctgcagagccccttctatggagacaagatgaacctcttcagcctgtgccagaagattgagcagtgtgactacccacccctgcctggagagcactacagcgagaagctgcgggagctggtgtccatgtgcatctgcccagacccccaccagaggccagacatcggctacgtgcaccaggtggccaagcagatgcacatctggatgagcagcacctag

SEQ ID NO: 161960 - DNA, 996 bp, Artificial Sequence
  Description of Artificial Sequence: Synthetic coding sequence
atgggcagaagaagacctgcccccttccgggccctggtgcggctggcctgcaggatggccggccagcccggccacatgccccacggcggcagcagcaacaacctgtgccacaccctgggccctgtgcaccccccagacccccagaggcaccccaacaccctgtccttccgctgcagcctggccgacttccagatcgagaagaagattggccggggccagttcagcgaggtgtacaaggccacctgcctgctggacaggaagacagtggccctgaagaaggtgcagatctttgagatgatggatgccaaggcccggcaggactgtgtgaaggagatcggcctgctgaagcagctgaaccaccccaacatcatcaagtacctggacagcttcatcgaggacaatgagctgaacatcgtgctggagctggctgatgctggggacctgagccagatgatcaagtacttcaagaagcagaagaggctcatccctgagaggacagtgtggaagtactttgtgcagctgtgcagcgctgtggagcacatgcacagccggcgggtgatgcaccgggacatcaagccagccaacgtgttcatcacagccactggagtggtgaagctgggggacctgggcctgggccgcttcttcagcagcgagaccacagctgcccacagcctggtgggcaccccctactacatgagccctgagcgcatccatgaaaatggctacaacttcaagagtgacatctggagcctgggctgcctgctgtatgagatggccgccctgcagagccccttctacggggacaagatgaacctcttcagcctgtgccagaagattgagcagtgtgactacccacccctgcccggggagcactacagcgagaagctgcgggagctggtgtccatgtgcatctgcccagacccccaccagaggccagacatcggctacgtgcaccaggtggccaagcagatgcacatctggatgagcagcacctag

SEQ ID NO: 161961 - DNA, 942 bp, Artificial Sequence; identical to SEQ ID NO: 161947
  Description of Artificial Sequence: Synthetic coding sequence

SEQ ID NO: 161962 - DNA, 942 bp, Artificial Sequence; identical to SEQ ID NO: 161947
  Description of Artificial Sequence: Synthetic coding sequence

SEQ ID NO: 161963 - DNA, 909 bp, Artificial Sequence
  Description of Artificial Sequence: Synthetic coding sequence
atggatgagcagagccagggcatgcagggcccccctgtgccccagttccagccccagaaggccctgcggccagacatgggctacaacaccctggccaacttccgcatcgagaagaagattggccggggccagttcagcgaggtgtacagagctgcctgcctgctggatggagtgcctgtggccctgaagaaggtgcagatctttgacctgatggatgccaaggcccgggctgactgcatcaaggagattgacctgctgaagcagctgaaccaccccaacgtcatcaagtactatgccagcttcattgaagataatgagctgaacatcgtgctggagctggctgatgctggggacctgagcaggatgatcaagcacttcaagaagcagaagaggctcatccctgagaggacagtgtggaagtactttgtgcagctgtgcagcgccctggagcacatgcacagcagaagagtgatgcaccgggacatcaagccagccaacgtgttcatcacagccaccggggtggtgaagctgggggacctgggcctgggccgcttcttcagcagcaagaccacagctgcccacagcctggtgggcaccccctactacatgagccctgagcgcatccatgaaaatggctacaacttcaagagtgacatctggagcctgggctgcctgctgtatgagatggccgccctgcagagccccttctatggagacaagatgaacctgtacagcctgtgcaagaagattgagcagtgtgactacccacccctgcccagcgaccactacagcgaggagctgcggcagctggtgaacatgtgcatcaacccagaccctgagaagaggccagatgtgacctacgtgtatgatgtggccaagaggatgcacgcctgcacagccagcagctag

SEQ ID NO: 161964 - DNA, 249 bp, Artificial Sequence
  Description of Artificial Sequence: Synthetic coding sequence
atggatgagcagagccagggcatgcagggcccccctgtgccccagttccagccccagaaggccctgcggccagacatgggctacaacaccctggccaacttccgcatcgagaagaagattggccggggccagttcagcgaggtgtacagagctgcctgcctgctggatggagtgcctgtggccctgaagaaggtgcagatctttgacctgatggatgccaaggcccgggctgactgcatcaaggagtag

SEQ ID NO: 161965 - DNA, 99 bp, Artificial Sequence
  Description of Artificial Sequence: Synthetic coding sequence
atggatgagcagagccagggcatgcagggcccccctgtgccccagttccagccccagaaggccctgcggccagacatgggctacaacaccctggcctag

SEQ ID NO: 161966 - DNA, 909 bp, Artificial Sequence; identical to SEQ ID NO: 161963
  Description of Artificial Sequence: Synthetic coding sequence

SEQ ID NO: 161967 - DNA, 189 bp, Artificial Sequence
  Description of Artificial Sequence: Synthetic coding sequence
atggatgagcagagccagggcatgcagggcccccctgtgccccagttccagccccagaaggccctgcggccagacatgggctacaacaccctggccaacttccgcatcgagaagaagattggccggggccagttcagcgaggtgtacagagctgcctgcctgctggatggagtgcctgtggccctgtag

SEQ ID NO: 161968 - DNA, 3729 bp, Artificial Sequence
  Description of Artificial Sequence: Synthetic coding sequence
atggagaagtatgtgcggctgcagaagatcggggagggcagctttgggaaggccatcctggtgaagagcacagaagatggccggcagtatgtgatcaaggagatcaacatcagcaggatgagcagcaaggagcgggaggagagcagaagagaggtggccgtgctggccaacatgaagcaccccaacatcgtgcagtaccgggagagctttgaggagaatggcagcctgtacatcgtgatggactactgtgagggcggggacctcttcaagaggatcaatgcccagaagggcgtgctcttccaggaggaccagatcctggactggtttgtgcagatctgcctggccctgaagcacgtgcatgacaggaagatcctgcaccgggacatcaagagccagaacatcttcctgaccaaggatggcaccgtgcagctgggggactttggaattgcccgggtgctgaacagcacagtggagctggcccggacctgcatcggcaccccctactacctgagccctgagatctgtgagaacaagccctacaacaacaagagtgacatctgggccctgggctgtgtgctgtatgagctgtgcaccctgaagcacgcctttgaagctggctccatgaagaacctggtgctgaagatcatcagcggcagcttcccccctgtgtccctgcactacagctatgacctgcggagcctggtgtcccagctgttcaagaggaacccccgggaccggcccagcgtgaacagcatcctggagaagggcttcatcgccaagagaattgagaagttcctgagcccccagctgattgctgaggagttctgcctgaagaccttcagcaagtttggcagccagcccatcccagccaagaggcctgccagcggccagaacagcatctctgtgatgcctgcccagaagatcaccaagccagctgccaagtatggcatccccctggcctacaagaagtacggggacaagaagctgcacgagaagaagcccctgcagaagcacaagcaggcccaccagaccccagagaagagggtgaacacaggagaggagaggaggaagatcagcgaggaggccgccaggaagaggcggctggagttcatcgagaaggagaagaagcagaaggaccagatcatcagcctgatgaaggccgagcagatgaagaggcaggagaaggagcggctggagcgcatcaacagagcccgggagcagggctggagaaatgtgctgtctgctgggggcagcggggaggtgaaggcccccttcctgggcagcggcggcaccatcgcccccagcagcttcagcagccggggccagtatgagcactaccacgccatctttgaccagatgcagcagcagagagcagaagataatgaggccaagtggaagcgggagatctacggccggggcctgcctgagcggcagaagggccagctggccgtggagcgggccaagcaggtggaggagttcctgcagaggaagcgggaggccatgcagaacaaggcccgggcagagggccacatgggcatcctgcagaacctggccgccatgtatggaggccggcccagcagcagccggggcggcaagcccaggaacaaggaggaggaggtgtacctggcccggctgcggcagatccggctgcagaacttcaatgaaaggcagcagatcaaggccaagctgcggggggagaagaaggaggccaaccacagcgagggccaggagggcagcgaggaggccgacatgaggaggaagaagattgagagcctgaaggcccacgccaatgcccgggctgctgtgctgaaggagcagctggagaggaagaggaaggaggcctatgagcgggagaagaaggtgtgggaggagcacctggtggccaagggcgtgaagagcagtgatgtgagcccccccctgggccagcatgaaacaggaggcagccccagcaagcagcagatgaggagcgtcatctctgtgaccagcgccctgaaggaggtgggcgtggacagcagcctgacagacacccgggagaccagcgaggagatgcagaagaccaacaatgccatcagcagcaagcgggagatcctgcggcggctgaatgaaaacctgaaggcccaggaggatgagaagggcaagcagaacctgagtgacacctttgagatcaacgtgcatgaagatgccaaggagcacgagaaggagaagtctgtgtccagtgacaggaagaagtgggaggccggcggccagctggtgatccccctggatgagctgaccctggacaccagcttcagcaccacagagcggcacacagtgggggaggtgatcaagctgggccccaacggcagcccccggcgggcctggggcaagagccccacagacagcgtgctgaagatcctgggggaggccgagctgcagctgcagacagagctgctggagaacaccaccatccgctctgagatcagccctgagggggagaagtacaagcccctcatcaccggggagaagaaggtgcagtgcatcagccatgagatcaaccccagcgccatcgtggacagccctgtggagaccaagagccctgagttcagcgaggccagcccccagatgagcctgaagctggagggcaacctggaggagccagatgacctggagacagagatcctgcaggagcccagcggcaccaacaaggatgagagcctgccctgcaccatcacagatgtgtggatcagcgaggagaaggagaccaaggagacccagagcgctgaccgcatcaccatccaggagaatgaggtgtctgaagatggagtgagcagcacagtggaccagctgagtgacatccacatcgagcccggcaccaatgacagccagcacagcaaatgtgatgtggacaagtctgtgcagcctgagcccttcttccacaaggtggtgcacagcgagcacctgaacctggtgccccaggtgcagagcgtgcagtgcagccctgaggagagctttgccttccgcagccacagccacctgccccccaagaacaagaacaagaacagcctgctgattggcctgagcacaggcctgtttgatgccaacaaccccaagatgctgcggacctgcagcctgcctgacctgagcaagctgttccgcaccctgatggatgtgcccaccgtgggagatgtgcggcaggacaacctggagattgatgaaattgaagatgagaacatcaaggagggccccagcgacagtgaagatattgtgtttgaggagacagacacagacctgcaggagctgcaggcctccatggagcagctgctgcgggagcagcctggagaggagtacagcgaggaggaggagagcgtgctgaagaacagtgatgtggagcccacagccaatggaacagatgtggctgatgaagatgacaaccccagcagcgagagcgccctgaatgaggagtggcacagcgacaacagtgatggagaaattgcctctgaatgtgaatgtgacagcgtcttcaaccacctggaggagctgcggctgcacctggagcaggagatgggctttgagaagttctttgaggtgtatgagaagatcaaggccatccatgaagatgaagatgagaacatcgagatctgcagcaagatcgtgcagaacatcctgggcaatgagcaccagcacctgtatgccaagatcctgcacctggtgatggctgatggagcctaccaggaggacaatgatgaatag

SEQ ID NO: 161969 - DNA, 1800 bp, Artificial Sequence
  Description of Artificial Sequence: Synthetic coding sequence
atgctgaagttccaggaggccgccaagtgtgtgtctggcagcacagccatcagcacctaccccaagaccctgattgccaggagatatgtgctgcagcagaagctgggcagcggcagctttggcaccgtgtacctggtgtctgacaagaaggccaagagaggagaggagctgaaggtgctgaaggagatctctgtgggggagctgaaccccaatgaaacagtgcaggccaacctggaggcccagctgctgagcaagctggaccacccagccatcgtgaagttccacgccagctttgtggagcaggacaacttctgcatcatcacagagtactgtgagggccgggacctggatgacaagatccaggagtacaagcaggccggcaagatcttccctgagaaccagatcatcgagtggttcatccagctgctgctgggcgtggactacatgcatgagcggcgcatcctgcaccgggacctgaagagcaagaatgtgttcctgaagaacaacctgctgaagattggagactttggagtgtcccggctgctgatgggcagctgtgacctggccaccaccctgaccggcaccccccactacatgagccctgaggccctgaagcaccagggctatgacaccaagagtgacatctggagcctggcctgcatcctgtatgagatgtgctgcatgaaccacgcctttgctggcagcaacttcctgagcatcgtgctgaagatcgtggagggggacacccccagcctgcctgagcgctaccccaaggagctgaatgccatcatggagagcatgctgaacaagaaccccagcctgcggcccagcgccatcgagatcctgaagatcccctacctggatgagcagctgcagaacctgatgtgccgctacagcgagatgaccctggaggacaagaacctggactgccagaaggaggccgcccacatcatcaatgccatgcagaagaggatccacctgcagaccctgcgggccctgtctgaggtgcagaagatgaccccccgggagaggatgaggctgaggaagctgcaggccgcagatgagaaggccaggaagctgaagaagatcgtggaggagaagtatgaggagaacagcaagaggatgcaggagctgcggagcaggaacttccagcagctgtctgtggatgtgctgcacgagaagacccacctgaagggcatggaggagaaggaggagcagcctgagggccgcctgagctgcagcccccaggatgaagatgaggagcgctggcagggccgggaggaggagagtgatgagcccaccctggagaacctgcctgagagccagcccatccccagcatggacctgcacgagctggagagcatcgtggaggatgccaccagtgacctgggctaccacgagatccctgaggaccccctggtggccgaggagtactatgcagatgcctttgacagctactgtgaggagagtgatgaggaggaggaggagatcgccctggagaggcctgagaaggagatcagaaatgaaggcagccagcctgcctaccgcaccaaccagcaggacagcgacatcgaggccctggcccgctgcctggagaatgtgctgggctgcaccagcctggaccagccctgccgctcctggggccagaagtacctgaagaggagcatcatcaccagccgggagcagggcatccgcatgctggccaagcagaggtctgcctctgtgtggaagaagtggtgcctgaagccagccaccgtgctgaagtggaccagcagctgcaccctgaagagcagctgctag

SEQ ID NO: 161970 - DNA, 459 bp, Artificial Sequence
  Description of Artificial Sequence: Synthetic coding sequence
atggattctggaacagaggagtatgagctgaatggaggcctgcccccaggcaccccaggcagcccagatgccagccctgcccgctggggctggaggcatggccccatcaacgtgaaccactacgccagcaagaagtctgctgctgagagcatgctggacatcgccctgctgatggccaatgccagccagctgaaggctgtggtggagcagggccccagctttgccttctacgtgcccctggtggtgctgatcagcatcagcctggtgctgcagatcggcgtgggcgtgctgctgatcttcctggtgaagtatgacctgaacaacccagccaagcacgccaagctggacttcctgaacaacctggccaccggcctggtgttcatcatcgtggtggtgaacatcttcatcacagcctttggagtgcagaagcccctgatggacatggccccccagcagtag

SEQ ID NO: 161971 - DNA, 567 bp, Artificial Sequence
  Description of Artificial Sequence: Synthetic coding sequence
atggccggcctgagccggcagctgtgtgccctgagccaccccaagaaggctgctgagacccagacagctgagcctggaggagcccatgctgtgtgcagccgccaccctgtgcgggtgaagggcctggagggcagcgagatggagagcgcccgggagaacatcgacctgcagcccggcagcagtgaccccaggagccagcccatcaacctgaaccactacgccaccaagaagtctgtggccgagagcatgctggatgtggccctcttcatgagcaatgccatgaggctgaaggctgtgctggagcagggccccagcagccactactacaccaccctggtgaccctcatcagcctgagcctgctgctgcaggtggtgattggagtgctgctggtggtgattgcccggctgaacctgaatgaggtggagaagcagtggaggctgaaccagctgaacaatgctgccaccatcctggtgttcttcaccgtggtgatcaacgtgttcatcacagcctttggagcccacaagacaggcttcctggccgcccgggccagcaggaaccccctgtag

SEQ ID NO: 161972 - DNA, 273 bp, Artificial Sequence
  Description of Artificial Sequence: Synthetic coding sequence
atgctggatgtggccctcttcatgagcaatgccatgaggctgaaggctgtgctggagcagggccccagcagccactactacaccaccctggtgaccctcatcagcctgagcctgctgctgcaggtggtgattggagtgctgctggtggtgattggagaggagcccagcctgcagagcgacctgctgcccaggcacccctggctggccgagcggccccacgtgtccccaggccccccctgcattggaacaggcagctttgccaccaccaggtag

SEQ ID NO: 161973 - DNA, 1401 bp, Artificial Sequence
  Description of Artificial Sequence: Synthetic coding sequence
atgcctggggacagcagccctggcaccctgcccctgtgggatgccagcctgagcccccccctgggccctgaccccggcggcttcagccgggccagccacgccggggacaagagccggcccccagcccctgagctgggcagccctggagctgtgcggccccgggtgggcagctgtgcccctggccccatggagctgcgggtgagcaacaccagctgtgaaaatggcagcctgctgcacctgtactgcagcagccaggaggtgctgtgccagatcgtgaatgacctgagccctgaggtgcccagcaatgccaccttccacagctggcaggagcgcatccggcagaactacggcttctacatcggcctgggcctggccttcctgagcagcttcctgattggcagcagcgtcatcctgaagaagaagggcctgctgcggctggtggccactggagccaccagggctgtggatggcggcttcggctacctgaaggatgccatgtggtgggccggcttcctgaccatggccgccggggaggtggccaactttggagcctatgcctttgccccagccaccgtggtgacccccctgggcgccctgtctgtgctgatcagcgccatcctgagcagctacttcctgcgggagagcctgaacctgctgggcaagctgggctgcgtcatctgtgtggccggcagcacagtgatggtgattcatgcccctgaggaggagaaggtgaccaccatcatggagatggccagcaagatgaaggacaccggcttcatcgtgtttgctgtgctgctgctggtgtcctgcctgatcctgatctttgtgattgcccccaggtatggccagaggaacatcctgatctacatcatcatctgcagcgtcatcggggccttctctgtggccgctgtgaagggcctgggcatcaccatcaagaacttcttccagggcctgcctgtggtgcgccaccccctgccctacatcctgagcctcatcctggccctgagcctgagcacccaggtgaacttcctgaacagagccctggacatcttcaacaccagcctggtgttccccatctactacgtgttcttcaccaccgtggtggtgaccagcagcatcatcctcttcaaggagtggtacagcatgtctgctgtggacattgctggcaccctgagcggctttgtgaccatcatcctgggcgtcttcatgctgcacgccttcaaggacctggacatcagctgtgccagcctgccccacatgcacaagaaccccccacccagccctgcccctgagcccaccgtcatccggctggaggacaagaatgtgctggtggacaacatcgagctggccagcaccagcagccctgaggagaagcccaaggtgttcatcatccacagctag

SEQ ID NO: 161974 - DNA, 1344 bp, Artificial Sequence
  Description of Artificial Sequence: Synthetic coding sequence
atgcctggggacagcagccctggcaccctgcccctgtgggatgccagcctgagcccccccctgggccctgaccccggcggcttcagccgggccagccacgccggggacaagagccggcccccagcccctgagctgggcagccctggagctgtgcggccccgggtgggcagctgtgcccctggccccatggagctgcgggtgagcaacaccagctgtgaaaatggcagcctgctgcacctgtactgcagcagccaggaggtgctgtgccagatcgtgaatgacctgagccctgaggtgcccagcaatgccaccttccacagctggcaggagcgcatccggcagaactacggcttctacatcggcctgggcctggccttcctgagcagcttcctgattggcagcagcgtcatcctgaagaagaagggcctgctgcggctggtggccactggagccaccagggctgtggccgccggggaggtggccaactttggagcctatgcctttgccccagccaccgtggtgacccccctgggcgccctgtctgtgctgatcagcgccatcctgagcagctacttcctgcgggagagcctgaacctgctgggcaagctgggctgtgtgatctgtgtggccggcagcacagtgatggtgatccacgcccctgaggaggagaaggtgaccaccatcatggagatggccagcaagatgaaggacaccggcttcatcgtgtttgctgtgctgctgctggtgtcctgcctgatcctgatcttcgtcatcgcccccaggtatggccagaggaacatcctgatctacatcatcatctgcagcgtgattggagccttctctgtggccgctgtgaagggcctgggcatcaccatcaagaacttcttccagggcctgcctgtggtgcgccaccccctgccctacatcctgagcctcatcctggccctgagcctgagcacccaggtgaacttcctgaacagagccctggacatcttcaacaccagcctggtgttccccatctactacgtgttcttcaccaccgtggtggtgaccagcagcatcatcctcttcaaggagtggtacagcatgtctgctgtggacattgctggcaccctgagcggctttgtgaccatcatcctgggcgtcttcatgctgcacgccttcaaggacctggacatcagctgtgccagcctgccccacatgcacaagaaccccccacccagccctgcccctgagcccaccgtcatccggctggaggacaagaatgtgctggtggacaacatcgagctggccagcaccagcagccctgaggagaagcccaaggtgttcatcatccacagctag

SEQ ID NO: 161975 - DNA, 8415 bp, Artificial Sequence
  Description of Artificial Sequence: Synthetic coding sequence
atgaatggagacatgcctcatgtgcccatcaccaccctggccggcatcgccagcctgacagacctgctgaaccagctgcccctgcccagccccctgcctgccaccaccaccaagagcctgctcttcaatgccagaattgctgaggaggtgaactgcctgctggcctgcagagatgacaacctggtgtcccagctggtgcacagcctgaaccaggtgtccacagaccacatcgagctgaaggacaacctgggcagtgatgatcctgagggggacatccctgtgctgctgcaggccgtgctggcccggagccccaacgtgttccgggagaagtccatgcagaaccgctacgtgcagagcggcatgatgatgagccagtacaagctgagccagaacagcatgcacagcagccctgccagcagcaactaccagcagaccaccatcagccacagccccagcagcagatttgtgcccccccagaccagcagcggcaaccgcttcatgccccagcagaacagccctgtgcccagcccctatgccccccagagccctgctggctacatgccctacagccaccccagcagctacaccacccacccccagatgcagcaggcctctgtgagcagccccatcgtggccggcggcctgaggaacatccatgacaacaaggtgtctggccccctgagcggcaacagcgccaaccaccacgccgacaaccccaggcatggcagcagcgaggactacctgcacatggtgcaccggctgagcagtgatgatggagacagcagcaccatgagaaatgctgccagcttccccctgcggagcccccagcctgtgtgcagccctgctggcagcgagggcacccccaagggcagcaggcctcctctcatcctgcagagccagagcctgccctgcagcagccccagagatgtgcccccagacatcctgctggacagccctgagaggaagcagaagaagcagaagaagatgaagctgggcaaggatgagaaggagcagagcgagaaggccgccatgtatgacatcatcagcagccccagcaaggacagcaccaagctgaccctgcggctgagccgggtgcgcagcagtgacatggaccagcaggaggacatgatcagcggcgtggagaacagcaatgtgtctgaaaatgacatccccttcaacgtgcagtacccaggccagaccagcaagacccccatcaccccccaggacatcaaccggcccctgaatgctgcccagtgcctgagccagcaggagcagacagccttcctgcctgccaaccaggtgcctgtgctgcagcagaacacctctgtggccgccaagcagccccagacctctgtggtgcagaaccagcagcagatcagccagcagggccccatctatgatgaggtggagctggatgccctggccgagattgagcgcatcgagcgggagagcgccatcgagcgggagcgcttcagcaaggaggtgcaggacaaggacaagcccctgaagaagaggaagcaggacagctacccccaggaggccggcggggccaccggcggcaacagacctgccagccaggagaccggcagcactggaaatggcagcaggcctgccctgatggtgtccattgacctgcaccaggccggccgggtggacagccaggccagcatcacccaggacagcgacagcatcaagaagccagaggagatcaagcagtgcaatgatgcccctgtgtctgtgctgcaggaggacatcgtgggcagcctgaagagcaccccagagaaccaccctgagacccccaagaagaagagtgaccctgagctgagcaagtctgagatgaagcagagcgagagccggctggccgagagcaagcccaatgaaaatcggctggtggagaccaagagcagcgagaacaagctggagaccaaggtggagacccagacagaggagctgaagcagaatgaaagcaggaccacagagtgcaagcagaatgaaagcaccatcgtggagcccaagcagaatgaaaatcggctgagtgacaccaagcccaatgacaacaagcagaacaacggccgctctgagaccaccaagagcaggcctgagacccccaagcagaagggggagagcaggcctgagacccccaagcagaagagtgatggccaccctgagacccccaagcagaagggagatggccggcctgagacccccaagcagaagggggagagcaggcctgagacccccaagcagaagaatgaaggccggcctgagacccccaagcacagacatgacaacagaagagacagcggcaagcccagcacagagaagaagccagaggtgtccaagcacaagcaggacaccaagagtgacagcccccggctgaagtctgagcgggcagaggccctgaagcagaggccagatggccgctctgtgtctgagagcctgcggcgggaccatgacaacaagcagaagagtgatgacagaggagagagcgagcggcacagaggagaccagagccgggtgagaagacctgagaccctgcggagcagcagcagaaatgagcacggcatcaagagtgacagcagcaagacagacaagctggagaggaagcacagacatgagagcggggacagccgggagcggcccagcagtggagagcagaagagcaggccagacagcccccgggtgaagcagggcgacagcaacaagagcagaagtgacaagctgggcttcaagagccccaccagcaaggatgacaagaggacagagggcaacaagagcaaggtggacaccaacaaggcccacccagacaacaaggccgagttccccagctacctgctgggcggccgcagcggggccctgaagaacttcgtcatccccaagatcaagagggacaaggatggaaatgtgacccaggagaccaagaagatggagatgaagggggagcccaaggacaaggtggagaagattggcctggtggaggacctgaacaagggggccaagcctgtggtggtgctgcagaagctgagcctggatgatgtgcagaagctgatcaaggaccgggaggacaagagccgcagcagcctgaagcccatcaagaacaagcccagcaagagcaacaagggcagcattgaccagagcgtgctgaaggagctgcccccagagctgctggccgagattgagagcaccatgcccctgtgtgagcgggtgaagatgaacaagaggaagaggagcacagtgaatgagaagcccaagtatgcagagatcagcagtgatgaggacaatgacagtgatgaggcctttgagagcagcaggaagaggcacaagaaggatgatgacaaggcctgggagtatgaggagcgggaccggcgcagcagcggggaccacagaagaagtggccacagccatgagggccgccgcagcagcggcggcggccgctacagaaacagaagccccagcgacagcgacatggaggactacagccccccacccagcctgtctgaggtggccaggaagatgaagaagaaggagaagcagaagaagaggaaggcctatgagcccaagctgaccccagaggagatgatggacagcagcaccttcaagcgcttcaccgccagcattgagaacatcctggacaacctggaggacatggacttcaccgcctttggagatgatgatgagatcccccaggagctgctgctgggcaagcaccagctgaatgagctgggcagcgagagcgccaagatcaaggccatgggcatcatggacaagctgagcacagacaagacagtgaaggtgctgaacatcctggagaagaacatccaggacggcagcaagctgagcaccctgctgaaccacaacaatgacacagaggaggaggagcggctgtggagggacctgatcatggagcgggtgaccaagtctgcagatgcctgcctgaccaccatcaacatcatgaccagccccaacatgcccaaggctgtgtacattgaagatgtgattgaaagagtcatccagtacaccaagttccacctgcagaacaccctgtacccccagtatgaccctgtgtaccgcctggacccccatggaggcggcctgctgagcagcaaggccaagagggccaagtgcagcacccacaagcagagggtgattgtgatgctgtacaacaaggtgtgtgacatcgtgagcagcctgtctgagctgctggagatccagctgctgacagacaccaccatcctgcaggtgtcctccatgggcatcacccccttctttgtggagaatgtgtctgagctgcagctgtgtgccatcaagctggtgacagctgtgttcagccgctatgagaagcaccggcagctgatcctggaggagatcttcaccagcctggcccggctgcccaccagcaagaggagcctgaggaacttccggctgaacagcagtgacatggatggagagcccatgtacatccagatggtgacagccctggtgctgcagctgatccagtgtgtggtgcacctgcccagcagcgagaaggacagcaatgctgaggaggacagcaacaagaagattgaccaggatgtggtgatcaccaacagctatgaaacagccatgaggacagcccagaacttcctgagcatcttcctgaagaagtgtggcagcaagcagggcgaggaggactaccggcccctgtttgaaaattttgtgcaggacctgctgagcacagtgaacaagccagagtggccagctgctgagctgctgctgagcctgctgggccgcctgctggtgcaccagttcagcaacaagagcacagagatggccctgcgggtggccagcctggactacctgggcaccgtggccgcccggctgaggaaggatgctgtgaccagcaagatggaccagggcagcattgaaagaatcctgaagcaggtgtctggaggagaagatgagatccagcagctgcagaaggccctgctggactacctggatgaaaatacagaaacagaccccagcctggtgttcagcaggaagttctacatcgcccagtggttccgggacaccaccctggagacagagaaggccatgaagagccagaaggatgaggagagcagcgagggcacccaccacgccaaggagattgagaccaccggccagatcatgcacagagcagaaaataggaagaagttcctgcggagcatcatcaagaccacccccagccagttcagcaccctgaagatgaacagcgacacagtggactatgatgatgcctgcctgattgtgcgctacctggcctccatgaggccctttgcccagagctttgacatctacctgacccagatcctgcgggtgctgggagaaaatgccatcgctgtgaggaccaaggccatgaagtgcctgtctgaggtggtggccgtggaccccagcatcctggcccggctggacatgcagaggggcgtgcacggccgcctgatggacaacagcacctctgtgcgggaggccgctgtggagctgctgggccgctttgtgctgtgccggccccagctggccgagcagtactatgacatgctgattgaaagaatcctggacaccggcatctctgtgaggaagagggtcatcaagatcctgcgggacatctgcatcgagcagcccaccttccccaagatcacagagatgtgtgtgaagatgatccggcgggtgaatgatgaggagggcatcaagaagctggtgaatgagaccttccagaagctgtggttcacccccaccccccacaatgacaaggaggccatgaccaggaagatcctgaacatcacagatgtggtggccgcctgccgggacaccggctatgactggtttgagcagctgctgcagaacctgctgaagtctgaggaggacagcagctacaagcctgtgaagaaggcctgcacccagctggtggacaacctggtggagcacatcctgaagtatgaggagagcctggccgacagcgacaacaagggcgtgaacagcggccgcctggtggcctgcatcaccaccctcttcctgttcagcaagatccggccccagctgatggtgaagcacgccatgaccatgcagccctacctgaccaccaagtgcagcacccagaatgacttcatggtgatctgcaatgtggccaagatcctggagctggtggtgcccctgatggagcaccccagcgagaccttcctggccaccatcgaggaggacctgatgaagctgatcatcaagtatggcatgacagtggtgcagcactgtgtgtcctgcctgggcgctgtggtgaacaaggtgacccagaacttcaagtttgtgtgggcctgcttcaaccgctactacggggccatcagcaagctgaagagccagcaccaggaggaccccaacaacaccagcctgctgaccaacaagccagccctgctgcggagcctcttcaccgtgggcgccctgtgccgccactttgattttgacctggaggacttcaagggcaacagcaaggtgaacatcaaggacaaggtgctggagctgctgatgtacttcaccaagcacagtgatgaggaggtgcagaccaaggccatcatcggcctgggctttgccttcatccagcaccccagcctgatgtttgagcaggaggtgaagaacctgtacaacaacatcctgagtgacaagaacagctctgtgaacctgaagatccaggtgctgaagaacctgcagacctacctgcaggaggaggacaccaggatgcagcaggccgaccgggactggaagaaggtggccaagcaggaggacctgaaggagatgggagatgtgagcagcggcatgagcagcagcatcatgcagctgtacctgaagcaggtgctggaggccttcttccacacccagagctctgtgcgccactttgccctgaatgtgattgccctgaccctgaaccagggcctcatccaccctgtgcagtgtgtgccctacctgattgccatgggcacagatcctgagcccgccatgaggaacaaggctgaccagcagctggtggagattgacaagaagtatgccggcttcatccacatgaaggctgtggccggcatgaagatgagctaccaggtgcagcaggccatcaacacctgcctgaaggaccctgtgcggggcttccggcaggatgagagcagcagcgccctgtgcagccacctgtacagcatgatccggggcaaccggcagcaccggcgggccttcctgatcagcctgctgaacctgtttgatgacacagccaagacagatgtgaccatgctgctgtacatcgctgacaacctggcctgcttcccctaccagacccaggaggagcccctcttcatcatgcaccacatcgacatcaccctgtctgtgtctggcagcaacctgctgcagagcttcaaggagagcatggtgaaggacaagaggaaggagaggaagagcagccccagcaaagaaaatgaaagcagtgacagcgaggaggaggtgtcccggcccaggaagagcaggaagagggtggacagcgacagcgacagcgacagtgaagatgacatcaacagcgtgatgaagtgcctgcctgagaacagcgcccccctcatcgagtttgccaacgtgtcccagggcatcctgctgctgctgatgctgaagcagcacctgaagaacctgtgtggcttcagtgacagcaagatccagaagtacagccccagcgagagcgccaaggtgtatgacaaggccatcaacaggaagacaggagtgcacttccaccccaagcagaccctggacttcctgcggagtgacatggccaacagcaagatcacagaggaggtgaagaggagcatcgtgaagcagtacctggacttcaagctgctgatggagcacctggaccctgatgaggaggaggaggagggggaggtgtctgccagcaccaatgccaggaacaaggccatcaccagcctgctgggcggcggcagccccaagaacaacacagctgctgagacagaagatgatgaaagtgatggagaagatcggggcggcggcaccagcggcagcctgcggcgcagcaagaggaacagcgacagcacagagctggccgcccagatgaatgaatctgtggatgtgatggatgtgattgccatctgctgccccaagtacaaggaccggccccagatcgcccgggtggtgcagaagaccagcagcggcttctctgtgcagtggatggccggcagctacagcggctcctggacagaggccaagagaagagatggcaggaagctggtgccctgggtggacaccatcaaggagagtgacatcatctacaagaagatcgccctgaccagcgccaacaagctgaccaacaaggtggtgcagaccctgcggagcctgtatgctgccaaggatggcaccagcagctag

SEQ ID NO: 161976 - DNA, 8094 bp, Artificial Sequence
  Description of Artificial Sequence: Synthetic coding sequence
atgaatggagacatgcctcatgtgcccatcaccaccctggccggcatcgccagcctgacagacctgctgaaccagctgcccctgcccagccccctgcctgccaccaccaccaagagcctgctcttcaatgccagaattgctgaggaggtgaactgcctgctggcctgcagagatgacaacctggtgtcccagctggtgcacagcctgaaccaggtgtccacagaccacatcgagctgaaggacaacctgggcagtgatgatcctgagggggacatccctgtgctgctgcaggccgtgctggcccggagccccaacgtgttccgggagaagtccatgcagaaccgctacgtgcagagcggcatgatgatgagccagtacaagctgagccagaacagcatgcacagcagccctgccagcagcaactaccagcagaccaccatcagccacagccccagcagcagatttgtgcccccccagaccagcagcggcaaccgcttcatgccccagcagaacagccctgtgcccagcccctatgccccccagagccctgctggctacatgccctacagccaccccagcagctacaccacccacccccagatgcagcaggcctctgtgagcagccccatcgtggccggcggcctgaggaacatccatgacaacaaggtgtctggccccctgagcggcaacagcgccaaccaccacgccgacaaccccaggcatggcagcagcgaggactacctgcacatggtgcaccggctgagcagtgatgatggagacagcagcaccatgagaaatgctgccagcttccccctgcggagcccccagcctgtgtgcagccctgctggcagcgagggcacccccaagggcagcaggcctcctctcatcctgcagagccagagcctgccctgcagcagccccagagatgtgcccccagacatcctgctggacagccctgagaggaagcagaagaagcagaagaagatgaagctgggcaaggatgagaaggagcagagcgagaaggccgccatgtatgacatcatcagcagccccagcaaggacagcaccaagctgaccctgcggctgagccgggtgcgcagcagtgacatggaccagcaggaggacatgatcagcggcgtggagaacagcaatgtgtctgaaaatgacatccccttcaacgtgcagtacccaggccagaccagcaagacccccatcaccccccaggacatcaaccggcccctgaatgctgcccagtgcctgagccagcaggagcagacagccttcctgcctgccaaccaggtgcctgtgctgcagcagaacacctctgtggccgccaagcagccccagacctctgtggtgcagaaccagcagcagatcagccagcagggccccatctatgatgaggtggagctggatgccctggccgagattgagcgcatcgagcgggagagcgccatcgagcgggagcgcttcagcaaggaggtgcaggacaaggacaagcccctgaagaagaggaagcaggacagctacccccaggaggccggcggggccaccggcggcaacagacctgccagccaggagaccggcagcactggaaatggcagcaggcctgccctgatggtgtccattgacctgcaccaggccggccgggtggacagccaggccagcatcacccaggacagcgacagcatcaagaagccagaggagatcaagcagtgcaatgatgcccctgtgtctgtgctgcaggaggacatcgtgggcagcctgaagagcaccccagagaaccaccctgagacccccaagaagaagagtgaccctgagctgagcaagtctgagatgaagcagagcgagagccggctggccgagagcaagcccaatgaaaatcggctggtggagaccaagagcagcgagaacaagctggagaccaaggtggagacccagacagaggagctgaagcagaatgaaagcaggaccacagagtgcaagcagaatgaaagcaccatcgtggagcccaagcagaatgaaaatcggctgagtgacaccaagcccaatgacaacaagcagaacaacggccgctctgagaccaccaagagcaggcctgagacccccaagcagaagggggagagcaggcctgagacccccaagcagaagagtgatggccaccctgagacccccaagcagaagggagatggccggcctgagacccccaagcagaagggggagagcaggcctgagacccccaagcagaagaatgaaggccggcctgagacccccaagcacagacatgacaacagaagagacagcggcaagcccagcacagagaagaagccagaggtgtccaagcacaagcaggacaccaagagtgacagcccccggctgaagtctgagcgggcagaggccctgaagcagaggccagatggccgctctgtgtctgagagcctgcggcgggaccatgacaacaagcagaagagtgatgacagaggagagagcgagcggcacagaggagaccagagccgggtgagaagacctgagaccctgcggagcagcagcagaaatgagcacggcatcaagagtgacagcagcaagacagacaagctggagaggaagcacagacatgagagcggggacagccgggagcggcccagcagtggagagcagaagagcaggccagacagcccccgggtgaagcagggcgacagcaacaagagcagaagtgacaagctgggcttcaagagccccaccagcaaggatgacaagaggacagagggcaacaagagcaaggtggacaccaacaaggcccacccagacaacaaggccgagttccccagctacctgctgggcggccgcagcggggccctgaagaacttcgtcatccccaagatcaagagggacaaggatggaaatgtgacccaggagaccaagaagatggagatgaagggggagcccaaggacaaggtggagaagattggcctggtggaggacctgaacaagggggccaagcctgtggtggtgctgcagaagctgagcctggatgatgtgcagaagctgatcaaggaccgggaggacaagagccgcagcagcctgaagcccatcaagaacaagcccagcaagagcaacaagggcagcattgaccagagcgtgctgaaggagctgcccccagagctgctggccgagattgagagcaccatgcccctgtgtgagcgggtgaagatgaacaagaggaagaggagcacagtgaatgagaagcccaagtatgcagagatcagcagtgatgaggacaatgacagtgatgaggcctttgagagcagcaggaagaggcacaagaaggatgatgacaaggcctgggagtatgaggagcgggaccggcgcagcagcggggaccacagaagaagtggccacagccatgagggccgccgcagcagcggcggcggccgctacagaaacagaagccccagcgacagcgacatggaggactacagccccccacccagcctgtctgaggtggccaggaagatgaagaagaaggagaagcagaagaagaggaaggcctatgagcccaagctgaccccagaggagatgatggacagcagcaccttcaagcgcttcaccgccagcattgagaacatcctggacaacctggaggacatggacttcaccgcctttggagatgatgatgagatcccccaggagctgctgctgggcaagcaccagctgaatgagctgggcagcgagagcgccaagatcaaggccatgggcatcatggacaagctgagcacagacaagacagtgaaggtgctgaacatcctggagaagaacatccaggacggcagcaagctgagcaccctgctgaaccacaacaatgacacagaggaggaggagcggctgtggagggacctgatcatggagcgggtgaccaagtctgcagatgcctgcctgaccaccatcaacatcatgaccagccccaacatgcccaaggctgtgtacattgaagatgtgattgaaagagtcatccagtacaccaagttccacctgcagaacaccctgtacccccagtatgaccctgtgtaccgcctggacccccatggaggcggcctgctgagcagcaaggccaagagggccaagtgcagcacccacaagcagagggtgattgtgatgctgtacaacaaggtgtgtgacatcgtgagcagcctgtctgagctgctggagatccagctgctgacagacaccaccatcctgcaggtgtcctccatgggcatcacccccttctttgtggagaatgtgtctgagctgcagctgtgtgccatcaagctggtgacagctgtgttcagccgctatgagaagcaccggcagctgatcctggaggagatcttcaccagcctggcccggctgcccaccagcaagaggagcctgaggaacttccggctgaacagcagtgacatggatggagagcccatgtacatccagatggtgacagccctggtgctgcagctgatccagtgtgtggtgcacctgcccagcagcgagaaggacagcaatgctgaggaggacagcaacaagaagattgaccaggatgtggtgatcaccaacagctatgaaacagccatgaggacagcccagaacttcctgagcatcttcctgaagaagtgtggcagcaagcagggcgaggaggactaccggcccctgtttgaaaattttgtgcaggacctgctgagcacagtgaacaagccagagtggccagctgctgagctgctgctgagcctgctgggccgcctgctggtgcaccagttcagcaacaagagcacagagatggccctgcgggtggccagcctggactacctgggcaccgtggccgcccggctgaggaaggatgctgtgaccagcaagatggaccagggcagcattgaaagaatcctgaagcaggtgtctggaggagaagatgagatccagcagctgcagaaggccctgctggactacctggatgaaaatacagaaacagaccccagcctggtgttcagcaggaagttctacatcgcccagtggttccgggacaccaccctggagacagagaaggccatgaagagccagaaggatgaggagagcagcgagggcacccaccacgccaaggagattgagaccaccggccagatcatgcacagagcagaaaataggaagaagttcctgcggagcatcatcaagaccacccccagccagttcagcaccctgaagatgaacagcgacacagtggactatgatgatgcctgcctgattgtgcgctacctggcctccatgaggccctttgcccagagctttgacatctacctgacccagatcctgcgggtgctgggagaaaatgccatcgctgtgaggaccaaggccatgaagtgcctgtctgaggtggtggccgtggaccccagcatcctggcccggctggacatgcagaggggcgtgcacggccgcctgatggacaacagcacctctgtgcgggaggccgctgtggagctgctgggccgctttgtgctgtgccggccccagctggccgagcagtactatgacatgctgattgaaagaatcctggacaccggcatctctgtgaggaagagggtcatcaagatcctgcgggacatctgcatcgagcagcccaccttccccaagatcacagagatgtgtgtgaagatgatccggcgggtgaatgatgaggagggcatcaagaagctggtgaatgagaccttccagaagctgtggttcacccccaccccccacaatgacaaggaggccatgaccaggaagatcctgaacatcacagatgtggtggccgcctgccgggacaccggctatgactggtttgagcagctgctgcagaacctgctgaagtctgaggaggacagcagctacaagcctgtgaagaaggcctgcacccagctggtggacaacctggtggagcacatcctgaagtatgaggagagcctggccgacagcgacaacaagggcgtgaacagcggccgcctggtggcctgcatcaccaccctcttcctgttcagcaagatccggccccagctgatggtgaagcacgccatgaccatgcagccctacctgaccaccaagtgcagcacccagaatgacttcatggtgatctgcaatgtggccaagatcctggagctggtggtgcccctgatggagcaccccagcgagaccttcctggccaccatcgaggaggacctgatgaagctgatcatcaagtatggcatgacagtggtgcagcactgtgtgtcctgcctgggcgctgtggtgaacaaggtgacccagaacttcaagtttgtgtgggcctgcttcaaccgctactacggggccatcagcaagctgaagagccagcaccaggaggaccccaacaacaccagcctgctgaccaacaagccagccctgctgcggagcctcttcaccgtgggcgccctgtgccgccactttgattttgacctggaggacttcaagggcaacagcaaggtgaacatcaaggacaaggtgctggagctgctgatgtacttcaccaagcacagtgatgaggaggtgcagaccaaggccatcatcggcctgggctttgccttcatccagcaccccagcctgatgtttgagcaggaggtgaagaacctgtacaacaacatcctgagtgacaagaacagctctgtgaacctgaagatccaggtgctgaagaacctgcagacctacctgcaggaggaggacaccaggatgcagcaggccgaccgggactggaagaaggtggccaagcaggaggacctgaaggagatgggagatgtgagcagcggcatgagcagcagcatcatgcagctgtacctgaagcaggtgctggaggccttcttccacacccagagctctgtgcgccactttgccctgaatgtgattgccctgaccctgaaccagggcctcatccaccctgtgcagtgtgtgccctacctgattgccatgggcacagatcctgagcccgccatgaggaacaaggctgaccagcagctggtggagattgacaagaagtatgccggcttcatccacatgaaggctgtggccggcatgaagatgagctaccaggtgcagcaggccatcaacacctgcctgaaggaccctgtgcggggcttccggcaggatgagagcagcagcgccctgtgcagccacctgtacagcatgatccggggcaaccggcagcaccggcgggccttcctgatcagcctgctgaacctgtttgatgacacagccaagacagatgtgaccatgctgctgtacatcgctgacaacctggcctgcttcccctaccagacccaggaggagcccctcttcatcatgcaccacatcgacatcaccctgtctgtgtctggcagcaacctgctgcagagcttcaaggagagcatggtgaaggacaagaggaaggagaggaagagcagccccagcaaagaaaatgaaagcagtgacagcgaggaggaggtgtcccggcccaggaagagcaggaagagggtggacagcgacagcgacagcgacagtgaagatgacatcaacagcgtgatgaagtgcctgcctgagaacagcgcccccctcatcgagtttgccaacgtgtcccagggcatcctgctgctgctgatgctgaagcagcacctgaagaacctgtgtggcttcagtgacagcaagatccagaagtacagccccagcgagagcgccaaggtgtatgacaaggccatcaacaggaagacaggagtgcacttccaccccaagcagaccctggacttcctgcggagtgacatggccaacagcaagatcacagaggaggtgaagaggagcatcgtgaagcagtacctggacttcaagctgctgatggagcacctggaccctgatgaggaggaggaggagggggaggtgtctgccagcaccaatgccaggaacaaggccatcaccagcctgctgggcggcggcagccccaagaacaacacagctgctgagacagaagatgatgaaagtgatggagaagatcggggcggcggcaccagcggcgtgagaagaagaagaagccagaggatcagccagaggatcacctag

SEQ ID NO: 161977 - DNA, 867 bp, Artificial Sequence
  Description of Artificial Sequence: Synthetic coding sequence
atggagcggccccagcctgacagcatgccccaggacctgtctgaggccctgaaggaggccaccaaggaggtgcacacccaggctgaaaatgctgagttcatgaggaacttccagaagggccaggtgaccagagatggcttcaagctggtgatggccagcctgtaccacatctacgtggccctggaggaggagattgaaagaaacaaggagagccctgtgtttgcccctgtgtacttccctgaggagctgcacaggaaggccgccctggagcaggacctggccttctggtacggcccccgctggcaggaggtgatcccctacaccccagccatgcagcgctacgtgaagaggctgcacgaggtgggccgcacagagcctgagctgctggtggcccacgcctacacccgctacctgggggacctgagcggcggccaggtgctgaagaagatcgcccagaaggccctggacctgcccagcagcggggagggcctggccttcttcaccttccccaacatcgccagcgccaccaagttcaagcagctgtaccgcagcaggatgaacagcctggagatgaccccagctgtgcggcagagggtcatcgaggaggccaagacagccttcctgctgaacatccagctgtttgaggagctgcaggagctgctgacccatgacaccaaggaccagagccccagccgggcccctggcctgcggcagagggccagcaacaaggtgcaggacagcgcccctgtggagaccccccggggcaagccacccctgaacaccaggagccaggcccccctgctgcgctgggtgctgaccctgtccttcctggtggccaccgtggccgtgggcctgtatgccatgtag

SEQ ID NO: 161978 - DNA, 4305 bp, Artificial Sequence
  Description of Artificial Sequence: Synthetic coding sequence
atggaggaccacatgtttggagtgcagcagatccagcccaacgtcatctctgtgcggctcttcaagaggaaggtgggcggcctgggcttcctggtgaaggagcgggtgtccaagccccctgtgatcatcagtgacctgatccggggcggcgctgctgagcagagcggcctcatccaggccggggacatcatcctggccgtgaatggccggcccctggtggacctgtcctatgattctgccctggaggtgctgcggggcatcgccagcgagacccacgtggtgctgatcctgcggggccctgagggcttcaccacccacctggagaccaccttcaccggagatggcacccccaagaccatccgggtgacccagcccctgggcccccccaccaaggctgtggacctgagccaccagcccccagctgggaaggagcagcccctggccgtggatggagccagcggccctggaaatggcccccagcacgcctatgatgatggccaggaggccggcagcctgccccacgccaacggcctggccccccggcccccaggccaggaccctgccaagaaggccaccagggtgtccctgcagggcagaggagaaaataatgagctgctgaaggagattgagcctgtgctgagcctgctgaccagcggcagccggggcgtgaagggcggggccccagccaaggccgagatgaaggacatgggcatccaggtggaccgggacctggatggcaagagccacaagcccctgcccctgggcgtggagaatgacagagtcttcaatgacctgtggggcaaaggaaatgtgcctgtggtgctgaacaacccctacagcgagaaggagcagccccccaccagcggcaagcagagccccaccaagaatggcagccccagcaaatgtccccgcttcctgaaggtgaagaactgggagacagaggtggtgctgacagacaccctgcacctgaagagcaccctggagaccggctgcacagagtacatctgcatgggcagcatcatgcaccccagccagcacgcccggcggccagaagatgtgaggaccaagggccagctgttccccctggccaaggagttcatcgaccagtactacagcagcatcaagagatttggcagcaaggcccacatggagcggctggaggaggtgaacaaggagattgacaccaccagcacctaccagctgaaggacacagagctgatctacggggccaagcacgcctggagaaatgccagccgctgtgtgggccgcatccagtggagcaagctgcaggtgtttgatgcccgggactgcaccacagcccacggcatgttcaactacatctgcaaccacgtgaagtatgccaccaacaagggcaacctgcggagcgccatcaccatcttcccccagaggacagatggcaagcatgacttccgggtgtggaacagccagctgatccgctatgccggctacaagcagccagatggcagcaccctgggggaccctgccaacgtgcagttcacagagatctgcatccagcagggctggaagccaccccggggccgctttgatgtgctgcccctgctgctgcaggccaatggaaatgaccctgagctgttccagatccccccagagctggtgctggaggtgcccatccgccaccccaagtttgagtggttcaaggacctgggcctgaagtggtacggcctgcctgctgtgagcaacatgctgctggagattggaggcctggagttcagcgcctgccccttcagcggctggtacatgggcacagaaattggagtgcgggactactgtgacaacagccgctacaacatcctggaggaggtggccaagaagatgaacctggacatgaggaagaccagcagcctgtggaaggaccaggccctggtggagatcaacattgctgtgctgtacagcttccagagcgacaaggtgaccatcgtggaccaccacagcgccacagagagcttcatcaagcacatggagaatgagtaccgctgccggggcggctgcccagctgactgggtgtggatcgtgccccccatgagcggcagcatcacccctgtgttccaccaggagatgctgaactaccgcctgacccccagctttgagtaccagcctgacccctggaacacccacgtgtggaagggcaccaacggcacccccaccaagagaagagccatcggcttcaagaagctggccgaggccgtgaagttcagcgccaagctgatgggccaggccatggccaagagggtgaaggccaccatcctgtatgccacagagaccgggaagagccaggcctatgccaagaccctgtgtgagatcttcaagcacgcctttgatgccaaggtgatgtccatggaggagtatgacatcgtgcacctggagcacgagaccctggtgctggtggtgaccagcacctttggaaatggagaccccccagaaaatggagagaagtttggctgtgccctgatggagatgaggcaccccaacagcgtgcaggaggagaggaagagctacaaggtgcgcttcaacagcgtgtcctcctacagcgacagccagaagagcagtggagatggccctgacctgcgggacaactttgaatctgctggccccctggccaacgtgcgcttctctgtgtttggcctgggcagccgggcctacccccacttctgtgccttcggccatgctgtggacaccctgctggaggagctgggcggggagcgcatcctgaagatgagagaaggagatgagctgtgtggccaggaggaggccttccgcacctgggccaagaaggtgttcaaggccgcctgtgatgtgttctgtgtgggagatgatgtgaacatcgagaaggccaacaacagcctcatcagcaatgaccgctcctggaagaggaacaagttccggctgacctttgtggccgaggcccctgagctgacccagggcctgagcaatgtgcacaagaagagggtgtctgctgcccggctgctgagccggcagaacctgcagagccccaagagcagccgcagcaccatctttgtgcggctgcacaccaacggcagccaggagctgcagtaccagcccggggaccacctgggcgtcttccctggcaaccacgaggacctggtgaatgccctgattgagcggctggaggatgcccctcctgtgaaccagatggtgaaggtggagctgctggaggagaggaacacagccctgggcgtcatcagcaactggacagatgagctgcggctgcccccctgcaccatcttccaggccttcaagtactacctggacatcaccaccccacccacccccctgcagctgcagcagtttgccagcctggccaccagcgagaaggagaagcagaggctgctggtgctgagcaagggcctgcaggagtatgaggagtggaagtggggcaagaaccccaccatcgtggaggtgctggaggagttccccagcatccagatgcctgccaccctgctgctgacccagctgagcctgctgcagccccgctactacagcatcagcagcagcccagacatgtacccagatgaggtgcacctgactgtggccatcgtgtcctaccgcaccagagatggagagggccccatccaccacggcgtgtgcagctcctggctgaaccgcatccaggctgatgagctggtgccctgctttgtgcggggggcccccagcttccacctgcccaggaacccccaggtgccctgcatcctggtgggccctggcaccggcatcgcccccttccgctccttctggcagcagaggcagtttgacatccagcacaagggcatgaacccctgccccatggtgctggtgtttggctgccggcagagcaagattgaccacatctaccgggaggagaccctgcaggccaagaacaagggcgtcttccgggagctgtacacagcctacagccgggagccagacaagcccaagaagtatgtgcaggacatcctgcaggagcagctggccgagagcgtgtaccgggccctgaaggagcagggcggccacatctacgtgtgtggagatgtgaccatggctgctgatgtgctgaaggccatccagaggatcatgacccagcagggcaagctgtctgcagaagatgctggggtcttcatcagcaggatgagagatgacaaccgctaccacgaggacatcttcggcgtgaccctgcggacctatgaggtgaccaaccggctgcggtctgagagcatcgccttcatcgaggagagcaagaaggacacagatgaggtgttcagcagctag

SEQ ID NO: 161979 - DNA, 4407 bp, Artificial Sequence
  Description of Artificial Sequence: Synthetic coding sequence
atggaggaccacatgtttggagtgcagcagatccagcccaacgtcatctctgtgcggctcttcaagaggaaggtgggcggcctgggcttcctggtgaaggagcgggtgtccaagccccctgtgatcatcagtgacctgatccggggcggcgctgctgagcagagcggcctcatccaggccggggacatcatcctggccgtgaatggccggcccctggtggacctgtcctatgattctgccctggaggtgctgcggggcatcgccagcgagacccacgtggtgctgatcctgcggggccctgagggcttcaccacccacctggagaccaccttcaccggagatggcacccccaagaccatccgggtgacccagcccctgggcccccccaccaaggctgtggacctgagccaccagcccccagctgggaaggagcagcccctggccgtggatggagccagcggccctggaaatggcccccagcacgcctatgatgatggccaggaggccggcagcctgccccacgccaacggcctggccccccggcccccaggccaggaccctgccaagaaggccaccagggtgtccctgcagggcagaggagaaaataatgagctgctgaaggagattgagcctgtgctgagcctgctgaccagcggcagccggggcgtgaagggcggggccccagccaaggccgagatgaaggacatgggcatccaggtggaccgggacctggatggcaagagccacaagcccctgcccctgggcgtggagaatgacagagtcttcaatgacctgtggggcaaaggaaatgtgcctgtggtgctgaacaacccctacagcgagaaggagcagccccccaccagcggcaagcagagccccaccaagaatggcagccccagcaaatgtccccgcttcctgaaggtgaagaactgggagacagaggtggtgctgacagacaccctgcacctgaagagcaccctggagaccggctgcacagagtacatctgcatgggcagcatcatgcaccccagccagcacgcccggcggccagaagatgtgaggaccaagggccagctgttccccctggccaaggagttcatcgaccagtactacagcagcatcaagagatttggcagcaaggcccacatggagcggctggaggaggtgaacaaggagattgacaccaccagcacctaccagctgaaggacacagagctgatctacggggccaagcacgcctggagaaatgccagccgctgtgtgggccgcatccagtggagcaagctgcaggtgtttgatgcccgggactgcaccacagcccacggcatgttcaactacatctgcaaccacgtgaagtatgccaccaacaagggcaacctgcggagcgccatcaccatcttcccccagaggacagatggcaagcatgacttccgggtgtggaacagccagctgatccgctatgccggctacaagcagccagatggcagcaccctgggggaccctgccaacgtgcagttcacagagatctgcatccagcagggctggaagccaccccggggccgctttgatgtgctgcccctgctgctgcaggccaatggaaatgaccctgagctgttccagatccccccagagctggtgctggaggtgcccatccgccaccccaagtttgagtggttcaaggacctgggcctgaagtggtacggcctgcctgctgtgagcaacatgctgctggagattggaggcctggagttcagcgcctgccccttcagcggctggtacatgggcacagaaattggagtgcgggactactgtgacaacagccgctacaacatcctggaggaggtggccaagaagatgaacctggacatgaggaagaccagcagcctgtggaaggaccaggccctggtggagatcaacattgctgtgctgtacagcttccagagcgacaaggtgaccatcgtggaccaccacagcgccacagagagcttcatcaagcacatggagaatgagtaccgctgccggggcggctgcccagctgactgggtgtggatcgtgccccccatgagcggcagcatcacccctgtgttccaccaggagatgctgaactaccgcctgacccccagctttgagtaccagcctgacccctggaacacccacgtgtggaagggcaccaacggcacccccaccaagagaagagccatcggcttcaagaagctggccgaggccgtgaagttcagcgccaagctgatgggccaggccatggccaagagggtgaaggccaccatcctgtatgccacagagaccgggaagagccaggcctatgccaagaccctgtgtgagatcttcaagcacgcctttgatgccaaggtgatgtccatggaggagtatgacatcgtgcacctggagcacgagaccctggtgctggtggtgaccagcacctttggaaatggagaccccccagaaaatggagagaagtttggctgtgccctgatggagatgaggcaccccaacagcgtgcaggaggagaggaagtacccagagcccctgcgcttcttccccaggaaaggaccacccctgcccaatggagacacagaggtgcacggcctggccgccgcccgggacagccagcacaggagctacaaggtgcgcttcaacagcgtgtcctcctacagcgacagccagaagagcagtggagatggccctgacctgcgggacaactttgaatctgctggccccctggccaacgtgcgcttctctgtgtttggcctgggcagccgggcctacccccacttctgtgccttcggccatgctgtggacaccctgctggaggagctgggcggggagcgcatcctgaagatgagagaaggagatgagctgtgtggccaggaggaggccttccgcacctgggccaagaaggtgttcaaggccgcctgtgatgtgttctgtgtgggagatgatgtgaacatcgagaaggccaacaacagcctcatcagcaatgaccgctcctggaagaggaacaagttccggctgacctttgtggccgaggcccctgagctgacccagggcctgagcaatgtgcacaagaagagggtgtctgctgcccggctgctgagccggcagaacctgcagagccccaagagcagccgcagcaccatctttgtgcggctgcacaccaacggcagccaggagctgcagtaccagcccggggaccacctgggcgtcttccctggcaaccacgaggacctggtgaatgccctgattgagcggctggaggatgcccctcctgtgaaccagatggtgaaggtggagctgctggaggagaggaacacagccctgggcgtcatcagcaactggacagatgagctgcggctgcccccctgcaccatcttccaggccttcaagtactacctggacatcaccaccccacccacccccctgcagctgcagcagtttgccagcctggccaccagcgagaaggagaagcagaggctgctggtgctgagcaagggcctgcaggagtatgaggagtggaagtggggcaagaaccccaccatcgtggaggtgctggaggagttccccagcatccagatgcctgccaccctgctgctgacccagctgagcctgctgcagccccgctactacagcatcagcagcagcccagacatgtacccagatgaggtgcacctgactgtggccatcgtgtcctaccgcaccagagatggagagggccccatccaccacggcgtgtgcagctcctggctgaaccgcatccaggctgatgagctggtgccctgctttgtgcggggggcccccagcttccacctgcccaggaacccccaggtgccctgcatcctggtgggccctggcaccggcatcgcccccttccgctccttctggcagcagaggcagtttgacatccagcacaagggcatgaacccctgccccatggtgctggtgtttggctgccggcagagcaagattgaccacatctaccgggaggagaccctgcaggccaagaacaagggcgtcttccgggagctgtacacagcctacagccgggagccagacaagcccaagaagtatgtgcaggacatcctgcaggagcagctggccgagagcgtgtaccgggccctgaaggagcagggcggccacatctacgtgtgtggagatgtgaccatggctgctgatgtgctgaaggccatccagaggatcatgacccagcagggcaagctgtctgcagaagatgctggggtcttcatcagcaggatgagagatgacaaccgctaccacgaggacatcttcggcgtgaccctgcggacctatgaggtgaccaaccggctgcggtctgagagcatcgccttcatcgaggagagcaagaaggacacagatgaggtgttcagcagctag

SEQ ID NO: 161980 - DNA, 1224 bp, Artificial Sequence
  Description of Artificial Sequence: Synthetic coding sequence
atggaggaccacatgtttggagtgcagcagatccagcccaacgtcatctctgtgcggctcttcaagaggaaggtgggcggcctgggcttcctggtgaaggagcgggtgtccaagccccctgtgatcatcagtgacctgatccggggcggcgctgctgagcagagcggcctcatccaggccggggacatcatcctggccgtgaatggccggcccctggtggacctgtcctatgattctgccctggaggtgctgcggggcatcgccagcgagacccacgtggtgctgatcctgcggggccctgagggcttcaccacccacctggagaccaccttcaccggagatggcacccccaagaccatccgggtgacccagcccctgggcccccccaccaaggctgtggacctgagccaccagcccccagctgggaaggagcagcccctggccgtggatggagccagcggccctggaaatggcccccagcacgcctatgatgatggccaggaggccggcagcctgccccacgccaacggcctggccccccggcccccaggccaggaccctgccaagaaggccaccagggtgtccctgcagggcagaggagaaaataatgagctgctgaaggagattgagcctgtgctgagcctgctgaccagcggcagccggggcgtgaagggcggggccccagccaaggccgagatgaaggacatgggcatccaggtggaccgggacctggatggcaagagccacaagcccctgcccctgggcgtggagaatgacagagtcttcaatgacctgtggggcaaaggaaatgtgcctgtggtgctgaacaacccctacagcgagaaggagcagatgaggaagctgcgcatcacagagggctttggagcccagaggggcagccacaaccaccccccaccccaggagaacagccccccccagaggatggccgccccacccagcgtgcacgccagcagccgcagcaggacaggccgcctgcgctggttcagcctgacccccagcaccctgcgggcccactggaagagagatgccctgagcaccagcgcctgggcccccagctgcatcctgctgtccatgcagggcggcctgaagaccagcgcccagaaggacagcagcagcctgagccccaagagcctgctgatcaacaccatccaccagctgaaggacctggcccccaagcccacctggaagggctggaagaggtag

SEQ ID NO: 161981 - DNA, 3993 bp, Artificial Sequence
  Description of Artificial Sequence: Synthetic coding sequence
atggaggaccacatgtttggagtgcagcagatccagcccaacgtcatctctgtgcggctcttcaagaggaaggtgggcggcctgggcttcctggtgaaggagcgggtgtccaagccccctgtgatcatcagtgacctgatccggggcggcgctgctgagcagagcggcctcatccaggccggggacatcatcctggccgtgaatggccggcccctggtggacctgtcctatgattctgccctggaggtgctgcggggcatcgccagcgagacccacgtggtgctgatcctgcggggccctgagggcttcaccacccacctggagaccaccttcaccggagatggcacccccaagaccatccgggtgacccagcccctgggcccccccaccaaggctgtggacctgagccaccagcccccagctgggaaggagcagcccctggccgtggatggagccagcggccctggaaatggcccccagcacgcctatgatgatggccaggaggccggcagcctgccccacgccaacggcctggccccccggcccccaggccaggaccctgccaagaaggccaccagggtgtccctgcagggcagaggagaaaataatgagctgctgaaggagattgagcctgtgctgagcctgctgaccagcggcagccggggcgtgaagggcggggccccagccaaggccgagatgaaggacatgggcatccaggtggaccgggacctggatggcaagagccacaagcccctgcccctgggcgtggagaatgacagagtcttcaatgacctgtggggcaaaggaaatgtgcctgtggtgctgaacaacccctacagcgagaaggagcagccccccaccagcggcaagcagagccccaccaagaatggcagccccagcaaatgtccccgcttcctgaaggtgaagaactgggagacagaggtggtgctgacagacaccctgcacctgaagagcaccctggagaccggctgcacagagtacatctgcatgggcagcatcatgcaccccagccagcacgcccggcggccagaagatgtgaggaccaagggccagctgttccccctggccaaggagttcatcgaccagtactacagcagcatcaagagatttggcagcaaggcccacatggagcggctggaggaggtgaacaaggagattgacaccaccagcacctaccagctgaaggacacagagctgatctacggggccaagcacgcctggagaaatgccagccgctgtgtgggccgcatccagtggagcaagctgcaggtgtttgatgcccgggactgcaccacagcccacggcatgttcaactacatctgcaaccacgtgaagtatgccaccaacaagggcaacctgcggagcgccatcaccatcttcccccagaggacagatggcaagcatgacttccgggtgtggaacagccagctgatccgctatgccggctacaagcagccagatggcagcaccctgggggaccctgccaacgtgcagttcacagaggaggtggccaagaagatgaacctggacatgaggaagaccagcagcctgtggaaggaccaggccctggtggagatcaacattgctgtgctgtacagcttccagagcgacaaggtgaccatcgtggaccaccacagcgccacagagagcttcatcaagcacatggagaatgagtaccgctgccggggcggctgcccagctgactgggtgtggatcgtgccccccatgagcggcagcatcacccctgtgttccaccaggagatgctgaactaccgcctgacccccagctttgagtaccagcctgacccctggaacacccacgtgtggaagggcaccaacggcacccccaccaagaggcgggccatcggcttcaagaagctggccgaggccgtgaagttcagcgccaagctgatgggccaggccatggccaagagggtgaaggccaccatcctgtatgccacagaaacaggcaagagccaggcctatgccaagaccctgtgtgagatcttcaagcacgcctttgatgccaaggtgatgtccatggaggagtatgacatcgtgcacctggagcacgagaccctggtgctggtggtgaccagcacctttggaaatggagaccccccagaaaatggagagaagtttggctgtgccctgatggagatgaggcaccccaacagcgtgcaggaggagaggaagagctacaaggtgcgcttcaacagcgtgagcagctacagcgacagccagaagagcagtggagatggccctgacctgcgggacaactttgagagcgctggccccctggccaacgtgcgcttctctgtgtttggcctgggcagccgggcctacccccacttctgtgcctttggacatgctgtggacaccctgctggaggagctgggcggggagcgcatcctgaagatgagagaaggagatgagctgtgtggccaggaggaggccttccgcacctgggccaagaaggtgttcaaggccgcctgtgatgtgttctgtgtgggagatgatgtgaacatcgagaaggccaacaacagcctcatcagcaatgaccgctcctggaagaggaacaagttccggctgacctttgtggccgaggcccctgagctgacccagggcctgagcaatgtgcacaagaagagggtgtctgctgcccggctgctgagccggcagaacctgcagagccccaagagcagccgcagcaccatctttgtgcggctgcacaccaacggcagccaggagctgcagtaccagcccggggaccacctgggcgtcttccctggcaaccacgaggacctggtgaatgccctgattgaaaggctggaggatgcccctcctgtgaaccagatggtgaaggtggagctgctggaggagaggaacacagccctgggcgtcatcagcaactggacagatgagctgcggctgcccccctgcaccatcttccaggccttcaagtactacctggacatcaccaccccacccacccccctgcagctgcagcagtttgccagcctggccaccagcgagaaggagaagcagaggctgctggtgctgagcaagggcctgcaggagtatgaggagtggaagtggggcaagaaccccaccatcgtggaggtgctggaggagttccccagcatccagatgcctgccaccctgctgctgacccagctgagcctgctgcagccccgctactacagcatcagcagcagcccagacatgtacccagatgaggtgcacctgactgtggccatcgtgtcctaccgcaccagagatggagagggccccatccaccacggcgtgtgcagctcctggctgaaccgcatccaggctgatgagctggtgccctgctttgtgcggggggcccccagcttccacctgcccaggaacccccaggtgccctgcatcctggtgggccctggcactggaattgcccccttccgctccttctggcagcagaggcagtttgacatccagcacaagggcatgaacccctgccccatggtgctggtgtttggctgccggcagagcaagattgaccacatctaccgggaggagaccctgcaggccaagaacaagggcgtcttccgggagctgtacacagcctacagccgggagccagacaagcccaagaagtatgtgcaggacatcctgcaggagcagctggccgagagcgtgtaccgggccctgaaggagcagggcggccacatctacgtgtgtggagatgtgaccatggccgcagatgtgctgaaggccatccagaggatcatgacccagcagggcaagctgtctgcagaagatgctggggtcttcatcagcaggatgagagatgacaaccgctaccacgaggacatctttggagtgaccctgcggacctatgaggtgaccaaccggctgcggtctgagagcatcgccttcatcgaggagagcaagaaggacacagatgaccaggtgttcaagacctag

SEQ ID NO: 161982 - DNA, 3621 bp, Artificial Sequence
  Description of Artificial Sequence: Synthetic coding sequence
atggaggaccacatgtttggagtgcagcagatccagcccaacgtcatctctgtgcggctcttcaagaggaaggtgggcggcctgggcttcctggtgaaggagcgggtgtccaagccccctgtgatcatcagtgacctgatccggggcggcgctgctgagcagagcggcctcatccaggccggggacatcatcctggccgtgaatggccggcccctggtggacctgtcctatgattctgccctggaggtgctgcggggcatcgccagcgagacccacgtggtgctgatcctgcggggccctgagggcttcaccacccacctggagaccaccttcaccggagatggcacccccaagaccatccgggtgacccagcccctgggcccccccaccaaggctgtggacctgagccaccagcccccagctgggaaggagcagcccctggccgtggatggagccagcggccctggaaatggcccccagcacgcctatgatgatggccaggaggccggcagcctgccccacgccaacggcctggccccccggcccccaggccaggaccctgccaagaaggccaccagggtgtccctgcagggcagaggagaaaataatgagctgctgaaggagattgagcctgtgctgagcctgctgaccagcggcagccggggcgtgaagggcggggccccagccaaggccgagatgaaggacatgggcatccaggtggaccgggacctggatggcaagagccacaagcccctgcccctgggcgtggagaatgacagagtcttcaatgacctgtggggcaaaggaaatgtgcctgtggtgctgaacaacccctacagcgagaaggagcagccccccaccagcggcaagcagagccccaccaagaatggcagccccagcaaatgtccccgcttcctgaaggtgaagaactgggagacagaggtggtgctgacagacaccctgcacctgaagagcaccctggagaccggctgcacagagtacatctgcatgggcagcatcatgcaccccagccagcacgcccggcggccagaagatgtgaggaccaagggccagctgttccccctggccaaggagttcatcgaccagtactacagcagcatcaagagatttggcagcaaggcccacatggagcggctggaggaggtgaacaaggagattgacaccaccagcacctaccagctgaaggacacagagctgatctacggggccaagcacgcctggagaaatgccagccgctgtgtgggccgcatccagtggagcaagctgcaggtgtttgatgcccgggactgcaccacagcccacggcatgttcaactacatctgcaaccacgtgaagtatgccaccaacaagggcaacctgcggagcgccatcaccatcttcccccagaggacagatggcaagcatgacttccgggtgtggaacagccagctgatccgctatgccggctacaagcagccagatggcagcaccctgggggaccctgccaacgtgcagttcacagagatctgcatccagcagggctggaagccaccccggggccgctttgatgtgctgcccctgctgctgcaggccaatggaaatgaccctgagctgttccagatccccccagagctggtgctggaggtgcccatccgccaccccaagtttgagtggttcaaggacctgggcctgaagtggtacggcctgcctgctgtgagcaacatgctgctggagattggaggcctggagttcagcgcctgccccttcagcggctggtacatgggcacagaaattggagtgcgggactactgtgacaacagccgctacaacatcctggaggaggtggccaagaagatgaacctggacatgaggaagaccagcagcctgtggaaggaccaggccctggtggagatcaacattgctgtgctgtacagcttccagagcgacaaggtgaccatcgtggaccaccacagcgccacagagagcttcatcaagcacatggagaatgagtaccgctgccggggcggctgcccagctgactgggtgtggatcgtgccccccatgagcggcagcatcacccctgtgttccaccaggagatgctgaactaccgcctgacccccagctttgagtaccagcctgacccctggaacacccacgtgtggaagggcaccaacggcacccccaccaagagaagagccatcggcttcaagaagctggccgaggccgtgaagttcagcgccaagctgatgggccaggccatggccaagagggtgaaggccaccatcctgtatgccacagagaccgggaagagccaggcctatgccaagaccctgtgtgagatcttcaagcacgcctttgatgccaaggtgatgtccatggaggagtatgacatcgtgcacctggagcacgagaccctggtgctggtggtgaccagcacctttggaaatggagaccccccagaaaatggagagaagtttggctgtgccctgatggagatgaggcaccccaacagcgtgcaggaggagaggaagagctacaaggtgcgcttcaacagcgtgtcctcctacagcgacagccagaagagcagtggagatggccctgacctgcgggacaactttgaatctgctggccccctggccaacgtgcgcttctctgtgtttggcctgggcagccgggcctacccccacttctgtgccttcggccatgctgtggacaccctgctggaggagctgggcggggagcgcatcctgaagatgagagaaggagatgagctgtgtggccaggaggaggccttccgcacctgggccaagaaggtgttcaaggccgcctgtgatgtgttctgtgtgggagatgatgtgaacatcgagaaggccaacaacagcctcatcagcaatgaccgctcctggaagaggaacaagttccggctgacctttgtggccgaggcccctgagctgacccagggcctgagcaatgtgcacaagaagagggtgtctgctgcccggctgctgagccggcagaacctgcagagccccaagagcagccgcagcaccatctttgtgcggctgcacaccaacggcagccaggagctgcagtaccagcccggggaccacctgggcgtcttccctggcaaccacgaggacctggtgaatgccctgattgagcggctggaggatgcccctcctgtgaaccagatggtgaaggtggagctgctggaggagaggaacacagccctgggcgtcatcagcaactggacagatgagctgcggctgcccccctgcaccatcttccaggccttcaagtactacctggacatcaccaccccacccacccccctgcagctgcagcagtttgccagcctggccaccagcgagaaggagaagcagaggctgctggtgctgagcaagggcctgcaggagtatgaggagtggaagtggggcaagaaccccaccatcgtggaggtgctggaggagttccccagcatccagatgcctgccaccctgctgctgacccagctgagcctgctgcagccccgctactacagcatcagcagcagcccccacacccacaccctgtctgagacccggcccagccccctgcccctgagcagccagtgctgctag

SEQ ID NO: 161983 - DNA, 204 bp, Artificial Sequence
  Description of Artificial Sequence: Synthetic coding sequence
caccccaacagcgtgcaggaggagaggaagtacccagagcccctgcgcttcttccccaggaaaggaccacccctgcccaatggagacacagaggtgcacggcctggccgccgcccgggacagccagcacaggagctacaaggtgcgcttcaacagcgtgtcctcctacagcgacagccagaagagcagtggagatggcccctag

SEQ ID NO: 161984 - DNA, 1521 bp, Artificial Sequence
  Description of Artificial Sequence: Synthetic coding sequence
atgcccagcaagaccaagtacaacctggtggatgatggccatgacctgcgcatccccctgcacaatgaagatgccttccagcacggcatctgctttgaggccaagtatgtgggcagcctggatgtgccccggcccaacagccgggtggagatcgtggccgccatgaggcgcatccgctatgagttcaaggccaagaacatcaagaagaagaaggtgtccatcatggtgtctgtggatggagtgaaggtgatcctgaagaagaagaagaagctgctgctgctgcagaagaaggagtggacctgggatgagagcaagatgctggtgatgcaggaccccatctaccgcatcttctacgtgtcccatgacagccaggacctgaagatcttctcctacatcgccagagatggagccagcaacatcttccgctgcaatgtgttcaagagcaagaagaagagccaggccatgagaattgtgaggacagtgggccaggcctttgaggtgtgccacaagctgagcctgcagcacacccagcagaatgctgatggccaggaggatggagagagcgagaggaacagcaacagcagcggggaccccggccggcagctgactggagctgagcgggccagcacagccacagctgaggagacagacattgatgctgtggaggtgcccctgcctggaaatgatgtgctggagttcagccggggcgtgacagacctggatgctgtgggcaaggagggcggcagccacacaggcagcaaggtgagccacccccaggagcccatgctgacagccagccccaggatgctgctgcccagcagcagcagcaagcccccaggcctgggcacagagacccccctgagcacccaccaccagatgcagctgctgcagcagctgctgcagcagcagcagcagcagacccaggtggccgtggcccaggtgcacctgctgaaggaccagctggccgctgaggccgccgcccggctggaggcccaggcccgggtgcaccagctgctgctgcagaacaaggacatgctgcagcacatcagcctgctggtgaagcaggtgcaggagctggagctgaagctgagcggccagaatgccatgggcagccaggacagcctgctggagatcaccttccgcagcggggccctgcctgtgctgtgtgaccccaccacccccaagccagaggacctgcacagcccccccctgggcgccggcctggccgactttgcccaccctgctggcagccccctgggcagaagagactgcctggtgaagctggagtgcttccgcttcctgcccccagaggacaccccacctccagcccagggcgaggccctgctgggcggcctggagctgatcaagttccgggagagcggcatcgcctctgaatatgagagcaacacagatgaaagtgaggagcgggacagctggagccaggaggagctgccccggctgctgaatgtgctgcagaggcaggagctgggagatggcctggatgatgaaattgctgtgtag

SEQ ID NO: 161985 - DNA, 636 bp, Artificial Sequence
  Description of Artificial Sequence: Synthetic coding sequence
atgagcctgagcagcctgtgccctgtgttttctgctgctgccagcagcctgcaggtgcacctgctgaaggaccagctggccgctgaggccgccgcccggctggaggcccaggcccgggtgcaccagctgctgctgcagaacaaggacatgctgcagcacatcagcctgctggtgaagcaggtgcaggagctggagctgaagctgagcggccagaatgccatgggcagccaggacagcctgctggagatcaccttccgcagcggggccctgcctgtgctgtgtgaccccaccacccccaagccagaggacctgcacagcccccccctgggcgccggcctggccgactttgcccaccctgctggcagccccctgggccggcgggactgcctggtgaagctggagtgcttccgcttcctgcccccagaggacaccccacctccagcccagggcgaggccctgctgggcggcctggagctgatcaagttccgggagagcggcatcgcctctgaatatgagagcaacacagatgagagcgaggagcgggacagctggagccaggaggagctgccccggctgctgaatgtgctgcagaggcaggagctgggagatggcctggatgatgaaattgctgtgtag

SEQ ID NO: 161986 - DNA, 1506 bp, Artificial Sequence
  Description of Artificial Sequence: Synthetic coding sequence
atgcccagcaagaccaagtacaacctggtggatgatggccatgacctgcgcatccccctgcacaatgaagatgccttccagcacggcatctgctttgaggccaagtatgtgggcagcctggatgtgccccggcccaacagccgggtggagatcgtggccgccatgaggcgcatccgctatgagttcaaggccaagaacatcaagaagaagaaggtgtccatcatggtgtctgtggatggagtgaaggtgatcctgaagaagaagaagaagaagaaggagtggacctgggatgagagcaagatgctggtgatgcaggaccccatctaccgcatcttctacgtgtcccatgacagccaggacctgaagatcttctcctacatcgccagagatggagccagcaacatcttccgctgcaatgtgttcaagagcaagaagaagagccaggccatgagaattgtgaggacagtgggccaggcctttgaggtgtgccacaagctgagcctgcagcacacccagcagaatgctgatggccaggaggatggagagagcgagaggaacagcaacagcagcggggaccccggccggcagctgaccggggctgagcgggccagcacagccacagctgaggagacagacattgatgctgtggaggtgcccctgcctggaaatgatgtgctggagttcagcagaggagtgacagacctggatgctgtgggcaaggagggcggcagccacacaggcagcaaggtgagccacccccaggagcccatgctgacagccagccccaggatgctgctgcccagcagcagcagcaagcccccaggcctgggcacagagacccccctgagcacccaccaccagatgcagctgctgcagcagctgctgcagcagcagcagcagcagacccaggtggccgtggcccaggtgcacctgctgaaggaccagctggccgctgaggccgccgcccggctggaggcccaggcccgggtgcaccagctgctgctgcagaacaaggacatgctgcagcacatcagcctgctggtgaagcaggtgcaggagctggagctgaagctgagcggccagaatgccatgggcagccaggacagcctgctggagatcaccttccgcagcggggccctgcctgtgctgtgtgaccccaccacccccaagccagaggacctgcacagcccccccctgggcgccggcctggccgactttgcccaccctgctggcagccccctgggccggcgggactgcctggtgaagctggagtgcttccgcttcctgcccccagaggacaccccacctccagcccagggcgaggccctgctgggcggcctggagctgatcaagttccgggagagcggcatcgcctctgaatatgagagcaacacagatgagagcgaggagcgggacagctggagccaggaggagctgccccggctgctgaatgtgctgcagaggcaggagctgggagatggcctggatgatgaaattgctgtgtag

SEQ ID NO: 161987 - DNA, 2190 bp, Artificial Sequence
  Description of Artificial Sequence: Synthetic coding sequence
atggcctgcccctggaagttcctgttcaagaccaagttccaccagtatgccatgaatggagagaaggacatcaacaacaacgtggagaaggccccctgtgccaccagcagccctgtgacccaggatgacctgcagtaccacaacctgagcaagcagcagaatgaaagcccccagcccctggtggagaccgggaagaagagccctgagagcctggtgaagctggatgccacccccctgagcagccccaggcatgtgcgcatcaagaactggggcagcggcatgaccttccaggacaccctgcaccacaaggccaagggcatcctgacctgccgcagcaagagctgcctgggcagcatcatgacccccaagagcctgacccggggcccccgggacaagcccaccccaccagatgagctgctgccccaggccatcgagtttgtgaaccagtactacggcagcttcaaggaggccaagattgaggagcacctggcccgggtggaggccgtgaccaaggagattgagaccaccggcacctaccagctgactggagatgagctgatctttgccaccaagcaggcctggagaaatgccccccgctgcatcggccgcatccagtggagcaacctgcaggtgtttgatgcccggagctgcagcacagcccgggagatgtttgagcacatctgccgccacgtgcgctacagcaccaacaatggaaacatccgcagcgccatcaccgtcttcccccagaggagtgatggcaagcatgacttccgggtgtggaatgcccagctgatccgctatgccggctaccagatgccagatggcagcatccggggggaccctgccaacgtggagttcacccagctgtgcatcgacctgggctggaagcccaagtatggccgctttgatgtggtgcccctggtgctgcaggccaacggccgggaccctgagctgtttgagatccccccagacctggtgctggaggtggccatggagcaccccaagtatgagtggttccgggagctggagctgaagtggtacgccctgcctgctgtggccaacatgctgctggaggtgggcggcctggagttccctggctgccccttcaacggctggtacatgggcacagaaattggagtgcgggacttctgtgatgtgcagcgctacaacatcctggaggaggtgggccgcaggatgggcctggagacccacaagctggccagcctgtggaaggaccaggccgtggtggagatcaacattgctgtgctgcacagcttccagaagcagaatgtgaccatcatggaccaccacagcgctgctgagagcttcatgaagtacatgcagaatgagtaccgcagcagaggaggctgcccagctgactggatctggctggtgccccccatgagcggcagcatcacccctgtgttccaccaggagatgctgaactacgtgctgagccccttctactactaccaggtggaggcctggaagacccacgtgtggcaggatgagaagaggcggcccaagaggcgggagatccccctgaaggtgctggtgaaggctgtgctgtttgcctgcatgctgatgaggaagaccatggccagccgggtgcgggtgaccatcctgtttgccacagaaacaggcaagtctgaggccctggcctgggacctgggcgccctcttcagctgtgccttcaaccccaagaagctgaagaagagcctcttcatgctgaaggagctgaacaacaagttccgctatgctgtgtttggcctgggcagctccatgtacccccgcttctgtgcctttgcccatgacatcgaccagaagctgagccacctgggcgccagccagctgacccccatgggagaaggagatgagctgagcggccaggaggatgccttccgctcctgggccgtgcagaccttcaaggccgcctgtgagacctttgatgtgcggggcaagcagcacatccagatccccaagctgtacaccagcaatgtgacctgggacccccaccactaccgcctggtgcaggacagccagcccctgcctgctgccagcaccagcccccgcatcccccccatcctggccagcagcagcggcctggcccaggccagccggcccagcgctgtgtctggcagcaatggctccatgacccccagcacccgggagtgtggggaggccgcctag

SEQ ID NO: 161988 - DNA, 3462 bp, Artificial Sequence
  Description of Artificial Sequence: Synthetic coding sequence
atggcctgcccctggaagttcctgttcaagaccaagttccaccagtatgccatgaatggagagaaggacatcaacaacaacgtggagaaggccccctgtgccaccagcagccctgtgacccaggatgacctgcagtaccacaacctgagcaagcagcagaatgaaagcccccagcccctggtggagaccgggaagaagagccctgagagcctggtgaagctggatgccacccccctgagcagccccaggcatgtgcgcatcaagaactggggcagcggcatgaccttccaggacaccctgcaccacaaggccaagggcatcctgacctgccgcagcaagagctgcctgggcagcatcatgacccccaagagcctgacccggggcccccgggacaagcccaccccaccagatgagctgctgccccaggccatcgagtttgtgaaccagtactacggcagcttcaaggaggccaagattgaggagcacctggcccgggtggaggccgtgaccaaggagattgagaccaccggcacctaccagctgactggagatgagctgatctttgccaccaagcaggcctggagaaatgccccccgctgcatcggccgcatccagtggagcaacctgcaggtgtttgatgcccggagctgcagcacagcccgggagatgtttgagcacatctgccgccacgtgcgctacagcaccaacaatggaaacatccgcagcgccatcaccgtcttcccccagaggagtgatggcaagcatgacttccgggtgtggaatgcccagctgatccgctatgccggctaccagatgccagatggcagcatccggggggaccctgccaacgtggagttcacccagctgtgcatcgacctgggctggaagcccaagtatggccgctttgatgtggtgcccctggtgctgcaggccaacggccgggaccctgagctgtttgagatccccccagacctggtgctggaggtggccatggagcaccccaagtatgagtggttccgggagctggagctgaagtggtacgccctgcctgctgtggccaacatgctgctggaggtgggcggcctggagttccctggctgccccttcaacggctggtacatgggcacagaaattggagtgcgggacttctgtgatgtgcagcgctacaacatcctggaggaggtgggccgcaggatgggcctggagacccacaagctggccagcctgtggaaggaccaggccgtggtggagatcaacattgctgtgctgcacagcttccagaagcagaatgtgaccatcatggaccaccacagcgctgctgagagcttcatgaagtacatgcagaatgagtaccgcagcagaggaggctgcccagctgactggatctggctggtgccccccatgagcggcagcatcacccctgtgttccaccaggagatgctgaactacgtgctgagccccttctactactaccaggtggaggcctggaagacccacgtgtggcaggatgagaagaggcggcccaagaggcgggagatccccctgaaggtgctggtgaaggctgtgctgtttgcctgcatgctgatgaggaagaccatggccagccgggtgcgggtgaccatcctgtttgccacagaaacaggcaagtctgaggccctggcctgggacctgggcgccctcttcagctgtgccttcaaccccaaggtggtgtgcatggacaagtaccgcctgagctgcctggaggaggagcggctgctgctggtggtgaccagcacctttggaaatggagactgccctggaaatggagagaagctgaagaagagcctcttcatgctgaaggagctgaacaacaagttccgctatgctgtgtttggcctgggcagctccatgtacccccgcttctgtgcctttgcccatgacatcgaccagaagctgagccacctgggcgccagccagctgacccccatgggagaaggagatgagctgagcggccaggaggatgccttccgctcctgggccgtgcagaccttcaaggccgcctgtgagacctttgatgtgcggggcaagcagcacatccagatccccaagctgtacaccagcaatgtgacctgggacccccaccactaccgcctggtgcaggacagccagcccctggacctgagcaaggccctgagctccatgcacgccaagaatgtgttcaccatgaggctgaagagccggcagaacctgcagagccccaccagcagccgggccaccatcctggtggagctgagctgtgaagatggccagggcctgaactacctgcctggagagcacctgggcgtgtgccccggcaaccagcctgccctggtgcagggcatcctggagcgggtggtggatggccccaccccccaccagacagtgcggctggaggccctggatgaaagtggcagctactgggtgtctgacaagaggctgcccccctgcagcctgagccaggccctgacctacttcctggacatcaccaccccacccacccagctgctgctgcagaagctggcccaggtggccacagaggagcctgagcggcagaggctggaggccctgtgccagcccagcgagtacagcaagtggaagttcaccaacagccccaccttcctggaggtgctggaggagttccccagcctgcgggtgtctgctggcttcctgctgagccagctgcccatcctgaagccccgcttctacagcatcagcagcagccgggaccacacccccacagagatccacctgactgtggccgtggtgacctaccacaccagagatggccagggccccctgcaccacggcgtgtgcagcacctggctgaacagcctgaagccccaggaccctgtgccctgctttgtgagaaatgccagcggcttccacctgcctgaggaccccagccacccctgcatcctgattggccctggcaccggcatcgcccccttccgctccttctggcagcagaggctgcatgacagccagcacaagggcgtgcggggcggccgcatgaccctggtgtttggctgcagaagaccagatgaggaccacatctaccaggaggagatgctggagatggcccagaagggcgtgctgcatgctgtgcacacagcctacagccggctgcccgggaagcccaaggtgtatgtgcaggacatcctgcggcagcagctggccagcgaggtgctgcgggtgctgcacaaggagcccggccacctgtatgtgtgtggagatgtgaggatggccagagatgtggcccacaccctgaagcagctggtggccgccaagctgaagctgaatgaggagcaggtggaggactacttcttccagctgaagagccagaagcgctaccacgaggacatctttggagctgtgttcccctatgaggccaagaaggacagagtggccgtgcagcccagcagcctggagatgtctgccctgtag

SEQ ID NO: 161989 - DNA, 3345 bp, Artificial Sequence
  Description of Artificial Sequence: Synthetic coding sequence
atggcctgcccctggaagttcctgttcaagaccaagttccaccagtatgccatgaatggagagaaggacatcaacaacaacgtggagaaggccccctgtgccaccagcagccctgtgacccaggatgacctgcagtaccacaacctgagcaagcagcagaatgaaagcccccagcccctggtggagaccgggaagaagagccctgagagcctggtgaagctggatgccacccccctgagcagccccaggcatgtgcgcatcaagaactggggcagcggcatgaccttccaggacaccctgcaccacaaggccaagggcatcctgacctgccgcagcaagagctgcctgggcagcatcatgacccccaagagcctgacccggggcccccgggacaagcccaccccaccagatgagctgctgccccaggccatcgagtttgtgaaccagtactacggcagcttcaaggaggccaagattgaggagcacctggcccgggtggaggccgtgaccaaggagattgagaccaccggcacctaccagctgactggagatgagctgatctttgccaccaagcaggcctggagaaatgccccccgctgcatcggccgcatccagtggagcaacctgcaggtgtttgatgcccggagctgcagcacagcccgggagatgtttgagcacatctgccgccacgtgcgctacagcaccaacaatggaaacatccgcagcgccatcaccgtcttcccccagaggagtgatggcaagcatgacttccgggtgtggaatgcccagctgtgcatcgacctgggctggaagcccaacggccgggaccctgagctgtttgagatccccccagacctggtgctggaggtggccatggagcaccccaagtatgagtggttccgggagctggagctgaagtggtacgccctgcctgctgtggccaacatgctgctggaggtgggcggcctggagttccctggctgccccttcaacggctggtacatgggcacagaaattggagtgcgggacttctgtgatgtgcagcgctacaacatcctggaggaggtgggccgcaggatgggcctggagacccacaagctggccagcctgtggaaggaccaggccgtggtggagatcaacattgctgtgctgcacagcttccagaagcagaatgtgaccatcatggaccaccacagcgctgctgagagcttcatgaagtacatgcagaatgagtaccgcagccggggcggctgcccagctgactggatctggctggtgccccccatgagcggcagcatcacccctgtgttccaccaggagatgctgaactacgtgctgagccccttctactactaccaggtggaggcctggaagacccacgtgtggcaggatgagaagagaagacccaagagaagagagatccccctgaaggtgctggtgaaggctgtgctgtttgcctgcatgctgatgaggaagaccatggccagccgggtgcgggtgaccatcctgtttgccacagagaccgggaagtctgaggccctggcctgggacctgggcgccctcttcagctgtgccttcaaccccaaggtggtgtgcatggacaagtaccgcctgagctgcctggaggaggagcggctgctgctggtggtgaccagcacctttggaaatggagactgccctggaaatggagagaagctgaagaagagcctcttcatgctgaaggagctgaacaacaagttccgctatgctgtgtttggcctgggcagctccatgtacccccgcttctgtgcctttgcccatgacatcgaccagaagctgagccacctgggcgccagccagctgacccccatgggagaaggagatgagctgagcggccaggaggatgccttccgctcctgggccgtgcagaccttcaaggccgcctgtgagacctttgatgtgcggggcaagcagcacatccagatccccaagctgtacaccagcaatgtgacctgggacccccaccactaccgcctggtgcaggacagccagcccctggacctgagcaaggccctgagctccatgcacgccaagaatgtgttcaccatgaggctgaagagccggcagaacctgcagagccccaccagcagccgggccaccatcctggtggagctgagctgtgaagatggccagggcctgaactacctgcccggggagcacctgggcgtgtgccccggcaaccagcctgccctggtgcagggcatcctggagcgggtggtggatggccccaccccccaccagacagtgcggctggaggccctggatgagagcggcagctactgggtgtctgacaagaggctgcccccctgcagcctgagccaggccctgacctacttcctggacatcaccaccccacccacccagctgctgctgcagaagctggcccaggtggccacagaggagcctgagcggcagaggctggaggccctgtgccagcccagcgagtacagcaagtggaagttcaccaacagccccaccttcctggaggtgctggaggagttccccagcctgcgggtgtctgctggcttcctgctgagccagctgcccatcctgaagccccgcttctacagcatcagcagcagccgggaccacacccccacagagatccacctgactgtggccgtggtgacctaccacaccagagatggccagggccccctgcaccacggcgtgtgcagcacctggctgaacagcctgaagccccaggaccctgtgccctgctttgtgagaaatgccagcggcttccacctgcctgaggaccccagccacccctgcatcctgattggccctggcactggaattgcccccttccgctccttctggcagcagaggctgcatgacagccagcacaagggcgtgcggggcggccgcatgaccctggtgtttggctgccggcggccagatgaggaccacatctaccaggaggagatgctggagatggcccagaagggcgtgctgcatgctgtgcacacagcctacagccggctgcccgggaagcccaaggtgtatgtgcaggacatcctgcggcagcagctggccagcgaggtgctgcgggtgctgcacaaggagcccggccacctgtatgtgtgtggagatgtgaggatggccagagatgtggcccacaccctgaagcagctggtggccgccaagctgaagctgaatgaggagcaggtggaggactacttcttccagctgaagagccagaagcgctaccacgaggacatctttggagctgtgttcccctatgaggccaagaaggacagagtggccgtgcagcccagcagcctggagatgtctgccctgtag

SEQ ID NO: 161990 - DNA, 3612 bp, Artificial Sequence
  Description of Artificial Sequence: Synthetic coding sequence
atgggcaacctgaagtctgtggcccaggagcccggccccccctgtggcctgggcctgggcctgggcctgggcctgtgtgggaagcagggccctgccaccccagcccctgagcccagccgggccccagccagcctgctgcccccagcccctgagcacagcccccccagcagccccctgacccagcccccagagggccccaagttcccccgggtgaagaactgggaggtgggcagcatcacctatgacaccctgagcgcccaggcccagcaggacggcccctgcaccccccggcgctgcctgggcagcctggtgttccccaggaagctgcagggccggcccagccctggccccccagcccctgagcagctgctgagccaggcccgggacttcatcaaccagtactacagcagcatcaagaggagcggcagccaggcccacgagcagaggctgcaggaggtggaggccgaggtggccgccaccggcacctaccagctgcgggagagcgagctggtgtttggagccaagcaggcctggagaaatgccccccgctgtgtgggccgcatccagtggggcaagctgcaggtgtttgatgcccgggactgccgcagcgcccaggagatgttcacctacatctgcaaccacatcaagtatgccaccaacagaggcaacctgcggagcgccatcaccgtcttcccccagcgctgccccggccgcggggacttccgcatctggaacagccagctggtgcgctatgccggctaccggcagcaggacggctctgtgcggggggaccctgccaacgtggagatcacagagctgtgcatccagcacggctggaccccaggaaatggccgctttgatgtgctgcccctgctgctgcaggccccagatgatcctcctgagctgttcctgctgcccccagagctggtgctggaggtgcccctggagcaccccaccctggagtggtttgctgccctgggcctgcgctggtacgccctgcctgctgtgagcaacatgctgctggagattggaggcctggagttccctgctgcccccttcagcggctggtacatgagcacagagatcggcaccaggaacctgtgtgacccccaccgctacaacatcctggaggatgtggccgtgtgcatggacctggacaccaggaccaccagcagcctgtggaaggacaaggctgctgtggagatcaacgtggccgtgctgcacagctaccagctggccaaggtgaccatcgtggaccaccacgccgccacagccagcttcatgaagcacctggagaatgagcagaaggcccggggcggctgcccagctgactgggcctggatcgtgccccccatcagcggcagcctgacccctgtgttccaccaggagatggtgaactacttcctgagccctgccttccgctaccagcctgacccctggaagggcagcgctgccaagggcaccggcatcaccaggaagaagaccttcaaggaggtggccaatgctgtgaagatcagcgccagcctgatgggcaccgtgatggccaagagggtgaaggccaccatcctgtatggcagcgagaccggccgggcccagagctatgcccagcagctgggccgcctcttcaggaaggcctttgacccccgggtgctgtgcatggatgaatatgatgtggtgtccctggagcacgagaccctggtgctggtggtgaccagcacctttggaaatggagaccccccagaaaatggagagagctttgctgctgccctgatggagatgagcggcccctacaacagcagccccaggcctgagcagcacaagagctacaagatccgcttcaacagcatcagctgcagcgaccccctggtgtcctcctggaggaggaagaggaaggagagcagcaacacagacagcgctggggccctgggcaccctgcgcttctgtgtgtttggcctgggcagccgggcctacccccacttctgtgcctttgcccgggctgtggacacccggctggaggagctgggcggggagcggctgctgcagctgggccagggagatgagctgtgtggccaggaggaggccttccggggctgggcccaggccgccttccaggccgcctgtgagaccttctgtgtgggggaggatgccaaggctgctgcccgggacatcttcagccccaagaggtcctggaagaggcagcgctaccgcctgagcgcccaggccgagggcctgcagctgctgcccggcctcatccacgtgcacaggaggaagatgttccaggccaccatccgctctgtggagaacctgcagagcagcaagagcacccgggccaccatcctggtgcggctggacacaggaggccaggagggcctgcagtaccagcccggggaccacatcggcgtgtgcccccccaacagacctggcctggtggaggccctgctgagccgggtggaggaccccccagcccccacagagcctgtggccgtggagcagctggagaagggcagccctgggggccccccacctggctgggtgcgggacccccggctgcccccctgcaccctgcggcaggccctgaccttcttcctggacatcaccagcccccccagcccccagctgctgcggctgctgagcaccctggccgaggagccccgggagcagcaggagctggaggccctgagccaggacccccggcgctatgaggagtggaagtggttccgctgccccaccctgctggaggtgctggagcagttccccagcgtggccctgcctgcccccctgctgctgacccagctgcccctgctgcagccccgctactacagcgtgagcagcgcccccagcacccaccctggagagatccacctgactgtggccgtgctggcctaccgcacccaggacggcctgggccccctgcactatggagtgtgcagcacctggctgagccagctgaagccaggggaccctgtgccctgcttcatccggggggcccccagcttccggctgcccccagaccccagcctgccctgcatcctggtgggccctggcaccggcatcgcccccttccggggcttctggcaggagcggctgcatgacatcgagagcaagggcctgcagcccacccccatgaccctggtgtttggctgccgctgcagccagctggaccacctgtacagagatgaggtgcagaatgcccagcagaggggcgtgtttggccgggtgctgacagccttcagccgggagccagacaaccccaagacctacgtgcaggacatcctgaggacagagctggccgctgaggtgcaccgggtgctgtgcctggagcggggccacatgtttgtgtgtggagatgtgaccatggccaccaacgtgctgcagacagtgcagaggatcctggccacagaaggagacatggagctggatgaggccggagatgtgattggagtgctgcgggaccagcagcgctaccacgaggacatcttcggcctgaccctgcggacccaggaggtgaccagccgcatccgcacccagagcttcagcctgcaggagcggcagctgcggggagctgtgccctgggcctttgatcctcctggcagtgacaccaacagcccctag

SEQ ID NO: 161991 - DNA, 2994 bp, Artificial Sequence
  Description of Artificial Sequence: Synthetic coding sequence
atgttcacctacatctgcaaccacatcaagtatgccaccaacagaggcaacctgcggagcgccatcaccgtcttcccccagcgctgccccggccgcggggacttccgcatctggaacagccagctggtgcgctatgccggctaccggcagcaggacggctctgtgcggggggaccctgccaacgtggagatcacagagctgtgcatccagcacggctggaccccaggaaatggccgctttgatgtgctgcccctgctgctgcaggccccagatgatcctcctgagctgttcctgctgcccccagagctggtgctggaggtgcccctggagcaccccaccctggagtggtttgctgccctgggcctgcgctggtacgccctgcctgctgtgagcaacatgctgctggagattggaggcctggagttccctgctgcccccttcagcggctggtacatgagcacagagatcggcaccaggaacctgtgtgacccccaccgctacaacatcctggaggatgtggccgtgtgcatggacctggacaccaggaccaccagcagcctgtggaaggacaaggctgctgtggagatcaacgtggccgtgctgcacagctaccagctggccaaggtgaccatcgtggaccaccacgccgccacagccagcttcatgaagcacctggagaatgagcagaaggcccggggcggctgcccagctgactgggcctggatcgtgccccccatcagcggcagcctgacccctgtgttccaccaggagatggtgaactacttcctgagccctgccttccgctaccagcctgacccctggaagggcagcgctgccaagggcaccggcatcaccaggaagaagaccttcaaggaggtggccaatgctgtgaagatcagcgccagcctgatgggcaccgtgatggccaagagggtgaaggccaccatcctgtatggcagcgagaccggccgggcccagagctatgcccagcagctgggccgcctcttcaggaaggcctttgacccccgggtgctgtgcatggatgaatatgatgtggtgtccctggagcacgagaccctggtgctggtggtgaccagcacctttggaaatggagaccccccagaaaatggagagagctttgctgctgccctgatggagatgagcggcccctacaacagcagccccaggcctgagcagcacaagagctacaagatccgcttcaacagcatcagctgcagcgaccccctggtgtcctcctggaggaggaagaggaaggagagcagcaacacagacagcgctggggccctgggcaccctgcgcttctgtgtgtttggcctgggcagccgggcctacccccacttctgtgcctttgcccgggctgtggacacccggctggaggagctgggcggggagcggctgctgcagctgggccagggagatgagctgtgtggccaggaggaggccttccggggctgggcccaggccgccttccaggccgcctgtgagaccttctgtgtgggggaggatgccaaggctgctgcccgggacatcttcagccccaagaggtcctggaagaggcagcgctaccgcctgagcgcccaggccgagggcctgcagctgctgcccggcctcatccacgtgcacaggaggaagatgttccaggccaccatccgctctgtggagaacctgcagagcagcaagagcacccgggccaccatcctggtgcggctggacacaggaggccaggagggcctgcagtaccagcccggggaccacatcggcgtgtgcccccccaacagacctggcctggtggaggccctgctgagccgggtggaggaccccccagcccccacagagcctgtggccgtggagcagctggagaagggcagccctgggggccccccacctggctgggtgcgggacccccggctgcccccctgcaccctgcggcaggccctgaccttcttcctggacatcaccagcccccccagcccccagctgctgcggctgctgagcaccctggccgaggagccccgggagcagcaggagctggaggccctgagccaggacccccggcgctatgaggagtggaagtggttccgctgccccaccctgctggaggtgctggagcagttccccagcgtggccctgcctgcccccctgctgctgacccagctgcccctgctgcagccccgctactacagcgtgagcagcgcccccagcacccaccctggagagatccacctgactgtggccgtgctggcctaccgcacccaggacggcctgggccccctgcactatggagtgtgcagcacctggctgagccagctgaagccaggggaccctgtgccctgcttcatccggggggcccccagcttccggctgcccccagaccccagcctgccctgcatcctggtgggccctggcaccggcatcgcccccttccggggcttctggcaggagcggctgcatgacatcgagagcaagggcctgcagcccacccccatgaccctggtgtttggctgccgctgcagccagctggaccacctgtacagagatgaggtgcagaatgcccagcagaggggcgtgtttggccgggtgctgacagccttcagccgggagccagacaaccccaagacctacgtgcaggacatcctgaggacagagctggccgctgaggtgcaccgggtgctgtgcctggagcggggccacatgtttgtgtgtggagatgtgaccatggccaccaacgtgctgcagacagtgcagaggatcctggccacagaaggagacatggagctggatgaggccggagatgtgattggagtgctgcgggaccagcagcgctaccacgaggacatcttcggcctgaccctgcggacccaggaggtgaccagccgcatccgcacccagagcttcagcctgcaggagcggcagctgcggggagctgtgccctgggcctttgatcctcctggcagtgacaccaacagcccctag

SEQ ID NO: 161992 - DNA, 1521 bp, Artificial Sequence
  Description of Artificial Sequence: Synthetic coding sequence
atgagggaccccctgacagactgcccctacaacaaggtgtacaagaacctgaaggagttcagccagaatggagagaacttctgcaagcaggtgacctctgtgctgcagcagagggccaacctggagatctcctatgccaagggcctgcagaagctggccagcaagctgagcaaggccctgcagaacaccaggaagagctgtgtgagcagcgcctgggcctgggccagcgagggcatgaagagcacagctgacctgcaccagaagctgggcaaggccatcgagctggaggccatcaagcccacctaccaggtgctgaatgtgcaggagaagaagaggaagagcctggacaatgaggtggagaagacagccaacctggtgatcagcaactggaaccagcagatcaaggccaagaagaagctgatggtgtccaccaagaagcatgaggccctcttccagctggtggagagcagcaagcagagcatgacagagaaggagaagaggaagctgctgaacaagctgaccaagagcacagagaagctggagaaggaggatgagaactactaccagaagaacatggccggctacagcacccggctgaagtgggagaacaccctggagaactgctaccagagcatcctggagctggagaaggagcgcatccagctgctgtgcaacaacctgaaccagtacagccagcacatcagcctgtttggccagaccctgaccacctgccacacccagatccactgtgccatcagcaagattgatattgagaaggacatccaggccgtgatggaggagacagccatcctgagcacagagaacaagtctgagttcctgctgacagactactttgaggaggaccccaacagcgccatggacaaggagaggaggaagagcctgctgaagcccaagctgctgcggctgcagagggacatcgagaaggccagcaaggacaaggagggcctggagaggatgctgaagacctacagcagcaccagcagcttcagtgatgccaagagccagaaggacacagctgccctgatggatgagaacaacctgaagctggacctgctggaggccaacagctacaagctgagctccatgctggccgagctggagcagaggccccagcccagccacccctgcagcaacagcatcttccgctggagggagaaggagcacacccacagctatgtgaagatcagccggcccttcctgatgaagaggctggagaacatcgtgtccaaggccagcagcggcggccagagcaaccctggcagcagcaccccagcccctggagctgcccagctgagcagccggctgtgcaaggccctgtacagcttccaggcccggcaggatgatgagctgaacctggagaagggggacatcgtcatcatccacgagaagaaggagggcggctggtggtttggcagcctgaatggcaagaagggccacttccctgctgcctacgtggaggagctgcccagcaatgccggcaacacagccaccaaggcctag

SEQ ID NO: 161993 - DNA, 1287 bp, Artificial Sequence
  Description of Artificial Sequence: Synthetic coding sequence
atgaagagcacagctgacctgcaccagaagctgggcaaggccatcgagctggaggccatcaagcccacctaccaggtgctgaatgtgcaggagaagaagaggaagagcctggacaatgaggtggagaagacagccaacctggtgatcagcaactggaaccagcagatcaaggccaagaagaagctgatggtgtccaccaagaagcatgaggccctcttccagctggtggagagcagcaagcagagcatgacagagaaggagaagaggaagctgctgaacaagctgaccaagagcacagagaagctggagaaggaggatgagaactactaccagaagaacatggccggctacagcacccggctgaagtgggagaacaccctggagaactgctaccagagcatcctggagctggagaaggagcgcatccagctgctgtgcaacaacctgaaccagtacagccagcacatcagcctgtttggccagaccctgaccacctgccacacccagatccactgtgccatcagcaagattgatattgagaaggacatccaggccgtgatggaggagacagccatcctgagcacagagaacaagtctgagttcctgctgacagactactttgaggaggaccccaacagcgccatggacaaggagaggaggaagagcctgctgaagcccaagctgctgcggctgcagagggacatcgagaaggccagcaaggacaaggagggcctggagaggatgctgaagacctacagcagcaccagcagcttcagtgatgccaagagccagaaggacacagctgccctgatggatgagaacaacctgaagctggacctgctggaggccaacagctacaagctgagctccatgctggccgagctggagcagaggccccagcccagccacccctgcagcaacagcatcttccgctggagggagaaggagcacacccacagctatgtgaagatcagccggcccttcctgatgaagaggctggagaacatcgtgtccaaggccagcagcggcggccagagcaaccctggcagcagcaccccagcccctggagctgcccagctgagcagccggctgtgcaaggccctgtacagcttccaggcccggcaggatgatgagctgaacctggagaagggggacatcgtcatcatccacgagaagaaggagggcggctggtggtttggcagcctgaatggcaagaagggccacttccctgctgcctacgtggaggagctgcccagcaatgccggcaacacagccaccaaggcctag

SEQ ID NO: 161994 - DNA, 1692 bp, Artificial Sequence
  Description of Artificial Sequence: Synthetic coding sequence
atgagggaccccctgacagactgcccctacaacaaggtgtacaagaacctgaaggagttcagccagaatggagagaacttctgcaagcaggtgacctctgtgctgcagcagagggccaacctggagatctcctatgccaagggcctgcagaagctggccagcaagctgagcaaggccctgcagaacaccaggaagagctgtgtgagcagcgcctgggcctgggccagcgagggcatgaagagcacagctgacctgcaccagaagctgggcaaggccatcgagctggaggccatcaagcccacctaccaggtgctgaatgtgcaggagaagaagaggaagagcctggacaatgaggtggagaagacagccaacctggtgatcagcaactggaaccagcagatcaaggccaagaagaagctgatggtgtccaccaagaagcatgaggccctcttccagctggtggagagcagcaagcagagcatgacagagaaggagaagaggaagctgctgaacaagctgaccaagagcacagagaagctggagaaggaggatgagaactactaccagaagaacatggccggctacagcacccggctgaagtgggagaacaccctggagaactgctaccaggtgacccacagcatctgcctgtatgccttctgggtgaagagggcctggggcaaatgtgtgtctgacctgcgctaccaggacaccttcctgcccggcaacctgccccccctgtggtttggctatgacatcgtgaagaggctcatcatgaggctgtgcagcgtgtgcctgcagagcatcctggagctggagaaggagcgcatccagctgctgtgcaacaacctgaaccagtacagccagcacatcagcctgtttggccagaccctgaccacctgccacacccagatccactgtgccatcagcaagattgacatcgagaaggacatccaggccgtgatggaggagacagccatcctgagcacagagaacaagtctgagttcctgctgacagactactttgaggaggaccccaacagcgccatggacaaggagaggaggaagagcctgctgaagcccaagctgctgcggctgcagagggacatcgagaaggccagcaaggacaaggagggcctggagaggatgctgaagacctacagcagcaccagcagcttcagtgatgccaagagccagaaggacacagctgccctgatggatgagaacaacctgaagctggacctgctggaggccaacagctacaagctgagctccatgctggccgagctggagcagaggccccagcccagccacccctgcagcaacagcatcttccgctggagggagaaggagcacacccacagctatgtgaagatcagccggcccttcctgatgaagaggctggagaacatcgtgtccaaggccagcagcggcggccagagcaaccctggcagcagcaccccagcccctggggccgcccagctgagcagccggctgtgcaaggccctgtacagcttccaggcccggcaggatgatgagctgaacctggagaagggggacatcgtcatcatccacgagaagaaggagggcggctggtggtttggcagcctgaatggcaagaagggccacttccctgctgcctacgtggaggagctgcccagcaatgccggcaacacagccaccaaggcctag

SEQ ID NO: 161995 - DNA, 1692 bp, Artificial Sequence; identical to SEQ ID NO: 161994
  Description of Artificial Sequence: Synthetic coding sequence

SEQ ID NO: 161996 - DNA, 939 bp, Artificial Sequence
  Description of Artificial Sequence: Synthetic coding sequence
atgaccttcggcctgaggaagaggctgtctgaggagcggggcttcagcctgatgccccgggccatggccatcagcagcagcagctgtgagctgcccctggtggccgtgtgccaggtgaccagcaccccagacaagcagcagaacttcaagacctgtgccgagctggtgcgggaggccgcccggctgggcgcctgcctggccttcctgcctgaggcctttgacttcatcgcccgggaccctgctgagaccctgcacctgtctgagcccctgggcggcaagctgctggaggagtacacccagctggcccgggagtgtggcctgtggctgagcctgggcggcttccacgagcggggccaggactgggagcagacccagaagatctacaactgccacgtgctgctgaacagcaaaggagctgtggtggccacctacaggaagacccacctgtgtgatgtggagatccctggccagggccccatgtgtgagagcaacagcaccatgcctggccccagcctggagagccctgtgtccaccccagctgggaagattggcctggccgtgtgctatgacatgagatttcctgagctgagcctggccctggcccaggccggggctgagatcctgacctaccccagcgccttcggcagcatcaccggccctgcccactgggaggtgctgctgcgggcccgggccatcgagacccagtgctacgtggtggccgccgcccagtgtggccgccaccacgagaagagggccagctatggccacagcatggtggtggacccctggggcaccgtggtggcccgctgcagcgagggccctggcctgtgcctggccagaattgacctgaactacctgcggcagctgcggcggcacctgcccgtcttccagcacagaagaccagacctgtatggcaacctgggccaccccctgtcctag

SEQ ID NO: 161997 - DNA, 732 bp, Artificial Sequence
  Description of Artificial Sequence: Synthetic coding sequence
atgctgggcttcatcacccggcccccccaccgcttcctgagcctgctgtgccccggcctgcgcatcccccagctgtctgtgctgtgtgcccagccccggccccgggccatggccatcagcagcagcagctgtgagctgcccctggtggccgtgtgccaggtgaccagcaccccagacaagcagcagaacttcaagacctgtgccgagctggtgcgggaggccgcccggctgggcgcctgcctggccttcctgcctgaggcctttgacttcatcgcccgggaccctgctgagaccctgcacctgtctgagcccctgggcggcaagctgctggaggagtacacccagctggccagagaatgtggcctgtggctgagcctgggcggcttccacgagcggggccaggactgggagcagacccagaagatctacaactgccacgtgctgctgaacagcaaaggagctgtggtggccacctacaggaagacccacctgtgtgatgtggagatccctggccagggccccatgtgtgagagcaacagcaccatgcctggccccagcctggagagccctgtgtccaccccagctgggaagattggcctggccgtgtgctatgacatgagatttcctgagctgagcctggccctggcccaggccggggctgagatcctgacctaccccagcgccttcggcagcatcactggacctgcccactgggagcctgtgagcagctag

SEQ ID NO: 161998 - DNA, 984 bp, Artificial Sequence
  Description of Artificial Sequence: Synthetic coding sequence
atgctgggcttcatcacccggcccccccaccgcttcctgagcctgctgtgccccggcctgcgcatcccccagctgtctgtgctgtgtgcccagccccggccccgggccatggccatcagcagcagcagctgtgagctgcccctggtggccgtgtgccaggtgaccagcaccccagacaagcagcagaacttcaagacctgtgccgagctggtgcgggaggccgcccggctgggcgcctgcctggccttcctgcctgaggcctttgacttcatcgcccgggaccctgctgagaccctgcacctgtctgagcccctgggcggcaagctgctggaggagtacacccagctggccagagaatgtggcctgtggctgagcctgggcggcttccacgagcggggccaggactgggagcagacccagaagatctacaactgccacgtgctgctgaacagcaaaggagctgtggtggccacctacaggaagacccacctgtgtgatgtggagatccctggccagggccccatgtgtgagagcaacagcaccatgcctggccccagcctggagagccctgtgtccaccccagctgggaagattggcctggccgtgtgctatgacatgagatttcctgagctgagcctggccctggcccaggccggggctgagatcctgacctaccccagcgccttcggcagcatcactggacctgcccactgggaggtgctgctgcgggcccgggccatcgagacccagtgctacgtggtggccgccgcccagtgtggccgccaccacgagaagagggccagctatggccacagcatggtggtggacccctggggcaccgtggtggcccgctgcagcgagggccctggcctgtgcctggccagaattgacctgaactacctgcggcagctgcggcggcacctgcctgtgttccagcaccggcggccagacctgtatggcaacctgggccaccccctgtcctag

SEQ ID NO: 161999 - DNA, 876 bp, Artificial Sequence
  Description of Artificial Sequence: Synthetic coding sequence
atggccatcagcagcagcagctgtgagctgcccctggtggccgtgtgccaggtgaccagcaccccagacaagcagcagaacttcaagacctgtgccgagctggtgcgggaggccgcccggctgggcgcctgcctggccttcctgcctgaggcctttgacttcatcgcccgggaccctgctgagaccctgcacctgtctgagcccctgggcggcaagctgctggaggagtacacccagctggccagagaatgtggcctgtggctgagcctgggcggcttccacgagcggggccaggactgggagcagacccagaagatctacaactgccacgtgctgctgaacagcaaaggagctgtggtggccacctacaggaagacccacctgtgtgatgtggagatccctggccagggccccatgtgtgagagcaacagcaccatgcctggccccagcctggagagccctgtgtccaccccagctgggaagattggcctggccgtgtgctatgacatgagatttcctgagctgagcctggccctggcccaggccggggctgagatcctgacctaccccagcgccttcggcagcatcactggacctgcccactgggaggtgctgctgcgggcccgggccatcgagacccagtgctacgtggtggccgccgcccagtgtggccgccaccacgagaagagggccagctatggccacagcatggtggtggacccctggggcaccgtggtggcccgctgcagcgagggccctggcctgtgcctggccagaattgacctgaactacctgcggcagctgcggcggcacctgcctgtgttccagcaccggcggccagacctgtatggcaacctgggccaccccctgtcctag

SEQ ID NO: 162000 - DNA, 822 bp, Artificial Sequence
  Description of Artificial Sequence: Synthetic coding sequence
atgagcctgaccaacaccaagacaggcttctctgtgaaggacatcctggacctgcctgacaccaatgatgaggagggctctgtggccgagggccctgaggaggagaatgaaggacctgagcccgccaagagagctggccccctgggccagggcgccctggatgctgtgcagagcctgcccctgaagaaccccttctatgacagcagtgacaacccctacacccgctggctggccagcacagagggcctgcagtacagcctgcacggcctggccgccggggccccaccccaggacagcagcagcaagagccctgagcccagcgcagatgagagcccagacaatgacaaggagaccccaggcggcggcggagatgctgggaagaagaggaagagaagagtgctcttcagcaaggcccagacctatgagctggagcggcgcttccggcagcagcgctacctgagcgcccctgagcgggagcacctggccagcctcatccggctgacccccacccaggtgaagatctggttccagaaccaccgctacaagatgaagagggcccgggcagagaagggcatggaggtgacccccctgcccagccccaggagagtggccgtgcctgtgctggtgagagatggcaagccctgccacgccctgaaggcccaggacctggccgccgccaccttccaggccggcatccccttcagcgcctacagcgcccagagcctgcagcacatgcagtacaatgcccagtacagcagcgccagcaccccccagtaccccacagcccaccccctggtgcaggcccagcagtggacctggtag

SEQ ID NO: 162001 - DNA, 1065 bp, Artificial Sequence
  Description of Artificial Sequence: Synthetic coding sequence
atgagcctgagccccaagcacaccacccccttctctgtgtctgacatcctgagccccatcgaggagacctacaagaagttcagcggggccatggatggagcccctcctggcctgggcgcccccctgggcgctgctgctgcctaccgggcccctcctcctggccccagcagccaggccgccaccgtggccggcatgcagcccagccacgccatggccggccacaatgctgctgctgctgctgctgctgctgctgctgctgctgctgctgctgccacctaccacatgcctcctggggtgtcccagttcccccacggggccatgggcagctactgcaatggaggcctgggcaacatgggagagctgcctgcctacacagatggcatgaggggcggggccgccaccggctggtatggagccaacccagacccccgctacagcagcatcagccgcttcatgggccccagcgctggggtgaatgtggccggcatgggcagcctgactggaattgctgatgctgccaagagcctgggccccctgcatgctgctgctgctgctgctgcccccaggaggaagagaagagtgctcttcagccaggcccaggtgtatgagctggagcggcgcttcaagcagcagaagtacctgagcgcccctgagcgggagcacctggcctccatgatccacctgacccccacccaggtgaagatctggttccagaaccaccgctacaagatgaagaggcaggccaaggacaaggccgcccagcagctgcagcaggagggcggcctgggccccccacctcctcctccacccagccccaggagagtggccgtgcctgtgctggtgaaggatggcaagccctgccagaatggagccagcacccccaccccaggccaggccggcccccagcccccagcccccaccccagcccctgagctggaggagctgagccccagccccccagccctgcacggccctgggggcggcctggccgccctggatgctgctgctggggagtacagcggcggcgtgctgggcgccaacctgctgtatggccgcacctggtag

SEQ ID NO: 162002 - DNA, 975 bp, Artificial Sequence
  Description of Artificial Sequence: Synthetic coding sequence
atgttccccagccctgccctgacccccacccccttctctgtgaaggacatcctgaacctggagcagcagcagaggagcctggccgccgccggggagctgagcgcccggctggaggccaccctggcccccagcagctgcatgctggccgccttcaagccagaggcctatgccggccctgaggccgccgcccctggcctgcctgagctgcgggcagagctgggccgggcccccagccctgccaagtgtgccagcgccttccctgctgccccagccttctacccccgggcctacagcgaccctgaccctgccaaggaccccagggctgagaagaaggagctgtgtgccctgcagaaggctgtggagctggagaagacagaagctgacaatgctgagcggccccgggccaggagaagaaggaagccccgggtgctcttcagccaggcccaggtgtatgagctggagcggcgcttcaagcagcagcgctacctgagcgcccctgagcgggaccagctggcctctgtgctgaagctgaccagcacccaggtgaagatctggttccagaacagacgctacaagtgcaagaggcagaggcaggaccagaccctggagctggtgggcctgcccccacctcctcctcctccagccaggagaattgctgtgcctgtgctggtgagagatggcaagccctgcctgggggacagcgccccctatgccccagcctatggagtgggcctgaacccctacggctacaatgcctacccagcctacccaggctatggaggagctgcctgcagccctggctacagctgcacagctgcctacccagctggccccagccctgcccagcctgccacagctgctgccaacaacaactttgtgaactttggagtgggggacctgaatgctgtgcagagccctggcatcccccagagcaacagcggcgtgtccaccctgcacggcatccgggcctggtag

SEQ ID NO: 162003 - DNA, 339 bp, Artificial Sequence
  Description of Artificial Sequence: Synthetic coding sequence
atgttccccagccctgccctgacccccacccccttctctgtgaaggacatcctgaacctggagcagcagcagaggagcctggccgccgccggggagctgagcgcccggctggaggccaccctggcccccagcagctgcatgctggccgccttcaagccagaggcctatgccggccctgaggccgccgcccctggcctgcctgagctgcgggcagagctgggccgggcccccagccctgccaagtgtgccagcgccttccctgctgccccagccttctacccccgggcctacagcgaccctgaccctgccaaggaccccagggctgagaagaaggcctag

SEQ ID NO: 162004 - DNA, 456 bp, Artificial Sequence
  Description of Artificial Sequence: Synthetic coding sequence
atgttccccagccctgccctgacccccacccccttctctgtgaaggacatcctgaacctggagcagcagcagaggagcctggccgccgccggggagctgagcgcccggctggaggccaccctggcccccagcagctgcatgctggccgccttcaagccagaggcctatgccggccctgaggccgccgcccctggcctgcctgagctgcgggcagagctgggccgggcccccagccctgccaagtgtgccagcgccttccctgctgccccagccttctacccccgggcctacagcgaccctgaccctgccaaggaccccagggctgagaagaagggctgtgagctgccccggggccagaggcctcctgtgctcttcagcagcgccctgagccagcctgacttcctgcagatgctgtctgagacctgccgctggctgcctgtgcacctggccgagtag

SEQ ID NO: 162005 - DNA, 906 bp, Artificial Sequence
  Description of Artificial Sequence: Synthetic coding sequence
atgctgctgagccctgtgaccagcacccccttctctgtgaaggacatcctgcggctggagcgggagaggagctgcccagctgccagcccccacccccgggtgaggaagagccctgagaacttccagtacctgaggatggatgctgagccccggggcagcgaggtgcacaatgctgggggcggcggcggggacaggaagctggatggcagcgagcccccaggcggcccctgtgaggccgtgctggagatggatgctgagaggatgggagagccccagcccggcctgaatgctgccagccccctgggcggcggcaccagggtgcctgagcggggcgtgggcaacagcggggacagcgtgcggggcggccgctctgagcagcccaaggcccggcagaggaggaagccccgggtgctcttcagccaggcccaggtgctggccctggagcggcgcttcaagcagcagcgctacctgagcgcccctgagcgggagcacctggccagcgccctgcagctgaccagcacccaggtgaagatctggttccagaacagacgctacaagtgcaagaggcagaggcaggacaagagcctggagctggccggccaccccctgaccccccggcgggtggccgtgcctgtgctggtgagagatggcaagccctgcctgggccctggccctggggccccagccttccccagcccctacagcgctgctgtgagcccctacagctgctacggcggctacagcggggccccctacggggccggctacggcacctgctacgccggggcccccagcggccctgccccccacacccccctggccagcgctggcttcggccacggcggccagaatgccaccccccagggccacctggccgccaccctgcagggcgtgcgggcctggtag

SEQ ID NO: 162006 - DNA, 660 bp, Artificial Sequence
  Description of Artificial Sequence: Synthetic coding sequence
atggatgctgagaggatgggagagccccagcccggcctgaatgctgccagccccctgggcggcggcaccagggtgcctgagcggggcgtgggcaacagcggggacagcgtgcggggcggccgctctgagcagcccaaggcccggcagaggaggaagccccgggtgctcttcagccaggcccaggtgctggccctggagcggcgcttcaagcagcagcgctacctgagcgcccctgagcgggagcacctggccagcgccctgcagctgaccagcacccaggtgaagatctggttccagaacagacgctacaagtgcaagaggcagaggcaggacaagagcctggagctggccggccaccccctgaccccccggcgggtggccgtgcctgtgctggtgagagatggcaagccctgcctgggccctggccctggggccccagccttccccagcccctacagcgctgctgtgagcccctacagctgctacggcggctacagcggggccccctacggggccggctacggcacctgctacgccggggcccccagcggccctgccccccacacccccctggccagcgctggcttcggccacggcggccagaatgccaccccccagggccacctggccgccaccctgcagggcgtgcgggcctggtag

SEQ ID NO: 162007 - DNA, 720 bp, Artificial Sequence
  Description of Artificial Sequence: Synthetic coding sequence
atggccaccagcggccgcctgtccttcaccgtgcgcagcctgctggacctgcctgagcaggatgcccagcacctgccccggcgggagcctgagccccgggccccccagcctgacccctgtgccgcctggctggacagcgagcggggccactaccccagcagtgatgagagcagcctggagaccagccccccagacagcagccagaggccttctgcccggcctgccagccctggcagtgatgctgagaagaggaagaagagaagagtgctcttcagcaaggcccagaccctggagctggagcggcgcttccggcagcagcgctacctgagcgcccctgagcgggagcagctggccagcctgctgcggctgacccccacccaggtgaagatctggttccagaaccaccgctacaagctgaagagggcccgggcccctggagctgctgagagcccagacctggccgccagcgctgagctgcatgctgcccctggcctgctgcggcgggtggtggtgcctgtgctggtgagagatggccagccctgtggcggcggcggcggcggggaggtgggcacagctgctgcccaggagaagtgtggggcccctcctgctgctgcctgccccctgcccggctacccagccttcggccctggcagcgccctgggcctcttccctgcctaccagcacctggccagccctgccctggtgtcctggaactggtag

SEQ ID NO: 162008 - DNA, 1002 bp, Artificial Sequence
  Description of Artificial Sequence: Synthetic coding sequence
atggctgtgcggggggccaacaccctgaccagcttcagcatccaggccatcctgaacaagaaggaggagcggggcggcctggccgcccctgagggccggcctgcccctgggggcacagctgcctctgtggccgccgccccagctgtgtgctgctggaggctgtttggagagagagatgctggggccctgggcggcgctgaggacagcctgctggccagccctgctggcaccaggacagctgctggccgcacagctgagagccctgagggctgggacagcgacagcgccctgtctgaggagaatgaaagcagaagaagatgtgctgatgcccggggggccagcggggccggcctggccggcggcagcctgagcctgggccagcctgtgtgtgagctggccgccagcaaggacctggaggaggaggccgccggccgcagtgacagcgagatgtctgcctctgtgtctggggacaggagccccaggacagaagatgatggagtgggccccaggggggcccacgtgtctgccctgtgcagcggggccggcggcggcggcggcagcggccctgctggggtggccgaggaggaggaggagcctgctgcccccaagcccaggaagaagaggagcagagctgccttcagccacgcccaggtgtttgagctggagcggcgcttcaaccaccagcgctacctgagcggccctgagagagctgacctggccgccagcctgaagctgacagagacccaggtgaagatctggttccagaacagacgctacaagaccaagaggcggcagatggctgctgacctgctggccagcgccccagctgccaagaaggtggccgtgaaggtgctggtgagagatgaccagaggcagtacctgcctggagaggtgctgcggccccccagcctgctgcccctgcagcccagctactactacccctactactgcctgcccggctgggccctgagcacctgtgccgctgctgctggcacccagtag

SEQ ID NO: 162009 - DNA, 798 bp, Artificial Sequence
  Description of Artificial Sequence: Synthetic coding sequence
atggagagcaacctgcagggcaccttcctgctgaacaacacccccctggcccagtttcctgagatgaaggcccctgtgtgccagtacagcgtgcagaacagcttctacaagctgagccccccaggcctgggcccccagctggccgccggcacccctcatggcatcacagacatcctgagcaggcctgtggccgcccccaacaacagcctgctgagcggctacccccacgtggccggctttggaggcctgagcagccagggcgtgtactacagcccccaggtgggcaacttcagcaaggctggaaatgagtaccccaccaggaccaggaactgctgggccgacaccggccaggactggaggggcggccggcagtgcagcaacaccccagaccccctgagtgacagcatccacaagaagaagcacacccggcccaccttcaccggccaccagatctttgccctggagaagacctttgagcagaccaagtacctggccggccctgagcgggcccggctggcctacagcctgggcatgacagagagccaggtgaaggtgtggttccagaacagaaggaccaagtggaggaagaagagcgccctggagcccagcagcagcaccccccgggcccctgggggcgctggggccggggccggcggggaccgggcccccagtgaaaatgaagatgatgagtacaacaagcccctggaccctgacagtgatgatgagaagatccggctgctgctgaggaagcacagagctgccttctctgtgctgagcctgggcgcccacagcgtgtag

SEQ ID NO: 162010 - DNA, 408 bp, Artificial Sequence
  Description of Artificial Sequence: Synthetic coding sequence
atgcagcagggccagctggcccctggcagccggctgtgcagcggcccctggggcctgcctgagctgcagcctgctgcccccagcagcagcgctgcccagctgccctggggcgagagctggggcgaggaggccgacaccccagcctgcctgagcgccagcggcgtgtggttccagaacagaaggaccaagtggaggaagaagagcgccctggagcccagcagcagcaccccccgggcccctgggggcgctggggccggggccggcggggaccgggcccccagtgaaaatgaagatgatgagtacaacaagcccctggaccctgacagtgatgatgagaagatccggctgctgctgaggaagcacagagctgccttctctgtgctgagcctgggcgcccacagcgtgtag

SEQ ID NO: 162011 - DNA, 2928 bp, Artificial Sequence
  Description of Artificial Sequence: Synthetic coding sequence
atgcgctggggccaccacctgccccgggcctcctggggcagcggcttcagaagagccctgcagaggccagatgaccgcatccccttcctgatccactggagctggcccctgcagggcgagcggccctttggaccaccccgggccttcatccgccaccacggcagctctgtggacagcgcccctcctcctggccgccacggccgcctcttccccagcgccagcgccacagaggccatccagaggcacagaagaaacctggccgagtggttcagccggctgccccgggaggagcggcagtttggccccacctttgccctggacacagtgcacgtggaccctgtgatccgggagagcaccccagatgagctgctgcggcccccagctgagctggccctggagcaccagcccccccaggccggcctgccccccctggccctgagccagctgttcaacccagatgcctgtggcagaagagtgcagacagtggtgctgtatggaacagtgggcaccgggaagagcaccctggtgaggaagatggtgctggactggtgctacggccgcctgcctgcctttgagctgctgatccccttcagctgtgaggacctgagcagcctgggccctgccccagccagcctgtgccagctggtggcccagcgctacacccccctgaaggaggtgctgcccctgatggctgctgctggcagccacctgctgtttgtgctgcacggcctggagcacctgaacctggacttccggctggccggcaccggcctgtgcagcgaccctgaggagccccaggagcctgctgccatcatcgtgaacctgctgaggaagtacatgctgccccaggccagcatcctggtgaccacccggcccagcgccatcggccgcatccccagcaaatatgtgggccgctacggggagatctgtggcttcagtgacaccaacctgcagaagctgtacttccagctgcggctgaaccagccctactgcggctatgctgtgggcggcagcggcgtgtctgccaccccagcccagagggaccacctggtgcagatgctgagcaggaacctggagggccaccaccagattgctgctgcctgcttcctgcccagctactgctggctggtgtgtgccaccctgcacttcctgcacgcccccaccccagctggccagaccctgaccagcatctacaccagcttcctgcggctgaacttctctggagagaccctggacagcacagaccccagcaacctgagcctgatggcctatgctgcccggaccatgggcaagctggcctatgagggcgtgagcagcaggaagacctacttctctgaagaagatgtgtgtggctgcctggaggccggcatcagaacagaggaggagttccagctgctgcacatcttcagaagagatgccctgcgcttcttcctggccccctgtgtggagcccggccgggccggcacctttgtgttcaccgtgcctgccatgcaggagtacctggccgccctgtacatcgtgctgggcctgaggaagaccaccctgcagaaggtgggcaaggaggtggccgagctggtgggccgggtgggagaagatgtgtccctggtgctgggcatcatggccaagctgctgcccctgcgggccctgcccctgctcttcaacctgatcaaggtggtgccccgggtgtttggaaggatggtgggcaagagccgggaggccgtggcccaggccatggtgctggagatgttccgggaggaggactactacaatgatgatgtgctggaccagatgggcgccagcatcctgggcgtggagggcccccggcggcacccagatgagcccccagaagatgaggtgtttgagctgttccccatgttcatgggcggcctgctgagcgcccacaacagagctgtgctggcccagctgggctgccccatcaagaacctggatgccctggagaatgcccaggccatcaagaagaagctgggcaagctgggccggcaggtgctgcccccatctgagctgctggaccacctgttcttccactatgagttccagaaccagcgcttctctgctgaggtgctgagcagcctgcggcagctgaacctggccggcgtgaggatgacccctgtgaagtgcaccgtggtggccgctgtgctgggcagcggcagacatgccctggatgaggtgaacctggccagctgccagctggaccctgctggcctgcggaccctgctgcctgtgttcctgcgggccaggaagctgggcctgcagctgaacagcctgggccctgaggcctgcaaggacctgcgggacctgctgctgcatgaccagtgccagatcaccaccctgcggctgagcaacaaccccctgacagctgctggggtggccgtgctgatggagggcctggccggcaacacctctgtgacccacctgagcctgctgcacacaggcctgggagatgagggcctggagctgctggccgcccagctggacaggaaccggcagctgcaggagctgaatgtggcctacaatggagctggggacacagctgccctggccctggcccgggccgcccgggagcaccccagcctggagctgctgcacctgtacttcaatgagctgagcagcgagggccggcaggtgctgcgggacctgggcggcgctgctgagggcggggcccgggtggtggtgtccctgacagagggcacagctgtgtctgagtactggagcgtcatcctgtctgaggtgcagaggaacctgaacagctgggaccgggcccgggtgcagaggcacctggagctgctgctgcgggacctggaggacagcagaggagccaccctgaacccctggaggaaggcccagctgctgcgggtggagggggaggtgcgggccctgctggagcagctgggcagcagcggcagctag

SEQ ID NO: 162012 - DNA, 345 bp, Artificial Sequence
  Description of Artificial Sequence: Synthetic coding sequence
ggcatcagcaagctgaagatggtgaaccagtgcttcggcctgggagatggcacctgcctgctgagcatccagctggagggccccaagcacgtggccttcggctggccagaatgtcctgaggcccccctgcccaccctgcccccaccacccctgaaggagcccctgactgtgagcccccggggcagccacctgatgtctgccatgcctggggtgagccccagccgctgtgtgggcagcttccccagctgcctgatgctgacctgtggccaccggggctgcccccacatcggggccttcagcagcagcagctgccccctgtgccacaacggcatgatggcctggtag

SEQ ID NO: 162013 - DNA, 2928 bp, Artificial Sequence; identical to SEQ ID NO: 162011
  Description of Artificial Sequence: Synthetic coding sequence

SEQ ID NO: 162014 - DNA, 2766 bp, Artificial Sequence
  Description of Artificial Sequence: Synthetic coding sequence
atgcgctggggccaccacctgccccgggcctcctggggcagcggcttcagaagagccctgcagaggccagatgaccgcatccccttcctgatccactggagctggcccctgcagggcgagcggccctttggaccaccccgggccttcatccgccaccacggcagctctgtggacagcgcccctcctcctggccgccacggccgcctcttccccagcgccagcgccacagaggccatccagaggcacagaagaaacctggccgagtggttcagccggctgccccgggaggagcggcagtttggccccacctttgccctggacacagtgcacgtggaccctgtgatccgggagagcaccccagatgagctgctgcggcccccagctgagctggccctggagcaccagcccccccaggccggcctgccccccctggccctgagccagctgttcaacccagatgcctgtggcagaagagtgcagacagtggtgctgtatggaacagtgggcaccgggaagagcaccctggtgaggaagatggtgctggactggtgctacggccgcctgcctgcctttgagctgctgatccccttcagctgtgaggacctgagcagcctgggccctgccccagccagcctgtgccagctggtggcccagcgctacacccccctgaaggaggtgctgcccctgatggctgctgctggcagccacctgctgtttgtgctgcacggcctggagcacctgaacctggacttccggctggccggcaccggcctgtgcagcgaccctgaggagccccaggagcctgctgccatcatcgtgaacctgctgaggaagtacatgctgccccaggccagcatcctggtgaccacccggcccagcgccatcggccgcatccccagcaaatatgtgggccgctacggggagatctgtggcttcagtgacaccaacctgcagaagctgtacttccagctgcggctgaaccagccctactgcggctatgctgtgggcggcagcggcgtgtctgccaccccagcccagagggaccacctggtgcagatgctgagcaggaacctggagggccaccaccagattgctgctgcctgcttcctgcccagctactgctggctggtgtgtgccaccctgcacttcctgcacgcccccaccccagctggccagaccctgaccagcatctacaccagcttcctgcggctgaacttctctggagagaccctggacagcacagaccccagcaacctgagcctgatggcctatgctgcccggaccatgggcaagctggcctatgagggcgtgagcagcaggaagacctacttctctgaagaagatgtgtgtggctgcctggaggccggcatcagaacagaggaggagttccagctgctgcacatcttcagaagagatgccctgcgcttcttcctggccccctgtgtggagcccggccgggccggcacctttgtgttcaccgtgcctgccatgcaggagtacctggccgccctgtacatcgtgctgggcctgaggaagaccaccctgcagaaggtgggcaaggaggtggccgagctggtgggccgggtgggagaagatgtgtccctggtgctgggcatcatggccaagctgctgcccctgcgggccctgcccctgctcttcaacctgatcaaggtggtgccccgggtgtttggaaggatggtgggcaagagccgggaggccgtggcccaggccatggtgctggagatgttccgggaggaggactactacaatgatgatgtgctggaccagatgggcgccagcatcctgggcgtggagggcccccggcggcacccagatgagcccccagaagatgaggtgtttgagctgttccccatgttcatgggcggcctgctgagcgcccacaacagagctgtgctggcccagctgggctgccccatcaagaacctggatgccctggagaatgcccaggccatcaagaagaagctgggcaagctgggccggcaggtgctgcccccatctgagctgctggaccacctgttcttccactatgagttccagaaccagcgcttctctgctgaggtgctgagcagcctgcggcagctgaacctggccggcgtgaggatgacccctgtgaagtgcaccgtggtggccgctgtgctgggcagcggcagacatgccctggatgaggtgaacctggccagctgccagctggaccctgctggcctgcggaccctgctgcctgtgttcctgcgggccaggaagctgggcctgcagctgaacagcctgggccctgaggcctgcaaggacctgcgggacctgctgctgcatgaccagtgccagatcaccaccctgcggctgagcaacaaccccctgacagctgctggggtggccgtgctgatggagggcctggccggcaacacctctgtgacccacctgagcctgctgcacacaggcctgggagatgagggcctggagctgctggccgcccagctggacaggaaccggcagctgcaggagctgaatgtggcctacaatggagctggggacacagctgccctggccctggcccgggccgcccgggagcaccccagcctggagctgctgcagggcgtggccatccagatgtgctggaagctgcccctgctgccctatgcccacctgtggacccccaggatgcccagccactggtgcttcctgctgatcctgatgccacccctgccccagtggtatgatggcctggtggccccccggggccgctgcacctag

SEQ ID NO: 162015 - DNA, 2928 bp, Artificial Sequence; identical to SEQ ID NO: 162011
  Description of Artificial Sequence: Synthetic coding sequence

SEQ ID NO: 162016 - DNA, 2766 bp, Artificial Sequence; identical to SEQ ID NO: 162014
  Description of Artificial Sequence: Synthetic coding sequence

SEQ ID NO: 162017 - DNA, 3111 bp, Artificial Sequence
  Description of Artificial Sequence: Synthetic coding sequence
atgaagatggccagcacccgctgcaagctggcccgctacctggaggacctggaggatgtggacctgaagaagttcaagatgcacctggaggactacccaccccagaagggctgcatccccctgccccggggccagacagagaaggctgaccacgtggacctggccaccctgatgattgacttcaacggggaggagaaggcctgggccatggctgtgtggatctttgctgccatcaacagaagagacctgtatgagaaggccaagagagatgagcccaagtggggcagtgacaatgcccgggtgagcaaccccaccgtcatctgccaggaggacagcattgaggaggagtggatgggcctgctggagtacctgagccgcatcagcatctgcaagatgaagaaggactacaggaagaagtacagaaaatatgtgcgcagccgcttccagtgcatcgaggacagaaatgcccggctgggggagagcgtgtccctgaacaagcgctacacccggctgcggctcatcaaggagcacaggagccagcaggagcgggagcaggagctgctggccatcggcaagaccaagacctgtgagagccctgtgagccccatcaagatggagctgctgtttgatcctgatgatgagcacagcgagcctgtgcacacagtggtgttccagggcgccgccggcatcggcaagaccatcctggccaggaagatgatgctggactgggccagcggcaccctgtaccaggacagatttgactacctgttctacatccactgccgggaggtgtccctggtgacccagaggagcctgggggacctgatcatgagctgctgcccagaccccaacccccccatccacaagatcgtgaggaagcccagccgcatcctcttcctgatggatggctttgatgagctgcagggcgcctttgatgagcacatcggccccctgtgcacagactggcagaaggccgagcggggggacatcctgctgagcagcctcatcaggaagaagctgctgcctgaggccagcctgctgatcaccaccaggcctgtggccctggagaagctgcagcacctgctggaccaccccaggcatgtggagatcctgggcttcagcgaggccaagaggaaggagtacttcttcaagtacttcagtgatgaggcccaggcccgggccgccttcagcctcatccaggagaatgaggtgctcttcaccatgtgcttcatccccctggtgtgctggatcgtgtgcaccggcctgaagcagcagatggagagcggcaagagcctggcccagaccagcaagaccaccacagctgtgtatgtgttcttcctgagcagcctgctgcagccccggggcggcagccaggagcacggcctgtgtgcccacctgtggggcctgtgcagcctggccgcagatggcatctggaaccagaagatcctgtttgaggagagtgacctgaggaaccacggcctgcagaaggcagatgtgtctgccttcctgaggatgaacctcttccagaaggaggtggactgtgagaagttctacagcttcatccacatgaccttccaggagttctttgctgccatgtactacctgctggaggaggagaaggagggccgcaccaacgtgcccggcagccggctgaagctgcccagcagagatgtgacagtgctgctggagaactacggcaagtttgagaagggctacctgatctttgtggtgcgcttcctgtttggcctggtgaaccaggagaggaccagctacctggagaagaagctgagctgcaagatcagccagcagatccggctggagctgctgaagtggattgaggtgaaggccaaggccaagaagctgcagatccagcccagccagctggagctgttctactgcctgtatgagatgcaggaggaggactttgtgcagagggccatggactacttccccaagattgagatcaacctgagcaccaggatggaccacatggtgtcctccttctgcatcgagaactgccaccgggtggagagcctgagcctgggcttcctgcacaacatgcccaaggaggaggaggaggaggagaaggagggccgccacctggacatggtgcagtgtgtgctgcccagcagcagccacgccgcctgcagccacggcctggtgaacagccacctgaccagcagcttctgccggggcctcttctctgtgctgagcaccagccagagcctgacagagctggacctgagtgacaacagcctgggggaccccggcatgagggtgctgtgtgagaccctgcagcaccctggctgcaacatccggcggctgtggctgggccgctgtggcctgagccatgagtgctgctttgacatcagcctggtgctgagcagcaaccagaagctggtggagctggacctgagtgacaatgccctgggggactttggcatccggctgctgtgtgtgggcctgaagcacctgctgtgcaacctgaagaagctgtggctggtgtcctgctgcctgaccagcgcctgctgccaggacctggcctctgtgctgagcaccagccacagcctgacccggctgtatgtgggggagaatgccctgggggacagcggcgtggccatcctgtgtgagaaggccaagaacccccagtgcaacctgcagaagctgggcctggtgaacagcggcctgacctctgtgtgctgcagcgccctgagctctgtgctgagcaccaaccagaacctgacccacctgtacctgcggggcaacaccctgggggacaagggcatcaagctgctgtgtgagggcctgctgcacccagactgcaagctgcaggtgctggagctggacaactgcaacctgaccagccactgctgctgggacctgagcaccctgctgaccagcagccagagcctgaggaagctgagcctgggcaacaatgacctgggggacctgggcgtgatgatgttctgtgaggtgctgaagcagcagagctgcctgctgcagaacctgggcctgtctgagatgtacttcaactatgagaccaagagcgccctggagaccctgcaggaggagaagccagagctgactgtggtgtttgagcccagctggtag

SEQ ID NO: 162018 - DNA, 2769 bp, Artificial Sequence
  Description of Artificial Sequence: Synthetic coding sequence
atgaagatggccagcacccgctgcaagctggcccgctacctggaggacctggaggatgtggacctgaagaagttcaagatgcacctggaggactacccaccccagaagggctgcatccccctgccccggggccagacagagaaggctgaccacgtggacctggccaccctgatgattgacttcaacggggaggagaaggcctgggccatggctgtgtggatctttgctgccatcaacagaagagacctgtatgagaaggccaagagagatgagcccaagtggggcagtgacaatgcccgggtgagcaaccccaccgtcatctgccaggaggacagcattgaggaggagtggatgggcctgctggagtacctgagccgcatcagcatctgcaagatgaagaaggactacaggaagaagtacagaaaatatgtgcgcagccgcttccagtgcatcgaggacagaaatgcccggctgggggagagcgtgtccctgaacaagcgctacacccggctgcggctcatcaaggagcacaggagccagcaggagcgggagcaggagctgctggccatcggcaagaccaagacctgtgagagccctgtgagccccatcaagatggagctgctgtttgatcctgatgatgagcacagcgagcctgtgcacacagtggtgttccagggcgccgccggcatcggcaagaccatcctggccaggaagatgatgctggactgggccagcggcaccctgtaccaggacagatttgactacctgttctacatccactgccgggaggtgtccctggtgacccagaggagcctgggggacctgatcatgagctgctgcccagaccccaacccccccatccacaagatcgtgaggaagcccagccgcatcctcttcctgatggatggctttgatgagctgcagggcgcctttgatgagcacatcggccccctgtgcacagactggcagaaggccgagcggggggacatcctgctgagcagcctcatcaggaagaagctgctgcctgaggccagcctgctgatcaccaccaggcctgtggccctggagaagctgcagcacctgctggaccaccccaggcatgtggagatcctgggcttcagcgaggccaagaggaaggagtacttcttcaagtacttcagtgatgaggcccaggcccgggccgccttcagcctcatccaggagaatgaggtgctcttcaccatgtgcttcatccccctggtgtgctggatcgtgtgcaccggcctgaagcagcagatggagagcggcaagagcctggcccagaccagcaagaccaccacagctgtgtatgtgttcttcctgagcagcctgctgcagccccggggcggcagccaggagcacggcctgtgtgcccacctgtggggcctgtgcagcctggccgcagatggcatctggaaccagaagatcctgtttgaggagagtgacctgaggaaccacggcctgcagaaggcagatgtgtctgccttcctgaggatgaacctcttccagaaggaggtggactgtgagaagttctacagcttcatccacatgaccttccaggagttctttgctgccatgtactacctgctggaggaggagaaggagggccgcaccaacgtgcccggcagccggctgaagctgcccagcagagatgtgacagtgctgctggagaactacggcaagtttgagaagggctacctgatctttgtggtgcgcttcctgtttggcctggtgaaccaggagaggaccagctacctggagaagaagctgagctgcaagatcagccagcagatccggctggagctgctgaagtggattgaggtgaaggccaaggccaagaagctgcagatccagcccagccagctggagctgttctactgcctgtatgagatgcaggaggaggactttgtgcagagggccatggactacttccccaagattgagatcaacctgagcaccaggatggaccacatggtgtcctccttctgcatcgagaactgccaccgggtggagagcctgagcctgggcttcctgcacaacatgcccaaggaggaggaggaggaggagaaggagggccgccacctggacatggtgcagtgtgtgctgcccagcagcagccacgccgcctgcagccacggcctgggccgctgtggcctgagccatgagtgctgctttgacatcagcctggtgctgagcagcaaccagaagctggtggagctggacctgagtgacaatgccctgggggactttggcatccggctgctgtgtgtgggcctgaagcacctgctgtgcaacctgaagaagctgtggctggtgaacagcggcctgacctctgtgtgctgcagcgccctgagctctgtgctgagcaccaaccagaacctgacccacctgtacctgcggggcaacaccctgggggacaagggcatcaagctgctgtgtgagggcctgctgcacccagactgcaagctgcaggtgctggagctggacaactgcaacctgaccagccactgctgctgggacctgagcaccctgctgaccagcagccagagcctgaggaagctgagcctgggcaacaatgacctgggggacctgggcgtgatgatgttctgtgaggtgctgaagcagcagagctgcctgctgcagaacctgggcctgtctgagatgtacttcaactatgagaccaagagcgccctggagaccctgcaggaggagaagccagagctgactgtggtgtttgagcccagctggtag

SEQ ID NO: 162019 - DNA, 2940 bp, Artificial Sequence
  Description of Artificial Sequence: Synthetic coding sequence
atgaagatggccagcacccgctgcaagctggcccgctacctggaggacctggaggatgtggacctgaagaagttcaagatgcacctggaggactacccaccccagaagggctgcatccccctgccccggggccagacagagaaggctgaccacgtggacctggccaccctgatgattgacttcaacggggaggagaaggcctgggccatggctgtgtggatctttgctgccatcaacagaagagacctgtatgagaaggccaagagagatgagcccaagtggggcagtgacaatgcccgggtgagcaaccccaccgtcatctgccaggaggacagcattgaggaggagtggatgggcctgctggagtacctgagccgcatcagcatctgcaagatgaagaaggactacaggaagaagtacagaaaatatgtgcgcagccgcttccagtgcatcgaggacagaaatgcccggctgggggagagcgtgtccctgaacaagcgctacacccggctgcggctcatcaaggagcacaggagccagcaggagcgggagcaggagctgctggccatcggcaagaccaagacctgtgagagccctgtgagccccatcaagatggagctgctgtttgatcctgatgatgagcacagcgagcctgtgcacacagtggtgttccagggcgccgccggcatcggcaagaccatcctggccaggaagatgatgctggactgggccagcggcaccctgtaccaggacagatttgactacctgttctacatccactgccgggaggtgtccctggtgacccagaggagcctgggggacctgatcatgagctgctgcccagaccccaacccccccatccacaagatcgtgaggaagcccagccgcatcctcttcctgatggatggctttgatgagctgcagggcgcctttgatgagcacatcggccccctgtgcacagactggcagaaggccgagcggggggacatcctgctgagcagcctcatcaggaagaagctgctgcctgaggccagcctgctgatcaccaccaggcctgtggccctggagaagctgcagcacctgctggaccaccccaggcatgtggagatcctgggcttcagcgaggccaagaggaaggagtacttcttcaagtacttcagtgatgaggcccaggcccgggccgccttcagcctcatccaggagaatgaggtgctcttcaccatgtgcttcatccccctggtgtgctggatcgtgtgcaccggcctgaagcagcagatggagagcggcaagagcctggcccagaccagcaagaccaccacagctgtgtatgtgttcttcctgagcagcctgctgcagccccggggcggcagccaggagcacggcctgtgtgcccacctgtggggcctgtgcagcctggccgcagatggcatctggaaccagaagatcctgtttgaggagagtgacctgaggaaccacggcctgcagaaggcagatgtgtctgccttcctgaggatgaacctcttccagaaggaggtggactgtgagaagttctacagcttcatccacatgaccttccaggagttctttgctgccatgtactacctgctggaggaggagaaggagggccgcaccaacgtgcccggcagccggctgaagctgcccagcagagatgtgacagtgctgctggagaactacggcaagtttgagaagggctacctgatctttgtggtgcgcttcctgtttggcctggtgaaccaggagaggaccagctacctggagaagaagctgagctgcaagatcagccagcagatccggctggagctgctgaagtggattgaggtgaaggccaaggccaagaagctgcagatccagcccagccagctggagctgttctactgcctgtatgagatgcaggaggaggactttgtgcagagggccatggactacttccccaagattgagatcaacctgagcaccaggatggaccacatggtgtcctccttctgcatcgagaactgccaccgggtggagagcctgagcctgggcttcctgcacaacatgcccaaggaggaggaggaggaggagaaggagggccgccacctggacatggtgcagtgtgtgctgcccagcagcagccacgccgcctgcagccacggcctggtgaacagccacctgaccagcagcttctgccggggcctcttctctgtgctgagcaccagccagagcctgacagagctggacctgagtgacaacagcctgggggaccccggcatgagggtgctgtgtgagaccctgcagcaccctggctgcaacatccggcggctgtggctgggccgctgtggcctgagccatgagtgctgctttgacatcagcctggtgctgagcagcaaccagaagctggtggagctggacctgagtgacaatgccctgggggactttggcatccggctgctgtgtgtgggcctgaagcacctgctgtgcaacctgaagaagctgtggctggtgaacagcggcctgacctctgtgtgctgcagcgccctgagctctgtgctgagcaccaaccagaacctgacccacctgtacctgcggggcaacaccctgggggacaagggcatcaagctgctgtgtgagggcctgctgcacccagactgcaagctgcaggtgctggagctggacaactgcaacctgaccagccactgctgctgggacctgagcaccctgctgaccagcagccagagcctgaggaagctgagcctgggcaacaatgacctgggggacctgggcgtgatgatgttctgtgaggtgctgaagcagcagagctgcctgctgcagaacctgggcctgtctgagatgtacttcaactatgagaccaagagcgccctggagaccctgcaggaggagaagccagagctgactgtggtgtttgagcccagctggtag

SEQ ID NO: 162020 - DNA, 2940 bp, Artificial Sequence; identical to SEQ ID NO: 162019
  Description of Artificial Sequence: Synthetic coding sequence

SEQ ID NO: 162021 - DNA, 2940 bp, Artificial Sequence
  Description of Artificial Sequence: Synthetic coding sequence
atgaagatggccagcacccgctgcaagctggcccgctacctggaggacctggaggatgtggacctgaagaagttcaagatgcacctggaggactacccaccccagaagggctgcatccccctgccccggggccagacagagaaggctgaccacgtggacctggccaccctgatgattgacttcaacggggaggagaaggcctgggccatggctgtgtggatctttgctgccatcaacagaagagacctgtatgagaaggccaagagagatgagcccaagtggggcagtgacaatgcccgggtgagcaaccccaccgtcatctgccaggaggacagcattgaggaggagtggatgggcctgctggagtacctgagccgcatcagcatctgcaagatgaagaaggactacaggaagaagtacagaaaatatgtgcgcagccgcttccagtgcatcgaggacagaaatgcccggctgggggagagcgtgtccctgaacaagcgctacacccggctgcggctcatcaaggagcacaggagccagcaggagcgggagcaggagctgctggccatcggcaagaccaagacctgtgagagccctgtgagccccatcaagatggagctgctgtttgatcctgatgatgagcacagcgagcctgtgcacacagtggtgttccagggcgccgccggcatcggcaagaccatcctggccaggaagatgatgctggactgggccagcggcaccctgtaccaggacagatttgactacctgttctacatccactgccgggaggtgtccctggtgacccagaggagcctgggggacctgatcatgagctgctgcccagaccccaacccccccatccacaagatcgtgaggaagcccagccgcatcctcttcctgatggatggctttgatgagctgcagggcgcctttgatgagcacatcggccccctgtgcacagactggcagaaggccgagcggggggacatcctgctgagcagcctcatcaggaagaagctgctgcctgaggccagcctgctgatcaccaccaggcctgtggccctggagaagctgcagcacctgctggaccaccccaggcatgtggagatcctgggcttcagcgaggccaagaggaaggagtacttcttcaagtacttcagtgatgaggcccaggcccgggccgccttcagcctcatccaggagaatgaggtgctcttcaccatgtgcttcatccccctggtgtgctggatcgtgtgcaccggcctgaagcagcagatggagagcggcaagagcctggcccagaccagcaagaccaccacagctgtgtatgtgttcttcctgagcagcctgctgcagccccggggcggcagccaggagcacggcctgtgtgcccacctgtggggcctgtgcagcctggccgcagatggcatctggaaccagaagatcctgtttgaggagagtgacctgaggaaccacggcctgcagaaggcagatgtgtctgccttcctgaggatgaacctcttccagaaggaggtggactgtgagaagttctacagcttcatccacatgaccttccaggagttctttgctgccatgtactacctgctggaggaggagaaggagggccgcaccaacgtgcccggcagccggctgaagctgcccagcagagatgtgacagtgctgctggagaactacggcaagtttgagaagggctacctgatctttgtggtgcgcttcctgtttggcctggtgaaccaggagaggaccagctacctggagaagaagctgagctgcaagatcagccagcagatccggctggagctgctgaagtggattgaggtgaaggccaaggccaagaagctgcagatccagcccagccagctggagctgttctactgcctgtatgagatgcaggaggaggactttgtgcagagggccatggactacttccccaagattgagatcaacctgagcaccaggatggaccacatggtgtcctccttctgcatcgagaactgccaccgggtggagagcctgagcctgggcttcctgcacaacatgcccaaggaggaggaggaggaggagaaggagggccgccacctggacatggtgcagtgtgtgctgcccagcagcagccacgccgcctgcagccacggcctgggccgctgtggcctgagccatgagtgctgctttgacatcagcctggtgctgagcagcaaccagaagctggtggagctggacctgagtgacaatgccctgggggactttggcatccggctgctgtgtgtgggcctgaagcacctgctgtgcaacctgaagaagctgtggctggtgtcctgctgcctgaccagcgcctgctgccaggacctggcctctgtgctgagcaccagccacagcctgacccggctgtatgtgggagaaaatgccctgggggacagcggcgtggccatcctgtgtgagaaggccaagaacccccagtgcaacctgcagaagctgggcctggtgaacagcggcctgacctctgtgtgctgcagcgccctgagctctgtgctgagcaccaaccagaacctgacccacctgtacctgcggggcaacaccctgggggacaagggcatcaagctgctgtgtgagggcctgctgcacccagactgcaagctgcaggtgctggagctggacaactgcaacctgaccagccactgctgctgggacctgagcaccctgctgaccagcagccagagcctgaggaagctgagcctgggcaacaatgacctgggggacctgggcgtgatgatgttctgtgaggtgctgaagcagcagagctgcctgctgcagaacctgggcctgtctgagatgtacttcaactatgagaccaagagcgccctggagaccctgcaggaggagaagccagagctgactgtggtgtttgagcccagctggtag

SEQ ID NO: 162022 - DNA, 3111 bp, Artificial Sequence; identical to SEQ ID NO: 162017
  Description of Artificial Sequence: Synthetic coding sequence

SEQ ID NO: 162023 - DNA, 1512 bp, Artificial Sequence
  Description of Artificial Sequence: Synthetic coding sequence
atggagtacatggccgagagcacagacaggagccctggccacatcctgtgctgtgaatgtggggtgcccatcagccccaacccagccaacatctgtgtggcctgcctgcggagcaaggtggacatcagccagggcatccccaagcaggtgtccatctccttctgcaagcagtgccagcgctacttccagcccccaggcacctggatccagtgtgccctggagagccgggagctgctggccctgtgcctgaagaagatcaaggcccccctgagcaaggtgcggctggtggatgctggctttgtgtggacagagccccacagcaagaggctgaaggtgaagctgaccatccagaaggaggtgatgaatggagccatcctgcagcaggtgtttgtggtggactatgtggtgcagagccagatgtgtggggactgccaccgggtggaggccaaggacttctggaaggctgtgatccaggtgcggcagaagaccctgcacaagaagaccttctactacctggagcagctgatcctgaagtatggcatgcaccagaacaccctgcgcatcaaggagatccatgatggcctggacttctactacagcagcaagcagcacgcccagaagatggtggagttcctgcagtgcaccgtgccctgccgctacaaggccagccagaggctcatcagccaggacatccacagcaacacctacaactacaagagcaccttctctgtggagatcgtgcccatctgcaaggacaacgtggtgtgcctgagccccaagctggcccagagcctgggcaacatgaaccagatctgtgtgtgcatccgggtgaccagcgccatccacctgattgaccccaacaccctgcaggtggccgacattgatggcagcaccttctggagccaccccttcaacagcctgtgccaccccaagcagctggaggagttcatcgtgatggagtgcagcatcgtgcaggacatcaagagagctgctggagctggcatgatcagcaagaagcacaccctgggggaggtgtgggtgcagaagaccagcgagatgaacacagacaagcagtacttctgcaggacccacctgggccacctgctgaaccctggggacctggtgctgggctttgacctggccaactgcaacctgaatgatgaacatgtgaacaagatgaacagcgacagagtgcctgatgtggtgctgatcaagaagagctatgacaggaccaagaggcagaggagaagaaactggaagctgaaggagctggcccgggagcgggagaacatggacacagatgatgagcggcagtaccaggacttcctggaggacctggaggaggatgaggccatcaggaagaatgtgaacatctacagagacagcgccatccctgtggagagtgacacagatgatgagggcgccccccgcatcagcctggccgagatgctggaggacctgcacatcagccaggatgccaccggggaggagggcgcctccatgctgacctag

SEQ ID NO: 162024 - DNA, 1512 bp, Artificial Sequence; identical to SEQ ID NO: 162023
  Description of Artificial Sequence: Synthetic coding sequence

SEQ ID NO: 162025 - DNA, 471 bp, Artificial Sequence
  Description of Artificial Sequence: Synthetic coding sequence
atggagtacatggccgagagcacagacaggagccctggccacatcctgtgctgtgaatgtggggtgcccatcagccccaacccagccaacatctgtgtggcctgcctgcggagcaaggtggacatcagccagggcatccccaagcaggtgtccatctccttctgcaagcagtgccagcgctacttccagcccccaggcacctggatccagtgtgccctggagagccgggagctgctggccctgtgcctgaagaagatcaaggcccccctgagcaaggtgcggctggtggatgctggctttgtgtggacagagccccacagcaagaggctgaaggtgaagctgaccatccagaaggaggtgatgaatggagccatcctgcagcaggtgtttgtggtggactatgtggtgcagagccagatgtgtggggactgccaccgggtggaggccaaggacttctggaaggctgtgtag

SEQ ID NO: 162026 - DNA, 657 bp, Artificial Sequence
  Description of Artificial Sequence: Synthetic coding sequence
atggagtacatggccgagagcacagacaggagccctggccacatcctgtgctgtgaatgtggggtgcccatcagccccaacccagccaacatctgtgtggcctgcctgcggagcaaggtggacatcagccagggcatccccaagcaggtgtccatctccttctgcaagcagtgccagcgctacttccagcccccaggcacctggatccagtgtgccctggagagccgggagctgctggccctgtgcctgaagaagatcaaggcccccctgagcaaggtgcggctggtggatgctggctttgtgtggacagagccccacagcaagaggctgaaggtgaagctgaccatccagaaggaggtgatgaatggagccatcctgcagcaggtgtttgtggtggactatgtggtgcagagccagatgtgtggggactgccaccgggtggaggccaaggacttctggaaggctgtgatccaggtgcggcagaagaccctgcacaagaagaccttctactacctggagcagctgatcctgaagtatggcatgcaccagaacaccctgcgcatcaaggagatccatgatggcctggacttctactacagcagcaagcagcacgcccagaagatggtggagttcctgcagtgcaccgtgccctgctag

SEQ ID NO: 162027 - DNA, 297 bp, Artificial Sequence
  Description of Artificial Sequence: Synthetic coding sequence
atggagtacatggccgagagcacagacaggagccctggccacatcctgtgctgtgaatgtggggtgcccatcagccccaacccagccaacatctgtgtggcctgcctgcggagcaaggtggacatcagccagggcatccccaagcaggtgtccatctccttctgcaagcagtgccagcgctacttccagcccccaggcacctggatccagtgtgccctggagagccgggagctgctggccctgtgcctgaagaagatcaaggcccccctgagcaaggtgcggctggtggatgcctag

SEQ ID NO: 162028 - DNA, 489 bp, Artificial Sequence
  Description of Artificial Sequence: Synthetic coding sequence
atggagtacatggccgagagcacagacaggagccctggccacatcctgtgctgtgaatgtggggtgcccatcagccccaacccagccaacatctgtgtggcctgcctgcggagcaaggtggacatcagccagggcatccccaagcaggtgtccatctccttctgcaagcagtgccagcgctacttccagcccccaggcacctggatccagtgtgccctggagagccgggagctgctggccctgtgcctgaagaagatcaaggcccccctgagcaaggtgcggctggtggatgctggctttgtgtggacagagccccacagcaagaggctgaaggtgaagctgaccatccagaaggaggtgatgaatggagccatcctgcagcaggtgtttgtggtggactatgtggtgcagagccagatgtgtggggactgccaccgggtggaggccaaggacttctggaaggctgtgatccaggtgcggcagaagtag

SEQ ID NO: 162029 - DNA, 657 bp, Artificial Sequence; identical to SEQ ID NO: 162026
  Description of Artificial Sequence: Synthetic coding sequence

SEQ ID NO: 162030 - DNA, 1152 bp, Artificial Sequence
  Description of Artificial Sequence: Synthetic coding sequence
atgaatggagccatcctgcagcaggtgtttgtggtggactatgtggtgcagagccagatgtgtggggactgccaccgggtggaggccaaggacttctggaaggctgtgatccaggtgcggcagaagaccctgcacaagaagaccttctactacctggagcagctgatcctgaagtatggcatgcaccagaacaccctgcgcatcaaggagatccatgatggcctggacttctactacagcagcaagcagcacgcccagaagatggtggagttcctgcagtgcaccgtgccctgccgctacaaggccagccagaggctcatcagccaggacatccacagcaacacctacaactacaagagcaccttctctgtggagatcgtgcccatctgcaaggacaacgtggtgtgcctgagccccaagctggcccagagcctgggcaacatgaaccagatctgtgtgtgcatccgggtgaccagcgccatccacctgattgaccccaacaccctgcaggtggccgacattgatggcagcaccttctggagccaccccttcaacagcctgtgccaccccaagcagctggaggagttcatcgtgatggagtgcagcatcgtgcaggacatcaagagagctgctggagctggcatgatcagcaagaagcacaccctgggggaggtgtgggtgcagaagaccagcgagatgaacacagacaagcagtacttctgcaggacccacctgggccacctgctgaaccctggggacctggtgctgggctttgacctggccaactgcaacctgaatgatgaacatgtgaacaagatgaacagcgacagagtgcctgatgtggtgctgatcaagaagagctatgacaggaccaagaggcagaggagaagaaactggaagctgaaggagctggcccgggagcgggagaacatggacacagatgatgagcggcagtaccaggacttcctggaggacctggaggaggatgaggccatcaggaagaatgtgaacatctacagagacagcgccatccctgtggagagtgacacagatgatgagggcgccccccgcatcagcctggccgagatgctggaggacctgcacatcagccaggatgccaccggggaggagggcgcctccatgctgacctag

SEQ ID NO: 162031 - DNA, 2949 bp, Artificial Sequence
  Description of Artificial Sequence: Synthetic coding sequence
atgagcagcaagatggtgatcagcgagcccggcctgaactgggacatcagccccaagaatggcctgaagaccttcttcagccgggagaactacaaggaccacagcatggcccccagcctgaaggagctgcgggtgctgagcaacagaagaattggagagaacctgaatgccagcgccagctctgtggagaatgaacctgctgtgagcagcgccacccaggccaaggagaaggtgaagaccaccatcggcatggtgctgctgcccaagccccgggtgccctacccccgcttcagccgcttcagccagcgggagcagaggagctatgtggacctgctggtgaagtatgccaagatcccagccaacagcaaggctgtgggcatcaacaagaatgactacctgcagtacctggacatgaagaagcacgtgaatgaggaggtgacagagttcctgaagttcctgcagaacagcgccaagaagtgtgcccaggactacaacatgctgagtgatgatgcccggctcttcacagagaagatcctgcgggcctgcatcgagcaggtgaagaagtacagcgagttctacaccctgcacgaggtgaccagcctgatgggcttcttccccttccgggtggagatgggcctgaagctggagaagaccctgctggccctgggctctgtgaagtatgtgaagacagtgttccccagcatgcccatcaagctgcagctgagcaaggatgacatcgccaccatcgagaccagcgagcagacagctgaggccatgcactatgacatcagcaaggaccccaatgctgagaagctggtgagccgctaccacccccagatcgccctgaccagccagagcctcttcaccctgctgaacaaccacggccccacctacaaggagcagtgggagatccctgtgtgcatccaggtgattcctgtggccggcagcaagcctgtgaaggtgatctacatcaacagccccctgccccagaagaagatgaccatgagggagaggaaccagatcttccacgaggtgcccctgaagttcatgatgagcaagaacacctctgtgcctgtgtctgctgtgttcatggacaagccagaggagttcatcagcgagatggacatgagctgtgaggtgaatgaatgtaggaagattgagagcctggagaacctgtacctggactttgatgatgatgtgacagagctggagaccttcggcgtgaccaccaccaaggtgtccaagagccccagccctgccagcaccagcacagtgcccaacatgacagatgcccccacagcccccaaggccggcaccaccaccgtggcccccagcgccccagacatcagcgccaacagccgcagcctgagccagatcctgatggagcagctgcagaaggagaagcagctggtgacaggcatggatggcggccctgaggagtgcaagaacaaggatgaccagggctttgagagctgtgagaaggtgagcaacagcgacaagcccctcatccaggacagcgacctgaagaccagtgatgccctgcagctggagaacagccaggagattgagaccagcaacaagaatgacatgaccatcgacatcctgcatgctgatggagagcggcccaacgtgctggagaacctggacaacagcaaggagaagacagtgggcagcgaggccgccaagacagaggacacagtgctgtgcagcagtgacacagatgaggagtgcctgatcatcgacacagagtgcaagaacaacagtgatggcaagacagctgtggtgggcagcaacctgagcagcaggcctgccagccccaacagcagcagcggccaggcctctgtgggcaaccagaccaacacagcctgcagccctgaggagagctgtgtgctgaagaagcccatcaagagggtgtacaagaagtttgatcctgtgggggagatcctgaagatgcaggatgagctgctgaagcccatcagcaggaaggtgcctgagctgcccctgatgaacctggagaacagcaagcagcccagcgtgtctgagcagctgagcggccccagcgacagcagctcctggcccaagagcggctggcccagcgccttccagaagcccaagggccgcctgccctatgagctgcaggactatgtggaggacaccagcgagtacctggccccccaggagggcaactttgtgtacaagctgttcagcctgcaggacctgctgctgctggtgcgctgcagcgtgcagagaattgagacccggcccaggagcaagaagaggaagaagatccggcggcagtttcctgtgtatgtgctgcccaaggtggagtaccaggcctgctatggagtggaggccctgacagaaagtgagctgtgccgcctgtggacagagagcctgctgcacagcaacagcagcttctacgtgggccacattgatgccttcaccagcaagctgttcctgctggaggagatcaccagcgaggagctgaaggagaagctgagcgccctgaagatcagcaacctcttcaacatcctgcagcacatcctgaagaagctgagcagcctgcaggagggcagctacctgctgagccatgctgctgaggacagcagcctgctgatctacaaggccagtgatggcaaggtgaccaggacagcctacaacctgtacaagacccactgcggcctgcccggggtgcccagcagcctgtctgtgccctgggtgcccctggaccccagcctgctgctgccctaccacatccaccacggccgcatcccctgcaccttcccccccaagagcctggacaccaccacccagcagaagattggaggcaccaggatgcccaccaggagccacaggaaccctgtgtccatggagaccaagagcagctgcctgcctgcccagcaggtggagacagaaggagtggccccccacaagaggaagatcacctag

SEQ ID NO: 162032 - DNA, 2538 bp, Artificial Sequence
  Description of Artificial Sequence: Synthetic coding sequence
atgaagaagcacgtgaatgaggaggtgacagagttcctgaagttcctgcagaacagcgccaagaagtgtgcccaggactacaacatgctgagtgatgatgcccggctcttcacagagaagatcctgcgggcctgcatcgagcaggtgaagaagtacagcgagttctacaccctgcacgaggtgaccagcctgatgggcttcttccccttccgggtggagatgggcctgaagctggagaagaccctgctggccctgggctctgtgaagtatgtgaagacagtgttccccagcatgcccatcaagctgcagctgagcaaggatgacatcgccaccatcgagaccagcgagcagacagctgaggccatgcactatgacatcagcaaggaccccaatgctgagaagctggtgagccgctaccacccccagatcgccctgaccagccagagcctcttcaccctgctgaacaaccacggccccacctacaaggagcagtgggagatccctgtgtgcatccaggtgattcctgtggccggcagcaagcctgtgaaggtgatctacatcaacagccccctgccccagaagaagatgaccatgagggagaggaaccagatcttccacgaggtgcccctgaagttcatgatgagcaagaacacctctgtgcctgtgtctgctgtgttcatggacaagccagaggagttcatcagcgagatggacatgagctgtgaggtgaatgaatgtaggaagattgagagcctggagaacctgtacctggactttgatgatgatgtgacagagctggagacctttggagtgaccaccaccaaggtgtccaagagccccagccctgccagcaccagcacagtgcccaacatgacagatgcccccacagcccccaaggccggcaccaccaccgtggcccccagcgccccagacatcagcgccaacagccgcagcctgagccagatcctgatggagcagctgcagaaggagaagcagctggtgacaggcatggatggcggccctgaggagtgcaagaacaaggatgaccagggctttgagagctgtgagaaggtgagcaacagcgacaagcccctcatccaggacagcgacctgaagaccagtgatgccctgcagctggagaacagccaggagattgagaccagcaacaagaatgacatgaccatcgacatcctgcacgcagatggagagcggcccaacgtgctggagaacctggacaacagcaaggagaagacagtgggcagcgaggccgccaagacagaagatactgtgctgtgcagcagtgacacagatgaagaatgtctcatcatcgacacagagtgcaagaacaacagtgatggcaagacagctgtggtgggcagcaacctgagcagcaggcctgccagccccaacagcagcagcggccaggcctctgtgggcaaccagaccaacacagcctgcagccctgaggagagctgtgtgctgaagaagcccatcaagagggtgtacaagaagtttgatcctgtgggggagatcctgaagatgcaggatgagctgctgaagcccatcagcaggaaggtgcctgagctgcccctgatgaacctggagaacagcaagcagcccagcgtgtctgagcagctgagcggccccagcgacagcagctcctggcccaagagcggctggcccagcgccttccagaagcccaagggccgcctgccctatgagctgcaggactatgtggaggacaccagcgagtacctggccccccaggagggcaactttgtgtacaagctgttcagcctgcaggacctgctgctgctggtgcgctgcagcgtgcagagaattgagacccggcccaggagcaagaagaggaagaagatccggcggcagtttcctgtgtatgtgctgcccaaggtggagtaccaggcctgctacggcgtggaggccctgacagagagcgagctgtgccgcctgtggacagagagcctgctgcacagcaacagcagcttctacgtgggccacattgatgccttcaccagcaagctgttcctgctggaggagatcaccagcgaggagctgaaggagaagctgagcgccctgaagatcagcaacctcttcaacatcctgcagcacatcctgaagaagctgagcagcctgcaggagggcagctacctgctgagccacgccgctgaggacagcagcctgctgatctacaaggccagtgatggcaaggtgaccaggacagcctacaacctgtacaagacccactgcggcctgcccggggtgcccagcagcctgtctgtgccctgggtgcccctggaccccagcctgctgctgccctaccacatccaccacggccgcatcccctgcaccttcccccccaagagcctggacaccaccacccagcagaagattggaggcaccaggatgcccaccaggagccacagaaatcctgtgtccatggagaccaagagcagctgcctgcctgcccagcaggtggagacagagggcgtggccccccacaagaggaagatcacctag

SEQ ID NO: 162033 - DNA, 1017 bp, Artificial Sequence
  Description of Artificial Sequence: Synthetic coding sequence
atgagcagcaagatggtgatcagcgagcccggcctgaactgggacatcagccccaagaatggcctgaagaccttcttcagccgggagaactacaaggaccacagcatggcccccagcctgaaggagctgcgggtgctgagcaacagaagaattggagagaacctgaatgccagcgccagctctgtggagaatgaacctgctgtgagcagcgccacccaggccaaggagaaggtgaagaccaccatcggcatggtgctgctgcccaagccccgggtgccctacccccgcttcagccgcttcagccagcgggagcagaggagctatgtggacctgctggtgaagtatgccaagatcccagccaacagcaaggctgtgggcatcaacaagaatgactacctgcagtacctggacatgaagaagcacgtgaatgaggaggtgacagagttcctgaagttcctgcagaacagcgccaagaagtgtgcccaggactacaacatgctgagtgatgatgcccggctcttcacagagaagatcctgcgggcctgcatcgagcaggtgaagaagtacagcgagttctacaccctgcacgaggtgaccagcctgatgggcttcttccccttccgggtggagatgggcctgaagctggagaagaccctgctggccctgggctctgtgaagtatgtgaagacagtgttccccagcatgcccatcaagctgcagctgagcaaggatgacatcgccaccatcgagaccagcgagcagacagctgaggccatgcactatgacatcagcaaggaccccaatgctgagaagctggtgagccgctaccacccccagatcgccctgaccagccagagcctcttcaccctgctgaacaaccacggccccacctacaaggagcagtgggagatccctgtgtgcatccaggtgattcctgtggccggcagcaagcctgtgaaggtgatctacatcaacagccccctgccccagaagaagatgaccatgagggagaggtag

SEQ ID NO: 162034 - DNA, 438 bp, Artificial Sequence
  Description of Artificial Sequence: Synthetic coding sequence
atgagcagcaagatggtgatcagcgagcccggcctgaactgggacatcagccccaagaatggcctgaagaccttcttcagccgggagaactacaaggaccacagcatggcccccagcctgaaggagctgcgggtgctgagcaacagaagaattggagagaacctgaatgccagcgccagctctgtggagaatgaacctgctgtgagcagcgccacccaggccaaggagaaggtgaagaccaccatcggcatggtgctgctgcccaagccccgggtgccctacccccgcttcagccgcttcagccagcgggagcagaggagctatgtggacctgctggtgaagtatgccaagatcccagccaacagcaaggctgtgggcatcaacaagaatgactacctgcagtacctggacatgaagaagcacgtgaatgaggagtag

SEQ ID NO: 162035 - DNA, 300 bp, Artificial Sequence
  Description of Artificial Sequence: Synthetic coding sequence
atgagcagcaagatggtgatcagcgagcccggcctgaactgggacatcagccccaagaatggcctgaagaccttcttcagccgggagaactacaaggaccacagcatggcccccagcctgaaggagctgcgggtgctgagcaacagaagaattggagagaacctgaatgccagcgccagctctgtggagaatgaacctgctgtgagcagcgccacccaggccaaggagaaggtgaagaccaccatcggcatggtgctgctgcccaagccccgggtgccctacccccgcttcagcaggtag

SEQ ID NO: 162036 - DNA, 285 bp, Artificial Sequence
  Description of Artificial Sequence: Synthetic coding sequence
atgagcagcaagatggtgatcagcgagcccggcctgaactgggacatcagccccaagaatggcctgaagaccttcttcagccgggagaactacaaggaccacagcatggcccccagcctgaaggagctgcgggtgctgagcaacagaagaattggagagaacctgaatgccagcgccagctctgtggagaatgaacctgctgtgagcagcgccacccaggccaaggagaaggtgaagaccaccatcggcatggtgctgctgcccaagccccgggtgccctactag

SEQ ID NO: 162037 - DNA, 846 bp, Artificial Sequence
  Description of Artificial Sequence: Synthetic coding sequence
atgggccagaagaagcagaggcctgcccgggccggccagccccacagcagcagtgatgctgcccaggccccagctgagcagccccacagcagcagtgatgctgcccaggccccctgcccccgggagcgctgcctgggcccccccaccaccccaggcccctaccgcagcatctacttcagcagccccaagggccacctgacccggctgggcctggagttctttgaccagcctgctgtgcccctggcccgggccttcctgggccaggtgctggtgcggcggctgcccaacggcacagagctgcggggccgcatcgtggagacagaggcctacctgggcccagaagatgaagctgcccacagccggggcggccggcagacccccaggaacagaggcatgttcatgaagccaggcaccctgtatgtgtacatcatctacggcatgtacttctgcatgaacatcagcagccagggagatggagcctgtgtgctgctgcgggccctggagcccctggagggcctggagaccatgaggcagctgcggagcaccctgaggaaaggaacagccagccgggtgctgaaggaccgggagctgtgcagcggccccagcaagctgtgccaggccctggccatcaacaagagctttgaccagagggacctggcccaggatgaggccgtgtggctggagcggggccccctggagcccagcgagcctgctgtggtggccgccgcccgggtgggcgtgggccacgccggggagtgggccaggaagcccctgcgcttctacgtgcggggcagcccctgggtgtctgtggtggacagagtggccgagcaggacacccaggcctag

SEQ ID NO: 162038 - DNA, 924 bp, Artificial Sequence
  Description of Artificial Sequence: Synthetic coding sequence
atggaggccgacaaggatgacacccagcagatcctgaaggagcacagcccagatgagttcatcaaggatgagcagaacaagggcctgattgatgagatcaccaagaagaacatccagctgaagaaggagatccagaagctggagacagagctgcaggaggccaccaaggagttccagatcaaggaggacatccctgagaccaagatgaagttcctgtctgtggagaccccagaaaatgacagccagctgagcaacatcagctgcagcttccaggtgagcagcaaggtgccctatgagatccagaagggccaggccctgatcacctttgagaaggaggaggtggcccagaatgtggtgtccatgagcaagcaccacgtgcagatcaaggatgtgaacctggaggtgacagccaagcctgtgcccctgaacagcggcgtgcgcttccaggtgtatgtggaggtgtccaagatgaagatcaacgtgacagagatcccagacaccctgcgggaggaccagatgagggacaagctggagctgtccttcagcaagagcagaaatggaggaggagaggtggacagagtggactatgaccggcagagcggcagcgctgtgatcacctttgtggagattggagtggccgacaagatcctgaagaagaaggagtaccccctgtacatcaaccagacctgccaccgggtgacagtgagcccctacacagagatccacctgaagaagtaccagatcttcagcggcaccagcaagaggacagtgctgctgaccggcatggagggcatccagatggatgaggagatcgtggaggacctgatcaacatccacttccagagggccaagaatggaggaggagaggtggatgtggtgaagtgcagcctgggccagccccacatcgcctactttgaggagtag

SEQ ID NO: 162039 - DNA, 90 bp, Artificial Sequence
  Description of Artificial Sequence: Synthetic coding sequence
atggaggccgacaaggatgacacccagcagatcctgaaggagcacagcccagatgagttcatcaaggatgagcagaacaagggcctgtag

SEQ ID NO: 162040 - DNA, 1185 bp, Artificial Sequence
  Description of Artificial Sequence: Synthetic coding sequence
atgagccgggagatgcaggatgtggacctggccgaggtgaagcccctggtggagaagggggagaccatcaccggcctgctgcaggagtttgatgtgcaggagcaggacatcgagaccctgcacggctctgtgcacgtgaccctgtgtggcacccccaagggcaacagacctgtgatcctgacctaccatgacatcggcatgaaccacaagacctgctacaaccccctcttcaactatgaggacatgcaggagatcacccagcactttgctgtgtgccacgtggatgcccctggccagcaggatggagctgccagcttccctgctggctacatgtaccccagcatggaccagctggccgagatgctgcccggggtgctgcagcagtttggcctgaagagcatcatcggcatgggcactggagctggggcctacatcctgaccaggtttgccctgaacaaccctgagatggtggagggcctggtgctgatcaacgtgaacccctgtgccgagggctggatggactgggccgccagcaagatcagcggctggacccaggccctgcctgacatggtggtgagccacctgtttgggaaggaggagatgcagagcaatgtggaggtggtgcacacctaccggcagcacatcgtgaatgacatgaaccctggcaacctgcacctgttcatcaatgcctacaacagccggcgggacctggagattgagcggcccatgcctggcacccacacagtgaccctgcagtgcccagccctgctggtggtgggggacagcagccctgctgtggatgctgtggtggagtgcaacagcaagctggaccccaccaagaccaccctgctgaagatggctgactgtggcggcctgccccagatcagccagcctgccaagctggccgaggccttcaagtactttgtgcagggcatgggctacatgcccagcgcctccatgacccggctgatgaggagcaggacagccagcggcagctctgtgaccagcctggatggcaccaggagccgcagccacaccagcgagggcaccaggagccgcagccacaccagcgagggcaccaggagccgcagccacaccagcgagggcgcccacctggacatcacccccaacagcggggctgctggcaacagcgctggccccaagtccatggaggtgtcctgctag

SEQ ID NO: 162041 - DNA, 975 bp, Artificial Sequence
  Description of Artificial Sequence: Synthetic coding sequence
atgagccgggagatgcaggatgtggacctggccgaggtgaagcccctggtggagaagggggagaccatcaccggcctgctgcaggagtttgatgtgcaggagcaggacatcgagaccctgcacggctctgtgcacgtgaccctgtgtggcacccccaagggcaacagacctgtgatcctgacctaccatgacatcggcatgaaccacaagacctgtgcctacatcctgaccaggtttgccctgaacaaccctgagatggtggagggcctggtgctgatcaacgtgaacccctgtgccgagggctggatggactgggccgccagcaagatcagcggctggacccaggccctgcctgacatggtggtgagccacctgtttgggaaggaggagatgcagagcaatgtggaggtggtgcacacctaccggcagcacatcgtgaatgacatgaaccctggcaacctgcacctgttcatcaatgcctacaacagccggcgggacctggagattgagcggcccatgcctggcacccacacagtgaccctgcagtgcccagccctgctggtggtgggggacagcagccctgctgtggatgctgtggtggagtgcaacagcaagctggaccccaccaagaccaccctgctgaagatggctgactgtggcggcctgccccagatcagccagcctgccaagctggccgaggccttcaagtactttgtgcagggcatgggctacatgcccagcgcctccatgacccggctgatgaggagcaggacagccagcggcagctctgtgaccagcctggatggcaccaggagccgcagccacaccagcgagggcaccaggagccgcagccacaccagcgagggcaccaggagccgcagccacaccagcgagggcgcccacctggacatcacccccaacagcggggctgctggcaacagcgctggccccaagtccatggaggtgtcctgctag

SEQ ID NO: 162042 - DNA, 1185 bp, Artificial Sequence; identical to SEQ ID NO: 162040
  Description of Artificial Sequence: Synthetic coding sequence

SEQ ID NO: 162043 - DNA, 498 bp, Artificial Sequence
  Description of Artificial Sequence: Synthetic coding sequence
atgagccgggagatgcaggatgtggacctggccgaggtgaagcccctggtggagaagggggagaccatcaccggcctgctgcaggagtttgatgtgcaggagcaggacatcgagaccctgcacggctctgtgcacgtgaccctgtgtggcacccccaagggcaacagacctgtgatcctgacctaccatgacatcggcatgaaccacaagacctgctacaaccccctcttcaactatgaggacatgcaggagatcacccagcactttgctgtgtgccacgtggatgcccctggccagcaggatggagctgccagcttccctgctggctacatgtaccccagcatggaccagctggccgagatgctgcccggggtgctgcagcagtttggcctgaagagcatcatcggcatgggcactggagctggggcctacatcctgaccaggtttgccctgaacaaccctgagatggtggagggcctggtgctgatcaacgtgtag

SEQ ID NO: 162044 - DNA, 477 bp, Artificial Sequence
  Description of Artificial Sequence: Synthetic coding sequence
atgagccgggagatgcaggatgtggacctggccgaggtgaagcccctggtggagaagggggagaccatcaccggcctgctgcaggagtttgatgtgcaggagcaggacatcgagaccctgcacggctctgtgcacgtgaccctgtgtggcacccccaagggcaacagacctgtgatcctgacctaccatgacatcggcatgaaccacaagacctgctacaaccccctcttcaactatgaggacatgcaggagatcacccagcactttgctgtgtgccacgtggatgcccctggccagcaggatggagctgccagcttccctgctggctacatgtaccccagcatggaccagctggccgagatgctgcccggggtgctgcagcagtttggcctgaagagcatcatcggcatgggcactggagctggggcctacatcctgaccaggtttgccctgaacaaccctgagatggtggagtag

SEQ ID NO: 162045 - DNA, 402 bp, Artificial Sequence
  Description of Artificial Sequence: Synthetic coding sequence
atgagccgggagatgcaggatgtggacctggccgaggtgaagcccctggtggagaagggggagaccatcaccggcctgctgcaggagtttgatgtgcaggagcaggacatcgagaccctgcacggctctgtgcacgtgaccctgtgtggcacccccaagggcaacagacctgtgatcctgacctaccatgacatcggcatgaaccacaagacctgctacaaccccctcttcaactatgaggacatgcaggagatcacccagcactttgctgtgtgccacgtggatgcccctggccagcaggatggagctgccagcttccctgctggctacatgtaccccagcatggaccagctggccgagatgctgcccggggtgctgcagcagtttggcctgaagagctag

SEQ ID NO: 162046 - DNA, 477 bp, Artificial Sequence; identical to SEQ ID NO: 162044
  Description of Artificial Sequence: Synthetic coding sequence

SEQ ID NO: 162047 - DNA, 669 bp, Artificial Sequence
  Description of Artificial Sequence: Synthetic coding sequence
atggactgggccgccagcaagatcagcggctggacccaggccctgcctgacatggtggtgagccacctgtttgggaaggaggagatgcagagcaatgtggaggtggtgcacacctaccggcagcacatcgtgaatgacatgaaccctggcaacctgcacctgttcatcaatgcctacaacagccggcgggacctggagattgagcggcccatgcctggcacccacacagtgaccctgcagtgcccagccctgctggtggtgggggacagcagccctgctgtggatgctgtggtggagtgcaacagcaagctggaccccaccaagaccaccctgctgaagatggctgactgtggcggcctgccccagatcagccagcctgccaagctggccgaggccttcaagtactttgtgcagggcatgggctacatgcccagcgcctccatgacccggctgatgaggagcaggacagccagcggcagctctgtgaccagcctggatggcaccaggagccgcagccacaccagcgagggcaccaggagccgcagccacaccagcgagggcaccaggagccgcagccacaccagcgagggcgcccacctggacatcacccccaacagcggggctgctggcaacagcgctggccccaagtccatggaggtgtcctgctag

SEQ ID NO: 162048 - DNA, 450 bp, Artificial Sequence
  Description of Artificial Sequence: Synthetic coding sequence
atgagccgggagatgcaggatgtggacctggccgaggtgaagcccctggtggagaagggggagaccatcaccggcctgctgcaggagtttgatgtgcaggagcaggacatcgagaccctgcacggctctgtgcacgtgaccctgtgtggcaccccaccagccaagctggccgaggccttcaagtactttgtgcagggcatgggctacatgcccagcgcctccatgacccggctgatgaggagcaggacagccagcggcagctctgtgaccagcctggatggcaccaggagccgcagccacaccagcgagggcaccaggagccgcagccacaccagcgagggcaccaggagccgcagccacaccagcgagggcgcccacctggacatcacccccaacagcggggccgccggcaacagcgctggccccaagtccatggaggtgtcctgctag

SEQ ID NO: 162049 - DNA, 942 bp, Artificial Sequence
  Description of Artificial Sequence: Synthetic coding sequence
atgcaggagatcacccagcactttgctgtgtgccacgtggatgcccctggccagcaggatggagctgccagcttccctgctggctacatgtaccccagcatggaccagctggccgagatgctgcccggggtgctgcagcagtttggcctgaagagcatcatcggcatgggcaccggggccggggcctacatcctgaccaggtttgccctgaacaaccctgagatggtggagggcctggtgctgatcaacgtgaacccctgtgccgagggctggatggactgggccgccagcaagatcagcggctggacccaggccctgcctgacatggtggtgagccacctgtttgggaaggaggagatgcagagcaatgtggaggtggtgcacacctaccggcagcacatcgtgaatgacatgaaccctggcaacctgcacctgttcatcaatgcctacaacagcagaagagacctggagattgaaagacccatgcctggcacccacacagtgaccctgcagtgcccagccctgctggtggtgggggacagcagccctgctgtggatgctgtggtggagtgcaacagcaagctggaccccaccaagaccaccctgctgaagatggctgactgtggcggcctgccccagatcagccagcctgccaagctggccgaggccttcaagtactttgtgcagggcatgggctacatgcccagcgcctccatgacccggctgatgaggagcaggacagccagcggcagctctgtgaccagcctggatggcaccaggagccgcagccacaccagcgagggcaccaggagccgcagccacaccagcgagggcaccaggagccgcagccacaccagcgagggcgcccacctggacatcacccccaacagcggggccgccggcaacagcgctggccccaagtccatggaggtgtcctgctag

SEQ ID NO: 162050 - DNA, 288 bp, Artificial Sequence
  Description of Artificial Sequence: Synthetic coding sequence
atgagccgggagatgcaggatgtggacctggccgaggtgaagcccctggtggagaagggggagaccatcaccggcctgctgcaggagtttgatgtgcagaccaagccagccaccacccccagcagcaccaccaggacctgccgccgcagccccagcaccctgcccagcgccacctggacccccctggccagcaggacagcccagccccccagcccccagggcacctgcaccccaccctggatctcctggctgaagtgcttcctggagagcttcaacagcctgggctag

SEQ ID NO: 162051 - DNA, 1491 bp, Artificial Sequence
  Description of Artificial Sequence: Synthetic coding sequence
atggctgatgaaagtgaaacagctgtgaagcccccagccccacccctgccccagatgatggagggcaatggaaatggacatgagcactgcagcgactgtgaaaatgaggaggacaacagctacaacagaggaggcctgagccctgccaatgacaccggggccaagaagaagaagaagaagcagaagaagaagaaggagaagggcagcgagacagattctgcccaggaccagcctgtgaagatgaacagcctgcctgctgagcgcatccaggagatccagaaggccatcgagctgttctctgtgggccagggccctgccaagaccatggaggaggccagcaagaggagctaccagttctgggacacccagcctgtgcccaagctgggggaggtggtgaacacccacggccctgtggagccagacaaggacaacatccggcaggagccctacaccctgccccagggcttcacctgggatgccctggacctgggggacagaggagtgctgaaggagctgtacaccctgctgaatgaaaactacgtggaggatgatgacaacatgttccgctttgactacagccctgagttcctgctgtgggccctgcggcccccaggctggctgccccagtggcactgcggcgtgcgggtggtgagcagcaggaagctggtgggcttcatcagcgccatcccagccaacatccacatctatgacacagagaagaagatggtggagatcaacttcctgtgtgtgcacaagaagctgcggagcaagagggtggcccctgtgctgatccgggagatcaccaggagagtgcacctggagggcatcttccaggccgtgtacacagctggggtggtgctgcccaagcctgtgggcacctgccgctactggcacaggagcctgaaccccaggaagctgattgaggtgaagttcagccacctgagcaggaacatgaccatgcagaggaccatgaagctgtaccgcctgcctgagacccccaagacagctggcctgcggcccatggagaccaaggacatccctgtggtgcaccagctgctgacccgctacctgaagcagttccacctgacccctgtgatgagccaggaggaggtggagcactggttctacccccaggagaacatcatcgacacctttgtggtggagaatgccaatggagaggtgacagacttcctgtccttctacaccctgcccagcaccatcatgaaccaccccacccacaagagcctgaaggccgcctacagcttctacaacgtgcacacccagacccccctgctggacctgatgtctgatgccctggtgctggccaagatgaagggctttgatgtgttcaatgccctggacctgatggagaacaagaccttcctggagaagctgaagtttggaattggagatggcaacctgcagtactacctgtacaactggaagtgccccagcatgggcgctgagaaggtgggcctggtgctgcagtag

SEQ ID NO: 162052 - DNA, 414 bp, Artificial Sequence
  Description of Artificial Sequence: Synthetic coding sequence
atggctgatgaaagtgaaacagctgtgaagcccccagccccacccctgccccagatgatggagggcaatggaaatggacatgagcactgcagcgactgtgaaaatgaggaggacaacagctacaacagaggaggcctgagccctgccaatgacaccggggccaagaagaagaagaagaagcagaagaagaagaaggagaagggcagcgagacagattctgcccaggaccagcctgtgaagatgaacagcctgcctgctgagcgcatccaggagatccagaaggccatcgagctgttctctgtgggccagggccctgccaagaccatggaggaggccagcaagaggagctaccagttctgggacacccagcctgtgcccaagctggccaagaggacagtgcaccccccagagtag

SEQ ID NO: 162053 - DNA, 1491 bp, Artificial Sequence; identical to SEQ ID NO: 162051
  Description of Artificial Sequence: Synthetic coding sequence

SEQ ID NO: 162054 - DNA, 1590 bp, Artificial Sequence
  Description of Artificial Sequence: Synthetic coding sequence
atggctgaagattctgagagcgctgccagccagcagagcctggagctggatgaccaggacacctgtggcattgatggagacaatgaggaggagacagagcacgccaagggcagccctgggggctacctgggcgccaagaagaagaagaagaagcagaagaggaagaaggagaagcccaacagcggcggcaccaagagtgacagcgccagtgacagccaggagatcaagatccagcagcccagcaagcacaacaccatctggcagcagatctctgctggggccgccatgggcagcgccaccatggagggggagtggacaggcatgagaaatgaccacaagaaccccagcgtgcccatgcagaagctgcaggacatccagagggccatggagctgctgagcgcctgccagggccctgccaggaacattgatgaagctgccaagcaccgctaccagttctgggacacccagcctgtgcccaagctggatgaggtgatcaccagccacggggccattgaaccagacaaggacaacgtgcggcaggagccctacagcctgccccagggcttcatgtgggacaccctggacctgagtgatgctgaggtgctgaaggagctgtacaccctgctgaatgaaaattatgtggaggatgatgacaacatgttccgctttgactacagccctgagttcctgctgtgggccctgcggcccccaggctggctgctgcagtggcactgcggcgtgcgggtgagcagcaacaagaagctggtgggcttcatcagcgccatcccagccaacatccgcatctatgattctgtgaagaagatggtggagatcaacttcctgtgtgtgcacaagaagctgcggagcaagagggtggcccctgtgctgatccgggagatcacccggcgggtgaacctggagggcatcttccaggccgtgtacacagctggggtggtgctgcccaagcccatcgccacctgccgctactggcacaggagcctgaaccccaggaagctggtggaggtgaagttcagccacctgagcaggaacatgaccctgcagaggaccatgaagctgtaccgcctgcctgatgtgaccaagaccagcggcctgcggcccatggagcccaaggacatcaagtctgtgcgggagctgatcaacacctacctgaagcagttccacctggcccctgtgatggatgaggaggaggtggcccactggttcctgccccgggagcacatcatcgacacctttgtggtggagagccccaacgggaagctgacagacttcctgtccttctacaccctgcccagcacagtgatgcaccacccagcccacaagagcctgaaggccgcctacagcttctacaacatccacacagagacccccctgctggacctgatgtctgatgccctgatcctggccaagagcaagggctttgatgtgttcaatgccctggacctgatggagaacaagaccttcctggagaagctgaagtttggaattggagatggcaacctgcagtactacctgtacaactggcgctgccctggaacagattctgagaaggtgggcctggtgctgcagtag

SEQ ID NO: 162055 - DNA, 1458 bp, Artificial Sequence
  Description of Artificial Sequence: Synthetic coding sequence
atgagaagaagaagaagcacccccaaggaggtgctggagggcatctgggagcccaagaggaagagaagaaacagaagagagaagagaagaaaccagatccctgaggcccccagccagaccaggcacctgatcccccggcggctgaagttcagcagcctgaggaacaccaccccatctggcagccgcttccagcgggagcagccctggaaccccagcgtgcccatgcagaagctgcaggacatccagagggccatggagctgctgagcgcctgccagggccctgccaggaacattgatgaagctgccaagcaccgctaccagttctgggacacccagcctgtgcccaagctggatgaggtgatcaccagccacggggccattgaaccagacaaggacaacgtgcggcaggagccctacagcctgccccagggcttcatgtgggacaccctggacctgagtgatgctgaggtgctgaaggagctgtacaccctgctgaatgaaaattatgtggaggatgatgacaacatgttccgctttgactacagccctgagttcctgctgtgggccctgcggcccccaggctggctgctgcagtggcactgcggcgtgcgggtgagcagcaacaagaagctggtgggcttcatcagcgccatcccagccaacatccgcatctatgattctgtgaagaagatggtggagatcaacttcctgtgtgtgcacaagaagctgcggagcaagagggtggcccctgtgctgatccgggagatcacccggcgggtgaacctggagggcatcttccaggccgtgtacacagctggggtggtgctgcccaagcccatcgccacctgccgctactggcacaggagcctgaaccccaggaagctggtggaggtgaagttcagccacctgagcaggaacatgaccctgcagaggaccatgaagctgtaccgcctgcctgatgtgaccaagaccagcggcctgcggcccatggagcccaaggacatcaagtctgtgcgggagctgatcaacacctacctgaagcagttccacctggcccctgtgatggatgaggaggaggtggcccactggttcctgccccgggagcacatcatcgacacctttgtggtggagagccccaacgggaagctgacagacttcctgtccttctacaccctgcccagcacagtgatgcaccacccagcccacaagagcctgaaggccgcctacagcttctacaacatccacacagagacccccctgctggacctgatgtctgatgccctgatcctggccaagagcaagggctttgatgtgttcaatgccctggacctgatggagaacaagaccttcctggagaagctgaagtttggaattggagatggcaacctgcagtactacctgtacaactggcgctgccctggaacagattctgagaaggtgggcctggtgctgcagtag

SEQ ID NO: 162056 - DNA, 1497 bp, Artificial Sequence
  Description of Artificial Sequence: Synthetic coding sequence
atggctgaagattctgagagcgctgccagccagcagagcctggagctggatgaccaggacacctgtggcattgatggagacaatgaggaggagacagagcacgccaagggcagccctgggggctacctgggcgccaagaagaagaagaagaagcagaagaggaagaaggagaagcccaacagcggcggcaccaagagtgacagcgccagtgacagccaggagatcaagatccagcagcccagcaagaaccccagcgtgcccatgcagaagctgcaggacatccagagggccatggagctgctgagcgcctgccagggccctgccagaaatattgatgaggccgccaagcaccgctaccagttctgggacacccagcctgtgcccaagctggatgaagtcatcaccagccatggagccatcgagccagacaaggacaacgtgcggcaggagccctacagcctgccccagggcttcatgtgggacaccctggacctgagtgatgctgaggtgctgaaggagctgtacaccctgctgaatgaaaactacgtggaggatgatgacaacatgttccgctttgactacagccctgagttcctgctgtgggccctgcggcccccaggctggctgctgcagtggcactgcggcgtgcgggtgagcagcaacaagaagctggtgggcttcatcagcgccatcccagccaacatccgcatctatgacagcgtgaagaagatggtggagatcaacttcctgtgtgtgcacaagaagctgcggagcaagagggtggcccctgtgctgatccgggagatcaccaggagagtgaacctggagggcatcttccaggccgtgtacacagctggggtggtgctgcccaagcccatcgccacctgccgctactggcacaggagcctgaaccccaggaagctggtggaggtgaagttcagccacctgagcaggaacatgaccctgcagaggaccatgaagctgtaccgcctgcctgatgtgaccaagaccagcggcctgcggcccatggagcccaaggacatcaagtctgtgcgggagctgatcaacacctacctgaagcagttccacctggcccctgtgatggatgaggaggaggtggcccactggttcctgccccgggagcacatcatcgacacctttgtggtggagagccccaacgggaagctgacagacttcctgtccttctacaccctgcccagcacagtgatgcaccacccagcccacaagagcctgaaggccgcctacagcttctacaacatccacacagagacccccctgctggacctgatgtctgatgccctgatcctggccaagagcaaaggatttgatgtgttcaatgccctggacctgatggagaacaagaccttcctggagaagctgaagtttggaattggagatggcaacctgcagtactacctgtacaactggcgctgccccggcacagacagcgagaaggtgggcctggtgctgcagtag

SEQ ID NO: 162057 - DNA, 234 bp, Artificial Sequence
  Description of Artificial Sequence: Synthetic coding sequence
atgtctgatgccctgatcctggccaagagcaaaggatttgatgtgttcaatgccctggacctgatggagaacaagaccttcctggagaagctgaagtttggaattggagatggcaacctgcagtactacctgtacaactggcgctgccccggcacagacagcgagaagggcagcggcaactttgtgaatgccaacgggaagctgctgcctgatgtgtgccggcggcccccatag

SEQ ID NO: 162058 - DNA, 1458 bp, Artificial Sequence
  Description of Artificial Sequence: Synthetic coding sequence
atggccagcccctggaggggggcccacgaggtgctggagggcatctgggagcccaagaggaagagaagaaacagaagagagaagagaagaaaccagatccctgaggcccccagccagaccaggcacctgatcccccggcggctgaagttcagcagcctgaggaacaccaccccatctggcagccgcttccagcgggagcagccctggaaccccagcgtgcccatgcagaagctgcaggacatccagagggccatggagctgctgagcgcctgccagggccctgccaggaacattgatgaagctgccaagcaccgctaccagttctgggacacccagcctgtgcccaagctggatgaggtgatcaccagccacggggccattgaaccagacaaggacaacgtgcggcaggagccctacagcctgccccagggcttcatgtgggacaccctggacctgagtgatgctgaggtgctgaaggagctgtacaccctgctgaatgaaaattatgtggaggatgatgacaacatgttccgctttgactacagccctgagttcctgctgtgggccctgcggcccccaggctggctgctgcagtggcactgcggcgtgcgggtgagcagcaacaagaagctggtgggcttcatcagcgccatcccagccaacatccgcatctatgattctgtgaagaagatggtggagatcaacttcctgtgtgtgcacaagaagctgcggagcaagagggtggcccctgtgctgatccgggagatcacccggcgggtgaacctggagggcatcttccaggccgtgtacacagctggggtggtgctgcccaagcccatcgccacctgccgctactggcacaggagcctgaaccccaggaagctggtggaggtgaagttcagccacctgagcaggaacatgaccctgcagaggaccatgaagctgtaccgcctgcctgatgtgaccaagaccagcggcctgcggcccatggagcccaaggacatcaagtctgtgcgggagctgatcaacacctacctgaagcagttccacctggcccctgtgatggatgaggaggaggtggcccactggttcctgccccgggagcacatcatcgacacctttgtggtggagagccccaacgggaagctgacagacttcctgtccttctacaccctgcccagcacagtgatgcaccacccagcccacaagagcctgaaggccgcctacagcttctacaacatccacacagagacccccctgctggacctgatgtctgatgccctgatcctggccaagagcaagggctttgatgtgttcaatgccctggacctgatggagaacaagaccttcctggagaagctgaagtttggaattggagatggcaacctgcagtactacctgtacaactggcgctgccctggaacagattctgagaaggtgggcctggtgctgcagtag

SEQ ID NO: 162059 - DNA, 933 bp, Artificial Sequence
  Description of Artificial Sequence: Synthetic coding sequence
atgttccgctttgactacagccctgagttcctgctgtgggccctgcggcccccaggctggctgctgcagtggcactgcggcgtgcgggtgagcagcaacaagaagctggtgggcttcatcagcgccatcccagccaacatccgcatctatgacagcgtgaagaagatggtggagatcaacttcctgtgtgtgcacaagaagctgcggagcaagagggtggcccctgtgctgatccgggagatcaccaggagagtgaacctggagggcatcttccaggccgtgtacacagctggggtggtgctgcccaagcccatcgccacctgccgctactggcacaggagcctgaaccccaggaagctggtggaggtgaagttcagccacctgagcaggaacatgaccctgcagaggaccatgaagctgtaccgcctgcctgatgtgaccaagaccagcggcctgcggcccatggagcccaaggacatcaagtctgtgcgggagctgatcaacacctacctgaagcagttccacctggcccctgtgatggatgaggaggaggtggcccactggttcctgccccgggagcacatcatcgacacctttgtggtggagagccccaacgggaagctgacagacttcctgtccttctacaccctgcccagcacagtgatgcaccacccagcccacaagagcctgaaggccgcctacagcttctacaacatccacacagagacccccctgctggacctgatgtctgatgccctgatcctggccaagagcaaaggatttgatgtgttcaatgccctggacctgatggagaacaagaccttcctggagaagctgaagtttggaattggagatggcaacctgcagtactacctgtacaactggcgctgccccggcacagacagcgagaaggtgggcctggtgctgcagtag

SEQ ID NO: 162060 - DNA, 459 bp, Artificial Sequence
  Description of Artificial Sequence: Synthetic coding sequence
atggaggccgtgctgaatgagctggtgtctgtggaggacctgctgaagtttgagaagaagttccagagcgagaaggctgctggctctgtgtccaagagcacccagtttgaatatgcctggtgcctggtgcgcagcaagtacaatgatgacatcagaaaaggaattgtgctgctggaggagctgctgcccaagggcagcaaggaggagcagagggactatgtgttctacctggccgtgggcaactaccgcctgaaggagtatgagaaggccctgaagtatgtgcggggcctgctgcagacagagccccagaacaaccaggccaaggagctggagcggctgattgacaaggccatgaagaaggatggcctggtgggcatggccatcgtgggcggcatggccctgggcgtggccggcctggccggcctgattggcctggccgtgtccaagagcaagagctag

SEQ ID NO: 162061 - DNA, 2076 bp, Artificial Sequence
  Description of Artificial Sequence: Synthetic coding sequence
atggccctgctgctgaccctgaccagcccagacctggagggcacctgggacacccgggacaaggatggcttcaaggcccaggagggcccccccctggccgtgcctgagttccctgtgtgtggcctgtaccgcatctacggcgtgtgtggcagcttcagcagcttcttcatcatccgctgcagcctgtgtgccctggagaccctgaagagcccccagcacgaccccctggagatccctgagcagagcctgaagctgatccccctggtgtctgggaagcgggagctgacccggggccagaaggccggggagaagcccctggccgccggccctggagaggaggagctgctgcggggcagcgccccccacgcccaggacacccagagcgaggagctgccccccagctgcaccatcagcggggagaagaagcccccagctgtgtctggagaggccactggagcagatgctggccgcctgtgccccccacccaggagccgggccccccacaaggacaggaccctggcccggagccggccccagacccagggcgaggactgcagcctgcctgtgggggaggtgaagattggcaagaggagctacagccctgcccctgggaagcagaagaagcccaatgccatgggcctggcccccaccagcagccctggggcccccaacagcgcccgggccacccacaaccctgtgccctgtggcagcggccggggcccctgccacctggccaacctgctgagcaccctggcccagagcaaccagaacagagaccacaagcagggccccccagaggtgacctgccagatcaggaagaagaccaggaccctgtacagaagtgaccagctggaggagctggagaagatcttccaggaggaccactacccagacagcgacaagaggcgggagatcgcccagacagtgggcgtgaccccccagaggatcatggtgaagggagctggcagcctggtggccggctggagcggcggcggccccaccatcgagaccctggagctgcagagcgagaggtctgctgtggcctgggtgtggttccagaacagaagagccaagtggaggaagatggagaagctgaatggcaaggagagcaaggacaacccagctgcccctggccctgccagcagccagtgcagcagcgctgctgagatcctgcctgctgtgcccatggagcccaagccagaccccttcccccaggagagccccctggacaccttccctgagccccccatgctgctgaccagtgaccagaccctggcccccacccagcccagcgagggcgcccagagggtggtgaccccacccctcttcagccccccacctgtgagaagagctgacctgcccttccccctgggccctgtgcacaccccccagctgatgcccctgctgatggatgtggccggcagtgacagcagccacaaggatggcccctgtggctcctggggcaccagcatcaccctgcccccaccctgcagctacctggaggagctggagccccaggactaccagcagagcaaccagcccggccccttccagttcagccaggccccccagcccccactcttccagagcccccagcccaagctgccctacctgcccaccttccccttctccatgcccagcagcctgaccctgcccccacctgaggacagcctcttcatgttcccctgtggccccagcggcggcaccagccagggctactgccctggggccagcagcggccagatcctgatgcagcccccagctggcaacattggaacagcctcctggagcgacccctgcctgcctgagctgcccttccctggccccttctgcccccaggccctgggccaccccccaggaggagatggctacttcccagacctcttccccaccccctgcccccaggccctgggccggcagcccagcagcgccctgtcctggatgcctgagggcgcccggcccggcaccggccccctgctgagcaaggccaaggaggagcccccagctgccagcctggaccagcccagcgccctggaggaggcccggggagatgacaagaacagccacgtgccctag

SEQ ID NO: 162062 - DNA, 699 bp, Artificial Sequence
  Description of Artificial Sequence: Synthetic coding sequence
atggagcgctgccccagcctgggcgtgaccctgtatgccctggtggtggtgctgggcctgcgggccaccccagctgggggccagcactacctgcacatccggcctgcccccagcgacaacctgcccctggtggacctgattgagcacccagaccccatctttgaccccaaggagaaggacctgaatgagaccctgctgcggagcctgctgggcggccactatgaccccggcttcatggccaccagccccccagaagatagacctgggggcggcggcggcgctgctggaggagctgaggacctggccgagctggaccagctgctgcggcagaggccttctggggccatgcccagcgagatcaagggcctggagttcagcgagggcctggcccagggcaagaagcagaggctgagcaagaagctgcggaggaagctgcagatgtggctgtggagccagaccttctgccctgtgctgtatgcctggaatgacctgggcagccgcttctggccccgctacgtgaaggtgggcagctgcttcagcaagaggagctgcagcgtgcctgagggcatggtgtgcaagcccagcaagtctgtgcacctgactgtgctgcgctggcgctgccagaggagaggaggccagagatgtggctggatccccatccagtaccccatcatcagcgagtgcaagtgcagctgctag

SEQ ID NO: 162063 - DNA, 990 bp, Artificial Sequence
  Description of Artificial Sequence: Synthetic coding sequence
atgggcacagctgctgctgctgctgctgctgctgctgctgctgctgctggggagggcgcccggagccccagccctgctgctgtgtccctgggcctgggcgtggccgtggtgagcagcctggtgaatggcagcacctttgtgctgcagaagaagggcatcgtgcgggccaagaggcggggcaccagctacctgacagacatcgtgtggtgggccggcaccatcgccatggctgtgggccagatcggcaacttcctggcctacacagctgtgcccaccgtgctggtgacccccctgggcgccctgggcgtgcccttcggcagcatcctggccagctacctgctgaaggagaagctgaacatcctgggcaagctgggctgcctgctgagctgtgccggctctgtggtgctgatcatccacagccccaagtctgagagcgtgaccacccaggccgagctggaggagaagctgaccaaccctgtgtttgtgggctacctgtgcatcgtgctgctgatgctgctgctgctgatcttctggatcgccccagcccacggccccaccaacatcatggtgtacatcagcatctgcagcctgctgggcagcttcaccgtgcccagcaccaagggcatcggcctggccgcccaggacatcctgcacaacaaccccagcagccagagggccctgtgcctgtgcctggtgctgctggccgtgctgggctgcagcatcatcgtgcagttccgctacatcaacaaggccctggagtgctttgacagctctgtgtttggagccatctactacgtggtgttcaccaccctggtgctgctggccagcgccatcctcttccgggagtggagcaatgtgggcctggtggacttcctgggcatggcctgtggcttcaccaccgtgtctgtgggcatcgtgctgatccaggtgttcaaggagttcaacttcaacctgggggagatgaacaagagcaacatgaagacagactag

SEQ ID NO: 162064 - DNA, 765 bp, Artificial Sequence
  Description of Artificial Sequence: Synthetic coding sequence
atggctgtgggccagatcggcaacttcctggcctacacagctgtgcccaccgtgctggtgacccccctgggcgccctgggcgtgcccttcggcagcatcctggccagctacctgctgaaggagaagctgaacatcctgggcaagctgggctgcctgctgagctgtgccggctctgtggtgctgatcatccacagccccaagtctgagagcgtgaccacccaggccgagctggaggagaagctgaccaaccctgtgtttgtgggctacctgtgcatcgtgctgctgatgctgctgctgctgatcttctggatcgccccagcccacggccccaccaacatcatggtgtacatcagcatctgcagcctgctgggcagcttcaccgtgcccagcaccaagggcatcggcctggccgcccaggacatcctgcacaacaaccccagcagccagagggccctgtgcctgtgcctggtgctgctggccgtgctgggctgcagcatcatcgtgcagttccgctacatcaacaaggccctggagtgctttgacagctctgtgtttggagccatctactacgtggtgttcaccaccctggtgctgctggccagcgccatcctcttccgggagtggagcaatgtgggcctggtggacttcctgggcatggcctgtggcttcaccaccgtgtctgtgggcatcgtgctgatccaggtgttcaaggagttcaacttcaacctgggggagatgaacaagagcaacatgaagacagactag

SEQ ID NO: 162065 - DNA, 480 bp, Artificial Sequence
  Description of Artificial Sequence: Synthetic coding sequence
atgctgctgctgctgatcttctggatcgccccagcccacggccccaccaacatcatggtgtacatcagcatctgcagcctgctgggcagcttcaccgtgcccagcaccaagggcatcggcctggccgcccaggacatcctgcacaacaaccccagcagccagagggccctgtgcctgtgcctggtgctgctggccgtgctgggctgcagcatcatcgtgcagttccgctacatcaacaaggccctggagtgctttgacagctctgtgtttggagccatctactacgtggtgttcaccaccctggtgctgctggccagcgccatcctcttccgggagtggagcaatgtgggcctggtggacttcctgggcatggcctgtggcttcaccaccgtgtctgtgggcatcgtgctgatccaggtgttcaaggagttcaacttcaacctgggggagatgaacaagagcaacatgaagacagactag

SEQ ID NO: 162066 - DNA, 765 bp, Artificial Sequence; identical to SEQ ID NO: 162064
  Description of Artificial Sequence: Synthetic coding sequence

SEQ ID NO: 162067 - DNA, 1083 bp, Artificial Sequence
  Description of Artificial Sequence: Synthetic coding sequence
atgagccagggccggggcaagtatgacttctacatcggcctgggcctggccatgagcagcagcatcttcatcggcggcagcttcatcctgaagaagaagggcctgctgcggctggccaggaagggctccatgagagctggccagggcggccacgcctacctgaaggagtggctgtggtgggccggcctgctgtccatgggcgctggggaggtggccaactttgctgcctatgcctttgccccagccaccctggtgacccccctgggcgccctgtctgtgctggtgtctgccatcctgagcagctacttcctgaatgaaaggctgaacctgcacggcaagattggctgcctgctgagcatcctgggcagcacagtgatggtgattcatgcccccaaggaggaggagattgagaccctgaatgagatgagccacaagctgggggaccccggctttgtggtgtttgccaccctggtggtgattgtggccctgatcctgatctttgtggtgggccccaggcatggccagaccaacatcctggtgtacatcaccatctgcagcgtcatcggggccttctctgtgtcctgtgtgaagggcctgggcatcgccatcaaggagctgtttgctgggaagcctgtgctgcggcaccccctggcctggatcctgctgctgagcctcatcgtgtgtgtgtccacccagatcaactacctgaacagagccctggacatcttcaacaccagcatcgtgacccccatctactacgtgttcttcaccacctctgtgctgacctgcagcgccatcctcttcaaggagtggcaggacatgcctgtggatgatgtgattggcaccctgagcggcttcttcaccatcatcgtgggcatcttcctgctgcacgccttcaaggatgtgtccttcagcctggccagcctgcctgtgtccttcaggaaggatgagaaggccatgaatggaaacctgagcaacatgtatgaggtgctgaacaacaatgaggagagcctgacctgtggcatcgagcagcacactggagaaaatgtgtccagaagaaatggaaacctgacagccttctag

SEQ ID NO: 162068 - DNA, 1026 bp, Artificial Sequence
  Description of Artificial Sequence: Synthetic coding sequence
atgagccagggccggggcaagtatgacttctacatcggcctgggcctggccatgagcagcagcatcttcatcggcggcagcttcatcctgaagaagaagggcctgctgcggctggccaggaagggctccatgagagctgtgggcgctggggaggtggccaactttgctgcctatgcctttgccccagccaccctggtgacccccctgggcgccctgtctgtgctggtgtctgccatcctgagcagctacttcctgaatgaaaggctgaacctgcacggcaagattggctgcctgctgagcatcctgggcagcacagtgatggtgatccacgcccccaaggaggaggagattgagaccctgaatgagatgagccacaagctgggggaccccggctttgtggtgtttgccaccctggtggtgattgtggccctgatcctgatctttgtggtgggccccaggcatggccagaccaacatcctggtgtacatcaccatctgcagcgtgattggagccttctctgtgtcctgtgtgaagggcctgggcatcgccatcaaggagctgtttgctgggaagcctgtgctgcggcaccccctggcctggatcctgctgctgagcctgattgtgtgtgtgtccacccagatcaactacctgaacagagccctggacatcttcaacaccagcatcgtgacccccatctactacgtgttcttcaccacctctgtgctgacctgcagcgccatcctcttcaaggagtggcaggacatgcctgtggatgatgtgattggcaccctgagcggcttcttcaccatcatcgtgggcatcttcctgctgcacgccttcaaggatgtgtccttcagcctggccagcctgcctgtgtccttcaggaaggatgagaaggccatgaatggaaacctgagcaacatgtatgaggtgctgaacaacaatgaggagagcctgacctgtggcatcgagcagcacactggagaaaatgtgtccagaagaaatggaaacctgacagccttctag

SEQ ID NO: 162069 - DNA, 1083 bp, Artificial Sequence; identical to SEQ ID NO: 162067
  Description of Artificial Sequence: Synthetic coding sequence

SEQ ID NO: 162070 - DNA, 1083 bp, Artificial Sequence; identical to SEQ ID NO: 162067
  Description of Artificial Sequence: Synthetic coding sequence

SEQ ID NO: 162071 - DNA, 1026 bp, Artificial Sequence; identical to SEQ ID NO: 162068
  Description of Artificial Sequence: Synthetic coding sequence

SEQ ID NO: 162072 - DNA, 180 bp, Artificial Sequence
  Description of Artificial Sequence: Synthetic coding sequence
atgagccagggccggggcaagtatgacttctacatcggcctgggcctggccatgagcagcagcatcttcatcggcggcagcttcatcctgaagaagaagggcctgctgcggctggccaggaagggctccatgagagctggccagggcggccacgcctacctgaaggagtggctgtggtag

SEQ ID NO: 162073 - DNA, 900 bp, Artificial Sequence
  Description of Artificial Sequence: Synthetic coding sequence
atggaggagctggagcagggcctgctgatgcagccctgggcctggctgcagctggccgagaacagcctgctggccaaggtgttcatcaccaagcagggctacgccctgctggtgtctgacctgcagcaggtgtggcatgagcaggtggacacctctgtggtgtcccagagggccaaggagctgaacaagaggctgacagcccccccagctgccttcctgtgccacctggacaacctgctgcggcccctgctgaaggatgctgcccaccccagcgaggccaccttcagctgtgactgtgtggctgatgccctgatcctgcgggtgcgctctgagctgagcggcctgcccttctactggaacttccactgcatgctggccagccccagcctggtgtcccagcacctgatccggcccctgatgggcatgagcctggccctgcagtgccaggtgcgggagctggccaccctgctgcacatgaaggacctggagatccaggactaccaggagagcggggccaccctcatccgggaccggctgaagacagagccctttgaggagaacagcttcctggagcagttcatgattgagaagctgcctgaggcctgcagcattggagatggcaagccctttgtgatgaacctgcaggacctgtacatggctgtgaccacccaggaggtgcaggtgggccagaagcaccagggcgctggggacccccacaccagcaacagcgccagcctgcagggcatcgacagccagtgtgtgaaccagcctgagcagctggtgtcctctgcccccaccctgagcgcccctgagaaggagagcacaggcaccagcggccccctgcagaggccccagctgagcaaggtgaagaggaagaagccccggggcctcttctcctag

SEQ ID NO: 162074 - DNA, 951 bp, Artificial Sequence
  Description of Artificial Sequence: Synthetic coding sequence
atggaggagctggagcagggcctgctgatgcagccctgggcctggctgcagctggccgagaacagcctgctggccaaggtgttcatcaccaagcagggctacgccctgctggtgtctgacctgcagcaggtgtggcatgagcaggtggacacctctgtggtgtcccagagggccaaggagctgaacaagaggctgacagcccccccagctgccttcctgtgccacctggacaacctgctgcggcccctgctgaaggatgctgcccaccccagcgaggccaccttcagctgtgactgtgtggctgatgccctgatcctgcgggtgcgctctgagctgagcggcctgcccttctactggaacttccactgcatgctggccagccccagcctggtgtcccagcacctgatccggcccctgatgggcatgagcctggccctgcagtgccaggtgcgggagctggccaccctgctgcacatgaaggacctggagatccaggactaccaggagagcggggccaccctcatccgggaccggctgaagacagagccctttgaggagaacagcttcctggagcagttcatgattgagaagctgcctgaggcctgcagcattggagatggcaagccctttgtgatgaacctgcaggacctgtacatggctgtgaccacccaggaggtgcaggtgggccagaagcaccagggcgctggggacccccacaccagcaacagcgccagcctgcagggcatcgacagccagtgtgtgaaccagcctgagcagctggtgtcctctgcccccaccctgagcgcccctgagaaggagagcacagccctgtgccgggacctgagctgccagaggagccggggccgcagccagggcgtgtcctctgtgaacctgctgtggccccagctgctgaggatggacctggagaacagcttccaggccagcccctag

SEQ ID NO: 162075 - DNA, 690 bp, Artificial Sequence
  Description of Artificial Sequence: Synthetic coding sequence
atggaggagctggagcagggcctgctgatgcagccctgggcctggctgcagctggccgagaacagcctgctggccaaggtgttcatcaccaagcagggctacgccctgctggtgtctgacctgcagcaggtgtggcatgagcaggtggacacctctgtggtgtcccagagggccaaggagctgaacaagaggctgacagcccccccagctgccttcctgtgccacctggacaacctgctgcggcccctgctgaaggatgctgcccaccccagcgaggccaccttcagctgtgactgtgtggctgatgccctgatcctgcgggtgcgctctgagctgagcggcctgcccttctactggaacttccactgcatgctggccagccccagcctggtgtcccagcacctgatccggcccctgatgggcatgagcctggccctgcagtgccaggtgcgggagctggccaccctgctgcacatgaaggacctggagatccaggactaccaggagagcggggccaccctcatccgggaccggctgaagacagagccctttgaggagaacagcttcctggagcagttcatgattgagaagctgcctgaggcctgcagcattggagatggcaagccctttgtgatgaacctgcaggacctgtacatggctgtgaccacccaggaggtgcaggtgggctag

SEQ ID NO: 162076 - DNA, 804 bp, Artificial Sequence
  Description of Artificial Sequence: Synthetic coding sequence
atggccaactgtgagaggaccttcatcgccatcaagccagatggagtgcagaggggcctggtgggggagatcatcaagagatttgagcagaagggcttccggctggtgggcctgaagttcatgcaggccagcgaggacctgctgaaggagcactacgtggacctgaaggaccggcccttctttgctggcctggtgaagtacatgcacagcggccctgtggtggccatggtgtgggagggcctgaatgtggtgaagacaggccgggtgatgctgggggagaccaacccagctgacagcaagccaggcaccatccggggggacttctgcatccaggtgggccgcaccatggccaacctggagaggaccttcatcgccatcaagccagatggagtgcagaggggcctggtgggggagatcatcaagagatttgagcagaagggcttccggctggtggccatgaagttcctgcgggccagcgaggagcacctgaagcagcactacatcgacctgaaggaccggcccttcttccctggcctggtgaagtacatgaacagcggccctgtggtggccatggtgtgggagggcctgaatgtggtgaagacaggccgggtgatgctgggggagaccaacccagctgacagcaagccaggcaccatccggggggacttctgcatccaggtgggcaggaacatcatccacggcagtgacagcgtgaagtctgctgagaaggagatcagcctgtggttcaagccagaggagctggtggactacaagagctgtgcccatgactgggtgtatgaatag

SEQ ID NO: 162077 - DNA, 234 bp, Artificial Sequence
  Description of Artificial Sequence: Synthetic coding sequence
atggtgtgggagggcctgaatgtggtgaagacaggccgggtgatgctgggggagaccaacccagctgacagcaagccaggcaccatccggggggacttctgcatccaggtgggcaggaacatcatccacggcagtgacagcgtgaagtctgctgagaaggagatcagcctgtggttcaagccagaggagctggtggactacaagagctgtgcccatgactgggtgtatgaatag

SEQ ID NO: 162078 - DNA, 234 bp, Artificial Sequence; identical to SEQ ID NO: 162077
  Description of Artificial Sequence: Synthetic coding sequence

SEQ ID NO: 162079 - DNA, 459 bp, Artificial Sequence
  Description of Artificial Sequence: Synthetic coding sequence
atggccaacctggagaggaccttcatcgccatcaagccagatggagtgcagaggggcctggtgggggagatcatcaagagatttgagcagaagggcttccggctggtggccatgaagttcctgcgggccagcgaggagcacctgaagcagcactacatcgacctgaaggaccggcccttcttccctggcctggtgaagtacatgaacagcggccctgtggtggccatggtgtgggagggcctgaatgtggtgaagacaggccgggtgatgctgggggagaccaacccagctgacagcaagccaggcaccatccggggggacttctgcatccaggtgggcaggaacatcatccacggcagtgacagcgtgaagtctgctgagaaggagatcagcctgtggttcaagccagaggagctggtggactacaagagctgtgcccatgactgggtgtatgaatag

SEQ ID NO: 162080 - DNA, 459 bp, Artificial Sequence; identical to SEQ ID NO: 162079
  Description of Artificial Sequence: Synthetic coding sequence

SEQ ID NO: 162081 - DNA, 459 bp, Artificial Sequence; identical to SEQ ID NO: 162079
  Description of Artificial Sequence: Synthetic coding sequence

SEQ ID NO: 162082 - DNA, 459 bp, Artificial Sequence; identical to SEQ ID NO: 162079
  Description of Artificial Sequence: Synthetic coding sequence

SEQ ID NO: 162083 - DNA, 459 bp, Artificial Sequence; identical to SEQ ID NO: 162079
  Description of Artificial Sequence: Synthetic coding sequence

SEQ ID NO: 162084 - DNA, 879 bp, Artificial Sequence
  Description of Artificial Sequence: Synthetic coding sequence
atggtgctgctgagcaccctgggcatcgtgttccagggcgagggcccccccatcagcagctgtgacaccggcaccatggccaactgtgagaggaccttcatcgccatcaagccagatggagtgcagaggggcctggtgggggagatcatcaagagatttgagcagaagggcttccggctggtgggcctgaagttcatgcaggccagcgaggacctgctgaaggagcactacgtggacctgaaggaccggcccttctttgctggcctggtgaagtacatgcacagcggccctgtggtggccatggtgtgggagggcctgaatgtggtgaagacaggccgggtgatgctgggggagaccaacccagctgacagcaagccaggcaccatccggggggacttctgcatccaggtgggccgcaccatggccaacctggagaggaccttcatcgccatcaagccagatggagtgcagaggggcctggtgggggagatcatcaagagatttgagcagaagggcttccggctggtggccatgaagttcctgcgggccagcgaggagcacctgaagcagcactacatcgacctgaaggaccggcccttcttccctggcctggtgaagtacatgaacagcggccctgtggtggccatggtgtgggagggcctgaatgtggtgaagacaggccgggtgatgctgggggagaccaacccagctgacagcaagccaggcaccatccggggggacttctgcatccaggtgggcaggaacatcatccacggcagtgacagcgtgaagtctgctgagaaggagatcagcctgtggttcaagccagaggagctggtggactacaagagctgtgcccatgactgggtgtatgaatag

SEQ ID NO: 162085 - DNA, 1188 bp, Artificial Sequence
  Description of Artificial Sequence: Synthetic coding sequence
atggtgtctgctgctggcctgtctggagatggcaagatgagaggagtgctgctggtgctgctgggcctgctgtacagcagcaccagctgtggggtgcagaaggccagcgtcttctacggccctgaccccaaggagggcctggtgtcctccatggagttcccctgggtggtgtccctgcaggacagccagtacacccacctggccttcggctgcatcctgtctgagttctgggtgctgagcatcgccagcgccatccagaacaggaaggacatcgtggtgattgtgggcatcagcaacatggaccccagcaagatcgcccacacagagtaccctgtgaacaccatcatcatccatgaagattttgacaacaacagcatgagcaacaacatcgccctgctgaagacagacacagccatgcactttggaaacctggtgcagagcatctgcttcctgggccgcatgctgcacaccccacctgtgctgcagaactgctgggtgtctggctggaaccccaccagcgccactggaaaccacatgaccatgtctgtgctgaggaagatctttgtgaaggacctggacatgtgccccctgtacaagctgcagaagacagaatgtggcagccacaccaaggaggagaccaagacagcctgcctgggggaccccggcagccccatgatgtgccagctgcagcagtttgacctgtgggtgctgcggggcgtgctgaactttggaggagagacctgccccggcctcttcctgtacaccaaggtggaggactacagcaagtggatcaccagcaaggccgagagagctggcccccccctgagcagcctgcaccactgggagaagctgatctccttcagccaccacggccccaatgccaccatgacccagaagacctacagcgacagcgagctgggccacgtgggcagctacctgcagggccagaggaggaccatcacccacagccggctgggcaacagcagccgggacagcctggatgtgcgggagaaggatgtgaaggagagcggccgcagccctgaggcctctgtgcagcccctgtactatgactactatggaggagaggtgggggagggccgcatctttgctggccagaacagactctaccagcctgaggagatcatcctggtgtcctttgtgctggtgttcttctgcagcagcatctag

SEQ ID NO: 162086 - DNA, 639 bp, Artificial Sequence
  Description of Artificial Sequence: Synthetic coding sequence
atggagatctccatgcccccaccccagatctacgtggagaagaccctggccatcatcaagccagacatcgtggacaaggaggaggagatccaggacatcatcctgcggagcggcttcaccatcgtgcagaggaggaagctgcggctgagccctgagcagtgcagcaacttctacgtggagaagtatggcaagatgttcttccccaacctgacagcctacatgagcagcggccccctggtggccatgatcctggcccggcacaaggccatctcctactggctggagctgctgggccccaacaacagcctggtggccaaggagacccacccagacagcctgcgggccatctatggaacagatgacctgagaaatgccctgcacggcagcaatgactttgctgctgctgagcgggagatccgcttcatgtttcctgaggtgattgtggagcccatccccatcggccaggccgccaaggactacctgaacctgcacatcatgcccaccctgctggagggcctgacagagctgtgcaagcagaagccagctgaccccctcatctggctggccgactggctgctgaagaacaaccccaacaagcccaagctgtgccaccaccccatcgtggaggagccctactag

SEQ ID NO: 162087 - DNA, 561 bp, Artificial Sequence
  Description of Artificial Sequence: Synthetic coding sequence
atggccagcatcctgcggagcccccaggccctgcagctgaccctggccctgatcaagccagatgctgtggcccaccccctcatcctggaggccgtgcaccagcagatcctgagcaacaagttcctgattgtgaggatgagggagctgctgtggaggaaggaggactgccagcgcttctaccgggagcacgagggccgcttcttctaccagaggctggtggagttcatggccagcggccccatccgggcctacatcctggcccacaaggatgccatccagctgtggaggaccctgatgggccccaccagggtcttccgggcccggcacgtggccccagacagcatccggggcagctttggcctgacagacaccaggaacaccacccacggcagtgacagcgtggtgtctgccagccgggagattgctgccttcttcccagacttcagcgagcagcgctggtatgaggaggaggagccccagctgcgctgtggccctgtgtgctacagccctgagggcggcgtgcactacgtggccggcaccggcggcctgggccctgcctag

SEQ ID NO: 162088 - DNA, 585 bp, Artificial Sequence
  Description of Artificial Sequence: Synthetic coding sequence
atgacccagaacctgggcagcgagatggccagcatcctgcggagcccccaggccctgcagctgaccctggccctgatcaagccagatgctgtggcccaccccctcatcctggaggccgtgcaccagcagatcctgagcaacaagttcctgattgtgaggatgagggagctgctgtggaggaaggaggactgccagcgcttctaccgggagcacgagggccgcttcttctaccagaggctggtggagttcatggccagcggccccatccgggcctacatcctggcccacaaggatgccatccagctgtggaggaccctgatgggccccaccagggtcttccgggcccggcacgtggccccagacagcatccggggcagctttggcctgacagacaccaggaacaccacccacggcagtgacagcgtggtgtctgccagccgggagattgctgccttcttcccagacttcagcgagcagcgctggtatgaggaggaggagccccagctgcgctgtggccctgtgtgctacagccctgagggcggcgtgcactacgtggccggcaccggcggcctgggccctgcctag

SEQ ID NO: 162089 - DNA, 561 bp, Artificial Sequence; identical to SEQ ID NO: 162087
  Description of Artificial Sequence: Synthetic coding sequence

SEQ ID NO: 162090 - DNA, 360 bp, Artificial Sequence
  Description of Artificial Sequence: Synthetic coding sequence
atggccagcatcctgcggagcccccaggccctgcagctgaccctggccctgatcaagccagatgctgtggcccaccccctcatcctggaggccgtgcaccagcagatcctgagcaacaagttcctgattgtgaggatgagggagctgctgtggaggaaggaggactgccagcgcttctaccgggagcacgaggacagcgtggtgtctgccagccgggagattgctgccttcttcccagacttcagcgagcagcgctggtatgaggaggaggagccccagctgcgctgtggccctgtgtgctacagccctgagggcggcgtgcactacgtggccggcactggaggcctgggccctgcctag

SEQ ID NO: 162091 - DNA, 561 bp, Artificial Sequence; identical to SEQ ID NO: 162087
  Description of Artificial Sequence: Synthetic coding sequence

SEQ ID NO: 162092 - DNA, 492 bp, Artificial Sequence
  Description of Artificial Sequence: Synthetic coding sequence
atggccagcatcctgcggagcccccaggccctgcagctgaccctggccctgatcaagccagatgctgtggcccaccccctcatcctggaggccgtgcaccagcagatcctgagcaacaagttcctgattgtgaggatgagggagctgctgtggaggaaggaggactgccagcgcttctaccgggagcatgaagctggccagagcgagcccaccagcctgcccaccaggatgcccagcagcagcggcggccgctcctgggaccccccagagtgcagcgagcacgccatgtggccccagatcctgtctgtgggcgtgtctgccagcctgaccccagccaccccacccatggtgaggaccctgtggttccagcctgctgagcggctgcagcccagcagcctgacctctgtgaacagcgctggcatgaggaggaagagccccagctgtgctgtggccctgtgtgccatcgcccagcgggaggtgtccaccatgtag

SEQ ID NO: 162093 - DNA, 561 bp, Artificial Sequence; identical to SEQ ID NO: 162087
  Description of Artificial Sequence: Synthetic coding sequence

SEQ ID NO: 162094 - DNA, 1131 bp, Artificial Sequence
  Description of Artificial Sequence: Synthetic coding sequence
atgaaccacagcgagagatttgtgttcatcgccgagtggtatgaccccaatgccagcctgctgcggcgctatgagctgctcttctacccaggagatggctctgtggagatgcatgatgtgaagaaccacaggaccttcctgaagaggaccaagtatgacaacctgcacctggaggacctcttcatcggcaacaaggtgaatgtgttcagccggcagctggtgctgattgattatggagaccagtacacagcccggcagctgggcagcaggaaggagaagaccctggccctgatcaagccagatgccatcagcaaggccggggagatcatcgagatcatcaacaaggccggcttcaccatcaccaagctgaagatgatgatgctgagcaggaaggaggccctggacttccacgtggaccaccagagccggcccttcttcaatgaactcatccagttcatcaccaccggccccatcatcgccatggagatcctgagagatgatgccatctgtgagtggaagaggctgctgggccctgccaacagcggcgtggccaggacagatgccagcgagagcatccgggccctgtttggaacagatggcatcagaaatgctgcccacggccctgacagctttgccagcgctgcccgggagatggagctgttcttccccagcagcggcggctgcggccctgccaacacagccaagttcaccaactgcacctgctgcatcgtgaagccccatgctgtgtctgagggcctgctgggcaagatcctgatggccatcagagatgctggctttgagatcagcgccatgcagatgttcaacatggacagagtgaatgtggaggagttctatgaggtgtacaagggcgtggtgacagagtaccatgacatggtgacagagatgtacagcggcccctgtgtggccatggagatccagcagaacaatgccaccaagaccttccgggagttctgtggccctgctgaccctgagatcgcccggcacctgcggcccggcaccctgcgggccatctttgggaagaccaagatccagaatgctgtgcactgcacagacctgcctgaagatggcctgctggaggtgcagtacttcttcaagatcctggacaactag

SEQ ID NO: 162095 - DNA, 1023 bp, Artificial Sequence
  Description of Artificial Sequence: Synthetic coding sequence
atgcatgatgtgaagaaccacaggaccttcctgaagaggaccaagtatgacaacctgcacctggaggacctcttcatcggcaacaaggtgaatgtgttcagccggcagctggtgctgattgattatggagaccagtacacagcccggcagctgggcagcaggaaggagaagaccctggccctgatcaagccagatgccatcagcaaggccggggagatcatcgagatcatcaacaaggccggcttcaccatcaccaagctgaagatgatgatgctgagcaggaaggaggccctggacttccacgtggaccaccagagccggcccttcttcaatgaactcatccagttcatcaccaccggccccatcatcgccatggagatcctgagagatgatgccatctgtgagtggaagaggctgctgggccctgccaacagcggcgtggccaggacagatgccagcgagagcatccgggccctgtttggaacagatggcatcagaaatgctgcccacggccctgacagctttgccagcgctgcccgggagatggagctgttcttccccagcagcggcggctgcggccctgccaacacagccaagttcaccaactgcacctgctgcatcgtgaagccccatgctgtgtctgagggcctgctgggcaagatcctgatggccatcagagatgctggctttgagatcagcgccatgcagatgttcaacatggacagagtgaatgtggaggagttctatgaggtgtacaagggcgtggtgacagagtaccatgacatggtgacagagatgtacagcggcccctgtgtggccatggagatccagcagaacaatgccaccaagaccttccgggagttctgtggccctgctgaccctgagatcgcccggcacctgcggcccggcaccctgcgggccatctttgggaagaccaagatccagaatgctgtgcactgcacagacctgcctgaagatggcctgctggaggtgcagtacttcttcaagatcctggacaactag

SEQ ID NO: 162096 - DNA, 1416 bp, Artificial Sequence
  Description of Artificial Sequence: Synthetic coding sequence
atgcagagcaacaagaccttcaacctggagaagcagaaccacacccccaggaagcaccaccagcaccaccaccagcagcagcaccaccagcagcagcagcagcagcccccacctccacccatcccagccaacggccagcaggccagcagccagaatgaaggcctgaccatcgacctgaagaacttcaggaagccaggagagaagaccttcacccagaggagccggctgtttgtgggcaacctgcccccagacatcacagaggaggagatgaggaagctgtttgagaagtatggcaaggccggggaggtgttcatccacaaggacaagggcttcggcttcatccggctggagaccaggaccctggccgagatcgccaaggtggagctggacaacatgcccctgcggggcaagcagctgcgggtgcgctttgcctgccacagcgccagcctgactgtgaggaacctgccccagtatgtgtccaatgagctgctggaggaggccttctctgtgtttggccaggtggagagagctgtggtgattgtggatgaccggggccggcccagcggcaagggcatcgtggagttcagcggcaagccagctgccaggaaggccctggaccgctgcagcgagggcagcttcctgctgaccaccttccccaggcctgtgacagtggagcccatggaccagctggatgatgaggagggcctgcctgagaagctggtgatcaagaaccagcagttccacaaggagcgggagcagccccccaggtttgcccagcccggcagctttgaatatgaatatgccatgcgctggaaggccctgattgagatggagaagcagcagcaggaccaggtggacaggaacatcaaggaggcccgggagaagctggagatggagatggaggccgcccggcatgagcaccaggtgatgctgatgaggcaggacctgatgaggcggcaggaggagctgcggaggatggaggagctgcacaaccaggaggtgcagaagaggaagcagctggagctgcggcaggaggaggagaggagaagaagagaggaggagatgaggcggcagcaggaggagatgatgaggcggcagcaggagggcttcaagggcaccttcccagatgcccgggagcaggagatccgcatgggccagatggccatgggcggggccatgggcatcaacaacagaggagccatgcccccagcccctgtgcctgctggcaccccagcccctcctggccctgccaccatgatgccagatggcaccctgggcctgaccccacccaccacagaaagatttggccaggccgccaccatggagggcatcggggccatcggcggcaccccaccagccttcaacagagctgcccctggagctgagtttgcccccaacaagagaagacgctactag

SEQ ID NO: 162097 - DNA, 1416 bp, Artificial Sequence; identical to SEQ ID NO: 162096
  Description of Artificial Sequence: Synthetic coding sequence

SEQ ID NO: 162098 - DNA, 1416 bp, Artificial Sequence; identical to SEQ ID NO: 162096
  Description of Artificial Sequence: Synthetic coding sequence

SEQ ID NO: 162099 - DNA, 747 bp, Artificial Sequence
  Description of Artificial Sequence: Synthetic coding sequence
atgcagagcaacaagaccttcaacctggagaagcagaaccacacccccaggaagcaccaccagcaccaccaccagcagcagcaccaccagcagcagcagcagcagcccccacctccacccatcccagccaacggccagcaggccagcagccagaatgaaggcctgaccatcgacctgaagaacttcaggaagccaggagagaagaccttcacccagaggagccggctgtttgtgggcaacctgcccccagacatcacagaggaggagatgaggaagctgtttgagaagtatggcaaggccggggaggtgttcatccacaaggacaagggcttcggcttcatccggctggagaccaggaccctggccgagatcgccaaggtggagctggacaacatgcccctgcggggcaagcagctgcgggtgcgctttgcctgccacagcgccagcctgactgtgaggaacctgccccaggagcgggagcagccccccaggtttgcccagcccggcagctttgaatatgaatatgccatgcgctggaaggccctgattgagatggagaagcagcagcaggaccaggtggacaggaacatcaaggaggcccgggagaagctggagatggagatggaggccgcccggcatgagcaccaggtgatgctgatgaggcaggacctgatgaggcggcaggaggagctgcggaggatggaggagctgcacaaccaggaggtgcagaagaggaagcagctgtag

SEQ ID NO: 162100 - DNA, 708 bp, Artificial Sequence
  Description of Artificial Sequence: Synthetic coding sequence
tgaccagacatcacagaggaggagatgaggaagctgtttgagaagtatggcaaggccggggaggtgttcatccacaaggacaagggcttcggcttcatccggctggtggagagagctgtggtgattgtggatgaccggggccggcccagcggcaagggcatcgtggagttcagcggcaagccagctgccaggaaggccctggaccgctgcagcgagggcagcttcctgctgaccaccttccccaggcctgtgacagtggagcccatggaccagctggatgatgaggagggcctgcctgagaagctggtgatcaagaaccagcagttccacaaggagcgggagcagccccccaggtttgcccagcccggcagctttgaatatgaatatgccatgcgctggaaggccctgattgagatggagaagcagcagcaggaccaggtggacaggaacatcaaggaggcccgggagaagctggagatggagatggaggccgcccggcatgagcaccaggtgatgctgatgaggcaggacctgatgaggcggcaggaggagctgcggaggatggaggagctgcacaaccaggaggtgcagaagaggaagcagctggagctgcggcaggaggaggagaggagaagaagagaggaggagatgaggcggcagcaggaggagatgatgaggcggcagcaggagggcttcaagggcacctag

SEQ ID NO: 162101 - DNA, 375 bp, Artificial Sequence
  Description of Artificial Sequence: Synthetic coding sequence
atgcagagcaacaagaccttcaacctggagaagcagaaccacacccccaggaagcaccaccagcaccaccaccagcagcagcaccaccagcagcagcagcagcagcccccacctccacccatcccagccaacggccagcaggccagcagccagaatgaaggcctgaccatcgacctgaagaacttcaggaagccaggagagaagaccttcacccagaggagccggctgtttgtgggcaacctgcccccagacatcacagaggaggagatgaggaagctgtttgagaagtatggcaaggagaccaggaccctggccgagatcgccaaggtggagctggacaacatgcccctgcggggcaagcagctgcgggtgtag

SEQ ID NO: 162102 - DNA, 201 bp, Artificial Sequence
  Description of Artificial Sequence: Synthetic coding sequence
atgcagagcaacaagaccttcaacctggagaagcagaaccacacccccaggaagcaccaccagcaccaccaccagcagcagcaccaccagcagcagcagcagcagcccccacctccacccatcccagccaacggccagcaggccagcagccagaatgaaggcctgaccatcgacctgaagaacttcaggaagccaggatag

SEQ ID NO: 162103 - DNA, 624 bp, Artificial Sequence
  Description of Artificial Sequence: Synthetic coding sequence
atgcagagcaacaagaccttcaacctggagaagcagaaccacacccccaggaagcaccaccagcaccaccaccagcagcagcaccaccagcagcagcagcagcagcccccacctccacccatcccagccaacggccagcaggccagcagccagaatgaaggcctgaccatcgacctgaagaacttcaggaagccaggagagaagaccttcacccagaggagccggctgtttgtgggcaacctgcccccagacatcacagaggaggagatgaggaagctgtttgagaagtatggcaaggccggggaggtgttcatccacaaggacaagggcttcggcttcatccggctggagaccaggaccctggccgagatcgccaaggtggagctggacaacatgcccctgcggggcaagcagctgcgggtgcgctttgcctgccacagcgccagcctgactgtgaggaacctgccccagtatgtgtccaatgagctgctggaggaggccttctctgtgtttggccaggtggagagagctgtggtgattgtggatgaccggggccggcccagcggcaagggcatcgtggagttcagcggcaagccagctgccaggaaggccctggacagatag

SEQ ID NO: 162104 - DNA, 1149 bp, Artificial Sequence
  Description of Artificial Sequence: Synthetic coding sequence
atgaggaagctgtttgagaagtatggcaaggccggggaggtgttcatccacaaggacaagggcttcggcttcatccggctggagaccaggaccctggccgagatcgccaaggtggagctggacaacatgcccctgcggggcaagcagctgcgggtgcgctttgcctgccacagcgccagcctgactgtgaggaacctgccccagtatgtgtccaatgagctgctggaggaggccttctctgtgtttggccaggtggagagagctgtggtgattgtggatgaccggggccggcccagcgggaaaggaattgtggagttcagcggcaagccagctgccaggaaggccctggaccgctgcagcgagggcagcttcctgctgaccaccttccccaggcctgtgacagtggagcccatggaccagctggatgatgaggagggcctgcctgagaagctggtgatcaagaaccagcagttccacaaggagcgggagcagcccccaagatttgcccagcccggcagctttgaatatgaatatgccatgcgctggaaggccctgattgagatggagaagcagcagcaggaccaggtggacaggaacatcaaggaggcccgggagaagctggagatggagatggaggccgcccggcatgagcaccaggtgatgctgatgaggcaggacctgatgaggcggcaggaggagctgcggaggatggaggagctgcacaaccaggaggtgcagaagaggaagcagctggagctgcggcaggaggaggagaggagaagaagagaggaggagatgaggcggcagcaggaggagatgatgaggcggcagcaggagggcttcaagggcaccttcccagatgcccgggagcaggagatccgcatgggccagatggccatgggcggggccatgggcatcaacaacagaggagccatgcccccagcccctgtgcctgctggcaccccagcccctcctggccctgccaccatgatgccagatggcaccctgggcctgaccccacccaccacagagcgcttcggccaggccgccaccatggagggcattggagccatcggcggcaccccaccagccttcaacagagctgcccctggagctgagtttgcccccaacaagagaagacgctactag

SEQ ID NO: 162105 - DNA, 3048 bp, Artificial Sequence
  Description of Artificial Sequence: Synthetic coding sequence
atgggcgctgagcggcggctgctgagcatcaaggaggccttccggctggcccagcagccccaccagaaccaggccaagctggtggtggccctgagcaggacctaccgcaccatggatgacaagacagtgttccacgaggagttcatccactacctgaagtatgtgatggtggtgtacaagcgggagcctgctgtggagcgggtgattgaatttgctgccaagtttgtgaccagcttccaccagagcgacatggaggatgatgaggaggaggaggatggcggcctgctgaactacctgttcaccttcctgctgaagagccatgaggccaacagcaatgctgtgcgcttccgggtgtgcctgctgatcaacaagctgctgggctccatgccagaaaatgcccagattgatgatgatgtgtttgacaagatcaacaaggccatgctgatccggctgaaggacaagatccccaacgtgcgcatccaggccgtgctggccctgagccggctgcaggaccccaaggatgatgagtgccctgtggtgaatgcctatgccaccctgattgaaaatgacagcaaccctgaggtgcggcgggctgtgctgagctgcatcgcccccagcgccaagaccctgcccaagatcgtgggccgcaccaaggatgtgaaggaggccgtgaggaagctggcctaccaggtgctggccgagaaggtgcacatgagggccatgagcatcgcccagagggtgatgctgctgcagcagggcctgaatgacagaagtgatgctgtgaagcaggccatgcagaagcacctgctgcagggctggctgcgcttcagcgagggcaacatcctggagctgctgcaccggctggatgtggagaacagcagcgaggtggccgtgtctgtgctgaatgccctcttcagcatcacccccctgtctgagctggtgggcctgtgcaagaacaatgatggcaggaagctgatccctgtggagaccctgaccccagaaattgccctgtactggtgtgccctgtgtgagtacctgaagagcaaaggagatgaaggagaggagttcctggagcagatcctgcctgagcctgtggtgtatgctgactacctgctgagctacatccagagcatccctgtggtgaatgaggagcacagaggagacttctcctacatcggcaacctgatgaccaaggagttcatcggccagcagctgatcctgatcatcaagagcctggacaccagcgaggagggcggcaggaagaagctgctggccgtgctgcaggagatcctgatcctgcccaccatccccatcagcctggtgtccttcctggtggagcggctgctgcacatcatcattgatgacaacaagaggacccagatcgtgacagagatcatcagcgagatccgggcccccatcgtgacagtgggcgtgaacaatgaccctgcagatgtgaggaagaaggagctgaagatggccgagatcaaggtgaagctgattgaggccaaggaggccctggagaactgcatcaccctgcaggacttcaacagagccagcgagctgaaggaggagatcaaggccctggaggatgcccgcatcaacctgctgaaggagacagagcagctggagatcaaggaggtgcacatcgagaagaatgatgctgagaccctgcagaagtgcctgatcctgtgctatgagctgctgaagcagatgagcatcagcacaggcctgagcgccaccatgaatggcatcatcgagagcctcatcctgcccggcatcatcagcatccaccctgtggtgaggaacctggccgtgctgtgcctgggctgctgcggcctgcagaaccaggactttgccaggaagcactttgtgctgctgctgcaggtgctgcagattgatgatgtgaccatcaagatcagcgccctgaaggccatctttgaccagctgatgaccttcggcatcgagcccttcaagaccaagaagatcaagaccctgcactgtgagggcacagagatcaacagtgatgatgagcaggagagcaaggaggtggaggagacagccacagccaagaatgtgctgaagctgctgagtgacttcctggacagcgaggtgtctgagctgaggactggagctgctgagggcctggccaagctgatgttttctggcctgctggtgagcagccgcatcctgagccgcctcatcctgctgtggtacaaccctgtgacagaggaggatgtgcagctgcggcactgcctgggcgtcttcttccctgtgtttgcctatgccagcaggaccaaccaggagtgctttgaggaggccttcctgcccaccctgcagaccctggccaatgccccagccagcagccccctggccgagattgacatcaccaacgtggccgagctgctggtggacctgacccggcccagcggcctgaacccccaggccaagaccagccaggactaccaggccctgactgtgcatgacaacctggccatgaagatctgcaatgagatcctgaccagcccctgcagccctgagatccgggtgtacaccaaggccctgagcagcctggagctgagcagccacctggccaaggacctgctggtgctgctgaatgagatcctggagcaggtgaaggacaggacctgcctgcgggccctggagaagatcaagatccagctggagaagggcaacaaggagtttggagaccaggccgaggccgcccaggatgccaccctgaccaccaccaccttccagaatgaagatgagaagaacaaggaggtgtacatgacccccctgcggggcgtgaaggccacccaggccagcaagagcacccagctgaagaccaacagaggccagaggaaggtgacagtgtctgcccggaccaacagacgctgccagacagctgaggccgacagcgagagtgaccacgaggtgcctgagcctgagagcgagatgaagatgaggctgccccggcgggccaagacagctgccctggagaagagcaagctgaacctggcccagttcctgaatgaagacctgtcctag

SEQ ID NO: 162106 - DNA, 951 bp, Artificial Sequence
  Description of Artificial Sequence: Synthetic coding sequence
atgtctggggacagcagcggccggggccctgagggccggggccggggccgggacccccaccgggacaggaccaggagccgcagccgcagccgcagccccctgagccccaggagcagaagaggcagcgcccgggagcggcgggaggcccctgagcggcccagcctggaggacacagagcccagcgacagcggagatgagatgatggaccctgccagcctggaggccgaggccgaccagggcctgtgccggcagatccgccaccagtaccgggccctgatcaacagcgtgcagcagaaccgggaggacatcctgaatgctggggacaagctgacagaggtgctggaggaggccaacaccctcttcaatgaggtgtcccgggcccgggaggccgtgctggatgcccacttcctggtgctggccagtgacctgggcaaggagaaggccaagcagctgcggagtgacctgagcagctttgacatgctgcgctacgtggagaccctgctgacccacatgggcgtgaaccccctggaggccgaggagctgatcagagatgaggacagcccagactttgagttcatcgtgtatgacagctggaagatcactggaagaacagctgagaacaccttcaacaagacccacaccttccacttcctgctgggcagcatctatggagaatgtcctgtgcccaagccccgggtggaccggcccaggaaggtgcctgtgatccaggaggagcgggccatgcctgcccagctgcggaggatggaggagagccaccaggaggccacagagaaggaggtggagcgcatcctgggcctgctgcagacctacttccgggaggaccgggacagcctgaccctgagcccccggctggagtgcagcggcaccatcagcacccactgcaacctgcacctgctggacagcagcaacagccctgccagcgccagctag

SEQ ID NO: 162107 - DNA, 1158 bp, Artificial Sequence
  Description of Artificial Sequence: Synthetic coding sequence
atgtctggggacagcagcggccggggccctgagggccggggccggggccgggacccccaccgggacaggaccaggagccgcagccgcagccgcagccccctgagccccaggagcagaagaggcagcgcccgggagcggcgggaggcccctgagcggcccagcctggaggacacagagcccagcgacagcggagatgagatgatggaccctgccagcctggaggccgaggccgaccagggcctgtgccggcagatccgccaccagtaccgggccctgatcaacagcgtgcagcagaaccgggaggacatcctgaatgctggggacaagctgacagaggtgctggaggaggccaacaccctcttcaatgaggtgtcccgggcccgggaggccgtgctggatgcccacttcctggtgctggccagtgacctgggcaaggagaaggccaagcagctgcggagtgacctgagcagctttgacatgctgcgctacgtggagaccctgctgacccacatgggcgtgaaccccctggaggccgaggagctgatcagagatgaggacagcccagactttgagttcatcgtgtatgacagctggaagatcactggaagaacagctgagaacaccttcaacaagacccacaccttccacttcctgctgggcagcatctatggagaatgtcctgtgcccaagccccgggtggaccggcccaggaaggtgcctgtgatccaggaggagcgggccatgcctgcccagctgcggaggatggaggagagccaccaggaggccacagagaaggaggtggagcgcatcctgggcctgctgcagacctacttccgggaggaccctgacacccccatgtccttctttgattttgtggtggacccccacagcttccccaggacagtggagaacatcttccacgtgtccttcatcatcagagatggctttgcccgcatccggctggaccaggaccggctgcctgtgattgagcctgtgtccatcaatgaagaaaatgaaggatttgagcacaacacccaggtgaggaaccagggcatcatcgccctgagctacagagactgggaggagatcgtgaagacctttgagatcagcgagcccgtcatcacccccagccagaggcagcagaagcccagcgcctag

SEQ ID NO: 162108 - DNA, 519 bp, Artificial Sequence
  Description of Artificial Sequence: Synthetic coding sequence
atgctgcgctacgtggagaccctgctgacccacatgggcgtgaaccccctggaggccgaggagctgatcagagatgaggacagcccagactttgagttcatcgtgtatgacagctggaagatcaccggccgcacagctgagaacaccttcaacaagacccacaccttccacttcctgctgggcagcatctacggggagtgccctgtgcccaagccccgggtggaccggcccaggaaggtgcctgtgatccaggaggagcgggccatgcctgcccagctgcggaggatggaggagagccaccaggaggccacagagaaggaggtggagcgcatcctgggcctgctgcagacctacttcagagaagatcctgacacccccatgtccttctttgattttgtggtggacccccacagcttccccaggacagtggagaacatcttccacgtgtccttcatcatcagagatggctttgcccgcatccggctggaccaggaccggctgcccgtcatcggcaagtag

SEQ ID NO: 162109 - DNA, 2574 bp, Artificial Sequence
  Description of Artificial Sequence: Synthetic coding sequence
atggccaaggccaagaaggtgggcgcccggaggaaggccagcggggccccagctggggcccggggcggccctgccaaggccaacagcaacccctttgaggtgaaggtgaaccggcagaagttccagatcctgggcaggaagaccaggcatgatgtgggcctgcccggggtgtcccgggcccgggccctgaggaagaggacccagaccctgctgaaggagtacaaggagcgggacaagagcaatgtgttccgggacaagagatttggagagtacaacagcaacatgagccctgaggagaagatgatgaagagatttgccctggagcagcagaggcaccacgagaagaagagcatctacaacctgaatgaagatgaggagctgacccactacggccagagcctggccgacatcgagaagcacaatgacatcgtggacagcgacagtgatgctgaagatcggggcaccctgtctgctgagctgacagctgcccactttggaggcggcggcggcctgctgcacaagaagacccagcaggagggggaggagcgggagaagcccaagagcaggaaggagctgattgaggagctgattgccaagagcaagcaggagaagcgggagcggcaggcccagcgggaggatgccctggagctgacagagaagctggaccaggactggaaggagatccagaccctgctgagccacaagacccccaagtctgagaacagagacaagaaggagaagcccaagccagatgcctatgacatgatggtgcgggagctgggctttgagatgaaggcccagcccagcaacaggatgaagacagaggccgagctggccaaggaggagcaggagcacctgaggaagctggaggccgagcggctgcggaggatgctgggcaaggatgaagatgaaaatgtgaagaagcccaagcacatgtctgcagatgacctgaatgatggctttgtgctggacaaggatgaccggcggctgctgagctacaaggatggcaagatgaatgtggaggaggatgtgcaggaggagcagagcaaggaggccagtgaccctgagagcaatgaggaggagggggacagcagtggaggagaggacacagaggagagtgacagcccagacagccacctggacctggagagcaatgtggagagcgaggaggagaatgagaagccagccaaggagcagaggcagaccccaggcaagggcctcatcagcggcaaggagcgggccggcaaggccaccagagatgagctgccctacacctttgctgcccctgagagctatgaggagctgcggagcctgctgctgggccgctccatggaggagcagctgctggtggtggagcgcatccagaagtgcaaccaccccagcctggccgagggcaacaaggccaagctggagaagctgtttggcttcctgctggagtatgtgggggacctggccacagatgatcctccagacctgactgtgattgacaagctggtggtgcacctgtaccacctgtgccagatgtttcctgagagcgccagtgatgccatcaagtttgtgctgagagatgccatgcatgagatggaggagatgattgagaccaagggccgggccgccctgcccggcctggatgtgctgatctacctgaagatcaccggcctgctcttccccaccagtgacttctggcaccctgtggtgaccccagccctggtgtgcctgagccagctgctgaccaagtgccccatcctgagcctgcaggatgtggtgaagggcctgtttgtgtgctgcctcttcctggagtatgtggccctgagccagcgcttcatccctgagctgatcaacttcctgctgggcatcctgtacatcgccacccccaacaaggccagccagggcagcaccctggtgcaccccttccgggccctgggcaagaacagcgagctgctggtggtgtctgcccgggaggatgtggccacctggcagcagagcagcctgagcctgcgctgggccagccggctgcgggcccccaccagcacagaggccaaccacatccggctgagctgcctggccgtgggcctggccctgctgaagagatgtgtgctgatgtatggcagcctgcccagcttccacgccatcatgggccccctgcaggccctgctgacagaccacctggccgactgcagccacccccaggagctgcaggagctgtgccagagcaccctgacagagatggagagccagaagcagctgtgccggcccctgacctgtgagaagagcaagcctgtgcccctgaagctgttcaccccccggctggtgaaggtgctggagtttggaaggaagcagggcagcagcaaggaggagcaggagaggaagaggctcatccacaagcacaagcgggagttcaagggagctgtgcgggagatcaggaaggacaaccagttcctggccaggatgcagctgtctgagatcatggagagagatgctgagaggaagaggaaggtgaagcagctgttcaacagcctggccacccaggagggggagtggaaggccctgaagaggaagaagttcaagaagtag

SEQ ID NO: 162110 - DNA, 2421 bp, Artificial Sequence
  Description of Artificial Sequence: Synthetic coding sequence
atggccaaggccaagaaggtgggcgcccggaggaaggccagcggggccccagctggggcccggggcggccctgccaaggccaacagcaacccctttgaggtgaaggtgaaccggcagaagttccagatcctgggcaggaagaccaggcatgatgtgggcctgcccggggtgtcccgggcccgggccctgaggaagaggacccagaccctgctgaaggagtacaaggagcgggacaagagcaatgtgttccgggacaagagatttggagagtacaacagcaacatgagccctgaggagaagatgatgaagagatttgccctggagcagcagaggcaccacgagaagaagagcatctacaacctgaatgaagatgaggagctgacccactacggccagagcctggccgacatcgagaagcacaatgacatcgtggacagcgacagtgatgctgaagatcggggcaccctgtctgctgagctgacagctgcccactttggaggcggcggcggcctgctgcacaagaagacccagcaggagggggaggagcgggagaagcccaagagcaggaaggagctgattgaggagctgattgccaagagcaagcaggagaagcgggagcggcaggcccagcgggaggatgccctggagctgacagagaagctggaccaggactggaaggagatccagaccctgctgagccacaagacccccaagtctgagaacagagacaagaaggagaagcccaagccagatgcctatgacatgatggtgcgggagctgggctttgagatgaaggcccagcccagcaacaggatgaagacagaggccgagctggccaaggaggagcaggagcacctgaggaagctggaggccgagcggctgcggaggatgctgggcaaggatgaagatgaaaatgtgaagaagcccaagcacatgtctgcagatgacctgaatgatggctttgtgctggacaaggatgaccggcggctgctgagctacaaggatggcaagatgaatgtggaggaggatgtgcaggaggagcagagcaaggaggccagtgaccctgagagcaatgaggaggagggggacagcagtggaggagaggacacagaggagagtgacagcccagacagccacctggacctggagagcaatgtggagagcgaggaggagaatgagaagccagccaaggagcagaggcagaccccaggcaagggcctcatcagcggcaaggagcgggccggcaaggccaccagagatgagctgccctacacctttgctgcccctgagagctatgaggagctgcggagcctgctgctgggccgctccatggaggagcagctgctggtggtggagcgcatccagaagtgcaaccaccccagcctggccgagggcaacaaggccaagctggagaagctgtttggcttcctgctggagtatgtgggggacctggccacagatgatcctccagacctgactgtgattgacaagctggtggtgcacctgtaccacctgtgccagatgtttcctgagagcgccagtgatgccatcaagtttgtgctgagagatgccatgcatgagatggaggagatgattgagaccaagggccgggccgccctgcccggcctggatgtgctgatctacctgaagatcaccggcctgctcttccccaccagtgacttctggcaccctgtggtgaccccagccctggtgtgcctgagccagctgctgaccaagtgccccatcctgagcctgcaggatgtggtgaagggcctgtttgtgtgctgcctcttcctggagtatgtggccctgagccagcgcttcatccctgagctgatcaacttcctgctgggcatcctgtacatcgccacccccaacaaggccagccagggcagcaccctggtgcaccccttccgggccctgggcaagaacagcgagctgctggtggtgtctgcccgggaggatgtggccacctggcagcagagcagcctgagcctgcgctgggccagccggctgcgggcccccaccagcacagaggccaaccacatccggctgagctgcctggccgtgggcctggccctgctgaagagatgtgtgctgatgtatggcagcctgcccagcttccacgccatcatgggccccctgcaggccctgctgacagaccacctggccgactgcagccacccccaggagctgcaggagctgtgccagagcaccctgacagagatggagagccagaagcagctgtgccggcccctgacctgtgagaagagcaagcctgtgcccctgaagctgttcaccccccggctggtgagcaacagccggccccaggtgatccacctgccctggccacccaactaccgctgtgagccccagcacccagccaagaaggtgatcttcttccgggtcatcatgctgtag

SEQ ID NO: 162111 - DNA, 2574 bp, Artificial Sequence; identical to SEQ ID NO: 162109
  Description of Artificial Sequence: Synthetic coding sequence

SEQ ID NO: 162112 - DNA, 1728 bp, Artificial Sequence
  Description of Artificial Sequence: Synthetic coding sequence
atgaagagatttgccctggagcagcagaggcaccacgagaagaagagcatctacaacctgaatgaagatgaggagctgacccactacggccagagcctggccgacatcgagaagcacaatgacatcgtggacagcgacagtgatgctgaggaccggggcaccctgtctgctgagctgacagctgcccactttggaggcggcggcggcctgctgcacaagaagacccagcaggagggggaggagcgggagaagcccaagagcaggaaggagctgattgaggagctgattgccaagagcaagcaggagaagcgggagcggcaggcccagagagaagatgccctggagctgacagagaagctggaccaggactggaaggagatccagaccctgctgagccacaagacccccaagtcagaaaatagagacaagaaggagaagcccaagccagatgcctatgacatgatggtgcgggagctgggctttgagatgaaggcccagcccagcaacaggatgaagacagaagctgagctggccaaggaggagcaggagcacctgaggaagctggaggccgagcggctgcggaggatgctgggcaaggatgaagatgaaaatgtgaagaagcccaagcacatgtctgcagatgacctgaatgatggctttgtgctggacaaggatgaccggcggctgctgagctacaaggatggcaagatgaatgtggaggaggatgtgcaggaggagcagagcaaggaggccagtgaccctgagagcaatgaggaggagggggacagcagtggaggagaggacacagaggagagtgacagcccagacagccacctggacctggagagcaatgtggagagcgaggaggagaatgagaagccagccaaggagcagaggcagacccctgggaagggcctcatcagcggcaaggagagagctgggaaggccaccagagatgagctgccctacacctttgctgcccctgagagctatgaggagctgcggagcctgctgctgggccgctccatggaggagcagctgctggtggtggagcgcatccagaagtgcaaccaccccagcctggccgagggcaacaaggccaagctggagaagctgtttggcttcctgctggagtatgtgggggacctggccacagatgaccccccagacctgaccgtcatcgacaagctggtggtgcacctgtaccacctgtgccagatgtttcctgagagcgccagtgatgccatcaagtttgtgctgagagatgccatgcatgagatggaggagatgattgagaccaagggccgggccgccctgcccggcctggatgtgctgatctacctgaagatcaccggcctgctcttccccaccagtgacttctggcaccctgtggtgaccccagccctggtgtgcctgagccagctgctgaccaagtgccccatcctgagcctgcaggatgtggtgaagggcctgtttgtgtgctgcctcttcctggagtatgtggccctgagccagcgcttcatccctgagctgatcaacttcctgctgggcatcctgtacatcgccacccccaacaaggccagccagggcagcaccctggtgcaccccttccgggccctgggcaagaacagcgagctgctggtggtgtctgccagagaagatgtggccacctggcagcagagcagcctgagcctgcgctggtggagccgcatcccagacctgaggtag

SEQ ID NO: 162113 - DNA, 2304 bp, Artificial Sequence
  Description of Artificial Sequence: Synthetic coding sequence
atgggcagaagaagccggggccggcggctgcagcagcagcagaggccagaagatgctgaagatggagctgagggcggcggcaagagaggagaggccggctgggagggcggctacccagaaattgtgaaggagaacaagctgtttgagcactactaccaggagctgaagatcgtgcctgagggggagtggggccagttcatggatgccctgcgggagcccctgcctgccaccctgcgcatcaccggctacaagagccacgccaaggagatcctgcactgcctgaagaacaagtacttcaaggagctggaggacctggaggtggatggccagaaggtggaggtgccccagcccctgtcctggtacccagaggagctggcctggcacaccaacctgagcaggaagatcctgaggaagagcccccacctggagaagttccaccagttcctggtgtctgaaacagaaagtggcaacatcagccggcaggaggccgtgtccatgatcccccccctgctgctgaatgtgcggccccaccacaagatcctggacatgtgtgccgcccctggcagcaagaccacccagctgattgagatgctgcacgccgacatgaatgtgcccttccctgagggcttcgtcatcgccaatgatgtggacaacaagcgctgctacctgctggtgcaccaggccaagaggctgagcagcccctgcatcatggtggtgaaccatgatgccagcagcatcccccggctgcagattgatgtggatggcaggaaggagatcctcttctatgaccgcatcctgtgtgatgtgccctgcagcggagatggcaccatgaggaagaacattgatgtgtggaagaagtggaccaccctgaacagcctgcagctgcacggcctgcagctgcgcatcgccaccagaggagctgagcagctggccgagggcggccgcatggtgtacagcacctgcagcctgaaccccattgaagatgaggccgtcatcgccagcctgctggagaagtctgagggcgccctggagctggctgatgtgtccaatgagctgcccggcctgaagtggatgcctggcatcacccagtggaaggtgatgaccaaggatggccagtggttcacagactgggatgctgtgccccacagccgccacacccagatccggcccaccatgttcccccccaaggaccctgagaagctgcaggccatgcacctggagcgctgcctgcgcatcctgccccaccaccagaacacaggaggcttctttgtggccgtgctggtgaagaagagctccatgccctggaacaagaggcagcccaagctgcagggcaagtctgctgagacccgggagagcacccagctgagccctgctgacctgacagagggcaagcccacagaccccagcaagctggagagccccagcttcaccggcactggagacacagagatcgcccacgccacagaggacctggagaacaacggcagcaagaaggatggagtgtgtggccccccacccagcaagaagatgaagctgtttggcttcaaggaggacccctttgtgttcatcccagaagatgaccccctcttcccccccatcgagaagttctacgccctggaccccagcttccccaggatgaacctgctgaccaggaccacagagggcaagaagaggcagctgtacatggtgtccaaggagctgagaaatgtgctgctgaacaacagcgagaagatgaaggtgatcaacacaggcatcaaggtgtggtgcaggaacaacagcggggaggagtttgactgtgccttccggctggcccaggagggcatctacaccctgtaccccttcatcaacagccgcatcatcaccgtgtccatggaggatgtgaagatcctgctgacccaggagaaccccttcttcaggaagctgagcagcgagacctacagccaggccaaggacctggccaagggcagcatcgtgctgaagtatgagccagattctgccaacccagatgccctgcagtgccccatcgtgctgtgtggctggaggggcaaggccagcatccgcacctttgtgcccaagaatgaaaggctgcactacctgaggatgatgggcctggaggtgctgggggagaagaagaaggagggcgtcatcctgaccaatgaatctgctgccagcacaggccagcctgacaatgatgtgacagagggccagagagctggggagcccaacagcccagatgctgaggaggccaacagcccagatgtgacagctggctgtgaccctgctggggtgcaccccccaagatag

SEQ ID NO: 162114 - DNA, 1596 bp, Artificial Sequence
  Description of Artificial Sequence: Synthetic coding sequence
atggtggtgaaccatgatgccagcagcatcccccggctgcagattgatgtggatggcaggaaggagatcctcttctatgaccgcatcctgtgtgatgtgccctgcagcggagatggcaccatgaggaagaacattgatgtgtggaagaagtggaccaccctgaacagcctgcagctgcacggcctgcagctgcgcatcgccaccagaggagctgagcagctggccgagggcggccgcatggtgtacagcacctgcagcctgaaccccattgaagatgaggccgtcatcgccagcctgctggagaagtctgagggcgccctggagctggctgatgtgtccaatgagctgcccggcctgaagtggatgcctggcatcacccagtggaaggtgatgaccaaggatggccagtggttcacagactgggatgctgtgccccacagccgccacacccagatccggcccaccatgttcccccccaaggaccctgagaagctgcaggccatgcacctggagcgctgcctgcgcatcctgccccaccaccagaacacaggaggcttctttgtggccgtgctggtgaagaagagctccatgccctggaacaagaggcagcccaagctgcagggcaagtctgctgagacccgggagagcacccagctgagccctgctgacctgacagagggcaagcccacagaccccagcaagctggagagccccagcttcaccggcactggagacacagagatcgcccacgccacagaggacctggagaacaacggcagcaagaaggatggagtgtgtggccccccacccagcaagaagatgaagctgtttggcttcaaggaggacccctttgtgttcatcccagaagatgaccccctcttcccccccatcgagaagttctacgccctggaccccagcttccccaggatgaacctgctgaccaggaccacagagggcaagaagaggcagctgtacatggtgtccaaggagctgagaaatgtgctgctgaacaacagcgagaagatgaaggtgatcaacacaggcatcaaggtgtggtgcaggaacaacagcggggaggagtttgactgtgccttccggctggcccaggagggcatctacaccctgtaccccttcatcaacagccgcatcatcaccgtgtccatggaggatgtgaagatcctgctgacccaggagaaccccttcttcaggaagctgagcagcgagacctacagccaggccaaggacctggccaagggcagcatcgtgctgaagtatgagccagattctgccaacccagatgccctgcagtgccccatcgtgctgtgtggctggaggggcaaggccagcatccgcacctttgtgcccaagaatgaaaggctgcactacctgaggatgatgggcctggaggtgctgggggagaagaagaaggagggcgtcatcctgaccaatgaatctgctgccagcacaggccagcctgacaatgatgtgacagagggccagagagctggggagcccaacagcccagatgctgaggaggccaacagcccagatgtgacagctggctgtgaccctgctggggtgcaccccccaagatag

SEQ ID NO: 162115 - DNA, 2199 bp, Artificial Sequence
  Description of Artificial Sequence: Synthetic coding sequence
atgggcagaagaagccggggccggcggctgcagcagcagcagaggccagaagatgctgaagatggagctgagggcggcggcaagagaggagaggccggctgggagggcggctacccagaaattgtgaaggagaacaagctgtttgagcactactaccaggagctgaagatcgtgcctgagggggagtggggccagttcatggatgccctgcgggagcccctgcctgccaccctgcgcatcaccggctacaagcgctacccagaggagctggcctggcacaccaacctgagcaggaagatcctgaggaagagcccccacctggagaagttccaccagttcctggtgtctgaaacagagagcggcaacatcagccggcaggaggccgtgtccatgatcccccccctgctgctgaatgtgcggccccaccacaagatcctggacatgtgtgccgcccctggcagcaagaccacccagctgattgagatgctgcatgctgacatgaatgtgcccttccctgagggctttgtgattgccaatgatgtggacaacaagcgctgctacctgctggtgcaccaggccaagaggctgagcagcccctgcatcatggtggtgaaccatgatgccagcagcatcccccggctgcagattgatgtggatggcaggaaggagatcctcttctatgaccgcatcctgtgtgatgtgccctgcagcggagatggcaccatgaggaagaacattgatgtgtggaagaagtggaccaccctgaacagcctgcagctgcacggcctgcagctgagaattgccaccagaggagctgagcagctggccgagggcggccgcatggtgtacagcacctgcagcctgaaccccattgaagatgaagctgtgattgccagcctgctggagaagtctgagggcgccctggagctggctgatgtgtccaatgagctgcccggcctgaagtggatgcctggcatcacccagtggaaggtgatgaccaaggatggccagtggttcacagactgggatgctgtgccccacagccgccacacccagatccggcccaccatgtttcctcccaaggaccctgagaagctgcaggccatgcacctggagcgctgcctgcgcatcctgccccaccaccagaacacaggaggcttctttgtggccgtgctggtgaagaagagctccatgccctggaacaagaggcagcccaagctgcagggcaagtctgctgagacccgggagagcacccagctgagccctgctgacctgacagagggcaagcccacagaccccagcaagctggagagccccagcttcaccggcaccggggacacagaaattgcccacgccacagaggacctggagaacaacggcagcaagaaggatggagtgtgtggccccccacccagcaagaagatgaagctgtttggcttcaaggaggacccctttgtgttcatcccagaagatgaccccctcttcccccccatcgagaagttctacgccctggaccccagcttccccaggatgaacctgctgaccaggaccacagagggcaagaagaggcagctgtacatggtgtccaaggagctgagaaatgtgctgctgaacaacagcgagaagatgaaggtgatcaacacaggcatcaaggtgtggtgcaggaacaacagcggggaggagtttgactgtgccttccggctggcccaggagggcatctacaccctgtaccccttcatcaacagccgcatcatcaccgtgtccatggaggatgtgaagatcctgctgacccaggagaaccccttcttcaggaagctgagcagcgagacctacagccaggccaaggacctggccaagggcagcatcgtgctgaagtatgagccagacagcgccaacccagatgccctgcagtgccccatcgtgctgtgtggctggaggggcaaggccagcatccgcacctttgtgcccaagaatgaaaggctgcactacctgaggatgatgggcctggaggtgctgggggagaagaagaaggagggcgtcatcctgaccaatgaatctgctgccagcacaggccagcctgacaatgatgtgacagagggccagagagctggggagcccaacagcccagatgctgaggaggccaacagcccagatgtgacagctggctgtgaccctgctggggtgcacccccccaggtag

SEQ ID NO: 162116 - DNA, 1785 bp, Artificial Sequence
  Description of Artificial Sequence: Synthetic coding sequence
atggtgctgctgcacgtgctgtttgagcacgctgtgggctacgccctgctggccctgaaggaggtggaggagatcagcctgctgcagccccaggtggaggagagcgtgctgaacctgggcaagttccacagcatcgtgcggctggtggccttctgcccctttgccagcagccaggtggccctggagaatgccaatgctgtgtctgagggcgtggtgcatgaggacctgcggctgctgctggagacccacctgcccagcaagaagaagaaggtgctgctgggcgtgggggaccccaagatcggggccgccatccaggaggagctgggctacaactgccagacaggaggagtgattgctgagatcctgcggggcgtgcggctgcacttccacaacctggtgaagggcctgacagacctgagcgcctgcaaggcccagctgggcctgggccacagctacagccgggccaaggtgaagttcaacgtgaacagagtggacaacatgatcatccagagcatcagcctgctggaccagctggacaaggacatcaacaccttctccatgagggtgcgggagtggtacggctaccacttccctgagctggtgaagatcatcaatgacaatgccacctactgccgcctggcccagttcatcggcaacagaagagagctgaatgaagacaagctggagaagctggaggagctgaccatggatggagccaaggccaaggccatcctggatgccagccgcagctccatgggcatggacatcagcgccatcgacctgatcaacatcgagagcttcagcagccgggtggtgtccctgtctgagtaccggcagagcctgcacacctacctgcggagcaagatgagccaggtggcccccagcctgagcgccctgattggagaggccgtgggcgcccggctgattgcccacgccggcagcctgaccaacctggccaagtacccagccagcacagtgcagatcctgggcgctgagaaggccctcttccgggccctgaagacccggggcaacacccccaagtatggcctcatcttccacagcaccttcatcggccgggctgctgccaagaacaagggccgcatcagccgctacctggccaacaagtgcagcatcgccagcagaattgactgcttcagcgaggtgcccacctctgtgtttggagagaagctgcgggagcaggtggaggagcggctgtccttctatgagaccggggagatccccaggaagaacctggatgtgatgaaggaggccatggtgcaggccgaggaggccgctgctgagatcaccaggaagctggagaagcaggagaagaagaggctgaagaaggagaagaagaggctggccgccctggccctggccagcagcgagaacagcagcagcaccccagaagaatgtgaggagatgtctgagaagcccaagaagaagaagaagcagaagccccaggaggtgccccaggagaatggcatggaggaccccagcatctccttcagcaagcccaagaagaagaagagcttcagcaaggaggagctgatgagcagtgacctggaggagacagctggcagcaccagcatccccaagaggaagaagagcacccccaaggaggagaccgtgaatgaccctgaggaggccggccacaggagcggcagcaagaagaagaggaagttcagcaaggaggagcctgtgagcagcggccctgaggaggccgtgggcaagagcagcagcaagaagaagaagaagttccacaaggccagccaggaggactag

SEQ ID NO: 162117 - DNA, 678 bp, Artificial Sequence
  Description of Artificial Sequence: Synthetic coding sequence
atggacatcagcgccatcgacctgatcaacatcgagagcttcagcagccgggtggtgtccctgtctgagtaccggcagagcctgcacacctacctgcggagcaagatgagccaggtggcccccagcctgagcgccctgattggagaggccgtgggcgcccggctcatcgcccatgctggcagcctgaccaacctggccaagtacccagccagcacagtgcagatcctgggcgctgagaaggccctcttccgggccctgaagacccggggcaacacccccaagtatggcctcatcttccacagcaccttcatcggccgggccgccgccaagaacaagggccgcatcagccgctacctggccaacaagtgcagcatcgccagcagaattgactgcttcagcgaggtgcccacctctgtgtttggagagaagctgcgggagcaggtggaggagcggctgtccttctatgaaacaggagagatccccaggaagaacctggatgtgatgaaggaggccatggtgcaggccgaggaggccgctgctgagatcaccaggaagctggagaagcaggagaagaagaggctgaagaaggagaagaagaggctggccgccctggccctggccagcagcgagaacagcagcagcaccccagaggagtgtgaggagggggaccgctgctag

SEQ ID NO: 162118 - DNA, 660 bp, Artificial Sequence
  Description of Artificial Sequence: Synthetic coding sequence
tgactcatcaacatcgagagcttcagcagccgggtggtgtccctgtctgagtaccggcagagcctgcacacctacctgcggagcaagatgagccaggtggcccccagcctgagcgccctgattggagaggccgtgggcgcccggctcatcgcccatgctggcagcctgaccaacctggccaagtacccagccagcacagtgcagatcctgggcgctgagaaggccctcttccgggccctgaagacccggggcaacacccccaagtatggcctcatcttccacagcaccttcatcggccgggccgccgccaagaacaagggccgcatcagccgctacctggccaacaagtgcagcatcgccagcagaattgactgcttcagcgaggtgcccacctctgtgtttggagagaagctgcgggagcaggtggaggagcggctgtccttctatgaaacaggagagatccccaggaagaacctggatgtgatgaaggaggccatggtgcaggccgaggaggccgctgctgagatcaccaggaagctggagaagcaggagaagaagaggctgaagaaggagaagaagaggctggccgccctggccctggccagcagcgagaacagcagcagcaccccagaggagtgtgaggagggggaccgctgctag

SEQ ID NO: 162119 - DNA, 846 bp, Artificial Sequence
  Description of Artificial Sequence: Synthetic coding sequence
atggtgctgctgcacgtgctgtttgagcacgctgtgggctacgccctgctggccctgaaggaggtggaggagatcagcctgctgcagccccaggtggaggagagcgtgctgaacctgggcaagttccacagcatcgtgcggctggtggccttctgcccctttgccagcagccaggtggccctggagaatgccaatgctgtgtctgagggcgtggtgcatgaggacctgcggctgctgctggagacccacctgcccagcaagaagaagaaggtgctgctgggcgtgggggaccccaagatcggggccgccatccaggaggagctgggctacaactgccagacaggaggagtgattgctgagatcctgcggggcgtgcggctgcacttccacaacctggtgaagggcctgacagacctgagcgcctgcaaggcccagctgggcctgggccacagctacagccgggccaaggtgaagttcaacgtgaacagagtggacaacatgatcatccagagcatcagcctgctggaccagctggacaaggacatcaacaccttctccatgagggtgcggcagagccgctgtggggagggcaaggctgtggccctgtggttcctgatgaagcagctgggccagggcgtgacagtggccctgtgccgggagtggtacggctaccacttccctgagctggtgaagatcatcaatgacaatgccacctactgccgcctggcccagttcatcggcaacagaagagagctgaatgaagacaagctggagaagctggaggagctgaccatggatggagccaaggccaaggccatcctggatgccagccgcagctccatgtag

SEQ ID NO: 162120 - DNA, 402 bp, Artificial Sequence
  Description of Artificial Sequence: Synthetic coding sequence
atgaggaagcacgtgctggccgccagcttctccatgctgagcctgctggtgatcatgggagacacagacagcaagacagacagcagcttcatcatggacagcgacccccggcgctgcatgaggcaccactacgtggacagcatcagccaccccctgtacaagtgcagcagcaagatggtgctgctggcccgctgtgagggccactgcagccaggccagccgctctgagcccctggtgtccttcagcacagtgctgaagcagcccttccgcagcagctgccactgctgccggccccagaccagcaagctgaaggccctgcggctgcgctgcagcggcggcatgaggctgacagccacctaccgctacatcctgagctgccactgtgaggagtgcaacagctag

SEQ ID NO: 162121 - DNA, 7416 bp, Artificial Sequence
  Description of Artificial Sequence: Synthetic coding sequence
atgcctgccctgcggcctgccctgctgtgggccctgctggccctgtggctgtgctgtgccgccccagcccacgccctgcagtgcagagatggctatgagccctgtgtgaatgaaggcatgtgtgtgacctaccacaacggcaccggctactgcaagtgcccagagggcttcctgggggagtactgccagcaccgggacccctgtgagaagaaccgctgccagaatggaggcacctgtgtggcccaggccatgctgggcaaggccacctgccgctgtgccagcggcttcaccggggaggactgccagtacagcaccagccacccctgctttgtgtcccggccctgcctgaatggaggcacctgccacatgctgagccgggacacctatgagtgcacctgccaggtgggcttcaccgggaaggagtgccagtggacagatgcctgcctgagccacccctgtgccaacggcagcacctgcaccaccgtggccaaccagttcagctgcaagtgcctgaccggcttcaccggccagaagtgtgaaacagatgtgaatgaatgtgacatccctggccactgccagcacggcggcacctgcctgaacctgcccggcagctaccagtgccagtgcccccagggcttcaccggccagtactgtgacagcctgtatgtgccctgtgcccccagcccctgtgtgaatggaggcacctgccggcagacaggagacttcacctttgagtgcaactgcctgcccggctttgagggcagcacctgtgaaagaaatattgatgactgccccaaccaccgctgccagaatggaggagtgtgtgtggatggagtgaacacctacaactgccgctgccccccccagtggacaggccagttctgcacagaagatgtggatgaatgtctgctgcagcccaatgcctgccagaatggaggcacctgtgccaacagaaatggaggctacggctgtgtgtgtgtgaatggctggagcggagatgactgcagtgaaaatattgatgactgtgcctttgccagctgcaccccaggcagcacctgcatcgacagagtggccagcttcagctgcatgtgcccagagggcaaggccggcctgctgtgccacctggatgatgcctgcatcagcaacccctgccacaagggggccctgtgtgacaccaaccccctgaatggccagtacatctgcacctgcccccagggctacaagggagctgactgcacagaagatgtggatgaatgtgccatggccaacagcaacccctgtgaacatgctggaaaatgtgtgaacacagatggagccttccactgtgaatgtctgaagggctacgccggcccccgctgtgagatggacatcaatgaatgccacagcgacccctgccagaatgatgccacctgcctggacaagattggaggcttcacctgcctgtgcatgcctggcttcaagggcgtgcactgtgagctggagatcaatgaatgccagagcaacccctgtgtgaacaacggccagtgtgtggacaaggtgaaccgcttccagtgcctgtgccccccaggcttcaccggccctgtgtgccagattgatattgatgactgcagcagcaccccctgcctgaatggagccaagtgcatcgaccaccccaacggctatgagtgccagtgtgccaccggcttcaccggggtgctgtgtgaagaaaatattgacaactgtgaccctgacccctgccaccacggccagtgccaggacggcatcgacagctacacctgcatctgcaaccctggctacatgggcgccatctgcagcgaccagattgatgagtgctacagcagcccctgcctgaatgatggccgctgcatcgacctggtgaatggctaccagtgcaactgccagcccggcaccagcggcgtgaactgtgagatcaactttgatgactgtgccagcaacccctgcatccacggcatctgcatggatggcatcaaccgctacagctgtgtgtgcagccctggcttcaccggccagcgctgcaacattgatattgatgaatgtgccagcaacccctgcaggaaaggagccacctgcatcaatggagtgaatggcttccgctgcatctgcccagagggcccccaccaccccagctgctacagccaggtgaatgaatgtctgagcaacccctgcatccacggcaactgcacaggaggcctgagcggctacaagtgcctgtgtgatgctggctgggtgggcatcaactgtgaggtggacaagaatgaatgtctgagcaacccctgccagaatggaggcacctgtgacaacctggtgaatggctaccgctgcacctgcaagaagggcttcaagggctacaactgccaggtgaacattgatgaatgtgccagcaacccctgcctgaaccagggcacctgctttgatgacatcagcggctacacctgccactgtgtgctgccctacaccgggaagaactgccagacagtgctggccccctgcagccccaacccctgtgaaaatgctgctgtgtgcaaggagagccccaactttgagagctacacctgcctgtgtgcccctggctggcagggccagcgctgcaccatcgacattgatgagtgcatcagcaagccctgcatgaaccacggcctgtgccacaacacccagggcagctacatgtgtgagtgccccccaggcttcagcggcatggactgtgaggaggacattgatgactgcctggccaacccctgccagaatggaggcagctgcatggatggagtgaacaccttcagctgcctgtgcctgcccggcttcaccggggacaagtgccagacagacatgaatgaatgtctgtctgagccctgcaagaatggaggcacctgcagcgactatgtgaacagctacacctgcaagtgccaggccggctttgatggagtgcactgtgagaacaacatcaatgaatgtacagagagcagctgcttcaacggcggcacctgtgtggatggcatcaacagcttcagctgcctgtgccctgtgggcttcaccggcagcttctgcctgcacgagatcaatgaatgtagcagccacccctgcctgaatgaaggcacctgtgtggatggcctgggcacctaccgctgcagctgccccctgggctacaccgggaagaactgccagaccctggtgaacctgtgcagccgcagcccctgcaagaacaagggcacctgtgtgcagaagaaggccgagagccagtgcctgtgccccagcggctgggccggggcctactgtgatgtgcccaacgtgtcctgtgacattgctgccagcagaagaggagtgctggtggagcacctgtgccagcacagcggcgtgtgcatcaatgccggcaacacccactactgccagtgccccctgggctacacaggcagctactgtgaggagcagctggatgaatgtgccagcaacccctgccagcacggggccacctgcagcgacttcatcggcggctaccgctgtgaatgtgtgcccggctaccagggcgtgaactgtgaatatgaggtggatgagtgccagaaccagccctgccagaatggaggcacctgcatcgacctggtgaaccacttcaagtgcagctgccccccaggcacccggggcctgctgtgtgaggagaacattgatgactgtgcccggggcccccactgcctgaatggaggccagtgcatggacagaattggaggctacagctgccgctgcctgcccggctttgctggggagcgctgtgagggggacatcaatgaatgtctgagcaacccctgcagcagcgagggcagcctggactgcatccagctgaccaatgactacctgtgtgtgtgccgcagcgccttcaccggccgccactgtgagacctttgtggatgtgtgcccccagatgccctgcctgaatggaggcacctgtgctgtggccagcaacatgccagatggcttcatctgccgctgccccccaggcttcagcggggcccgctgccagagcagctgtggccaggtgaagtgcaggaaaggagagcagtgtgtgcacacagccagcggcccccgctgcttctgccccagcccccgggactgtgagagcggctgtgccagcagcccctgccagcacggcggcagctgccacccccagaggcagcccccctactacagctgccagtgtgccccacccttcagcggcagccgctgtgagctgtacacagccccacccagcaccccaccagccacctgcctgagccagtactgtgccgacaaggccagagatggagtgtgtgatgaggcctgcaacagccacgcctgccagtgggatggaggagactgcagcctgaccatggagaacccctgggccaactgcagcagccccctgccctgctgggactacatcaacaaccagtgtgatgagctgtgcaacacagtggagtgcctgtttgacaactttgagtgccagggcaacagcaagacctgcaagtatgacaagtactgtgccgaccacttcaaggacaaccactgtgaccagggctgcaacagcgaggagtgtggctgggatggcctggactgtgccgctgaccagcctgagaacctggccgagggcaccctggtgattgtggtgctgatgcctcctgagcagctgctgcaggatgcccggagcttcctgcgggccctgggcaccctgctgcacaccaacctgcgcatcaagagggacagccagggcgagctgatggtgtacccctactatggagagaagtctgctgccatgaagaagcagaggatgaccaggaggagcctgcctggagagcaggagcaggaggtggccggcagcaaggtgttcctggagattgacaaccggcagtgtgtgcaggacagcgaccactgcttcaagaacacagatgctgctgctgccctgctggccagccacgccatccagggcaccctgagctaccccctggtgtctgtggtgtctgagagcctgaccccagagaggacccagctgctgtacctgctggccgtggccgtggtgatcatcctcttcatcatcctgctgggcgtcatcatggccaagaggaagaggaagcacggcagcctgtggctgcctgagggcttcaccctgcggagagatgccagcaaccacaagaggcgggagcctgtgggccaggatgctgtgggcctgaagaacctgtctgtgcaggtgtctgaggccaacctgattggcaccggcaccagcgagcactgggtggatgatgagggcccccagcccaagaaggtgaaggccgaggatgaggccctgctgtctgaggaggatgaccccatcgaccggcggccctggacccagcagcacctggaggccgctgacatccggaggacccccagcctggccctgaccccaccccaggccgagcaggaggtggatgtgctggatgtgaatgtgcggggcccagatggctgcacccccctgatgctggccagcctgcggggcggcagcagtgacctgagtgatgaagatgaagatgctgaggacagcagcgccaacatcatcacagacctggtgtaccagggcgccagcctgcaggcccagacagacagaactggagagatggccctgcacctggccgcccgctacagcagagcagatgctgccaagaggctgctggatgctggagcagatgccaatgcccaggacaacatgggccgctgccccctgcacgccgctgtggccgcagatgcccagggcgtcttccagatcctgatccggaacagagtgacagacctggatgccaggatgaatgatggcaccacccccctcatcctggccgcccggctggccgtggagggcatggtggccgagctgatcaactgccaggctgatgtgaatgctgtggatgaccacggcaagagcgccctgcactgggccgctgctgtgaacaacgtggaggccaccctgctgctgctgaagaatggagccaacagagacatgcaggacaacaaggaggagacccccctcttcctggccgcccgggagggcagctatgaagctgccaagatcctgctggaccactttgccaacagagacatcacagaccacatggaccggctgcccagagatgtggcccgggacaggatgcaccacgacatcgtgcggctgctggatgagtacaacgtgacccccagccccccaggcaccgtgctgaccagcgccctgagccctgtgatctgtggccccaacagaagcttcctgagcctgaagcacacccccatgggcaagaagagccggcggcccagcgccaagagcaccatgcccaccagcctgcccaacctggccaaggaggccaaggatgccaagggcagcaggaggaagaagagcctgtctgagaaggtgcagctgtctgagagctctgtgaccctgagccctgtggacagcctggagagcccccacacctacgtgtctgacaccaccagcagccccatgatcaccagccctggcatcctgcaggccagccccaaccccatgctggccacagctgcccccccagcccctgtgcacgcccagcacgccctgtccttcagcaacctgcacgagatgcagcccctggcccacggggccagcacagtgctgcccagcgtgtcccagctgctgagccaccaccacatcgtgtccccaggcagcggcagcgctggcagcctgagccggctgcaccctgtgcctgtgcctgctgactggatgaacaggatggaggtgaatgagacccagtacaatgagatgtttggcatggtgctggccccagctgagggcacccaccctggcatcgccccccagagccggcccccagagggcaagcacatcaccaccccccgggagcccctgccccccatcgtgaccttccagctgatccccaagggcagcatcgcccagcctgctggggccccccagccccagagcacctgccccccagctgtggccggccccctgcccaccatgtaccagatccctgagatggcccggctgcccagcgtggccttccccacagccatgatgccccagcaggacggccaggtggcccagaccatcctgcctgcctaccaccccttccctgcctctgtgggcaagtaccccaccccacccagccagcacagctatgccagcagcaatgctgctgagaggacccccagccacagcggccacctgcagggcgagcacccctacctgacccccagccctgagagcccagaccagtggagcagcagcagcccccacagcgccagtgactggagcgatgtgaccaccagccccaccccaggaggagctgggggcggccagaggggccctggcacccacatgtctgagcccccccacaacaacatgcaggtgtatgcctag

SEQ ID NO: 162122 - DNA, 711 bp, Artificial Sequence
  Description of Artificial Sequence: Synthetic coding sequence
atgtgtgtgacctaccacaatggaacaggctactgcaagtgcccagagggcttcctgggggagtactgccagcaccgggacccctgtgagaagaaccgctgccagaatggaggcacctgtgtggcccaggccatgctgggcaaggccacctgccgctgtgccagcggcttcaccggggaggactgccagtacagcaccagccacccctgctttgtgtcccggccctgcctgaatggaggcacctgccacatgctgagccgggacacctatgaatgtacctgccaggtgggcttcaccgggaaggagtgccagtggacagatgcctgcctgagccacccctgtgccaacggcagcacctgcaccaccgtggccaaccagttcagctgcaagtgcctgaccggcttcaccggccagaagtgtgaaacagatgtgaatgaatgtgacatccctggccactgccagcacggcggcacctgcctgaacctgcccggcagctaccagtgccagtgcccccagggcttcaccggccagtactgtgacagcctgtatgtgccctgtgcccccagcccctgtgtgaatggaggcacctgccggcagacaggagacttcacctttgagtgcaactgcctgcctgagaccgtgagaagaggaacagagctgtgggagcgggaccggcaggtgtggaatggcaaggagcatgatgaaaattag

SEQ ID NO: 162123 - DNA, 720 bp, Artificial Sequence
  Description of Artificial Sequence: Synthetic coding sequence
tgcagagatggctatgagccctgtgtgaatgaaggcatgtgtgtgacctaccacaatggaacaggctactgcaagtgcccagagggcttcctgggggagtactgccagcaccgggacccctgtgagaagaaccgctgccagaatggaggcacctgtgtggcccaggccatgctgggcaaggccacctgccgctgtgccagcggcttcaccggggaggactgccagtacagcaccagccacccctgctttgtgtcccggccctgcctgaatggaggcacctgccacatgctgagccgggacacctatgaatgtacctgccaggtgggcttcaccgggaaggagtgccagtggacagatgcctgcctgagccacccctgtgccaacggcagcacctgcaccaccgtggccaaccagttcagctgcaagtgcctgaccggcttcaccggccagaagtgtgaaacagatgtgaatgaatgtgacatccctggccactgccagcacggcggcacctgcctgaacctgcccggcagctaccagtgccagtgcccccagggcttcaccggccagtactgtgacagcctgtatgtgccctgtgcccccagcccctgtgtgaatggaggcacctgccggcagacaggagacttcacctttgagtgcaactgcctgcctgcctgctggcccaggaccccagacctgcggctgctgctgggggagaagtag

SEQ ID NO: 162124 - DNA, 672 bp, Artificial Sequence
  Description of Artificial Sequence: Synthetic coding sequence
atgtggatctgccctgggggcggcggcggcggcggcggcggcggggaccgggaggatgcccggccccccctgtgctgcggccgctgctggaggagcggctgtgccgcccggccccccaggatggtgtccatcggcctgcggggagctgtgcggggggcccggggctgccacctgggccggcccttcagccccagcgtgctgctgtgtgtgggccggcccggcagcgctgctggagctgagcggggccacagcctgggcagccaggagtttggccacagaagaggccccctgccctggtgcccagccaacagaagaggcagcccccccagcgccccccggggccctggccccctgacccggctgctgggccggcgggaggccggcagcaagagccagaagctgctcttccgcagcgcccgggtgcagggcggcggccagttctgccccagcggcagcgccttcctgggcgtggagcgggagcccacagctggcctgggcggcgctgagaggagaaatgcccgcttctggagaggagagcggggccagggccggcaggccaagaggcctgcccccagccagcctgccagccccctgcccggcggcggcacctgggccggctgtgtgggcctggtgtggatgggcaccggcttctgtggggcccctgagttctag

SEQ ID NO: 162125 - DNA, 2592 bp, Artificial Sequence
  Description of Artificial Sequence: Synthetic coding sequence
atgtgtgtgacctaccacaatggaacaggctactgcaagtgcccagagggcttcctgggggagtactgccagcaccgggacccctgtgagaagaaccgctgccagaatggaggcacctgtgtggcccaggccatgctgggcaaggccacctgccgctgtgccagcggcttcaccggggaggactgccagtacagcaccagccacccctgctttgtgtcccggccctgcctgaatggaggcacctgccacatgctgagccgggacacctatgaatgtacctgccaggtgggcttcaccgggaaggagtgccagtggacagatgcctgcctgagccacccctgtgccaacggcagcacctgcaccaccgtggccaaccagttcagctgcaagtgcctgaccggcttcaccggccagaagtgtgaaacagatgtgaatgaatgtgacatccctggccactgccagcacggcggcacctgcctgaacctgcccggcagctaccagtgccagtgcccccagggcttcaccggccagtactgtgacagcctgtatgtgccctgtgcccccagcccctgtgtgaatggaggcacctgccggcagacaggagacttcacctttgagtgcaactgcctgcccggctttgagggcagcacctgtgagaggaacattgatgactgccccaaccaccgctgccagaatggaggagtgtgtgtggatggagtgaacacctacaactgccgctgccccccccagtggacaggccagttctgcacagaagatgtggatgagtgcctgctgcagcccaatgcctgccagaatggaggcacctgtgccaacagaaatggaggctacggctgtgtgtgtgtgaatggctggagcggagatgactgcagcgagaacattgatgactgtgcctttgccagctgcaccccaggcagcacctgcatcgacagagtggccagcttcagctgcatgtgcccagagggcaaggccggcctgctgtgccacctggatgatgcctgcatcagcaacccctgccacaagggggccctgtgtgacaccaaccccctgaatggccagtacatctgcacctgcccccagggctacaagggagctgactgcacagaagatgtggatgaatgtgccatggccaacagcaacccctgtgagcacgccgggaaatgtgtgaacacagatggagccttccactgtgagtgcctgaagggctacgccggcccccgctgtgagatggacatcaatgaatgccacagcgacccctgccagaatgatgccacctgcctggacaagattggaggcttcacctgcctgtgcatgcctggcttcaagggcgtgcactgtgagctggagatcaatgaatgccagagcaacccctgtgtgaacaacggccagtgtgtggacaaggtgaaccgcttccagtgcctgtgccccccaggcttcaccggccctgtgtgccagattgatattgatgactgcagcagcaccccctgcctgaatggagccaagtgcatcgaccaccccaacggctatgagtgccagtgtgccaccggcttcaccggggtgctgtgtgaggagaacatcgacaactgtgaccctgacccctgccaccacggccagtgccaggacggcatcgacagctacacctgcatctgcaaccctggctacatgggcgccatctgcagcgaccagattgatgagtgctacagcagcccctgcctgaatgatggccgctgcatcgacctggtgaatggctaccagtgcaactgccagcccggcaccagcggcgtgaactgtgagatcaactttgatgactgtgccagcaacccctgcatccacggcatctgcatggatggcatcaaccgctacagctgtgtgtgcagccctggcttcaccggccagcgctgcaacatcgacattgatgaatgtgccagcaacccctgcaggaagggggccacctgcatcaacggggtgaatggcttccgctgcatctgcccagagggcccccaccaccccagctgctacagccaggtgaatgaatgtctgagcaacccctgcatccacggcaactgcaccggcggcctgagcggctacaagtgcctgtgtgatgctggctgggtgggcatcaactgtgaggtggacaagaatgaatgtctgagcaacccctgccagaatggaggcacctgtgacaacctggtgaatggctaccgctgcacctgcaagaagggcttcaagggctacaactgccaggtgaacattgatgaatgtgccagcaacccctgcctgaaccagggcacctgctttgatgacatcagcggctacacctgccactgtgtgctgccctacacaggaggctcctggagataccagcagggccctgagggcatcctggacctggccctgtctgtgcctgagagccagtgccccggcctgtggggctgcaatgccccaccccgggcccacagctctgtggtgctgcctgccttcacagactggatcctgagctttgaggagaccctgtggccacccaagatgcaggtggtggacagccacctgcccaccctgtacttcagcatctag

SEQ ID NO: 162126 - DNA, 6966 bp, Artificial Sequence
  Description of Artificial Sequence: Synthetic coding sequence
atgggccctggggcccggggcagaagaagaagaagaagacccatgagccccccacctcctcctcctcctgtgcgggccctgcccctgctgctgctgctggccggccctggagctgctgccccaccctgcctggatggcagcccctgtgccaatggaggccgctgcacccagctgcccagccgggaggccgcctgcctgtgccccccaggctgggtgggggagcgctgccagctggaggacccctgccacagcggcccctgtgccggccggggcgtgtgccagagctctgtggtggccggcacagcccgcttcagctgccgctgcccccggggcttccggggccctgactgcagcctgcctgacccctgcctgagcagcccctgtgcccacggggcccgctgcagcgtgggcccagatggccgcttcctgtgcagctgccccccaggctaccagggccgcagctgccgcagtgatgtggatgaatgtcgggtgggggagccctgccgccacggcggcacctgcctgaacaccccaggcagcttccgctgccagtgcccagctggctacacaggccccctgtgtgaaaatcctgctgtgccctgtgcccccagcccctgcagaaatggaggcacctgccggcagagcggggacctgacctatgactgtgcctgcctgcccggctttgagggccagaactgtgaggtgaatgtggatgactgccccggccaccgctgcctgaatggaggcacctgtgtggatggagtgaacacctacaactgccagtgccccccagagtggacaggccagttctgcacagaagatgtggatgagtgccagctgcagcccaatgcctgccacaatggaggcacctgcttcaacaccctgggcggccacagctgtgtgtgtgtgaatggctggacaggagagagctgcagccagaacattgatgactgtgccacagctgtgtgcttccatggagccacctgccacgacagagtggccagcttctactgtgcctgccccatgggcaagacaggcctgctgtgccacctggatgatgcctgtgtgagcaacccctgccatgaagatgccatctgtgacaccaaccctgtgaatggccgggccatctgcacctgccccccaggcttcaccggcggggcctgtgaccaggatgtggatgagtgcagcattggagccaacccctgtgagcacctgggccgctgtgtgaacacccagggcagcttcctgtgccagtgtggccggggctacacaggcccccgctgtgaaacagatgtgaatgaatgtctgagcggcccctgcaggaaccaggccacctgcctggaccgcatcggccagttcacctgcatctgcatggccggcttcaccggcacctactgtgaggtggacattgatgagtgccagagcagcccctgtgtgaatggaggagtgtgcaaggacagagtgaatggcttcagctgcacctgccccagcggcttcagcggcagcacctgccagctggatgtggatgaatgtgccagcaccccctgcagaaatggagccaagtgtgtggaccagccagatggctatgagtgccgctgtgccgagggctttgagggcaccctgtgtgacagaaatgtggatgactgcagcccagacccctgccaccacggccgctgtgtggatggcatcgccagcttcagctgtgcctgtgcccctggctacacaggcacccgctgtgagagccaggtggatgaatgtcgcagccagccctgcagacatggaggcaagtgcctggacctggtggacaagtacctgtgccgctgccccagcggcaccactggagtgaactgtgaggtgaacattgatgactgtgccagcaacccctgcacctttggagtgtgcagagatggcatcaacagatatgactgtgtgtgccagcccggcttcaccggccccctgtgcaatgtggagatcaatgaatgtgccagcagcccctgtggggagggcggcagctgtgtggatggagaaaatggcttccgctgcctgtgccccccaggcagcctgccccccctgtgcctgccccccagccacccctgtgcccacgagccctgcagccacggcatctgctatgatgcccctgggggcttccgctgtgtgtgtgagcccggctggagcggcccccgctgcagccagagcctggccagagatgcctgtgagagccagccctgcagagctgggggcacctgcagcagtgatggcatgggcttccactgcacctgccccccaggagtgcagggccggcagtgtgagctgctgagcccctgcacccccaacccctgtgagcacggcggccgctgtgagagcgcccctggccagctgcctgtgtgcagctgcccccagggctggcagggcccccgctgccagcaggatgtggatgaatgtgccggccctgccccctgtggcccccacggcatctgcaccaacctggccggcagcttcagctgcacctgccacggcggctacacaggccccagctgtgaccaggacatcaatgactgtgaccccaacccctgcctgaatggaggcagctgccaggatggagtgggcagcttcagctgcagctgcctgcccggctttgctggcccccgctgtgccagagatgtggatgagtgcctgagcaacccctgtggccctggcacctgcacagaccacgtggccagcttcacctgcacctgccccccaggctacggcggcttccactgtgagcaggacctgcctgactgcagccccagcagctgcttcaatggaggcacctgtgtggatggagtgaacagcttcagctgcctgtgccggcccggctacacaggagcccactgccagcatgaagctgacccctgcctgagccggccctgcctgcatggaggagtgtgcagcgctgcccaccctggcttccgctgcacctgcctggagagcttcaccggcccccagtgccagaccctggtggactggtgcagccggcagccctgccagaatggaggccgctgtgtgcagacaggagcctactgcctgtgccccccaggctggagcggccgcctgtgtgacatccgcagcctgccctgccgggaggccgccgcccagattggagtgcggctggagcagctgtgccaggccggcggccagtgtgtggatgaggacagcagccactactgtgtgtgcccagagggccgcacaggcagccactgtgagcaggaggtggacccctgcctggcccagccctgccagcacggcggcacctgccggggctacatgggcggctacatgtgtgaatgtctgcccggctacaatggagacaactgtgaagatgatgtggatgaatgtgccagccagccctgccagcacggcggcagctgcatcgacctggtggcccgctacctgtgcagctgccccccaggcaccctgggcgtgctgtgtgagatcaatgaagatgactgtggccctggcccccccctggacagcggcccccgctgcctgcacaacggcacctgtgtggacctggtgggcggcttccgctgcacctgccccccaggctacacaggcctgcgctgtgaggccgacatcaatgaatgtagaagtggggcctgccacgccgcccacacccgggactgcctgcaggaccccggcggcggcttccgctgcctgtgccacgccggcttcagcggcccccgctgccagacagtgctgagcccctgtgagagccagccctgccagcacggcggccagtgccggcccagccctggccctgggggcggcctgaccttcacctgccactgtgcccagcccttctggggcccccgctgtgagcgggtggcccggagctgccgggagctgcagtgccctgtgggcgtgccctgccagcagaccccccggggcccccgctgtgcctgccccccaggcctgagcggccccagctgccgctccttccctggcagccccccaggggccagcaatgccagctgtgccgccgccccctgcctgcacggcggcagctgcaggcctgcccccctggcccccttcttccgctgtgcctgtgcccagggctggacaggcccccgctgtgaggccccagctgctgcccctgaggtgtctgaggagccccgctgcccccgggccgcctgccaggccaagagaggagaccagagatgtgaccgggagtgcaacagccctggctgcggctgggatggaggagactgcagcctgtctgtgggggacccctggaggcagtgtgaggccctgcagtgctggaggctcttcaacaacagccgctgtgaccctgcctgcagcagccctgcctgcctgtatgacaactttgactgccacgccggcggccgggagaggacctgcaaccctgtgtatgagaagtactgtgccgaccactttgctgatggccgctgtgaccagggctgcaacacagaggagtgtggctgggatggcctggactgtgccagcgaggtgcctgccctgctggcccggggcgtgctggtgctgactgtgctgctgcccccagaggagctgctgcggagcagcgctgacttcctgcagaggctgagcgccatcctgcggaccagcctgcgcttccggctggatgcccacggccaggccatggtgttcccctaccaccggcccagccctggcagcgagccccgggcccggcgggagctggcccctgaggtgattggctctgtggtgatgctggagattgacaaccggctgtgcctgcagagcccagaaaatgaccactgcttcccagatgcccagagcgctgctgactacctgggcgccctgtctgctgtggagcggctggacttcccctaccccctgagagatgtgcggggggagcccctggagcccccagagcccagcgtgcccctgctgcccctgctggtggccggggctgtgctgctgctggtgatcctggtgctgggcgtgatggtggcccggaggaagcgggagcacagcaccctgtggttccctgagggcttcagcctgcacaaggatgtggccagcggccacaagggcagaagagagcctgtgggccaggatgccctgggcatgaagaacatggccaagggggagagcctgatgggagaggtggccacagactggatggacacagaatgtcctgaggccaagaggctgaaggtggaggagcccggcatgggcgctgaggaggccgtggactgccggcagtggacccagcaccacctggtggccgctgacatccgggtggccccagccatggccctgaccccaccccagggagatgctgatgctgatggcatggatgtgaatgtgcggggcccagatggcttcacccccctgatgctggccagcttctgtggcggggccctggagcccatgcccacagaggaggatgaagcagatgacaccagcgccagcatcatcagtgacctgatctgccagggcgcccagctgggcgccaggacagacagaactggagaaacagccctgcacctggccgcccgctatgcccgggcagatgctgccaagaggctgctggatgctggagctgacaccaatgcccaggaccacagcggccgcacccccctgcacacagctgtgacagcagatgcccagggcgtcttccagatcctgatccggaacagaagcacagacctggatgccaggatggctgatggcagcacagccctgatcctggccgcccggctggccgtggagggcatggtggaggagctgattgccagccatgctgatgtgaatgctgtggatgagctgggcaagagcgccctgcactgggccgctgctgtgaacaacgtggaggccaccctggccctgctgaagaatggagccaacaaggacatgcaggacagcaaggaggagacccccctcttcctggccgcccgggagggcagctatgaagctgccaagctgctgctggaccactttgccaaccgggagatcacagaccacctggaccggctgcccagagatgtggcccaggagcggctgcaccaggacatcgtgcggctgctggaccagcccagcggccccaggagccccccaggcccccacggcctgggccccctgctgtgccccccaggggccttcctgcccggcctgaaggccgcccagagcggcagcaagaagagccggcggcccccaggcaaggccggcctgggcccccagggcccccggggccggggcaagaagctgaccctggcctgccccggccccctggccgacagctctgtgaccctgagccctgtggacagcctggacagcccccggccctttggaggccccccagccagccctgggggcttccccctggagggcccctatgctgctgccacagccacagctgtgtccctggcccagctgggcggccctggccgggccggcctgggccggcagcccccaggcggctgtgtgctgagcctgggcctgctgaaccctgtggccgtgcccctggactgggcccggctgcccccaccagcccctcctggccccagcttcctgctgcccctggcccctggcccccagctgctgaaccctggcacccctgtgagcccccaggagcggcccccaccctacctggccgtgcccggccatggagaggagtacccagctgctggggcccacagcagcccccccaaggcccgcttcctgcgggtgcccagcgagcacccctacctgacccccagccctgagagccctgagcactgggccagccccagcccccccagcctgagtgactggagcgagagcacccccagccctgccacagccactggagccatggccaccaccaccggggccctgcctgcccagcccctgcccctgtctgtgcccagcagcctggcccaggcccagacccagctgggcccccagcctgaggtgacccccaagaggcaggtgctggcctag

SEQ ID NO: 162127 - DNA, 3867 bp, Artificial Sequence
  Description of Artificial Sequence: Synthetic coding sequence
gctgccatgggccctggggcccggggcagaagaagaagaagaagacccatgagccccccacctcctcctcctcctgtgcgggccctgcccctgctgctgctgctggccggccctggagctgctgccccaccctgcctggatggcagcccctgtgccaatggaggccgctgcacccagctgcccagccgggaggccgcctgcctgtgccccccaggctgggtgggggagcgctgccagctggaggacccctgccacagcggcccctgtgccggccggggcgtgtgccagagctctgtggtggccggcacagcccgcttcagctgccgctgcccccggggcttccggggccctgactgcagcctgcctgacccctgcctgagcagcccctgtgcccacggggcccgctgcagcgtgggcccagatggccgcttcctgtgcagctgccccccaggctaccagggccgcagctgccgcagtgatgtggatgaatgtcgggtgggggagccctgccgccacggcggcacctgcctgaacaccccaggcagcttccgctgccagtgcccagctggctacacaggccccctgtgtgaaaatcctgctgtgccctgtgcccccagcccctgcagaaatggaggcacctgccggcagagcggggacctgacctatgactgtgcctgcctgcccggctttgagggccagaactgtgaggtgaatgtggatgactgccccggccaccgctgcctgaatggaggcacctgtgtggatggagtgaacacctacaactgccagtgccccccagagtggacaggccagttctgcacagaagatgtggatgagtgccagctgcagcccaatgcctgccacaatggaggcacctgcttcaacaccctgggcggccacagctgtgtgtgtgtgaatggctggacaggagagagctgcagccagaacattgatgactgtgccacagctgtgtgcttccatggagccacctgccacgacagagtggccagcttctactgtgcctgccccatgggcaagacaggcctgctgtgccacctggatgatgcctgtgtgagcaacccctgccatgaagatgccatctgtgacaccaaccctgtgaatggccgggccatctgcacctgccccccaggcttcaccggcggggcctgtgaccaggatgtggatgagtgcagcattggagccaacccctgtgagcacctgggccgctgtgtgaacacccagggcagcttcctgtgccagtgtggccggggctacacaggcccccgctgtgaaacagatgtgaatgaatgtctgagcggcccctgcaggaaccaggccacctgcctggaccgcatcggccagttcacctgcatctgcatggccggcttcaccggcacctactgtgaggtggacattgatgagtgccagagcagcccctgtgtgaatggaggagtgtgcaaggacagagtgaatggcttcagctgcacctgccccagcggcttcagcggcagcacctgccagctggatgtggatgaatgtgccagcaccccctgcagaaatggagccaagtgtgtggaccagccagatggctatgagtgccgctgtgccgagggctttgagggcaccctgtgtgacagaaatgtggatgactgcagcccagacccctgccaccacggccgctgtgtggatggcatcgccagcttcagctgtgcctgtgcccctggctacacaggcacccgctgtgagagccaggtggatgaatgtcgcagccagccctgcagacatggaggcaagtgcctggacctggtggacaagtacctgtgccgctgccccagcggcaccactggagtgaactgtgaggtgaacattgatgactgtgccagcaacccctgcacctttggagtgtgcagagatggcatcaacagatatgactgtgtgtgccagcccggcttcaccggccccctgtgcaatgtggagatcaatgaatgtgccagcagcccctgtggggagggcggcagctgtgtggatggagaaaatggcttccgctgcctgtgccccccaggcagcctgccccccctgtgcctgccccccagccacccctgtgcccacgagccctgcagccacggcatctgctatgatgcccctgggggcttccgctgtgtgtgtgagcccggctggagcggcccccgctgcagccagagcctggccagagatgcctgtgagagccagccctgcagagctgggggcacctgcagcagtgatggcatgggcttccactgcacctgccccccaggagtgcagggccggcagtgtgagctgctgagcccctgcacccccaacccctgtgagcacggcggccgctgtgagagcgcccctggccagctgcctgtgtgcagctgcccccagggctggcaggacccctgcctgaatggaggcagctgccaggatggagtgggcagcttcagctgcagctgcctgcccggctttgctggcccccgctgtgccagagatgtggatgagtgcctgagcaacccctgtggccctggcacctgcacagaccacgtggccagcttcacctgcacctgccccccaggctacggcggcttccactgtgagcaggacctgcctgactgcagccccagcagctgcttcaatggaggcacctgtgtggatggagtgaacagcttcagctgcctgtgccggcccggctacacaggagcccactgccagcatgaagctgacccctgcctgagccggccctgcctgcatggaggagtgtgcagcgctgcccaccctggcttccgctgcacctgcctggagagcttcaccggcccccagtgccagaccctggtggactggtgcagccggcagccctgccagaatggaggccgctgtgtgcagacaggagcctactgcctgtgccccccaggctggagcggccgcctgtgtgacatccgcagcctgccctgccgggaggccgccgcccagattggagtgcggctggagcagctgtgccaggccggcggccagtgtgtggatgaggacagcagccactactgtgtgtgcccagagggccgcacaggcagccactgtgagcaggaggtggacccctgcctggcccagccctgccagcacggcggcacctgccggggctacatgggcggctacatgtgtgaatgtctgcccggctacaatggagacaactgtgaagatgatgtggatgaatgtgccagccagccctgccagcacggcggcagctgcatcgacctggtggcccgctacctgtgcagctgccccccaggcaccctgggcgtgctgtgtgagatcaatgaagatgactgtggccctggcccccccctggacagcggcccccgctgcctgcacaacggcacctgtgtggacctggtgggcggcttccgctgcacctgccccccaggctacacaggcctgcgctgtgaggccgacatcaatgaatgtagaagtggggcctgccacgccgcccacacccgggactgcctgcaggaccccggcggcggcttccgctgcctgtgccacgccggcttcagcggcccccgctgccagacagtgctgagcccctgtgagagccagccctgccagcacggcggccagtgccggcccagccctggccctgggggcggcctgaccttcacctgccactgtgcccagcccttctggggcccccgctgtgagcgggtggcccggagctgccgggagctgcagtgccctgtgggcgtgccctgccagcagaccccccggggcccccgctgtgcctgccccccaggcctgagcggccccagctgccgctccttccctggcagccccccaggggccagcaatgccagctag

SEQ ID NO: 162128 - DNA, 6012 bp, Artificial Sequence
  Description of Artificial Sequence: Synthetic coding sequence
atgcagccccccagcctgctgctgctgctgctgctgctgctgctgctgtgtgtgtctgtggtgcggccccggggcctgctgtgtggcagcttccctgagccctgtgccaatggaggcacctgcctgagcctgagcctgggccagggcacctgccagtgtgcccctggcttcctgggggagacctgccagttcccagacccctgccagaatgcccagctgtgccagaatggaggcagctgccaggccctgctgcctgcccccctgggcctgcccagcagccccagccccctgacccccagcttcctgtgcacctgcctgcccggcttcaccggggagcgctgccaggccaagctggaggacccctgccccccatccttctgcagcaagaggggccgctgccacatccaggccagcggccggccccagtgcagctgcatgcctggctggacaggagagcagtgccagctgcgggacttctgcagcgccaacccctgtgtgaatggaggagtgtgcctggccacctacccccagatccagtgccactgccccccaggctttgagggccacgcctgtgaaagagatgtgaatgaatgcttccaggaccccggcccctgccccaagggcaccagctgccacaacaccctgggcagcttccagtgcctgtgccctgtgggccaggagggcccccgctgtgagctgcgggccggcccctgccccccccggggctgcagcaatggaggcacctgccagctgatgcctgagaaggacagcaccttccacctgtgcctgtgccccccaggcttcatcggccctgactgtgaggtgaacccagacaactgtgtgagccaccagtgccagaatggaggcacctgccaggacggcctggacacctacacctgcctgtgcccagagacctggacaggctgggactgcagtgaagatgtggatgaatgtgagacccagggccccccccactgcagaaatggaggcacctgccagaacagcgctggcagcttccactgtgtgtgtgtgtctggctggggcggcaccagctgtgaggagaacctggatgactgcatcgccgccacctgtgcccctggcagcacctgcatcgacagagtgggcagcttcagctgcctgtgccccccaggccgcacaggcctgctgtgccacctggaggacatgtgcctgagccagccctgccacggagatgcccagtgcagcaccaaccccctgaccggcagcaccctgtgcctgtgccagcccggctacagcggccccacctgccaccaggacctggatgaatgtctgatggcccagcagggccccagcccctgtgagcacggcggcagctgcctgaacaccccaggcagcttcaactgcctgtgccccccaggctacacaggcagccgctgtgaggccgaccacaatgaatgtctgagccagccctgccaccctggcagcacctgcctggacctgctggccaccttccactgcctgtgccccccaggcctggagggccagctgtgtgaggtggagaccaatgaatgtgccagcgccccctgcctgaaccacgccgactgccacgacctgctgaatggcttccagtgcatctgcctgcccggcttcagcggcacccgctgtgaggaggacattgatgagtgccgcagcagcccctgtgccaacggcggccagtgccaggaccagcccggggccttccactgcaagtgcctgcccggctttgagggcccccgctgccagacagaggtggatgagtgcctgagtgacccctgccctgtgggcgccagctgcctggacctgcccggggccttcttctgcctgtgccccagcggcttcaccggccagctgtgtgaggtgcccctgtgtgcccccaacctgtgccagcccaagcagatctgcaaggaccagaaggacaaggccaactgcctgtgcccagatggcagccctggctgtgcccctcctgaggacaactgcacctgccaccacggccactgccagaggagcagctgtgtgtgtgatgtgggctggacaggcccagaatgtgaggccgagctgggcggctgcatcagcgccccctgtgcccacggcggcacctgctacccccagcccagcggctacaactgcacctgccccaccggctacacaggccccacctgcagcgaggagatgacagcctgccacagcggcccctgcctgaatggaggcagctgcaaccccagccctgggggctactactgcacctgcccccccagccacacaggcccccagtgccagaccagcacagactactgtgtgtctgccccctgcttcaacggcggcacctgtgtgaaccggcccggcaccttcagctgcctgtgtgccatgggcttccagggcccccgctgtgagggcaagctgcggcccagctgtgccgacagcccctgcaggaacagagccacctgccaggacagcccccagggcccccgctgcctgtgccccaccggctacacaggaggcagctgccagaccctgatggacctgtgtgcccagaagccctgccccaggaacagccactgcctgcagacaggccccagcttccactgcctgtgcctgcagggctggacaggccccctgtgcaacctgcccctgagcagctgccagaaggccgccctgagccagggcattgatgtgagcagcctgtgccacaatggaggcctgtgtgtggacagcggccccagctacttctgccactgccccccaggcttccagggcagcctgtgccaggaccacgtgaacccctgtgagagccggccctgccagaatggagccacctgcatggcccagcccagcggctacctgtgccagtgtgcccctggctatgatggccagaactgcagcaaggagctggatgcctgccagagccagccctgccacaaccacggcacctgcacccccaagccaggcggcttccactgtgcctgccccccaggctttgtgggcctgcgctgtgaaggagatgtggatgaatgtctggaccagccctgccaccccaccggcacagctgcctgccacagcctggccaatgccttctactgccagtgcctgcccggccacacaggccagtggtgtgaggtggagattgacccctgccacagccagccctgcttccatggaggcacctgtgaggccacagctggcagccccctgggcttcatctgccactgccccaagggctttgagggccccacctgcagccaccgggcccccagctgtggcttccaccactgccaccacggcggcctgtgcctgcccagccccaagccaggcttccccccaagatgtgcctgcctgagcggctacggcggccctgactgcctgaccccaccagcccccaagggctgcggcccccccagcccctgcctgtacaacggcagctgcagcgagaccaccggcctgggcggccctggcttccgctgcagctgcccccacagcagccctggcccccgctgccagaagccaggggccaagggctgtgagggccgctctggagatggagcctgtgatgctggctgcagcggccctgggggcaactgggatggaggagactgcagcctgggcgtgcctgacccctggaagggctgccccagccacagccgctgctggctgctcttcagagatggccagtgccacccccagtgtgacagtgaagaatgtctgtttgatggctatgactgtgagaccccaccagcctgcaccccagcctatgaccagtactgccacgaccacttccacaacggccactgtgagaagggctgcaacacagcagaatgtggctgggatggaggagactgcaggccagaagatggagaccctgagtggggccccagcctggccctgctggtggtgctgagccccccagccctggaccagcagctgtttgccctggcccgggtgctgagcctgaccctgcgggtgggcctgtgggtgaggaaggacagagatggccgggacatggtgtacccctacccaggggcccgggcagaggagaagctgggcggcacccgggaccccacctaccaggagagagctgccccccagacccagcccctgggcaaggagacagacagcctgtctgctggctttgtggtggtgatgggcgtggacctgagccgctgtggccctgaccacccagccagccgctgcccctgggaccccggcctgctgctgcgcttcctggccgccatggctgctgtgggcgccctggagcccctgctgcccggccccctgctggccgtgcacccccacgccggcacagcccccccagccaaccagctgccctggcctgtgctgtgcagccctgtggccggggtcatcctgctggccctgggcgccctgctggtgctgcagctgatcagaagaagaagaagagagcacggggccctgtggctgcccccaggcttcacccggcggcccaggacccagagcgccccccacagaagaagaccacccctgggggaggacagcatcggcctgaaggccctgaagcccaaggccgaggtggatgaagatggagtggtgatgtgcagcggccctgaggagggggaggaggtgggccaggccgaggagactggaccacccagcacctgccagctgtggagcctgagcggcggctgtggggccctgccccaggccgccatgctgaccccaccccaggagagcgagatggaggccccagacctggacacccggggcccagatggagtgacccccctgatgtctgctgtgtgctgcggggaggtgcagagcggcaccttccagggcgcctggctgggctgcccagagccctgggagcccctgctggatggaggagcctgcccccaggcccacacagtgggcactggagagacccccctgcacctggccgcccgcttcagccggcccacagctgcccggcggctgctggaggccggggccaaccccaaccagcctgaccgggccggccgcacccccctgcatgctgctgtggccgcagatgcccgggaggtgtgccagctgctgctgcggagccggcagacagctgtggatgccaggacagaagatggcaccacccccctgatgctggccgcccggctggccgtggaggacctggtggaggagctgattgctgcccaggctgatgtgggcgcccgggacaagtggggcaagacagccctgcactgggccgctgctgtgaacaatgcccgggccgcccggagcctgctgcaggccggggctgacaaggatgcccaggacaaccgggagcagacccccctcttcctggccgcccgggagggcgctgtggaggtggcccagctgctgctgggcctgggcgccgcccgggagctgcgggaccaggccggcctggccccagcagatgtggcccaccagaggaaccactgggacctgctgaccctgctggagggcgccggccccccagaggcccggcacaaggccaccccaggccgggaggccggccccttcccccgggccaggacagtgtctgtgtctgtgccccctcatggaggaggagccctgccccgctgcaggaccctgtctgctggggccggcccccggggcggcggggcctgcctgcaggcccggacctggagcgtggacctggccgcccggggcggcggggcctacagccactgccgcagcctgtctggagtgggcgccggcggcggccccaccccccggggccgccgcttctctgctggcatgaggggcccccggcccaacccagccatcatgaggggccgctatggagtggccgccggccggggcggccgggtgtccacagatgactggccctgtgactgggtggccctgggcgcctgtggcagcgccagcaacatccccatccccccaccctgcctgacccccagccctgagcggggcagcccccagctggactgtggccccccagccctgcaggagatgcccatcaaccagggcggggagggcaagaagtag

SEQ ID NO: 162129 - DNA, 3147 bp, Artificial Sequence
  Description of Artificial Sequence: Synthetic coding sequence
tgtgcccctggctatgatggccagaactgcagcaaggagctggatgcctgccagagccagccctgccacaaccacggcacctgcacccccaagccaggcggcttccactgtgcctgccccccaggctttgtgggcctgcgctgtgaaggagatgtggatgagtgcctggaccagccctgccaccccactggaacagctgcctgccacagcctggccaatgccttctactgccagtgcctgcccggccacacaggccagtggtgtgaggtggagattgacccctgccacagccagccctgcttccacggcggcacctgtgaggccacagctggcagccccctgggcttcatctgccactgccccaagggctttgagggccccacctgcagccaccgggcccccagctgtggcttccaccactgccaccacggcggcctgtgcctgcccagccccaagccaggcttccccccaagatgtgcctgcctgagcggctatggaggccctgactgcctgaccccaccagcccccaagggctgcggcccccccagcccctgcctgtacaacggcagctgcagcgagaccaccggcctgggcggccctggcttccgctgcagctgcccccacagcagccctggcccccgctgccagaagccaggggccaagggctgtgagggccgctctggagatggagcctgtgatgctggctgcagcggccctgggggcaactgggatggaggagactgcagcctgggcgtgcctgacccctggaagggctgccccagccacagccgctgctggctgctcttcagagatggccagtgccacccccagtgtgacagcgaggagtgcctgtttgatggctatgactgtgagaccccaccagcctgcaccccagcctatgaccagtactgccacgaccacttccacaacggccactgtgagaagggctgcaacacagcagaatgtggctgggatggaggagactgcaggccagaagatggagaccctgagtggggccccagcctggccctgctggtggtgctgagccccccagccctggaccagcagctgtttgccctggcccgggtgctgagcctgaccctgcgggtgggcctgtgggtgaggaaggacagagatggccgggacatggtgtacccctacccaggggcccgggcagaggagaagctgggcggcacccgggaccccacctaccaggagcgggccgccccccagacccagcccctgggcaaggagacagacagcctgtctgctggctttgtggtggtgatgggcgtggacctgagccgctgtggccctgaccacccagccagccgctgcccctgggaccccggcctgctgctgcgcttcctggccgccatggctgctgtgggcgccctggagcccctgctgcccggccccctgctggccgtgcacccccatgctggaacagcccccccagccaaccagctgccctggcctgtgctgtgcagccctgtggccggggtcatcctgctggccctgggcgccctgctggtgctgcagctgatcagaagaagaagaagagaacatggagccctgtggctgcccccaggcttcacccggcggcccaggacccagagcgccccccacagaagaagaccacccctgggagaagattccatcggcctgaaggccctgaagcccaaggccgaggtggatgaagatggagtggtgatgtgcagcggccctgaggagggggaggaggtgggccaggccgaggagaccggcccccccagcacctgccagctgtggagcctgagcggcggctgtggggccctgccccaggccgccatgctgaccccaccccaggagagcgagatggaggccccagacctggacacccggggcccagatggagtgacccccctgatgtctgctgtgtgctgcggggaggtgcagagcggcaccttccagggcgcctggctgggctgcccagagccctgggagcccctgctggatggaggagcctgcccccaggcccacacagtgggcaccggggagacccccctgcacctggccgcccgcttcagccggcccacagctgcccggcggctgctggaggccggggccaaccccaaccagcctgacagagctggccgcacccccctgcacgccgctgtggccgcagatgcccgggaggtgtgccagctgctgctgcggagccggcagacagctgtggatgccaggacagaagatggcaccacccccctgatgctggccgcccggctggccgtggaggacctggtggaggagctgattgctgcccaggctgatgtgggcgcccgggacaagtggggcaagacagccctgcactgggccgctgctgtgaacaatgcccgggccgcccggagcctgctgcaggccggggctgacaaggatgcccaggacaaccgggagcagacccccctcttcctggccgcccgggagggcgctgtggaggtggcccagctgctgctgggcctgggcgccgcccgggagctgcgggaccaggccggcctggccccagcagatgtggcccaccagaggaaccactgggacctgctgaccctgctggagggcgccggccccccagaggcccggcacaaggccaccccaggccgggaggccggccccttcccccgggccaggacagtgtctgtgtctgtgcccccccacggcggcggggccctgccccgctgcaggaccctgtctgctggagctggcccccggggcggcggggcctgcctgcaggcccggacctggagcgtggacctggccgcccggggcggcggggcctacagccactgccgcagcctgagcggcgtgggcgctgggggcggccccaccccccggggccgccgcttctctgctggcatgaggggcccccggcccaacccagccatcatgaggggccgctatggagtggccgccggccggggcggccgggtgtccacagatgactggccctgtgactgggtggccctgggcgcctgtggcagcgccagcaacatccccatccccccaccctgcctgacccccagccctgagcggggcagcccccagctggactgtggccccccagccctgcaggagatgcccatcaaccagggcggggagggcaagaagtag

SEQ ID NO: 162130 - DNA, 6018 bp, Artificial Sequence
  Description of Artificial Sequence: Synthetic coding sequence
atgcagccccccagcctgctgctgctgctgctgctgctgctgctgctgctgctgtgtgtgtctgtggtgcggccccggggcctgctgtgtggcagcttccctgagccctgtgccaatggaggcacctgcctgagcctgagcctgggccagggcacctgccagtgtgcccctggcttcctgggggagacctgccagttcccagacccctgccagaatgcccagctgtgccagaatggaggcagctgccaggccctgctgcctgcccccctgggcctgcccagcagccccagccccctgacccccagcttcctgtgcacctgcctgcccggcttcaccggggagcgctgccaggcccagctggaggacccctgccccccatccttctgcagcaagaggggccgctgccacatccaggccagcggccggccccagtgcagctgcatgcctggctggacaggagagcagtgccagctgcgggacttctgcagcgccaacccctgtgtgaatggaggagtgtgcctggccacctacccccagatccagtgccactgccccccaggctttgagggccacgcctgtgaaagagatgtgaatgaatgcttccaggaccccggcccctgccccaagggcaccagctgccacaacaccctgggcagcttccagtgcctgtgccctgtgggccaggagggcccccgctgtgagctgcgggccggcccctgccccccccggggctgcagcaatggaggcacctgccagctgatgcctgagaaggacagcaccttccacctgtgcctgtgccccccaggcttcatcggccctgactgtgaggtgaacccagacaactgtgtgagccaccagtgccagaatggaggcacctgccaggacggcctggacacctacacctgcctgtgcccagagacctggacaggctgggactgcagtgaagatgtggatgaatgtgaggcccagggccccccccactgcagaaatggaggcacctgccagaacagcgctggcagcttccactgtgtgtgtgtgtctggctggggcggcaccagctgtgaggagaacctggatgactgcatcgccgccacctgtgcccctggcagcacctgcatcgacagagtgggcagcttcagctgcctgtgccccccaggccgcacaggcctgctgtgccacctggaggacatgtgcctgagccagccctgccacggagatgcccagtgcagcaccaaccccctgaccggcagcaccctgtgcctgtgccagcccggctacagcggccccacctgccaccaggacctggatgaatgtctgatggcccagcagggccccagcccctgtgagcacggcggcagctgcctgaacaccccaggcagcttcaactgcctgtgccccccaggctacacaggcagccgctgtgaggccgaccacaatgaatgtctgagccagccctgccaccctggcagcacctgcctggacctgctggccaccttccactgcctgtgccccccaggcctggagggccagctgtgtgaggtggagaccaatgaatgtgccagcgccccctgcctgaaccacgccgactgccacgacctgctgaatggcttccagtgcatctgcctgcccggcttcagcggcacccgctgtgaggaggacattgatgagtgccgcagcagcccctgtgccaacggcggccagtgccaggaccagcccggggccttccactgcaagtgcctgcccggctttgagggcccccgctgccagacagaggtggatgagtgcctgagtgacccctgccctgtgggcgccagctgcctggacctgcccggggccttcttctgcctgtgccccagcggcttcaccggccagctgtgtgaggtgcccctgtgtgcccccaacctgtgccagcccaagcagatctgcaaggaccagaaggacaaggccaactgcctgtgcccagatggcagccctggctgtgcccctcctgaggacaactgcacctgccaccacggccactgccagaggagcagctgtgtgtgtgatgtgggctggacaggcccagaatgtgaggccgagctgggcggctgcatcagcgccccctgtgcccacggcggcacctgctacccccagcccagcggctacaactgcacctgccccaccggctacacaggccccacctgcagcgaggagatgacagcctgccacagcggcccctgcctgaatggaggcagctgcaaccccagccctgggggctactactgcacctgcccccccagccacacaggcccccagtgccagaccagcacagactactgtgtgtctgccccctgcttcaacggcggcacctgtgtgaaccggcccggcaccttcagctgcctgtgtgccatgggcttccagggcccccgctgtgagggcaagctgcggcccagctgtgccgacagcccctgcaggaacagagccacctgccaggacagcccccagggcccccgctgcctgtgccccaccggctacacaggaggcagctgccagaccctgatggacctgtgtgcccagaagccctgccccaggaacagccactgcctgcagacaggccccagcttccactgcctgtgcctgcagggctggacaggccccctgtgcaacctgcccctgagcagctgccagaaggccgccctgagccagggcattgatgtgagcagcctgtgccacaatggaggcctgtgtgtggacagcggccccagctacttctgccactgccccccaggcttccagggcagcctgtgccaggaccacgtgaacccctgtgagagccggccctgccagaatggagccacctgcatggcccagcccagcggctacctgtgccagtgtgcccctggctatgatggccagaactgcagcaaggagctggatgcctgccagagccagccctgccacaaccacggcacctgcacccccaagccaggcggcttccactgtgcctgccccccaggctttgtgggcctgcgctgtgaaggagatgtggatgaatgtctggaccagccctgccaccccaccggcacagctgcctgccacagcctggccaatgccttctactgccagtgcctgcccggccacacaggccagtggtgtgaggtggagattgacccctgccacagccagccctgcttccatggaggcacctgtgaggccacagctggcagccccctgggcttcatctgccactgccccaagggctttgagggccccacctgcagccaccgggcccccagctgtggcttccaccactgccaccacggcggcctgtgcctgcccagccccaagccaggcttccccccaagatgtgcctgcctgagcggctacggcggccctgactgcctgaccccaccagcccccaagggctgcggcccccccagcccctgcctgtacaacggcagctgcagcgagaccaccggcctgggcggccctggcttccgctgcagctgcccccacagcagccctggcccccgctgccagaagccaggggccaagggctgtgagggccgctctggagatggagcctgtgatgctggctgcagcggccctgggggcaactgggatggaggagactgcagcctgggcgtgcctgacccctggaagggctgccccagccacagccgctgctggctgctcttcagagatggccagtgccacccccagtgtgacagtgaagaatgtctgtttgatggctatgactgtgagaccccaccagcctgcaccccagcctatgaccagtactgccacgaccacttccacaacggccactgtgagaagggctgcaacacagcagaatgtggctgggatggaggagactgcaggccagaagatggagaccctgagtggggccccagcctggccctgctggtggtgctgagccccccagccctggaccagcagctgtttgccctggcccgggtgctgagcctgaccctgcgggtgggcctgtgggtgaggaaggacagagatggccgggacatggtgtacccctacccaggggcccgggcagaggagaagctgggcggcacccgggaccccacctaccaggagagagctgccccccagacccagcccctgggcaaggagacagacagcctgtctgctggctttgtggtggtgatgggcgtggacctgagccgctgtggccctgaccacccagccagccgctgcccctgggaccccggcctgctgctgcgcttcctggccgccatggctgctgtgggcgccctggagcccctgctgcccggccccctgctggccgtgcacccccacgccggcacagcccccccagccaaccagctgccctggcctgtgctgtgcagccctgtggccggggtcatcctgctggccctgggcgccctgctggtgctgcagctgatcagaagaagaagaagagagcacggggccctgtggctgcccccaggcttcacccggcggcccaggacccagagcgccccccacagaagaagaccacccctgggggaggacagcatcggcctgaaggccctgaagcccaaggccgaggtggatgaagatggagtggtgatgtgcagcggccctgaggagggggaggaggtgggccaggccgaggagactggaccacccagcacctgccagctgtggagcctgagcggcggctgtggggccctgccccaggccgccatgctgaccccaccccaggagagcgagatggaggccccagacctggacacccggggcccagatggagtgacccccctgatgtctgctgtgtgctgcggggaggtgcagagcggcaccttccagggcgcctggctgggctgcccagagccctgggagcccctgctggatggaggagcctgcccccaggcccacacagtgggcactggagagacccccctgcacctggccgcccgcttcagccggcccacagctgcccggcggctgctggaggccggggccaaccccaaccagcctgaccgggccggccgcacccccctgcatgctgctgtggccgcagatgcccgggaggtgtgccagctgctgctgcggagccggcagacagctgtggatgccaggacagaagatggcaccacccccctgatgctggccgcccggctggccgtggaggacctggtggaggagctgattgctgcccaggctgatgtgggcgcccgggacaagtggggcaagacagccctgcactgggccgctgctgtgaacaatgcccgggccgcccggagcctgctgcaggccggggctgacaaggatgcccaggacaaccgggagcagacccccctcttcctggccgcccgggagggcgctgtggaggtggcccagctgctgctgggcctgggcgccgcccgggagctgcgggaccaggccggcctggccccagcagatgtggcccaccagaggaaccactgggacctgctgaccctgctggagggcgccggccccccagaggcccggcacaaggccaccccaggccgggaggccggccccttcccccgggccaggacagtgtctgtgtctgtgccccctcatggaggaggagccctgccccgctgcaggaccctgtctgctggggccggcccccggggcggcggggcctgcctgcaggcccggacctggagcgtggacctggccgcccggggcggcggggcctacagccactgccgcagcctgtctggagtgggcgccggcggcggccccaccccccggggccgccgcttctctgctggcatgaggggcccccggcccaacccagccatcatgaggggccgctatggagtggccgccggccggggcggccgggtgtccacagatgactggccctgtgactgggtggccctgggcgcctgtggcagcgccagcaacatccccatccccccaccctgcctgacccccagccctgagcggggcagcccccagctggactgtggccccccagccctgcaggagatgcccatcaaccagggcggggagggcaagaagtag

SEQ ID NO: 162131 - DNA, 6012 bp, Artificial Sequence
  Description of Artificial Sequence: Synthetic coding sequence
atgcagccccccagcctgctgctgctgctgctgctgctgctgctgctgtgtgtgtctgtggtgcggccccggggcctgctgtgtggcagcttccctgagccctgtgccaatggaggcacctgcctgagcctgagcctgggccagggcacctgccagtgtgcccctggcttcctgggggagacctgccagttcccagacccctgccagaatgcccagctgtgccagaatggaggcagctgccaggccctgctgcctgcccccctgggcctgcccagcagccccagccccctgacccccagcttcctgtgcacctgcctgcccggcttcaccggggagcgctgccaggcccagctggaggacccctgccccccatccttctgcagcaagaggggccgctgccacatccaggccagcggccggccccagtgcagctgcatgcctggctggacaggagagcagtgccagctgcgggacttctgcagcgccaacccctgtgtgaatggaggagtgtgcctggccacctacccccagatccagtgccactgccccccaggctttgagggccacgcctgtgaaagagatgtgaatgaatgcttccaggaccccggcccctgccccaagggcaccagctgccacaacaccctgggcagcttccagtgcctgtgccctgtgggccaggagggcccccgctgtgagctgcgggccggcccctgccccccccggggctgcagcaatggaggcacctgccagctgatgcctgagaaggacagcaccttccacctgtgcctgtgccccccaggcttcatcggccctgactgtgaggtgaacccagacaactgtgtgagccaccagtgccagaatggaggcacctgccaggacggcctggacacctacacctgcctgtgcccagagacctggacaggctgggactgcagtgaagatgtggatgaatgtgagacccagggccccccccactgcagaaatggaggcacctgccagaacagcgctggcagcttccactgtgtgtgtgtgtctggctggggcggcaccagctgtgaggagaacctggatgactgcatcgccgccacctgtgcccctggcagcacctgcatcgacagagtgggcagcttcagctgcctgtgccccccaggccgcacaggcctgctgtgccacctggaggacatgtgcctgagccagccctgccacggagatgcccagtgcagcaccaaccccctgaccggcagcaccctgtgcctgtgccagcccggctacagcggccccacctgccaccaggacctggatgaatgtctgatggcccagcagggccccagcccctgtgagcacggcggcagctgcctgaacaccccaggcagcttcaactgcctgtgccccccaggctacacaggcagccgctgtgaggccgaccacaatgaatgtctgagccagccctgccaccctggcagcacctgcctggacctgctggccaccttccactgcctgtgccccccaggcctggagggccagctgtgtgaggtggagaccaatgaatgtgccagcgccccctgcctgaaccacgccgactgccacgacctgctgaatggcttccagtgcatctgcctgcccggcttcagcggcacccgctgtgaggaggacattgatgagtgccgcagcagcccctgtgccaacggcggccagtgccaggaccagcccggggccttccactgcaagtgcctgcccggctttgagggcccccgctgccagacagaggtggatgagtgcctgagtgacccctgccctgtgggcgccagctgcctggacctgcccggggccttcttctgcctgtgccccagcggcttcaccggccagctgtgtgaggtgcccctgtgtgcccccaacctgtgccagcccaagcagatctgcaaggaccagaaggacaaggccaactgcctgtgcccagatggcagccctggctgtgcccctcctgaggacaactgcacctgccaccacggccactgccagaggagcagctgtgtgtgtgatgtgggctggacaggcccagaatgtgaggccgagctgggcggctgcatcagcgccccctgtgcccacggcggcacctgctacccccagcccagcggctacaactgcacctgccccaccggctacacaggccccacctgcagcgaggagatgacagcctgccacagcggcccctgcctgaatggaggcagctgcaaccccagccctgggggctactactgcacctgcccccccagccacacaggcccccagtgccagaccagcacagactactgtgtgtctgccccctgcttcaacggcggcacctgtgtgaaccggcccggcaccttcagctgcctgtgtgccatgggcttccagggcccccgctgtgagggcaagctgcggcccagctgtgccgacagcccctgcaggaacagagccacctgccaggacagcccccagggcccccgctgcctgtgccccaccggctacacaggaggcagctgccagaccctgatggacctgtgtgcccagaagccctgccccaggaacagccactgcctgcagacaggccccagcttccactgcctgtgcctgcagggctggacaggccccctgtgcaacctgcccctgagcagctgccagaaggccgccctgagccagggcattgatgtgagcagcctgtgccacaatggaggcctgtgtgtggacagcggccccagctacttctgccactgccccccaggcttccagggcagcctgtgccaggaccacgtgaacccctgtgagagccggccctgccagaatggagccacctgcatggcccagcccagcggctacctgtgccagtgtgcccctggctatgatggccagaactgcagcaaggagctggatgcctgccagagccagccctgccacaaccacggcacctgcacccccaagccaggcggcttccactgtgcctgccccccaggctttgtgggcctgcgctgtgaaggagatgtggatgaatgtctggaccagccctgccaccccaccggcacagctgcctgccacagcctggccaatgccttctactgccagtgcctgcccggccacacaggccagtggtgtgaggtggagattgacccctgccacagccagccctgcttccatggaggcacctgtgaggccacagctggcagccccctgggcttcatctgccactgccccaagggctttgagggccccacctgcagccaccgggcccccagctgtggcttccaccactgccaccacggcggcctgtgcctgcccagccccaagccaggcttccccccaagatgtgcctgcctgagcggctacggcggccctgactgcctgaccccaccagcccccaagggctgcggcccccccagcccctgcctgtacaacggcagctgcagcgagaccaccggcctgggcggccctggcttccgctgcagctgcccccacagcagccctggcccccgctgccagaagccaggggccaagggctgtgagggccgctctggagatggagcctgtgatgctggctgcagcggccctgggggcaactgggatggaggagactgcagcctgggcgtgcctgacccctggaagggctgccccagccacagccgctgctggctgctcttcagagatggccagtgccacccccagtgtgacagtgaagaatgtctgtttgatggctatgactgtgagaccccaccagcctgcaccccagcctatgaccagtactgccacgaccacttccacaacggccactgtgagaagggctgcaacacagcagaatgtggctgggatggaggagactgcaggccagaagatggagaccctgagtggggccccagcctggccctgctggtggtgctgagccccccagccctggaccagcagctgtttgccctggcccgggtgctgagcctgaccctgcgggtgggcctgtgggtgaggaaggacagagatggccgggacatggtgtacccctacccaggggcccgggcagaggagaagctgggcggcacccgggaccccacctaccaggagagagctgccccccagacccagcccctgggcaaggagacagacagcctgtctgctggctttgtggtggtgatgggcgtggacctgagccgctgtggccctgaccacccagccagccgctgcccctgggaccccggcctgctgctgcgcttcctggccgccatggctgctgtgggcgccctggagcccctgctgcccggccccctgctggccgtgcacccccacgccggcacagcccccccagccaaccagctgccctggcctgtgctgtgcagccctgtggccggggtcatcctgctggccctgggcgccctgctggtgctgcagctgatcagaagaagaagaagagagcacggggccctgtggctgcccccaggcttcacccggcggcccaggacccagagcgccccccacagaagaagaccacccctgggggaggacagcatcggcctgaaggccctgaagcccaaggccgaggtggatgaagatggagtggtgatgtgcagcggccctgaggagggggaggaggtgggccaggccgaggagactggaccacccagcacctgccagctgtggagcctgagcggcggctgtggggccctgccccaggccgccatgctgaccccaccccaggagagcgagatggaggccccagacctggacacccggggcccagatggagtgacccccctgatgtctgctgtgtgctgcggggaggtgcagagcggcaccttccagggcgcctggctgggctgcccagagccctgggagcccctgctggatggaggagcctgcccccaggcccacacagtgggcactggagagacccccctgcacctggccgcccgcttcagccggcccacagctgcccggcggctgctggaggccggggccaaccccaaccagcctgaccgggccggccgcacccccctgcatgctgctgtggccgcagatgcccgggaggtgtgccagctgctgctgcggagccggcagacagctgtggatgccaggacagaagatggcaccacccccctgatgctggccgcccggctggccgtggaggacctggtggaggagctgattgctgcccaggctgatgtgggcgcccgggacaagtggggcaagacagccctgcactgggccgctgctgtgaacaatgcccgggccgcccggagcctgctgcaggccggggctgacaaggatgcccaggacaaccgggagcagacccccctcttcctggccgcccgggagggcgctgtggaggtggcccagctgctgctgggcctgggcgccgcccgggagctgcgggaccaggccggcctggccccagcagatgtggcccaccagaggaaccactgggacctgctgaccctgctggagggcgccggccccccagaggcccggcacaaggccaccccaggccgggaggccggccccttcccccgggccaggacagtgtctgtgtctgtgccccctcatggaggaggagccctgccccgctgcaggaccctgtctgctggggccggcccccggggcggcggggcctgcctgcaggcccggacctggagcgtggacctggccgcccggggcggcggggcctacagccactgccgcagcctgtctggagtgggcgccggcggcggccccaccccccggggccgccgcttctctgctggcatgaggggcccccggcccaacccagccatcatgaggggccgctatggagtggccgccggccggggcggccgggtgtccacagatgactggccctgtgactgggtggccctgggcgcctgtggcagcgccagcaacatccccatccccccaccctgcctgacccccagccctgagcggggcagcccccagctggactgtggccccccagccctgcaggagatgcccatcaaccagggcggggagggcaagaagtag

SEQ ID NO: 162132 - DNA, 561 bp, Artificial Sequence
  Description of Artificial Sequence: Synthetic coding sequence
atgtctgctgtgtgctgcggggaggtgcagagcggcaccttccagggcgcctggctgggctgcccagagccctgggagcccctgctggatggaggagcctgcccccaggcccacacagtgggcaccggggagacccccctgcacctggccgcccgcttcagccggcccacagctgcccggcggctgctggaggccggggccaaccccaaccagcctgacagagctggccgcacccccctgcacgccgctgtggccgcagatgcccgggaggtgtgccagctgctgctgcggagccggcagacagctgtggatgccaggacagaagatggcaccacccccctgatgctggccgcccggctggccgtggaggacctggtggaggagctgattgctgcccaggctgatgtgggcgcccgggacaagtggggcgcagatgctgccatccctggaggagctggccgcagcggcggcagcagccctgccacagctggagctgggggcagccccagggctgctggccctggctgggccagcgctgggggccgccgcagccccacctag

SEQ ID NO: 162133 - DNA, 6009 bp, Artificial Sequence
  Description of Artificial Sequence: Synthetic coding sequence
atgcagccccccagcctgctgctgctgctgctgctgctgctgctgtgtgtgtctgtggtgcggccccggggcctgctgtgtggcagcttccctgagccctgtgccaacggcggcacctgcctgagcctgagcctgggccagggcacctgccagtgtgcccctggcttcctgggggagacctgccagttcccagacccctgccagaatgcccagctgtgccagaatggaggcagctgccaggccctgctgcctgcccccctgggcctgcccagcagccccagccccctgacccccagcttcctgtgcacctgcctgcccggcttcaccggggagcgctgccaggcccagctggaggacccctgcccccccagcttctgcagcaagaggggccgctgccacatccaggccagcggccggccccagtgcagctgcatgcctggctggacaggagagcagtgccagctgcgggacttctgcagcgccaacccctgtgtgaatggaggagtgtgcctggccacctacccccagatccagtgccactgccccccaggctttgagggccacgcctgtgaaagagatgtgaatgaatgcttccaggaccccggcccctgccccaagggcaccagctgccacaacaccctgggcagcttccagtgcctgtgccctgtgggccaggagggcccccgctgtgagctgcgggccggcccctgccccccccggggctgcagcaatggaggcacctgccagctgatgcctgagaaggacagcaccttccacctgtgcctgtgccccccaggcttcatcggccctgactgtgaggtgaacccagacaactgtgtgagccaccagtgccagaatggaggcacctgccaggacggcctggacacctacacctgcctgtgcccagagacctggacaggctgggactgcagtgaagatgtggatgaatgtgagacccagggccccccccactgcagaaatggaggcacctgccagaacagcgctggcagcttccactgtgtgtgtgtgtctggctggggcggcaccagctgtgaggagaacctggatgactgcatcgccgccacctgtgcccctggcagcacctgcatcgacagagtgggcagcttcagctgcctgtgccccccaggccgcacaggcctgctgtgccacctggaggacatgtgcctgagccagccctgccacggagatgcccagtgcagcaccaaccccctgaccggcagcaccctgtgcctgtgccagcccggctacagcggccccacctgccaccaggacctggatgagtgcctgatggcccagcagggccccagcccctgtgaacatggaggcagctgcctgaacaccccaggcagcttcaactgcctgtgccccccaggctacacaggcagccgctgtgaggccgaccacaatgaatgtctgagccagccctgccaccctggcagcacctgcctggacctgctggccaccttccactgcctgtgccccccaggcctggagggccagctgtgtgaggtggagaccaatgaatgtgccagcgccccctgcctgaaccacgccgactgccacgacctgctgaatggcttccagtgcatctgcctgcccggcttcagcggcacccgctgtgaagaagatattgatgaatgtcgcagcagcccctgtgccaatggaggccagtgccaggaccagcccggggccttccactgcaagtgcctgcccggctttgagggcccccgctgccagacagaggtggatgaatgtctgagtgacccctgccctgtgggcgccagctgcctggacctgcccggggccttcttctgcctgtgccccagcggcttcaccggccagctgtgtgaggtgcccctgtgtgcccccaacctgtgccagcccaagcagatctgcaaggaccagaaggacaaggccaactgcctgtgcccagatggcagccctggctgtgcccccccagaggacaactgcacctgccaccacggccactgccagaggagcagctgtgtgtgtgatgtgggctggacaggcccagaatgtgaggccgagctgggcggctgcatcagcgccccctgtgcccatggaggcacctgctacccccagcccagcggctacaactgcacctgccccaccggctacacaggccccacctgcagcgaggagatgacagcctgccacagcggcccctgcctgaatggaggcagctgcaaccccagccctgggggctactactgcacctgcccccccagccacacaggcccccagtgccagaccagcacagactactgtgtgtctgccccctgcttcaatggaggcacctgtgtgaacagacctggcaccttcagctgcctgtgtgccatgggcttccagggcccccgctgtgagggcaagctgcggcccagctgtgccgacagcccctgcaggaacagagccacctgccaggacagcccccagggcccccgctgcctgtgccccaccggctacacaggaggcagctgccagaccctgatggacctgtgtgcccagaagccctgccccaggaacagccactgcctgcagacaggccccagcttccactgcctgtgcctgcagggctggacaggccccctgtgcaacctgcccctgagcagctgccagaaggccgccctgagccagggcattgatgtgagcagcctgtgccacaacggcggcctgtgtgtggacagcggccccagctacttctgccactgccccccaggcttccagggcagcctgtgccaggaccacgtgaacccctgtgagagccggccctgccagaatggagccacctgcatggcccagcccagcggctacctgtgccagtgtgcccctggctatgatggccagaactgcagcaaggagctggatgcctgccagagccagccctgccacaaccacggcacctgcacccccaagccaggcggcttccactgtgcctgccccccaggctttgtgggcctgcgctgtgaaggagatgtggatgagtgcctggaccagccctgccaccccactggaacagctgcctgccacagcctggccaatgccttctactgccagtgcctgcccggccacacaggccagtggtgtgaggtggagattgacccctgccacagccagccctgcttccacggcggcacctgtgaggccacagctggcagccccctgggcttcatctgccactgccccaagggctttgagggccccacctgcagccaccgggcccccagctgtggcttccaccactgccaccacggcggcctgtgcctgcccagccccaagccaggcttccccccaagatgtgcctgcctgagcggctatggaggccctgactgcctgaccccaccagcccccaagggctgcggcccccccagcccctgcctgtacaacggcagctgcagcgagaccaccggcctgggcggccctggcttccgctgcagctgcccccacagcagccctggcccccgctgccagaagccaggggccaagggctgtgagggccgctctggagatggagcctgtgatgctggctgcagcggccctgggggcaactgggatggaggagactgcagcctgggcgtgcctgacccctggaagggctgccccagccacagccgctgctggctgctcttcagagatggccagtgccacccccagtgtgacagcgaggagtgcctgtttgatggctatgactgtgagaccccaccagcctgcaccccagcctatgaccagtactgccacgaccacttccacaacggccactgtgagaagggctgcaacacagcagaatgtggctgggatggaggagactgcaggccagaagatggagaccctgagtggggccccagcctggccctgctggtggtgctgagccccccagccctggaccagcagctgtttgccctggcccgggtgctgagcctgaccctgcgggtgggcctgtgggtgaggaaggacagagatggccgggacatggtgtacccctacccaggggcccgggcagaggagaagctgggcggcacccgggaccccacctaccaggagcgggccgccccccagacccagcccctgggcaaggagacagacagcctgtctgctggctttgtggtggtgatgggcgtggacctgagccgctgtggccctgaccacccagccagccgctgcccctgggaccccggcctgctgctgcgcttcctggccgccatggctgctgtgggcgccctggagcccctgctgcccggccccctgctggccgtgcacccccatgctggaacagcccccccagccaaccagctgccctggcctgtgctgtgcagccctgtggccggggtcatcctgctggccctgggcgccctgctggtgctgcagctgatcagaagaagaagaagagaacatggagccctgtggctgcccccaggcttcacccggcggcccaggacccagagcgccccccacagaagaagaccacccctgggagaagattccatcggcctgaaggccctgaagcccaaggccgaggtggatgaagatggagtggtgatgtgcagcggccctgaggagggggaggaggtgggccaggccgaggagaccggcccccccagcacctgccagctgtggagcctgagcggcggctgtggggccctgccccaggccgccatgctgaccccaccccaggagagcgagatggaggccccagacctggacacccggggcccagatggagtgacccccctgatgtctgctgtgtgctgcggggaggtgcagagcggcaccttccagggcgcctggctgggctgcccagagccctgggagcccctgctggatggaggagcctgcccccaggcccacacagtgggcaccggggagacccccctgcacctggccgcccgcttcagccggcccacagctgcccggcggctgctggaggccggggccaaccccaaccagcctgacagagctggccgcacccccctgcacgccgctgtggccgcagatgcccgggaggtgtgccagctgctgctgcggagccggcagacagctgtggatgccaggacagaagatggcaccacccccctgatgctggccgcccggctggccgtggaggacctggtggaggagctgattgctgcccaggctgatgtgggcgcccgggacaagtggggcaagacagccctgcactgggccgctgctgtgaacaatgcccgggccgcccggagcctgctgcaggccggggctgacaaggatgcccaggacaaccgggagcagacccccctcttcctggccgcccgggagggcgctgtggaggtggcccagctgctgctgggcctgggcgccgcccgggagctgcgggaccaggccggcctggccccagcagatgtggcccaccagaggaaccactgggacctgctgaccctgctggagggcgccggccccccagaggcccggcacaaggccaccccaggccgggaggccggccccttcccccgggccaggacagtgtctgtgtctgtgcccccccacggcggcggggccctgccccgctgcaggaccctgtctgctggagctggcccccggggcggcggggcctgcctgcaggcccggacctggagcgtggacctggccgcccggggcggcggggcctacagccactgccgcagcctgagcggcgtgggcgctgggggcggccccaccccccggggccgccgcttctctgctggcatgaggggcccccggcccaacccagccatcatgaggggccgctatggagtggccgccggccggggcggccgggtgtccacagatgactggccctgtgactgggtggccctgggcgcctgtggcagcgccagcaacatccccatccccccaccctgcctgacccccagccctgagcggggcagcccccagctggactgtggccccccagccctgcaggagatgcccatcaaccagggcggggagggcaagaagtag

SEQ ID NO: 162134 - DNA, 6012 bp, Artificial Sequence; identical to SEQ ID NO: 162128
  Description of Artificial Sequence: Synthetic coding sequence

SEQ ID NO: 162135 - DNA, 561 bp, Artificial Sequence; identical to SEQ ID NO: 162132
  Description of Artificial Sequence: Synthetic coding sequence

SEQ ID NO: 162136 - DNA, 561 bp, Artificial Sequence; identical to SEQ ID NO: 162132
  Description of Artificial Sequence: Synthetic coding sequence

SEQ ID NO: 162137 - DNA, 561 bp, Artificial Sequence; identical to SEQ ID NO: 162132
  Description of Artificial Sequence: Synthetic coding sequence

SEQ ID NO: 162138 - DNA, 561 bp, Artificial Sequence; identical to SEQ ID NO: 162132
  Description of Artificial Sequence: Synthetic coding sequence

SEQ ID NO: 162139 - DNA, 561 bp, Artificial Sequence; identical to SEQ ID NO: 162132
  Description of Artificial Sequence: Synthetic coding sequence

SEQ ID NO: 162140 - DNA, 1491 bp, Artificial Sequence
  Description of Artificial Sequence: Synthetic coding sequence
atgggccggggcgtgcgggtgctgctgctgctgagcctgctgcactgtgccggcggcagcgagggcaggaagacctggaggcggcggggccagcagcccccacctccacccaggacagaagctgccccagctgctggccagcctgtggagagcttccccctggacttcaccgctgtggagggcaacatggacagcttcatggcccaggtgaagagcctggcccagagcctgtacccctgcagcgcccagcagctgaatgaagacctgcggctgcacctgctgctgaacacctctgtgacctgcaatgatggcagccctgctggctactacctgaaggagagccggggcagccgccgctggctgctcttcctggagggcggctggtactgcttcaaccgggagaactgtgacagccgctatgacaccatgaggcggctgatgagcagccgggactggcccaggaccaggactggaacaggcatcctgagcagccagcctgaggagaacccctactggtggaatgccaacatggtgttcatcccctactgcagcagtgatgtgtggagcggggccagcagcaagtctgagaagaatgaatatgccttcatgggcgccctgatcatccaggaggtggtgcgggagctgctgggccggggcctgagcggggccaaggtgctgctgctggccggcagcagcgctgggggcaccggggtgctgctgaatgtggacagagtggccgagcagctggagaagctgggctacccagccatccaggtgcggggcctggccgacagcggctggttcctggacaacaagcagtaccgccacacagactgtgtggacaccatcacctgtgcccccacagaggccatccggcggggcatccgctactggaatggagtggtgcctgagcgctgccggcggcagttccaggagggggaggagtggaactgcttcttcggctacaaggtgtaccccaccctgcgctgccctgtgtttgtggtgcagtggctgtttgatgaggcccagctgactgtggacaacgtgcacctgaccggccagcctgtgcaggagggcctgcggctgtacatccagaacctgggccgggagctgcggcacaccctgaaggatgtgcctgccagctttgccccagcctgcctgagccatgagatcatcatccgcagccactggacagatgtgcaggtgaagggcaccagcctgccccgggccctgcactgctgggacaggagcctgcatgacagccacaaggccagcaagacccccctgaagggctgccctgtgcacctggtggacagctgcccctggccccactgcaaccccagctgccccaccgtgcgggaccagttcaccggccaggagatgaatgtggcccagttcctgatgcacatgggctttgacatgcagacagtggcccagccccagggcctggagcccagcgagctgctgggcatgctgagcaatggcagctag

SEQ ID NO: 162141 - DNA, 888 bp, Artificial Sequence
  Description of Artificial Sequence: Synthetic coding sequence
atgggccggggcgtgcgggtgctgctgctgctgagcctgctgcactgtgccggcggcagcgagggcaggaagacctggaggcggcggggccagcagcccccacctccacccaggacagaagctgccccagctgctggccagcctgtggagagcttccccctggacttcaccgctgtggagggcaacatggacagcttcatggcccaggtgaagagcctggcccagagcctgtacccctgcagcgcccagcagctgaatgaagacctgcggctgcacctgctgctgaacacctctgtgacctgcaatgatggcagccctgctggctactacctgaaggagagccggggcagccgccgctggctgctcttcctggagggcggctggtactgcttcaaccgggagaactgtgacagccgctatgacaccatgaggcggctgatgagcagccgggactggcccaggaccaggactggaacaggcatcctgagcagccagcctgaggagaacccctactggtggaatgccaacatggtgttcatcccctactgcagcagtgatgtgtggagcggggccagcagcaagtctgagaagaatgaatatgccttcatgggcgccctgatcatccaggaggtggtgcgggagctgctgggccggggcctgagcggggccaaggtgctgctgctggccggcagcagcgctgggggcaccggggtgctgctgaatgtggacagagtggccgagcagctggagaagctgggctacccagccatccaggtgcggggcctggccgacagcggctggttcctggacaacaagcagtaccgccacacagactgtgtggacaccatcacctgtgcccccacagaggccatccggcggggcatctag

SEQ ID NO: 162142 - DNA, 4080 bp, Artificial Sequence
  Description of Artificial Sequence: Synthetic coding sequence
atggccgaggccggcctgcggggctggctgctgtgggccctgctgctgcggctggcccagagcgagccctacaccaccatccaccagcccggctactgtgccttctatgatgaatgtgggaagaaccctgagctgagcggcagcctgatgaccctgagcaatgtgtcctgcctgagcaacaccccagccaggaagatcactggagaccacctgatcctgctgcagaagatctgcccccggctgtacacaggccccaacacccaggcctgctgcagcgccaagcagctggtgtccctggaggccagcctgagcatcaccaaggccctgctgacccgctgcccagcctgcagcgacaactttgtgaacctgcactgccacaacacctgcagccccaaccagagcctcttcatcaacgtgaccagggtggcccagctgggcgccggccagctgcctgctgtggtggcctatgaggccttctaccagcacagctttgctgagcagagctatgacagctgcagccgggtgcgggtgcctgctgctgccaccctggccgtgggcaccatgtgtggggtgtatggcagcgccctgtgcaatgcccagcgctggctgaacttccagggcgacacaggaaatggcctggcccccctggacatcaccttccacctgctggagcccggccaggccgtgggcagcggcatccagcccctgaatgaaggagtggcccgctgcaatgaaagccagggagatgatgtggccacctgcagctgccaggactgtgccgccagctgcccagccatcgcccggccccaggccctggacagcaccttctacctgggccagatgcctggcagcctggtgctgatcatcatcctgtgcagcgtgtttgctgtggtgaccatcctgctggtgggcttccgggtggccccagcccgggacaagagcaagatggtggaccccaagaagggcaccagcctgagtgacaagctgtccttcagcacccacaccctgctgggccagttcttccagggctggggcacctgggtggcctcctggcccctgaccatcctggtgctgagcgtcatccctgtggtggccctggccgccggcctggtgttcacagagctgaccacagatcctgtggagctgtggagcgcccccaacagccaggcccggtctgagaaggccttccatgaccagcacttcggccccttcttccgcaccaaccaggtgatcctgacagcccccaacagaagcagctaccgctatgacagcctgctgctgggccccaagaacttcagcggcatcctggacctggacctgctgctggagctgctggagctgcaggagcggctgcggcacctgcaggtgtggagccctgaggcccagaggaacatcagcctgcaggacatctgctacgcccccctgaacccagacaacaccagcctgtatgactgctgcatcaacagcctgctgcagtacttccagaacaacagaaccctgctgctgctgacagccaaccagaccctgatgggccagaccagccaggtggactggaaggaccacttcctgtactgtgccaatgcccccctgaccttcaaggatggaacagccctggccctgagctgcatggctgactatggagcccctgtgttccccttcctggccatcggcggctacaagggcaaggactacagcgaggccgaggccctgatcatgaccttcagcctgaacaactacccagctggggacccccggctggcccaggccaagctgtgggaggaggccttcctggaggagatgagggccttccagaggaggatggccggcatgttccaggtgaccttcatggccgagaggagcctggaggatgagatcaacagaaccacagctgaggacctgcccatctttgccaccagctacatcgtcatcttcctgtacatcagcctggccctgggcagctacagctcctggagccgggtgatggtggacagcaaggccaccctgggcctgggcggcgtggccgtggtgctgggcgctgtgatggccgccatgggcttcttctcctacctgggcatccgcagcagcctggtgatcctgcaggtggtgcccttcctggtgctgtctgtgggcgctgacaacatcttcatctttgtgctggagtaccagaggctgccccggcggcctggagagccccgggaggtgcacatcggccgggccctgggccgggtggcccccagcatgctgctgtgcagcctgtctgaggccatctgcttcttcctgggcgccctgacccccatgcctgctgtgaggacctttgccctgaccagcggcctggccgtcatcctggacttcctgctgcagatgtctgcctttgtggccctgctgagcctggacagcaagaggcaggaggccagccggctggatgtgtgctgctgcgtgaagccccaggagctgcccccacctggccagggcgagggcctgctgctgggcttcttccagaaggcctatgcccccttcctgctgcactggatcacccggggcgtggtgctgctgctcttcctggccctgtttggagtgtccctgtacagcatgtgccacatctctgtgggcctggaccaggagctggccctgcccaaggacagctacctgctggactacttcctgttcctgaaccgctactttgaggtgggcgcccctgtgtactttgtgaccaccctgggctacaacttcagcagcgaggccggcatgaatgccatctgcagcagcgctggctgcaacaacttctccttcacccagaagatccagtatgccacagagttccctgagcagagctacctggccatcccagccagctcctgggtggatgacttcatcgactggctgacccccagcagctgctgccgcctgtacatcagcggccccaacaaggacaagttctgccccagcacagtgaacagcctgaactgcctgaagaactgcatgagcatcaccatgggctctgtgcggcccagcgtggagcagttccacaagtacctgccctggttcctgaatgaccggcccaacatcaagtgccccaagggcggcctggccgcctacagcacctctgtgaacctgaccagtgatggccaggtgctggacacagtggccatcctgagcccccggctggagtacagcggcaccatcagcgcccactgcaacctgtacctgctggacagcaccagccgcttcatggcctaccacaagcccctgaagaacagccaggactacacagaggccctgcgggccgcccgggagctggccgccaacatcacagctgacctgaggaaggtgcctggaacagatcctgcctttgaggtgttcccctacaccatcaccaacgtgttctatgagcagtacctgaccatcctgcctgagggcctcttcatgctgagcctgtgcctggtgcccacctttgctgtgtcctgcctgctgctgggcctggacctgcggagcggcctgctgaacctgctgagcatcgtgatgatcctggtggacacagtgggcttcatggccctgtggggcatctcctacaatgctgtgtccctcatcaacctggtgtctgctgtgggcatgtctgtggagtttgtgagccacatcaccaggagctttgccatcagcaccaagcccacctggctggagcgggccaaggaggccaccatctccatgggcagcgctgtgtttgctggggtggccatgaccaacctgcccggcatcctggtgctgggcctggccaaggcccagctgatccagatcttcttcttccggctgaacctgctgatcaccctgctgggcctgctgcacggcctggtgttcctgcccgtcatcctgtcctatgtgggcccagatgtgaacccagccctggccctggagcagaagagagctgaggaggccgtggccgctgtgatggtggccagctgccccaaccaccccagccgggtgtccacagctgacaacatctacgtgaaccacagctttgagggcagcatcaagggagctggggccatcagcaacttcctgcccaacaacggccggcagttctag

SEQ ID NO: 162143 - DNA, 3999 bp, Artificial Sequence
  Description of Artificial Sequence: Synthetic coding sequence
atggccgaggccggcctgcggggctggctgctgtgggccctgctgctgcggctggcccagagcgagccctacaccaccatccaccagcccggctactgtgccttctatgatgaatgtgggaagaaccctgagctgagcggcagcctgatgaccctgagcaatgtgtcctgcctgagcaacaccccagccaggaagatcactggagaccacctgatcctgctgcagaagatctgcccccggctgtacacaggccccaacacccaggcctgctgcagcgccaagcagctggtgtccctggaggccagcctgagcatcaccaaggccctgctgacccgctgcccagcctgcagcgacaactttgtgaacctgcactgccacaacacctgcagccccaaccagagcctcttcatcaacgtgaccagggtggcccagctgggcgccggccagctgcctgctgtggtggcctatgaggccttctaccagcacagctttgctgagcagagctatgacagctgcagccgggtgcgggtgcctgctgctgccaccctggccgtgggcaccatgtgtggggtgtatggcagcgccctgtgcaatgcccagcgctggctgaacttccagggcgacacaggaaatggcctggcccccctggacatcaccttccacctgctggagcccggccaggccgtgggcagcggcatccagcccctgaatgaaggagtggcccgctgcaatgaaagccagggagatgatgtggccacctgcagctgccaggactgtgccgccagctgcccagccatcgcccggccccaggccctggacagcaccttctacctgggccagatgcctggcagcctggtgctgatcatcatcctgtgcagcgtgtttgctgtggtgaccatcctgctggtgggcttccgggtggccccagcccgggacaagagcaagatggtggaccccaagaagggcaccagcctgagtgacaagctgtccttcagcacccacaccctgctgggccagttcttccagggctggggcacctgggtggcctcctggcccctgaccatcctggtgctgagcgtcatccctgtggtggccctggccgccggcctggtgttcacagagctgaccacagatcctgtggagctgtggagcgcccccaacagccaggcccggtctgagaaggccttccatgaccagcacttcggccccttcttccgcaccaaccaggtgatcctgacagcccccaacagaagcagctaccgctatgacagcctgctgctgggccccaagaacttcagcggcatcctggacctggacctgctgctggagctgctggagctgcaggagcggctgcggcacctgcaggtgtggagccctgaggcccagaggaacatcagcctgcaggacatctgctacgcccccctgaacccagacaacaccagcctgtatgactgctgcatcaacagcctgctgcagtacttccagaacaacagaaccctgctgctgctgacagccaaccagaccctgatgggccagaccagccaggtggactggaaggaccacttcctgtactgtgccaatgcccccctgaccttcaaggatggaacagccctggccctgagctgcatggctgactatggagcccctgtgttccccttcctggccatcggcggctacaagggcaaggactacagcgaggccgaggccctgatcatgaccttcagcctgaacaactacccagctggggacccccggctggcccaggccaagctgtgggaggaggccttcctggaggagatgagggccttccagaggaggatggccggcatgttccaggtgaccttcatggccgagaggagcctggaggatgagatcaacagaaccacagctgaggacctgcccatctttgccaccagctacatcgtcatcttcctgtacatcagcctggccctgggcagctacagctcctggagccgggtgatggtggacagcaaggccaccctgggcctgggcggcgtggccgtggtgctgggcgctgtgatggccgccatgggcttcttctcctacctgggcatccgcagcagcctggtgatcctgcaggtggtgcccttcctggtgctgtctgtgggcgctgacaacatcttcatctttgtgctggagtaccagaggctgccccggcggcctggagagccccgggaggtgcacatcggccgggccctgggccgggtggcccccagcatgctgctgtgcagcctgtctgaggccatctgcttcttcctgggcgccctgacccccatgcctgctgtgaggacctttgccctgaccagcggcctggccgtcatcctggacttcctgctgcagatgtctgcctttgtggccctgctgagcctggacagcaagaggcaggaggccagccggctggatgtgtgctgctgcgtgaagccccaggagctgcccccacctggccagggcgagggcctgctgctgggcttcttccagaaggcctatgcccccttcctgctgcactggatcacccggggcgtggtgctgctgctcttcctggccctgtttggagtgtccctgtacagcatgtgccacatctctgtgggcctggaccaggagctggccctgcccaaggacagctacctgctggactacttcctgttcctgaaccgctactttgaggtgggcgcccctgtgtactttgtgaccaccctgggctacaacttcagcagcgaggccggcatgaatgccatctgcagcagcgctggctgcaacaacttctccttcacccagaagatccagtatgccacagagttccctgagcagagctacctggccatcccagccagctcctgggtggatgacttcatcgactggctgacccccagcagctgctgccgcctgtacatcagcggccccaacaaggacaagttctgccccagcacagtgaacagcctgaactgcctgaagaactgcatgagcatcaccatgggctctgtgcggcccagcgtggagcagttccacaagtacctgccctggttcctgaatgaccggcccaacatcaagtgccccaagggcggcctggccgcctacagcacctctgtgaacctgaccagtgatggccaggtgctggccagccgcttcatggcctaccacaagcccctgaagaacagccaggactacacagaggccctgcgggccgcccgggagctggccgccaacatcacagctgacctgaggaaggtgcccggcacagatcctgcctttgaggtgttcccctacaccatcaccaacgtgttctatgagcagtacctgaccatcctgcctgagggcctcttcatgctgagcctgtgcctggtgcccacctttgctgtgtcctgcctgctgctgggcctggacctgcggagcggcctgctgaacctgctgagcatcgtgatgatcctggtggacacagtgggcttcatggccctgtggggcatctcctacaatgctgtgtccctcatcaacctggtgtctgctgtgggcatgtctgtggagtttgtgagccacatcaccaggagctttgccatcagcaccaagcccacctggctggagcgggccaaggaggccaccatctccatgggcagcgctgtgtttgctggggtggccatgaccaacctgcccggcatcctggtgctgggcctggccaaggcccagctgatccagatcttcttcttccggctgaacctgctgatcaccctgctgggcctgctgcacggcctggtgttcctgcctgtgatcctgtcctatgtgggcccagatgtgaacccagccctggccctggagcagaagagagctgaggaggccgtggccgctgtgatggtggccagctgccccaaccaccccagccgggtgtccacagctgacaacatctacgtgaaccacagctttgagggcagcatcaagggggccggggccatcagcaacttcctgcccaacaacggccggcagttctag

SEQ ID NO: 162144 - DNA, 3861 bp, Artificial Sequence
  Description of Artificial Sequence: Synthetic coding sequence
atggccgaggccggcctgcggggctggctgctgtgggccctgctgctgcggctggcccagagcgagccctacaccaccatccaccagcccggctactgtgccttctatgatgaatgtgggaagaaccctgagctgagcggcagcctgatgaccctgagcaatgtgtcctgcctgagcaacaccccagccaggaagatcactggagaccacctgatcctgctgcagaagatctgcccccggctgtacacaggccccaacacccaggcctgctgcagcgccaagcagctggtgtccctggaggccagcctgagcatcaccaaggccctgctgacccgctgcccagcctgcagcgacaactttgtgaacctgcactgccacaacacctgcagccccaaccagagcctcttcatcaacgtgaccagggtggcccagctgggcgccggccagctgcctgctgtggtggcctatgaggccttctaccagcacagctttgctgagcagagctatgacagctgcagccgggtgcgggtgcctgctgctgccaccctggccgtgggcaccatgtgtggggtgtatggcagcgccctgtgcaatgcccagcgctggctgaacttccagggcgacacaggaaatggcctggcccccctggacatcaccttccacctgctggagcccggccaggccgtgggcagcggcatccagcccctgaatgaaggagtggcccgctgcaatgaaagccagggagatgatgtggccacctgcagctgccaggactgtgccgccagctgcccagccatcgcccggccccaggccctggacagcaccttctacctgggccagatgcctggcagcctggtgctgatcatcatcctgtgcagcgtgtttgctgtggtgaccatcctgctggtgggcttccgggtggccccagcccgggacaagagcaagatggtggaccccaagaagggcaccagcctgagtgacaagctgtccttcagcacccacaccctgctgggccagttcttccagggctggggcacctgggtggcctcctggcccctgaccatcctggtgctgagcgtcatccctgtggtggccctggccgccggcctggtgttcacagagctgaccacagatcctgtggagctgtggagcgcccccaacagccaggcccggtctgagaaggccttccatgaccagcacttcggccccttcttccgcaccaaccaggtgatcctgacagcccccaacagaagcagctaccgctatgacagcctgctgctgggccccaagaacttcagcggcatcctggacctggacctgctgctggagctgctggagctgcaggagcggctgcggcacctgcaggtgtggagccctgaggcccagaggaacatcagcctgcaggacatctgctacgcccccctgaacccagacaacaccagcctgtatgactgctgcatcaacagcctgctgcagtacttccagaacaacagaaccctgctgctgctgacagccaaccagaccctgatgggccagaccagccaggtggactggaaggaccacttcctgtactgtgccaatgcccccctgaccttcaaggatggaacagccctggccctgagctgcatggctgactatggagcccctgtgttccccttcctggccatcggcggctacaagggcaaggactacagcgaggccgaggccctgatcatgaccttcagcctgaacaactacccagctggggacccccggctggcccaggccaagctgtgggaggaggccttcctggaggagatgagggccttccagaggaggatggccggcatgttccaggtgaccttcatggccgagaggagcctggaggatgagatcaacagaaccacagctgaggacctgcccatctttgccaccagctacatcgtcatcttcctgtacatcagcctggccctgggcagctacagctcctggagccgggtgatggtggacagcaaggccaccctgggcctgggcggcgtggccgtggtgctgggcgctgtgatggccgccatgggcttcttctcctacctgggcatccgcagcagcctggtgatcctgcaggtggtgcccttcctggtgctgtctgtgggcgctgacaacatcttcatctttgtgctggagtaccagaggctgccccggcggcctggagagccccgggaggtgcacatcggccgggccctgggccgggtggcccccagcatgctgctgtgcagcctgtctgaggccatctgcttcttcctgggcgccctgacccccatgcctgctgtgaggacctttgccctgaccagcggcctggccgtcatcctggacttcctgctgcagatgtctgcctttgtggccctgctgagcctggacagcaagaggcaggaggccagccggctggatgtgtgctgctgcgtgaagccccaggagctgcccccacctggccagggcgagggcctgctgctgggcttcttccagaaggcctatgcccccttcctgctgcactggatcacccggggcgtggtggtgggcgcccctgtgtactttgtgaccaccctgggctacaacttcagcagcgaggccggcatgaatgccatctgcagcagcgctggctgcaacaacttctccttcacccagaagatccagtatgccacagagttccctgagcagagctacctggccatcccagccagctcctgggtggatgacttcatcgactggctgacccccagcagctgctgccgcctgtacatcagcggccccaacaaggacaagttctgccccagcacagtgaacagcctgaactgcctgaagaactgcatgagcatcaccatgggctctgtgcggcccagcgtggagcagttccacaagtacctgccctggttcctgaatgaccggcccaacatcaagtgccccaagggcggcctggccgcctacagcacctctgtgaacctgaccagtgatggccaggtgctggccagccgcttcatggcctaccacaagcccctgaagaacagccaggactacacagaggccctgcgggccgcccgggagctggccgccaacatcacagctgacctgaggaaggtgcccggcacagatcctgcctttgaggtgttcccctacaccatcaccaacgtgttctatgagcagtacctgaccatcctgcctgagggcctcttcatgctgagcctgtgcctggtgcccacctttgctgtgtcctgcctgctgctgggcctggacctgcggagcggcctgctgaacctgctgagcatcgtgatgatcctggtggacacagtgggcttcatggccctgtggggcatctcctacaatgctgtgtccctcatcaacctggtgtctgctgtgggcatgtctgtggagtttgtgagccacatcaccaggagctttgccatcagcaccaagcccacctggctggagcgggccaaggaggccaccatctccatgggcagcgctgtgtttgctggggtggccatgaccaacctgcccggcatcctggtgctgggcctggccaaggcccagctgatccagatcttcttcttccggctgaacctgctgatcaccctgctgggcctgctgcacggcctggtgttcctgcctgtgatcctgtcctatgtgggcccagatgtgaacccagccctggccctggagcagaagagagctgaggaggccgtggccgctgtgatggtggccagctgccccaaccaccccagccgggtgtccacagctgacaacatctacgtgaaccacagctttgagggcagcatcaagggggccggggccatcagcaacttcctgcccaacaacggccggcagttctag

SEQ ID NO: 162145 - DNA, 783 bp, Artificial Sequence
  Description of Artificial Sequence: Synthetic coding sequence
atgccccagaatgagtacatcgagctgcacaggaagagatatggctaccgcctggactaccacgagaagaagaggaagaaggagagccgggaggcccacgagaggagcaagaaggccaagaagatgattggcctgaaggccaagctgtaccacaagcagagacatgctgagaagatccagatgaagaagaccatcaagatgcatgagaagaggaacaccaagcagaagaatgatgagaagaccccccagggcgctgtgcctgcctacctgctggaccgggagggccagagccgggccaaggtgctgagcaacatgatcaagcagaagaggaaggagaaggccggcaagtgggaggtgcccctgcccaaggtgcgggcccagggcgagacagaggtgctgaaggtgatcagaacaggcaagaggaagaagaaggcctggaagaggatggtgaccaaggtgtgctttgtgggagatggcttcaccaggaagccacccaagtatgagcgcttcatccggcccatgggcctgcgcttcaagaaggcccacgtgacccaccctgagctgaaggccaccttctgcctgcccatcctgggcgtgaagaagaaccccagcagccccctgtacaccaccctgggcgtcatcaccaagggcaccgtcatcgaggtgaatgtgtctgagctgggcctggtgacccagggcggcaaggtgatctggggcaagtatgcccaggtgaccaacaacccagaaaatgatggctgcatcaatgctgtgctgctggtgtag

SEQ ID NO: 162146 - DNA, 1509 bp, Artificial Sequence
  Description of Artificial Sequence: Synthetic coding sequence
atgagctgccctgtgcctgcctgctgtgccctgctgctggtgctgggcctgtgccgggcccggcccagaaatgccctgctgctgctggctgatgatggcggctttgaaagtggggcctacaacaacagcgccatcgccaccccccacctggatgccctggcccggcgcagcctgctcttcagaaatgccttcacctctgtgagcagctgcagccccagccgggccagcctgctgaccggcctgccccagcaccagaatggcatgtatggcctgcaccaggatgtgcaccacttcaacagctttgacaaggtgcgcagcctgcccctgctgctgagccaggccggcgtgaggacaggcatcatcggcaagaagcacgtgggccctgagaccgtgtacccctttgattttgcctacacagaagaaaatggatctgtgctgcaggtgggcaggaacatcacccgcatcaagctgctggtgaggaagttcctgcagacccaggatgaccggcccttcttcctgtatgtggccttccatgacccccaccgctgtggccacagccagccccagtatggcaccttctgtgagaagtttggaaatggagagagcggcatgggccgcatcccagactggaccccccaggcctatgaccccctggatgtgctggtgccctactttgtgcccaacaccccagctgcccgggctgacctggccgcccagtacaccaccgtgggccgcatggaccagggcgtgggcctggtgctgcaggagctgagagatgctggggtgctgaatgacaccctggtgatcttcaccagtgacaatggcatccccttccccagcggccgcaccaacctgtactggccaggcacagctgagcccctgctggtgagcagccctgagcaccccaagcgctggggccaggtgtctgaggcctacgtgtccctgctggacctgacccccaccatcctggactggttcagcatcccctaccccagctatgccatcttcggcagcaagaccatccacctgaccggccgcagcctgctgcctgccctggaggccgagcccctgtgggccaccgtgtttggcagccagagccaccacgaggtgaccatgagctaccccatgaggtctgtgcagcaccgccacttccggctggtgcacaacctgaacttcaagatgcccttccccatcgaccaggacttctacgtgagccccaccttccaggacctgctgaacagaaccacagctggccagcccaccggctggtacaaggacctgcggcactactactaccgggcccgctgggagctgtatgacaggagccgggacccccatgagacccagaacctggccacagaccccaggtttgcccagctgctggagatgctgcgggaccagctggccaagtggcagtgggagacccatgacccctgggtgtgtgccccagatggagtgctggaggagaagctgagcccccagtgccagcccctgcacaatgagctgtag

SEQ ID NO: 162147 - DNA, 900 bp, Artificial Sequence
  Description of Artificial Sequence: Synthetic coding sequence
atgggccgcatcccagactggaccccccaggcctatgaccccctggatgtgctggtgccctactttgtgcccaacaccccagctgcccgggctgacctggccgcccagtacaccaccgtgggccgcatggaccagggcgtgggcctggtgctgcaggagctgagagatgctggggtgctgaatgacaccctggtgatcttcaccagtgacaatggcatccccttccccagcggccgcaccaacctgtactggccaggcacagctgagcccctgctggtgagcagccctgagcaccccaagcgctggggccaggtgtctgaggcctacgtgtccctgctggacctgacccccaccatcctggactggttcagcatcccctaccccagctatgccatcttcggcagcaagaccatccacctgaccggccgcagcctgctgcctgccctggaggccgagcccctgtgggccaccgtgtttggcagccagagccaccacgaggtgaccatgagctaccccatgaggtctgtgcagcaccgccacttccggctggtgcacaacctgaacttcaagatgcccttccccatcgaccaggacttctacgtgagccccaccttccaggacctgctgaacagaaccacagctggccagcccaccggctggtacaaggacctgcggcactactactaccgggcccgctgggagctgtatgacaggagccgggacccccatgagacccagaacctggccacagaccccaggtttgcccagctgctggagatgctgcgggaccagctggccaagtggcagtgggagacccatgacccctgggtgtgtgccccagatggagtgctggaggagaagctgagcccccagtgccagcccctgcacaatgagctgtag

SEQ ID NO: 162148 - DNA, 618 bp, Artificial Sequence
  Description of Artificial Sequence: Synthetic coding sequence
atgagctgccctgtgcctgcctgctgtgccctgctgctggtgctgggcctgtgccgggcccggcccagaaatgccctgctgctgctggccgaccgggccctgtctgtgagccacctgacccagaggatgacagaggccctgcgggtggcccggaccaccacagcccccagcccccccaggacctggaccccctggccagctgctgccagcagctttgccatgcccagccccaggtctgctgctgccctgcctgctgccccagccagcagcctggcctgccccagcatccgcatgggctgcaccggctgcaccaggacctgcaccaccagcacccccagcacccgctgtggggcctgccgctgctgcagcgccaagctggtgtgtgcccaggccagcagcggccgcagcacctggggccggcggccctgcacccggctgaccctgcggaccaggaggaggatggcccccagcagccgctggggcggcaccagcctggagctgagctgcagcagcggcaacagctgccgcctgaggatgacaggcctgagcagcagcaccagccccagcaccacccccaccctgtgggccctgcctgcccctgtgaggaacctgctgtag

SEQ ID NO: 162149 - DNA, 1191 bp, Artificial Sequence
  Description of Artificial Sequence: Synthetic coding sequence
atggcctgtgccggcctgctgactgtgtgcctgctgcggcccccagccccccagccccagccccagacccccaggcacccccagctggccccagaccccggccctgctggccacaccctcttccaggatgtgttccggcgggctgacaagaatgatgatggcaagctgagctttgaggagttccagaactactttgctgatggagtgctgagcctgggggagctgcaggagctgttcagcggcattgatggccacctgacagacaacctggagacagagaagctgtgtgactacttcagcgagcacctgggcgtgtacagacctgtgctggccgccctggagagcctgaacagagctgtgctggccgccatggatgccaccaagctggagtatgagcgggccagcaaggtggaccagtttgtgacccgcttcctgctgcgggagaccgtgtcccagctgcaggccctgcagagcagcctggagggcgccagtgacaccctggaggcccaggcccacggctggaggagtgatgctgagagcgtggaggcccagagccggctgtgtggcagcagaagagctggaagaagagccctgcggtctgtgagccgcagcagcacctggagccctggcagcagtgacaccggccgcagcagcgaggccgagatgcagtggaggctgcaggtgaaccggctgcaggagctgattgaccagctggagtgcaaggtgcgggctgtgggccctggcccccacaagggcggccccagctggtacccacctgagcccggcccctgctggaggcctggcccccacagcgtgcccagccaggccccccggctggagcccctgcgggaggaggacctggccaagggccctgacctgcacatcctgatggcccagaggcaggtgcaggtggccgaggagggcctgcaggacttccaccgggccctgcgctgctacgtggacttcaccggggcccagagccactgcctgcacgtgtctgcccagaagatgctggatggagccagcttcaccctgtatgagttctggcaggatgaggcctcctggaggaggcaccagcagagccctggcagcaaggccttccagaggatcctgattgaccacctgcgggccccagacaccctgaccaccgtcttcttccctgcctcctggtggatcatgaacaacaactag

SEQ ID NO: 162150 - DNA, 1089 bp, Artificial Sequence
  Description of Artificial Sequence: Synthetic coding sequence
atggcctgtgccggcctgctgactgtgtgcctgctgcggcccccagccccccagccccagccccagacccccaggcacccccagctggccccagaccccggccctgctggccacaccctcttccaggatgtgttccggcgggctgacaagaatgatgatggcaagctgagctttgaggagttccagaactactttgctgatggagtgctgagcctgggggagctgcaggagctgttcagcggcattgatggccacctgacagacaacctggagacagagaagctgtgtgactacttcagcgagcacctgggcgtgtacagacctgtgctggccgccctggagagcctgaacagagctgtgctggccgccatggatgccaccaagctggagtatgagcgggccagcaaggtggaccagtttgtgacccgcttcctgctgcgggagaccgtgtcccagctgcaggccctgcagagcagcctggagggcgccagtgacaccctggaggcccaggcccacggctggaggagtgatgctgagagcgtggaggcccagagccggctgtgtggcagcagaagagctggaagaagagccctgcggtctgtgagccgcagcagcacctggagccctggcagcagtgacaccggccgcagcagcgaggccgagatgcagtggaggctgcaggtgaaccggctgcaggagctgattgaccagctggagtgcaaggccccccggctggagcccctgcgggaggaggacctggccaagggccctgacctgcacatcctgatggcccagaggcaggtgcaggtggccgaggagggcctgcaggacttccaccgggccctgcgctgctacgtggacttcaccggggcccagagccactgcctgcacgtgtctgcccagaagatgctggatggagccagcttcaccctgtatgagttctggcaggatgaggcctcctggaggaggcaccagcagagccctggcagcaaggccttccagaggatcctgattgaccacctgcgggccccagacaccctgaccaccgtcttcttccctgcctcctggtggatcatgaacaacaactag

SEQ ID NO: 162151 - DNA, 870 bp, Artificial Sequence
  Description of Artificial Sequence: Synthetic coding sequence
atggcctgtgccggcctgctgactgtgtgcctgctgcggcccccagccccccagccccagccccagacccccaggcacccccagctggccccagaccccggccctgctggccacaccctcttccaggatgtgttccggcgggctgacaagaatgatgatggcaagctgagctttgaggagttccagaactactttgctgatggagtgctgagcctgggggagctgcaggagctgttcagcggcattgatggccacctgacagacaacctggagacagagaagctgtgtgactacttcagcgagcacctgggcgtgtacagacctgtgctggccgccctggagagcctgaacagagctgtgctggccgccatggatgccaccaagctggagtatgagcgggccagcaaggtggaccagtttgtgacccgcttcctgctgcgggagaccgtgtcccagctgcaggccctgcagagcagcctggagggcgccagtgacaccctggaggcccaggcccacggctggaggagtgatgctgagagcgtggaggcccagagccggctgtgtggcagcagaagagctggaagaagagccctgcggtctgtgagccgcagcagcacctggagccctggcagcagtgacaccggccgcagcagcgaggccgagatgcagtggaggctgcaggtgaaccggctgcaggagctgattgaccagctggagtgcaagcacatcctgatggcccagaggcaggtgcaggtggccgaggagggcctgcaggacttccaccgggccctgcgctgctacgtggacttcaccggggcccagagccactgcctgcacgtgtctgcccagaagatgctggatggagcctag

SEQ ID NO: 162152 - DNA, 423 bp, Artificial Sequence
  Description of Artificial Sequence: Synthetic coding sequence
atggcctctgtggacttcaagacctacgtggaccaggcctgcagagctgctgaggagtttgtgaatgtgtactacaccaccatggacaagagaagaaggctgctgagccggctgtacatgggcacagccaccctggtgtggaatggaaatgctgtgtctggccaggagagcctgtctgagttctttgagatgctgcccagcagcgagttccagatctctgtggtggactgccagcctgtgcatgatgaggccacccccagccagaccaccgtgctggtggtgatctgtggctctgtgaagtttgagggcaacaagcagagggacttcaaccagaacttcatcctgacagcccaggccagccccagcaacacagtgtggaagatcgccagtgactgcttccgcttccaggactgggccagctag

SEQ ID NO: 162153 - DNA, 984 bp, Artificial Sequence
  Description of Artificial Sequence: Synthetic coding sequence
atggctgtgcctgccaagaagaggaagatgaacttcagcgagcgggaggtggagatcatcgtggaggagctggagctgaagaagcacctgctggtgaaccacttcaatgccggcgtgcccctggccgccaagtctgctgcctggcacggcatcctgcggcgggtgaatgctgtggccacctgccggcgggagctgcctgaggtgaagaagaagtggagcgacctgaagacagaggtgcggaggaaggtggcccaggtgcgggctgctgtggagggcggggaggcccctggccccacagaagaagatggagctgggggccctggcactggaggcggcagcggcggcggcggccctgctgtggcccctgtgctgctgacccccatgcagcagaggatctgcaacctgctgggggaggccaccatcatcagcctgcccagcaccacagagatccaccctgtggccctgggccccagcgccacagctgctgctgccaccgtgaccctgacccagatccccacagagaccacctaccacaccctggaggagggcgtggtggagtactgcacagctgaggcccccccacccctgcccccagagacccctgtggacatgatggcccagcacgccgacacctctgtgaagccccaggccctgaagagccgcatcgccctgaacagcgccaagctgatccaggagcagagggtgaccaacctgcacgtgaaggagatcgcccagcacctggagcagcagaatgacctgctgcagatgatccgccgcagccaggaggtgcaggcctgtgcccaggagcggcaggcccaggccatggagggcacccaggccgccctgtctgtgctgatccaggtgctgcggcccatgatcaaggacttccgccgctacctgcagagcaacacagccaacccagccccagccagtgaccccggccaggtggcccagaatggccagcctgacagcatcatccagtag

SEQ ID NO: 162154 - DNA, 1485 bp, Artificial Sequence
  Description of Artificial Sequence: Synthetic coding sequence
atggaggtggtggaggccgccgccgcccagctggagaccctgaagttcaatggaacagactttggagtgggggagggccctgctgcccccagccctggcagcgcccctgtgcccggcacccagccccccctgcagagctttgagggcagcccagatgctggccagacagtggaggtgaagccagctggggagcagcccctgcagcctgtgctgaatgctgtggccgccggcaccccagccccccagccccagcccccagctgagagccctgcctgtggggactgtgtgaccagccctggagctgctgagcccgcccgggccccagacagcctggagaccagtgacagcgacagcgacagcgacagcgagacagacagcgacagcagcagcagcagcagcagcagcagcagcagcagcagcagcagcagcagcagctgcatcagcctgccccctgtgctgagtgatggagatgatgacctgcagatcgagaaggagaacaagaacttccccctgaagaccaaggatgagctgctgctgaatgagctgcccagcgtggaggagctgaccatcatcctgcctgaggacatcgagctgaagcccctgggcatggtgagcagcatcatcgagcagctggtgatcatcgagagcatgaccaacctgccccctgtgaatgaggagaccgtcatcttcaagagtgaccggcaggccgccggcaagatctttgagatcttcggccctgtggcccaccccttctacgtgctgcgcttcaacagcagtgaccacatcgagagcaagggcatcaagatcaaggagaccatgtactttgcccccagcatgaaggacttcacccagtacatcttcacagagaagctgaagcaggacaagggcagtgatgcctcctggaagaatgaccaggagcccccacctgaggccctggacttcagtgatgatgagaaggagaaggaggccaagcagaggaagaagagccagatccagggcaggaagaagctgaagtctgagttcaatgagcccggggaggacttcacagaggtgcaccagaactggaatgcccacagcagcgccagcgagcacgccaagggctacagaaaccgggagttcacccggggcttcagccgggcccgctaccccaggagctgccacggccggcccccaccccagcacttctacaacagcgagcacatggtgtcccaggagaccagcggcttccccagccagaggcagaacaaccccatcatgccccagtaccccttccccctgcctgtgtttgacatgcacaacttccccctgcggcccccacctcctcctcctcctcctcctgtgaacatgggctgggccacccccaacatggccgcccaccccctgctgaacctgccctacagcctgcccccacctcctcctcctccacccctgcccccaccacccagcagcggggacagcaacagccacttcggcccctactactag

SEQ ID NO: 162155 - DNA, 1170 bp, Artificial Sequence
  Description of Artificial Sequence: Synthetic coding sequence
atggaggtggtggaggccgccgccgcccagctggagaccctgaagttcaatggaacagactttggagtgggggagggccctgctgcccccagccctggcagcgcccctgtgcccggcacccagccccccctgcagagctttgagggcagcccagatgctggccagacagtggaggtgaagccagctggggagcagcccctgcagcctgtgctgaatgctgtggccgccggcaccccagccccccagccccagcccccagctgagagccctgcctgtggggactgtgtgaccagccctggagctgctgagcccgcccgggccccagacagcctggagaccagtgacagcgacagcgacagcgacagcgagacagacagcgacagcagcagcagcagcagcagcagcagcagcagcagcagcagcagcagcagcagctgcatcagcctgccccctgtgctgagtgatggagatgatgacctgcagatcgagaaggagaacaagaacttccccctgaagaccaaggatgagctgctgctgaatgagctgcccagcgtggaggagctgaccatcatcctgcctgaggacatcgagctgaagcccctgggcatggtgagcagcatcatcgagcagctggtgatcatcgagagcatgaccaacctgccccctgtgaatgaggagaccgtcatcttcaagagtgaccggcaggccgccggcaagatctttgagatcttcggccctgtggcccaccccttctacgtgctgcgcttcaacagcagtgaccacatcgagagcaagggcatcaagatcaaggagaccatgtactttgcccccagcatgaaggacttcacccagtacatcttcacagagaagctgaagcaggacaagggcagtgatgcctcctggaagaatgaccaggagcccccacctgaggccctggacttcagtgatgatgagaaggagaaggaggccaagcagaggaagaagagccagatccagggcaggaagaagctgaagtctgagttcaatgagcccggcaccggcatcagccaccgctactgcggcctgggcagccggcccctgcagagcagcgagagccacaagctgtttggcttccagatgcacatcaaggtgaccttcacctgctacttcagcctgctgtccatgcagtag

SEQ ID NO: 162156 - DNA, 345 bp, Artificial Sequence
  Description of Artificial Sequence: Synthetic coding sequence
ctggccagccggctgggccctgtgtccacagccaacatgagcaggcctgtgaggaacaggaaggtggtggactacagccagttccaggagagtgatgatgctgactttgaaagtgaagattctgaggacaaggatgtgaagaccaagaaggatgacagccacagcgcagaagattctgaagatgagaaggaggaccacaagaatgtgcggcagcagaggcaggccgccagcaaggccgccagcaagcagcgggagatgctgatggaggatgtgggcagcgaggaggagcaggaggaggaggatgaggcccccttccaggagaggaaggacagcttcagccagtag

SEQ ID NO: 162157 - DNA, 732 bp, Artificial Sequence
  Description of Artificial Sequence: Synthetic coding sequence
atgagcaggcctgtgaggaacaggaaggtggtggactacagccagttccaggagagtgatgatgctgatgaggactatggccgggacagcggcccccccaccaagaagatccgcagcagcccccgggaggccaagaacaagagaagaagtggcaagaacagccaggaggacagtgaagattctgaggacaaggatgtgaagaccaagaaggatgacagccacagcgcagaagattctgaagatgagaaggaggaccacaagaatgtgcggcagcagaggcaggccgccagcaaggccgccagcaagcagcgggagatgctgatggaggatgtgggcagcgaggaggagcaggaggaggaggatgaggcccccttccaggagaaggacagcggcagtgatgaggacttcctgatggaggatgatgatgacagcgactatggcagcagcaagaagaagaacaagaagatggtgaagaagagcaagccagagaggaaggagaagaagatgcccaagccccggctgaaggccaccgtgacccccagccctgtgaagggcaagggcaaggtgggccggcccacagccagcaaggccagcaaggagaagacccccagccccaaggaggaggatgaggagcctgagagccccccagagaagaagaccagcaccagccccccacctgagaagtctggagatgagggctctgaagatgaggcccccagcggggaggactag

SEQ ID NO: 162158 - DNA, 1122 bp, Artificial Sequence
  Description of Artificial Sequence: Synthetic coding sequence
atgagcccctgccccccccagcagagcaggaacagagtcatccagctgagcaccagcgagctgggggagatggagctgacctggcaggagatcatgagcatcacagagctgcagggcctgaatgcccccagcgagcccagctttgagccccaggccccagccccctacctgggccccccaccacccaccacctactgcccctgcagcatccacccagacagcggcttccccctgcccccaccaccctatgagctgcctgccagcaccagccacgtgcctgaccccccctacagctatggcaacatggccatccctgtgtccaagcccctgagcctgagcggcctgctgtctgagcccctgcaggaccccctggccctgctggacatcggcctgcctgctggcccccccaagccccaggaggaccctgagagtgacagcggcctgagcctgaactacagtgatgctgagagcctggagctggagggcacagaagctggaagaagaagaagtgaatatgtggagatgtaccctgtggagtacccctacagcctgatgcccaacagcctggcccacagcaactacaccctgcctgctgctgagacccccctggccctggagcccagcagcggccctgtgcgggccaagcccacagcccggggggaggccggcagcagagatgagcggcgggccctggccatgaagatccccttccccacagacaagatcgtgaacctgcctgtggatgacttcaatgagctgctggcccgctaccccctgacagagagccagctggccctggtgcgggacatcagaagaagaggcaagaacaaggtggccgcccagaactgcaggaagaggaagctggagaccatcgtgcagctggagcgggagctggagcggctgaccaatgaaagagagcggctgctgcgggcccggggggaggccgacaggaccctggaggtgatgaggcagcagctgacagagctgtacagagacatcttccagcacctgagagatgaaagtggcaacagctacagccctgaggagtatgccctgcagcaggccgcagatggcaccatcttcctggtgccccggggcaccaagatggaggccacagactag

SEQ ID NO: 162159 - DNA, 1122 bp, Artificial Sequence; identical to SEQ ID NO: 162158
  Description of Artificial Sequence: Synthetic coding sequence

SEQ ID NO: 162160 - DNA, 1122 bp, Artificial Sequence; identical to SEQ ID NO: 162158
  Description of Artificial Sequence: Synthetic coding sequence

SEQ ID NO: 162161 - DNA, 1122 bp, Artificial Sequence; identical to SEQ ID NO: 162158
  Description of Artificial Sequence: Synthetic coding sequence

SEQ ID NO: 162162 - DNA, 1032 bp, Artificial Sequence
  Description of Artificial Sequence: Synthetic coding sequence
atgagcccctgccccccccagcagagcaggaacagagtcatccagctgagcaccagcgagctgggggagatggagctgacctggcaggagatcatgagcatcacagagctgcagggcctgaatgcccccagcgagcccagctttgagccccaggccccagccccctacctgggccccccaccacccaccacctactgcccctgcagcatccacccagacagcggcttccccctgcccccaccaccctatgagctgcctgccagcaccagccacgtgcctgaccccccctacagctatggcaacatggccatccctgtgtccaagcccctgagcctgagcggcctgctgtctgagcccctgcaggaccccctggccctgctggacatcggcctgcctgctggcccccccaagccccaggaggaccctgagagtgacagcggcctgagcctgaactacagtgatgctgagagcctggagctggagggcacagaagctggaagaagaagaagtgaatatgtggagatgtaccctgtggagtacccctacagcctgatgcccaacagcctggcccacagcaactacaccctgcctgctgctgagacccccctggccctggagcccagcagcggccctgtgcgggccaagcccacagcccggggggaggccggcagcagagatgagcggcgggccctggccatgaagatccccttccccacagacaagatcgtgaacctgcctgtggatgacttcaatgagctgctggcccgctaccccctgacagagagccagctggccctggtgcgggacatcagaagaagaggcaagaacaaggtggccgcccagaactgcaggaagaggaagctggagaccatcgtgcagctggagcgggagctggagcggctgaccaatgaaagagagcggctgctgcgggcccggggggaggccgacaggaccctggaggtgatgaggcagcagctgacagagctgtacagagacatcttccagcacctgagagatgaaagtggcaactag

SEQ ID NO: 162163 - DNA, 2229 bp, Artificial Sequence
  Description of Artificial Sequence: Synthetic coding sequence
atgctgagcctgaagaagtacctgacagagggcctgctgcagttcaccatcctgctgagcctcatcggcgtgcgggtggatgtggacacctacctgaccagccagctgccccccctgcgggagatcatcctgggccccagcagcgcctacacccagacccagttccacaacctgaggaacaccctggatggctacggcatccaccccaagagcattgacctggacaactacttcaccgcccggcggctgctgagccaggtgcgggccctggaccgcttccaggtgcccaccacagaggtgaatgcctggctggtgcaccgggaccctgagggctctgtgtctggcagccagcccaacagcggcctggccctggagagcagcagcggcctgcaggatgtgacaggccctgacaacggggtgcgggagagcgagacagagcagggctttggagaggacctggaggacctgggcgctgtggcccctcctgtgtctggggacctgaccaaggaggacatcgacctgattgacatcctgtggaggcaggacatcgacctgggcgccggccgggaggtgtttgactacagccaccggcagaaggagcaggatgtggagaaggagctgagagatggaggagagcaggacacctgggccggggagggcgctgaggccctggccaggaacctgctggtggatggagagaccggggagagcttccctgcccagtttcctgctgacatcagcagcatcacagaggccgtgcccagcgagagcgagcccccagccctgcagaacaacctgctgagccccctgctgaccggcacagagagcccctttgacctggagcagcagtggcaggacctgatgagcatcatggagatgcaggccatggaggtgaacaccagcgccagcgagatcctgtacagcgcccctcctggggaccccctgagcaccaactacagcctggcccccaacacccccatcaaccagaatgtgtccctgcaccaggccagcctgggcggctgcagccaggacttcctgctcttcagccctgaggtggagagcctgcctgtggccagcagcagcaccctgctgcccctggcccccagcaacagcaccagcctgaacagcaccttcggcagcaccaacctgaccggcctcttcttccccccccagctgaatggaacagccaatgacacagctggccctgagctgcctgaccccctgggcggcctgctggatgaggccatgctggatgagatcagcctgatggacctggccatcgaggagggcttcaaccctgtgcaggccagccagctggaggaggagtttgacagcgacagcggcctgagcctggacagcagccacagccccagcagcctgagcagcagcgagggcagcagcagcagcagcagcagcagcagcagcagcagcagcagcgccagcagcagcgccagcagcagcttcagcgaggagggcgctgtgggctacagcagtgacagcgagaccctggacctggaggaggccgagggcgctgtgggctaccagcctgagtacagcaagttctgcaggatgagctaccaggaccctgcccagctgagctgcctgccctacctggagcacgtgggccacaaccacacctacaacatggcccccagcgccctggacagcgctgacctgcccccaccttctgccctgaagaagggcagcaaggagaagcaggccgacttcctggacaagcagatgagcagagatgagcaccgggcccgggccatgaagatccccttcaccaatgacaagatcatcaacctgcctgtggaggagttcaatgagctgctgagcaagtaccagctgtctgaggcccagctgagcctcatccgggacatcagaagaagaggcaagaacaagatggccgcccagaactgcaggaagaggaagctggacaccatcctgaacctggagagagatgtggaggacctgcagagggacaaggcccggctgctgcgggagaaggtggagttcctgcggagcctgcggcagatgaagcagaaggtgcagagcctgtaccaggaggtgtttggccgcctgagagatgaaaatggccggccctacagccccagccagtatgccctgcagtatgctggagatggctctgtgctgctgatccccaggaccatggctgaccagcaggcccggcggcaggagaggaagcccaaggacaggaggaagtag

SEQ ID NO: 162164 - DNA, 2319 bp, Artificial Sequence
  Description of Artificial Sequence: Synthetic coding sequence
atgctgagcctgaagaagtacctgacagagggcctgctgcagttcaccatcctgctgagcctcatcggcgtgcgggtggatgtggacacctacctgaccagccagctgccccccctgcgggagatcatcctgggccccagcagcgcctacacccagacccagttccacaacctgaggaacaccctggatggctacggcatccaccccaagagcattgacctggacaactacttcaccgcccggcggctgctgagccaggtgcgggccctggaccgcttccaggtgcccaccacagaggtgaatgcctggctggtgcaccgggaccctgagggctctgtgtctggcagccagcccaacagcggcctggccctggagagcagcagcggcctgcaggatgtgacaggccctgacaacggggtgcgggagagcgagacagagcagggctttggagaggacctggaggacctgggcgctgtggcccctcctgtgtctggggacctgaccaaggaggacatcgacctgattgacatcctgtggaggcaggacatcgacctgggcgccggccgggaggtgtttgactacagccaccggcagaaggagcaggatgtggagaaggagctgagagatggaggagagcaggacacctgggccggggagggcgctgaggccctggccaggaacctgctggtggatggagagaccggggagagcttccctgcccaggtgcccagcggggaggaccagacagccctgagcctggaggagtgcctgcggctgctggaggccacctgcccctttggagaaaatgctgagttccctgctgacatcagcagcatcacagaggccgtgcccagcgagagcgagcccccagccctgcagaacaacctgctgagccccctgctgaccggcacagagagcccctttgacctggagcagcagtggcaggacctgatgagcatcatggagatgcaggccatggaggtgaacaccagcgccagcgagatcctgtacagcgcccctcctggggaccccctgagcaccaactacagcctggcccccaacacccccatcaaccagaatgtgtccctgcaccaggccagcctgggcggctgcagccaggacttcctgctcttcagccctgaggtggagagcctgcctgtggccagcagcagcaccctgctgcccctggcccccagcaacagcaccagcctgaacagcaccttcggcagcaccaacctgaccggcctcttcttccccccccagctgaatggaacagccaatgacacagctggccctgagctgcctgaccccctgggcggcctgctggatgaggccatgctggatgagatcagcctgatggacctggccatcgaggagggcttcaaccctgtgcaggccagccagctggaggaggagtttgacagcgacagcggcctgagcctggacagcagccacagccccagcagcctgagcagcagcgagggcagcagcagcagcagcagcagcagcagcagcagcagcagcagcgccagcagcagcgccagcagcagcttcagcgaggagggcgctgtgggctacagcagtgacagcgagaccctggacctggaggaggccgagggcgctgtgggctaccagcctgagtacagcaagttctgcaggatgagctaccaggaccctgcccagctgagctgcctgccctacctggagcacgtgggccacaaccacacctacaacatggcccccagcgccctggacagcgctgacctgcccccaccttctgccctgaagaagggcagcaaggagaagcaggccgacttcctggacaagcagatgagcagagatgagcaccgggcccgggccatgaagatccccttcaccaatgacaagatcatcaacctgcctgtggaggagttcaatgagctgctgagcaagtaccagctgtctgaggcccagctgagcctcatccgggacatcagaagaagaggcaagaacaagatggccgcccagaactgcaggaagaggaagctggacaccatcctgaacctggagagagatgtggaggacctgcagagggacaaggcccggctgctgcgggagaaggtggagttcctgcggagcctgcggcagatgaagcagaaggtgcagagcctgtaccaggaggtgtttggccgcctgagagatgaaaatggccggccctacagccccagccagtatgccctgcagtatgctggagatggctctgtgctgctgatccccaggaccatggctgaccagcaggcccggcggcaggagaggaagcccaaggacaggaggaagtag

SEQ ID NO: 162165 - DNA, 2376 bp, Artificial Sequence
  Description of Artificial Sequence: Synthetic coding sequence
tttgtgttctggaagatcctgaagaccaagaagcacaagcacagcggccccagcgccatgctgagcctgaagaagtacctgacagagggcctgctgcagttcaccatcctgctgagcctgattggagtgcgggtggatgtggacacctacctgaccagccagctgccccccctgcgggagatcatcctgggccccagcagcgcctacacccagacccagttccacaacctgaggaacaccctggatggctacggcatccaccccaagagcattgacctggacaactacttcaccgcccggcggctgctgagccaggtgcgggccctggaccgcttccaggtgcccaccacagaggtgaatgcctggctggtgcaccgggaccctgagggctctgtgtctggcagccagcccaacagcggcctggccctggagagcagcagcggcctgcaggatgtgactggaccagacaatggagtgcgggagagcgagacagagcagggctttggagaggacctggaggacctgggcgctgtggcccctcctgtgtctggggacctgaccaaggaggacatcgacctgattgacatcctgtggaggcaggacatcgacctgggcgccggccgggaggtgtttgactacagccaccggcagaaggagcaggatgtggagaaggagctgagagatggaggagagcaggacacctgggccggggagggcgctgaggccctggccaggaacctgctggtggatggagaaacaggagagagcttccctgcccaggtgcccagcggggaggaccagacagccctgagcctggaggagtgcctgcggctgctggaggccacctgcccctttggagaaaatgctgagttccctgctgacatcagcagcatcacagaagctgtgcccagcgagagcgagcccccagccctgcagaacaacctgctgagccccctgctgactggaacagagagcccctttgacctggagcagcagtggcaggacctgatgagcatcatggagatgcaggccatggaggtgaacaccagcgccagcgagatcctgtacagcgcccctcctggggaccccctgagcaccaactacagcctggcccccaacacccccatcaaccagaatgtgtccctgcaccaggccagcctgggcggctgcagccaggacttcctgctcttcagccctgaggtggagagcctgcctgtggccagcagcagcaccctgctgcccctggcccccagcaacagcaccagcctgaacagcaccttcggcagcaccaacctgaccggcctcttcttccccccccagctgaatggaacagccaatgacacagctggccctgagctgcctgaccccctgggcggcctgctggatgaggccatgctggatgagatcagcctgatggacctggccatcgaggagggcttcaaccctgtgcaggccagccagctggaggaggagtttgacagcgacagcggcctgagcctggacagcagccacagccccagcagcctgagcagcagcgagggcagcagcagcagcagcagcagcagcagcagcagcagcagcagcgccagcagcagcgccagcagcagcttcagcgaggagggcgctgtgggctacagcagtgacagcgagaccctggacctggaggaggccgagggcgctgtgggctaccagcctgagtacagcaagttctgcaggatgagctaccaggaccctgcccagctgagctgcctgccctacctggagcacgtgggccacaaccacacctacaacatggcccccagcgccctggacagcgctgacctgcccccacccagcgccctgaagaagggcagcaaggagaagcaggccgacttcctggacaagcagatgagcagagatgagcaccgggcccgggccatgaagatccccttcaccaatgacaagatcatcaacctgcctgtggaggagttcaatgagctgctgagcaagtaccagctgtctgaggcccagctgagcctcatccgggacatcagaagaagaggcaagaacaagatggccgcccagaactgcaggaagaggaagctggacaccatcctgaacctggagagagatgtggaggacctgcagagggacaaggcccggctgctgcgggagaaggtggagttcctgcggagcctgcggcagatgaagcagaaggtgcagagcctgtaccaggaggtgtttggccgcctgagagatgaaaatggccggccctacagccccagccagtatgccctgcagtatgctggagatggctctgtgctgctgatccccaggaccatggctgaccagcaggcccggcggcaggagaggaagcccaaggacaggaggaagtag

SEQ ID NO: 162166 - DNA, 1851 bp, Artificial Sequence
  Description of Artificial Sequence: Synthetic coding sequence
atgacccggctggacaggagcagccacagcggcggcggccacgccaagggcagccggcccctgaacagcctgctggccggccaccgggtggcccagcctgccagcgcccctggcagccgggcctctgtgcaggacatcgacctgattgacatcctgtggaggcaggacatcgacctgggcgccggccgggaggtgtttgactacagccaccggcagaaggagcaggatgtggagaaggagctgagagatggaggagagcaggacacctgggccggggagggcgctgaggccctggccaggaacctgctggtggatggagagaccggggagagcttccctgcccagtttcctgctgacatcagcagcatcacagaggccgtgcccagcgagagcgagcccccagccctgcagaacaacctgctgagccccctgctgaccggcacagagagcccctttgacctggagcagcagtggcaggacctgatgagcatcatggagatgcaggccatggaggtgaacaccagcgccagcgagatcctgtacagcgcccctcctggggaccccctgagcaccaactacagcctggcccccaacacccccatcaaccagaatgtgtccctgcaccaggccagcctgggcggctgcagccaggacttcctgctcttcagccctgaggtggagagcctgcctgtggccagcagcagcaccctgctgcccctggcccccagcaacagcaccagcctgaacagcaccttcggcagcaccaacctgaccggcctcttcttccccccccagctgaatggaacagccaatgacacagctggccctgagctgcctgaccccctgggcggcctgctggatgaggccatgctggatgagatcagcctgatggacctggccatcgaggagggcttcaaccctgtgcaggccagccagctggaggaggagtttgacagcgacagcggcctgagcctggacagcagccacagccccagcagcctgagcagcagcgagggcagcagcagcagcagcagcagcagcagcagcagcagcagcagcgccagcagcagcgccagcagcagcttcagcgaggagggcgctgtgggctacagcagtgacagcgagaccctggacctggaggaggccgagggcgctgtgggctaccagcctgagtacagcaagttctgcaggatgagctaccaggaccctgcccagctgagctgcctgccctacctggagcacgtgggccacaaccacacctacaacatggcccccagcgccctggacagcgctgacctgcccccaccttctgccctgaagaagggcagcaaggagaagcaggccgacttcctggacaagcagatgagcagagatgagcaccgggcccgggccatgaagatccccttcaccaatgacaagatcatcaacctgcctgtggaggagttcaatgagctgctgagcaagtaccagctgtctgaggcccagctgagcctcatccgggacatcagaagaagaggcaagaacaagatggccgcccagaactgcaggaagaggaagctggacaccatcctgaacctggagagagatgtggaggacctgcagagggacaaggcccggctgctgcgggagaaggtggagttcctgcggagcctgcggcagatgaagcagaaggtgcagagcctgtaccaggaggtgtttggccgcctgagagatgaaaatggccggccctacagccccagccagtatgccctgcagtatgctggagatggctctgtgctgctgatccccaggaccatggctgaccagcaggcccggcggcaggagaggaagcccaaggacaggaggaagtag

SEQ ID NO: 162167 - DNA, 1818 bp, Artificial Sequence
  Description of Artificial Sequence: Synthetic coding sequence
atgatggacctggagctgcccccacctggcctgcccagccagcaggacatggacctgattgacatcctgtggaggcaggacatcgacctgggcgtgtcccgggaggtgtttgacttcagccagaggaggaaggagtatgagctggagaagcagaagaagctggagaaggagcggcaggagcagctgcagaaggagcaggagaaggccttctttgcccagctgcagctggatgaggagaccggggagttcctgcccatccagcctgcccagcacatccagagcgagaccagcggcagcgccaactacagccaggtggcccacatccccaagagtgatgccctgtactttgatgactgcatgcagctgctggcccagaccttcccctttgtggatgacaatgaggtgtcctctgccaccttccagagcctggtgcctgacatccctggccacatcgagagccctgtgttcatcgccaccaaccaggcccagagccctgagacctctgtggcccaggtggcccctgtggacctggatggcatgcagcaggacatcgagcaggtgtgggaggagctgctgagcatccctgagctgcagtgcctgaacattgaaaatgacaagctggtggagaccaccatggtgcccagccctgaggccaagctgacagaggtggacaactaccacttctacagcagcatccccagcatggagaaggaggtgggcaactgcagcccccacttcctgaatgcctttgaagattccttcagcagcatcctgagcacagaggaccccaaccagctgactgtgaacagcctgaacagtgatgccaccgtgaacacagactttggagatgagttctacagcgccttcatcgccgagcccagcatcagcaacagcatgcccagccctgccaccctgagccacagcctgtctgagctgctgaatggccccattgatgtgtctgacctgagcctgtgcaaggccttcaaccagaaccaccctgagagcacagctgagttcaatgacagcgacagcggcatcagcctgaacaccagccccagcgtggccagccctgagcacagcgtggagagcagcagctatggagacaccctgctgggcctgagtgacagcgaggtggaggagctggacagcgcccctggctctgtgaagcagaatggccccaagacccctgtgcacagcagcggggacatggtgcagcccctgagccccagccagggccagagcacccacgtgcatgatgcccagtgtgagaacaccccagagaaggagctgcctgtgtccccaggccacaggaagacccccttcaccaaggacaagcacagcagccggctggaggcccacctgaccagagatgagctgcgggccaaggccctgcacatccccttccctgtggagaagatcatcaacctgcctgtggtggacttcaatgagatgatgagcaaggagcagttcaatgaggcccagctggccctgatccgggacatcagaagaagaggcaagaacaaggtggccgcccagaactgcaggaagaggaagctggagaacatcgtggagctggagcaggacctggaccacctgaaggatgagaaggagaagctgctgaaggagaagggagaaaatgacaagagcctgcacctgctgaagaagcagctgagcaccctgtacctggaggtgttctccatgctgagagatgaagatggcaagccctacagccccagcgagtacagcctgcagcagaccagagatggaaatgtgttcctggtgcccaagagcaagaagccagatgtgaagaagaactag

SEQ ID NO: 162168 - DNA, 1770 bp, Artificial Sequence
  Description of Artificial Sequence: Synthetic coding sequence
atggacctgattgacatcctgtggaggcaggacatcgacctgggcgtgtcccgggaggtgtttgacttcagccagaggaggaaggagtatgagctggagaagcagaagaagctggagaaggagcggcaggagcagctgcagaaggagcaggagaaggccttctttgcccagctgcagctggatgaggagaccggggagttcctgcccatccagcctgcccagcacatccagagcgagaccagcggcagcgccaactacagccaggtggcccacatccccaagagtgatgccctgtactttgatgactgcatgcagctgctggcccagaccttcccctttgtggatgacaatgaggtgtcctctgccaccttccagagcctggtgcctgacatccctggccacatcgagagccctgtgttcatcgccaccaaccaggcccagagccctgagacctctgtggcccaggtggcccctgtggacctggatggcatgcagcaggacatcgagcaggtgtgggaggagctgctgagcatccctgagctgcagtgcctgaacattgaaaatgacaagctggtggagaccaccatggtgcccagccctgaggccaagctgacagaggtggacaactaccacttctacagcagcatccccagcatggagaaggaggtgggcaactgcagcccccacttcctgaatgcctttgaagattccttcagcagcatcctgagcacagaggaccccaaccagctgactgtgaacagcctgaacagtgatgccaccgtgaacacagactttggagatgagttctacagcgccttcatcgccgagcccagcatcagcaacagcatgcccagccctgccaccctgagccacagcctgtctgagctgctgaatggccccattgatgtgtctgacctgagcctgtgcaaggccttcaaccagaaccaccctgagagcacagctgagttcaatgacagcgacagcggcatcagcctgaacaccagccccagcgtggccagccctgagcacagcgtggagagcagcagctatggagacaccctgctgggcctgagtgacagcgaggtggaggagctggacagcgcccctggctctgtgaagcagaatggccccaagacccctgtgcacagcagcggggacatggtgcagcccctgagccccagccagggccagagcacccacgtgcatgatgcccagtgtgagaacaccccagagaaggagctgcctgtgtccccaggccacaggaagacccccttcaccaaggacaagcacagcagccggctggaggcccacctgaccagagatgagctgcgggccaaggccctgcacatccccttccctgtggagaagatcatcaacctgcctgtggtggacttcaatgagatgatgagcaaggagcagttcaatgaggcccagctggccctgatccgggacatcagaagaagaggcaagaacaaggtggccgcccagaactgcaggaagaggaagctggagaacatcgtggagctggagcaggacctggaccacctgaaggatgagaaggagaagctgctgaaggagaagggagaaaatgacaagagcctgcacctgctgaagaagcagctgagcaccctgtacctggaggtgttctccatgctgagagatgaagatggcaagccctacagccccagcgagtacagcctgcagcagaccagagatggaaatgtgttcctggtgcccaagagcaagaagccagatgtgaagaagaactag

SEQ ID NO: 162169 - DNA, 705 bp, Artificial Sequence
  Description of Artificial Sequence: Synthetic coding sequence
atggacctgattgacatcctgtggaggcaggacatcgacctgggcgtgtcccgggaggtgtttgacttcagccagaggaggaaggagtatgagctggagaagcagaagaagctggagaaggagcggcaggagcagctgcagaaggagcaggagaaggccttctttgcccagctgcagctggatgaggagaccggggagttcctgcccatccagcctgcccagcacatccagagcgagaccagcggcagcgccaactacagccaggtggcccacatccccaagagtgatgccctgtactttgatgactgcatgcagctgctggcccagaccttcccctttgtggatgacaatgaggtgtcctctgccaccttccagagcctggtgcctgacatccctggccacatcgagagccctgtgttcatcgccaccaaccaggcccagagccctgagacctctgtggcccaggtggcccctgtggacctggatggcatgcagcaggacatcgagcaggtgtgggaggagctgctgagcatccctgagctgcagtgcctgaacattgaaaatgacaagctggtggagaccaccatggtgcccagccctgaggccaagctgacagaggtggacaactaccacttctacagcagcatccccagcatggagaaggaggtgggcaactgcagcccccacttcctgaatgccttctag

SEQ ID NO: 162170 - DNA, 843 bp, Artificial Sequence
  Description of Artificial Sequence: Synthetic coding sequence
atggacctgattgacatcctgtggaggcaggacatcgacctgggcgtgtcccgggaggtgtttgacttcagccagaggaggaaggagtatgagctggagaagcagaagaagctggagaaggagcggcaggagcagctgcagaaggagcaggagaaggccttctttgcccagctgcagctggatgaggagaccggggagttcctgcccatccagcctgcccagcacatccagagcgagaccagcggcagcgccaactacagccaggtggcccacatccccaagagtgatgccctgtactttgatgactgcatgcagctgctggcccagaccttcccctttgtggatgacaatgaggtgtcctctgccaccttccagagcctggtgcctgacatccctggccacatcgagagccctgtgttcatcgccaccaaccaggcccagagccctgagacctctgtggcccaggtggcccctgtggacctggatggcatgcagcaggacatcgagcaggtgtgggaggagctgctgagcatccctgagctgcagtgcctgaacattgaaaatgacaagctggtggagaccaccatggtgcccagccctgaggccaagctgacagaggtggacaactaccacttctacagcagcatccccagcatggagaaggaggtgggcaactgcagcccccacttcctgaatgcctttgaagattccttcagcagcatcctgagcacagaggaccccaaccagctgactgtgaacagcctgaacagtgatgccaccgtgaacacagactttggagatgagttctacagcgccttcatcgccgagcccagcatctcctag

SEQ ID NO: 162171 - DNA, 1749 bp, Artificial Sequence
  Description of Artificial Sequence: Synthetic coding sequence
atggacctgattgacatcctgtggaggcaggacatcgacctgggcgtgtcccgggaggtgtttgacttcagccagaggaggaaggagtatgagctggagaagcagaagaagctggagaaggagcggcaggagcagctgcagaaggagcaggagaaggccttctttgcccagctgcagctggatgaggagaccggggagttcctgcccatccagcctgcccagcacatccagagcgagaccagcggcagcgccaactacagccaggtggcccacatccccaagagtgatgccctgtactttgatgactgcatgcagctgctggcccagaccttcccctttgtggatgacaatgaaagcctggtgcctgacatccctggccacatcgagagccctgtgttcatcgccaccaaccaggcccagagccctgagacctctgtggcccaggtggcccctgtggacctggatggcatgcagcaggacatcgagcaggtgtgggaggagctgctgagcatccctgagctgcagtgcctgaacattgaaaatgacaagctggtggagaccaccatggtgcccagccctgaggccaagctgacagaggtggacaactaccacttctacagcagcatccccagcatggagaaggaggtgggcaactgcagcccccacttcctgaatgcctttgaggacagcttcagcagcatcctgagcacagaggaccccaaccagctgactgtgaacagcctgaacagtgatgccaccgtgaacacagactttggagatgagttctacagcgccttcatcgccgagcccagcatcagcaacagcatgcccagccctgccaccctgagccacagcctgtctgagctgctgaatggccccattgatgtgtctgacctgagcctgtgcaaggccttcaaccagaaccaccctgagagcacagctgagttcaatgacagcgacagcggcatcagcctgaacaccagccccagcgtggccagccctgagcacagcgtggagagcagcagctatggagacaccctgctgggcctgagtgacagcgaggtggaggagctggacagcgcccctggctctgtgaagcagaatggccccaagacccctgtgcacagcagcggggacatggtgcagcccctgagccccagccagggccagagcacccacgtgcatgatgcccagtgtgagaacaccccagagaaggagctgcctgtgtccccaggccacaggaagacccccttcaccaaggacaagcacagcagccggctggaggcccacctgaccagagatgagctgcgggccaaggccctgcacatccccttccctgtggagaagatcatcaacctgcctgtggtggacttcaatgagatgatgagcaaggagcagttcaatgaggcccagctggccctgatccgggacatcagaagaagaggcaagaacaaggtggccgcccagaactgcaggaagaggaagctggagaacatcgtggagctggagcaggacctggaccacctgaaggatgagaaggagaagctgctgaaggagaagggggagaatgacaagagcctgcacctgctgaagaagcagctgagcaccctgtacctggaggtgttctccatgctgagagatgaagatggcaagccctacagccccagcgagtacagcctgcagcagaccagagatggaaatgtgttcctggtgcccaagagcaagaagccagatgtgaagaagaactag

SEQ ID NO: 162172 - DNA, 2085 bp, Artificial Sequence
  Description of Artificial Sequence: Synthetic coding sequence
atgaagcacctgaagcgctggtggagcgctgggggcggcctgctgcacctgaccctgctgctgagcctggccggcctgcgggtggacctggacctgtacctgctgctgcccccacccaccctgctgcaggatgagctgctcttcctgggcggccctgccagcagcgcctatgccctgagccccttcagcgccagcggcggctggggccgggccggccacctgcaccccaagggccgggagctggaccctgctgcccctcctgagggccagctgctgcgggaggtgcgggccctgggcgtgccctttgtgcccaggacctctgtggatgcctggctggtgcacagcgtggccgccggcagcgcagatgaggcccacggcctgctgggcgctgctgctgccagcagcactggaggagctggggcctctgtggatggcggcagccaggccgtgcagggcggcggcggggaccccagggctgcccggagcggccccctggatgctggggaggaggagaaggccccagctgagcccacagcccaggtgcctgatgctgggggctgtgcctctgaagaaaatggagtgctgcgggagaagcatgaagctgtggaccacagcagccagcacgaggagaatgaggagcgggtgtctgcccagaaggagaacagcctgcagcagaatgatgatgatgagaacaagattgctgagaagccagactgggaggccgagaagaccacagagagcagaaatgaaagacacctgaatggaacagacaccagcttcagcctggaggacctcttccagctgctgagcagccagcctgagaacagcctggagggcatcagcctgggggacatccccctgcccggcagcatcagtgatggcatgaacagcagcgcccactaccacgtgaacttcagccaggccatcagccaggatgtgaacctgcacgaggccatcctgctgtgccccaacaacaccttccggcgggaccccacagcccggaccagccagagccaggagcccttcctgcagctgaacagccacaccaccaaccctgagcagaccctgcccggcaccaacctgaccggcttcctgagccctgtggacaaccacatgaggaacctgaccagccaggacctgctgtatgacctggacatcaacatctttgatgagatcaacctgatgagcctggccacagaggacaactttgaccccattgatgtgtcccagctgtttgatgagccagacagcgacagcggcctgagcctggacagcagccacaacaacaccagcgtcatcaagagcaacagcagccacagcgtgtgtgatgaaggagccatcggctactgcacagaccacgagagcagcagccaccacgacctggagggcgctgtgggcggctactacccagagcccagcaagctgtgccacctggaccagagcgacagcgacttccacggggacctgaccttccagcacgtgttccacaaccacacctaccacctgcagcccacagcccctgagagcaccagcgagcccttcccctggccaggcaagagccagaagatccgcagccgctacctggaggacacagacaggaacctgagcagagatgagcagagggccaaggccctgcacatccccttctctgtggatgagatcgtgggcatgcctgtggacagcttcaacagcatgctgagccgctactacctgacagacctgcaggtgtccctcatccgggacatcagaagaagaggcaagaacaaggtggccgcccagaactgcaggaagaggaagctggacatcatcctgaacctggaggatgatgtgtgcaacctgcaggccaagaaggagaccctgaagcgggagcaggcccagtgcaacaaggccatcaacatcatgaagcagaagctgcatgacctgtaccatgacatcttcagccggctgagagatgaccagggccggcctgtgaaccccaaccactacgccctgcagtgcacccatgatggcagcatcctgattgtgcccaaggagctggtggccagcggccacaagaaggagacccagaagggcaagaggaagtag

SEQ ID NO: 162173 - DNA, 1200 bp, Artificial Sequence
  Description of Artificial Sequence: Synthetic coding sequence
atgaacagcagcgcccactaccacgtgaacttcagccaggccatcagccaggatgtgaacctgcacgaggccatcctgctgtgccccaacaacaccttccggcgggaccccacagcccggaccagccagagccaggagcccttcctgcagctgaacagccacaccaccaaccctgagcagaccctgcccggcaccaacctgaccggcttcctgagccctgtggacaaccacatgaggaacctgaccagccaggacctgctgtatgacctggacatcaacatctttgatgagatcaacctgatgagcctggccacagaggacaactttgaccccattgatgtgtcccagctgtttgatgagccagacagcgacagcggcctgagcctggacagcagccacaacaacaccagcgtcatcaagagcaacagcagccacagcgtgtgtgatgaaggagccatcggctactgcacagaccacgagagcagcagccaccacgacctggagggcgctgtgggcggctactacccagagcccagcaagctgtgccacctggaccagagcgacagcgacttccacggggacctgaccttccagcacgtgttccacaaccacacctaccacctgcagcccacagcccctgagagcaccagcaacctcttccggcctgggaagagccagaagatccgcagccgctacctggaggacacagacaggaacctgagcagagatgagcagagggccaaggccctgcacatccccttctctgtggatgaaattgtgggcatgcctgtggacagcttcaacagcatgctgagccgctactacctgacagacctgcaggtgtccctcatccgggacatcagaagaagaggcaagaacaaggtggccgcccagaactgcaggaagaggaagctggacatcatcctgaacctggaggatgatgtgtgcaacctgcaggccaagaaggagaccctgaagcgggagcaggcccagtgcaacaaggccatcaacatcatgaagcagaagctgcatgacctgtaccatgacatcttcagccggctgagagatgaccagggccggcctgtgaaccccaaccactacgccctgcagtgcacccatgatggcagcatcctgattgtgcccaaggagctggtggccagcggccacaagaaggagacccagaagggcaagaggaagtag

SEQ ID NO: 162174 - DNA, 1143 bp, Artificial Sequence
  Description of Artificial Sequence: Synthetic coding sequence
atgtacagccccctgtgcctgacccaggatgagttccaccccttcatcgaggccctgctgccccacgtgcgggcctttgcctacacctggttcaacctgcaggccaggaagaggaagtacttcaagaagcatgagaagaggatgagcaaggaggaggagagagctgtgaaggatgagctgctgtctgagaagccagaggtgaagcagaagtgggccagccggctgctggccaagctgaggaaggacatccggcctgagtacagagaagattttgtgctgactgtgacaggcaagaagccaccctgctgcgtgctgagcaacccagaccagaagggcaagatgagaagaattgactgcctgcggcaggccgacaaggtgtggaggctggacctggtgatggtgatcctcttcaagggcatccccctggagagcacagatggagagcggctggtgaagagcccccagtgcagcaaccctggcctgtgtgtgcagccccaccacatcggcgtgtctgtgaaggagctggacctgtacctggcctactttgtgcatgctgctggcatgcccagccccaccaccctgaagaagtctgagaagagcggcttcagcagccccagccccagccagaccagcagcctgggcacagccttcacccagcaccacaggcctgtgatcaccggcccccgggccagcccccacgccacccccagcaccctgcacttccccaccagccccatcatccagcagcccggcccctacttcagccacccagccatccgctaccacccccaggagaccctgaaggagtttgtgcagctggtgtgcccagatgctggccagcaggccggccaggtgggcttcctgaaccccaacggcagcagccagggcaaggtgcacaaccccttcctgcccacccccatgctgcccccacctcctcctccacccatggcccggcctgtgcccctgcctgtgcctgacaccaagccacccaccaccagcacagagggcggggccgccagccccaccagccccacctacagcacccccagcaccagccctgccaacagatttgtgtctgtgggcccccgggaccccagctttgtgaacatcccccagcagacccagagctggtacctgggctag

SEQ ID NO: 162175 - DNA, 1464 bp, Artificial Sequence
  Description of Artificial Sequence: Synthetic coding sequence
atgtacagccccctgtgcctgacccaggatgagttccaccccttcatcgaggccctgctgccccacgtgcgggcctttgcctacacctggttcaacctgcaggccaggaagaggaagtacttcaagaagcatgagaagaggatgagcaaggaggaggagagagctgtgaaggatgagctgctgtctgagaagccagaggtgaagcagaagtgggccagccggctgctggccaagctgaggaaggacatccggcctgagtacagagaagattttgtgctgactgtgacaggcaagaagccaccctgctgcgtgctgagcaacccagaccagaagggcaagatgagaagaattgactgcctgcggcaggccgacaaggtgtggaggctggacctggtgatggtgatcctcttcaagggcatccccctggagagcacagatggagagcggctggtgaagagcccccagtgcagcaaccctggcctgtgtgtgcagccccaccacatcggcgtgtctgtgaaggagctggacctgtacctggcctactttgtgcatgctgctggccacctgggcttccaggacagctttgtgaccagcggggtcttctctgtgacagagctggtgcgggtgtcccagacccccatcgccgccggcaccggccccaacttcagcctgagtgacctggagagcagcagctactacagcatgagccctggggccatgagaagaagcctgcccagcaccagcagcaccagcagcaccaagaggctgaagtctgtggaggatgagatggacagccctggagaggagcccttctacacaggccagggccgcagccctggcagcggcagccagagcagcggctggcatgaggtggagcccggcatgcccagccccaccaccctgaagaagtctgagaagagcggcttcagcagccccagccccagccagaccagcagcctgggcacagccttcacccagcaccacaggcctgtgatcaccggcccccgggccagcccccacgccacccccagcaccctgcacttccccaccagccccatcatccagcagcccggcccctacttcagccacccagccatccgctaccacccccaggagaccctgaaggagtttgtgcagctggtgtgcccagatgctggccagcaggccggccaggtgggcttcctgaaccccaacggcagcagccagggcaaggtgcacaaccccttcctgcccacccccatgctgcccccacctcctcctccacccatggcccggcctgtgcccctgcctgtgcctgacaccaagccacccaccaccagcacagaaggaggagctgccagccccaccagccccacctacagcacccccagcaccagccctgccaacagatttgtgtctgtgggcccccgggaccccagctttgtgaacatcccccagcagacccagagctggtacctgggctag

SEQ ID NO: 162176 - DNA, 1401 bp, Artificial Sequence
  Description of Artificial Sequence: Synthetic coding sequence
atgtacagccccctgtgcctgacccaggatgagttccaccccttcatcgaggccctgctgccccacgtgcgggcctttgcctacacctggttcaacctgcaggccaggaagaggaagtacttcaagaagcatgagaagaggatgagcaaggaggaggagagagctgtgaaggatgagctgctgtctgagaagccagaggtgaagcagaagtgggccagccggctgctggccaagctgaggaaggacatccggcctgagtacagagaagattttgtgctgactgtgacaggcaagaagccaccctgctgcgtgctgagcaacccagaccagaagggcaagatgagaagaattgactgcctgcggcaggccgacaaggtgtggaggctggacctggtgatggtgatcctcttcaagggcatccccctggagagcacagatggagagcggctggtgaagagcccccagtgcagcaaccctggcctgtgtgtgcagccccaccacatcggcgtgtctgtgaaggagctggacctgtacctggcctactttgtgcatgctgctgacagcagccagagcgagagccccagccagcccagtgatgctgacatcaaggaccagccagaaaatggccacctgggcttccaggacagctttgtgaccagcggggtcttctctgtgacagagctggtgcgggtgtcccagacccccatcgccgccggcaccggccccaacttcagcctgagtgacctggagagcagcagctactacagcatgagccctggggccatgagaagaagcctgcccagcaccagcagcaccagcagcaccaagaggctgaagtctgtggaggatgagatggacagccctggagaggagcccttctacacaggccagggccgcagccctggcagcggcagccagagcagcggctggcatgaggtggagcccgccagcccccacgccacccccagcaccctgcacttccccaccagccccatcatccagcagcccggcccctacttcagccacccagccatccgctaccacccccaggagaccctgaaggagtttgtgcagctggtgtgcccagatgctggccagcaggccggccaggtgggcttcctgaaccccaacggcagcagccagggcaaggtgcacaaccccttcctgcccacccccatgctgcccccacctcctcctccacccatggcccggcctgtgcccctgcctgtgcctgacaccaagccacccaccaccagcacagagggcggggccgccagccccaccagccccacctacagcacccccagcaccagccctgccaacagatttgtgtctgtgggcccccgggaccccagctttgtgaacatcccccagcagacccagagctggtacctgggctag

SEQ ID NO: 162177 - DNA, 1665 bp, Artificial Sequence
  Description of Artificial Sequence: Synthetic coding sequence
atgcagatgtgcaggcctgccagcagctctgtgctgtatgtgcccacccgctggccaggcggctgtggggccacctggcagagctgccccagccccccacccaggaggacccgcatcccccagaggcctgctgtgatgtacagccccctgtgcctgacccaggatgagttccaccccttcatcgaggccctgctgccccacgtgcgggcctttgcctacacctggttcaacctgcaggccaggaagaggaagtacttcaagaagcatgagaagaggatgagcaaggaggaggagagagctgtgaaggatgagctgctgtctgagaagccagaggtgaagcagaagtgggccagccggctgctggccaagctgaggaaggacatccggcctgagtaccgggaggactttgtgctgactgtgacaggcaagaagccaccctgctgcgtgctgagcaacccagaccagaagggcaagatgagaagaattgactgcctgcggcaggccgacaaggtgtggaggctggacctggtgatggtgatcctcttcaagggcatccccctggagagcacagatggagagcggctggtgaagagcccccagtgcagcaaccctggcctgtgtgtgcagccccaccacatcggcgtgtctgtgaaggagctggacctgtacctggcctactttgtgcacgccgctgacagcagccagagcgagagccccagccagcccagtgatgctgacatcaaggaccagccagaaaatggccacctgggcttccaggacagctttgtgaccagcggggtcttctctgtgacagagctggtgcgggtgtcccagacccccatcgctgctggcaccggccccaacttcagcctgagtgacctggagagcagcagctactacagcatgagccctggggccatgaggaggagcctgcccagcaccagcagcaccagcagcaccaagaggctgaagtctgtggaggatgagatggacagccctggagaggagcccttctacacaggccagggccgcagccctggcagcggcagccagagcagcggctggcatgaggtggagcccggcatgcccagccccaccaccctgaagaagtctgagaagagcggcttcagcagccccagccccagccagaccagcagcctgggcacagccttcacccagcaccacaggcctgtgatcaccggcccccgggccagcccccacgccacccccagcaccctgcacttccccaccagccccatcatccagcagcccggcccctacttcagccacccagccatccgctaccacccccaggagaccctgaaggagtttgtgcagctggtgtgcccagatgctggccagcaggccggccaggtgggcttcctgaaccccaacggcagcagccagggcaaggtgcacaaccccttcctgcccacccccatgctgcccccacctcctcctccacccatggcccggcctgtgcccctgcctgtgcctgacaccaagccacccaccaccagcacagagggcggggccgccagccccaccagccccacctacagcacccccagcaccagccctgccaacagatttgtgtctgtgggcccccgggaccccagctttgtgaacatcccccagcagacccagagctggtacctgggctag

SEQ ID NO: 162178 - DNA, 1599 bp, Artificial Sequence
  Description of Artificial Sequence: Synthetic coding sequence
atgaagctggccgacagcgtgatggccggcaaggccagtgatggcagcatcaagtggcagctgtgctatgacatcagcgcccggacctggtggatggatgagttccaccccttcatcgaggccctgctgccccacgtgcgggcctttgcctacacctggttcaacctgcaggccaggaagaggaagtacttcaagaagcatgagaagaggatgagcaaggaggaggagagagctgtgaaggatgagctgctgtctgagaagccagaggtgaagcagaagtgggccagccggctgctggccaagctgaggaaggacatccggcctgagtaccgggaggactttgtgctgactgtgacaggcaagaagccaccctgctgcgtgctgagcaacccagaccagaagggcaagatgagaagaattgactgcctgcggcaggccgacaaggtgtggaggctggacctggtgatggtgatcctcttcaagggcatccccctggagagcacagatggagagcggctggtgaagagcccccagtgcagcaaccctggcctgtgtgtgcagccccaccacatcggcgtgtctgtgaaggagctggacctgtacctggcctactttgtgcacgccgctgacagcagccagagcgagagccccagccagcccagtgatgctgacatcaaggaccagccagaaaatggccacctgggcttccaggacagctttgtgaccagcggggtcttctctgtgacagagctggtgcgggtgtcccagacccccatcgctgctggcaccggccccaacttcagcctgagtgacctggagagcagcagctactacagcatgagccctggggccatgaggaggagcctgcccagcaccagcagcaccagcagcaccaagaggctgaagtctgtggaggatgagatggacagccctggagaggagcccttctacacaggccagggccgcagccctggcagcggcagccagagcagcggctggcatgaggtggagcccggcatgcccagccccaccaccctgaagaagtctgagaagagcggcttcagcagccccagccccagccagaccagcagcctgggcacagccttcacccagcaccacaggcctgtgatcaccggcccccgggccagcccccacgccacccccagcaccctgcacttccccaccagccccatcatccagcagcccggcccctacttcagccacccagccatccgctaccacccccaggagaccctgaaggagtttgtgcagctggtgtgcccagatgctggccagcaggccggccaggtgggcttcctgaaccccaacggcagcagccagggcaaggtgcacaaccccttcctgcccacccccatgctgcccccacctcctcctccacccatggcccggcctgtgcccctgcctgtgcctgacaccaagccacccaccaccagcacagagggcggggccgccagccccaccagccccacctacagcacccccagcaccagccctgccaacagatttgtgtctgtgggcccccgggaccccagctttgtgaacatcccccagcagacccagagctggtacctgggctag

SEQ ID NO: 162179 - DNA, 1530 bp, Artificial Sequence
  Description of Artificial Sequence: Synthetic coding sequence
atgtacagccccctgtgcctgacccaggatgagttccaccccttcatcgaggccctgctgccccacgtgcgggcctttgcctacacctggttcaacctgcaggccaggaagaggaagtacttcaagaagcatgagaagaggatgagcaaggaggaggagagagctgtgaaggatgagctgctgtctgagaagccagaggtgaagcagaagtgggccagccggctgctggccaagctgaggaaggacatccggcctgagtacagagaagattttgtgctgactgtgacaggcaagaagccaccctgctgcgtgctgagcaacccagaccagaagggcaagatgagaagaattgactgcctgcggcaggccgacaaggtgtggaggctggacctggtgatggtgatcctcttcaagggcatccccctggagagcacagatggagagcggctggtgaagagcccccagtgcagcaaccctggcctgtgtgtgcagccccaccacatcggcgtgtctgtgaaggagctggacctgtacctggcctactttgtgcatgctgctgacagcagccagagcgagagccccagccagcccagtgatgctgacatcaaggaccagccagaaaatggccacctgggcttccaggacagctttgtgaccagcggggtcttctctgtgacagagctggtgcgggtgtcccagacccccatcgccgccggcaccggccccaacttcagcctgagtgacctggagagcagcagctactacagcatgagccctggggccatgagaagaagcctgcccagcaccagcagcaccagcagcaccaagaggctgaagtctgtggaggatgagatggacagccctggagaggagcccttctacacaggccagggccgcagccctggcagcggcagccagagcagcggctggcatgaggtggagcccggcatgcccagccccaccaccctgaagaagtctgagaagagcggcttcagcagccccagccccagccagaccagcagcctgggcacagccttcacccagcaccacaggcctgtgatcaccggcccccgggccagcccccacgccacccccagcaccctgcacttccccaccagccccatcatccagcagcccggcccctacttcagccacccagccatccgctaccacccccaggagaccctgaaggagtttgtgcagctggtgtgcccagatgctggccagcaggccggccaggtgggcttcctgaaccccaacggcagcagccagggcaaggtgcacaaccccttcctgcccacccccatgctgcccccacctcctcctccacccatggcccggcctgtgcccctgcctgtgcctgacaccaagccacccaccaccagcacagaaggaggagctgccagccccaccagccccacctacagcacccccagcaccagccctgccaacagatttgtgtctgtgggcccccgggaccccagctttgtgaacatcccccagcagacccagagctggtacctgggctag

SEQ ID NO: 162180 - DNA, 1506 bp, Artificial Sequence
  Description of Artificial Sequence: Synthetic coding sequence
atggatgagttccaccccttcatcgaggccctgctgccccacgtgcgggcctttgcctacacctggttcaacctgcaggccaggaagaggaagtacttcaagaagcatgagaagaggatgagcaaggaggaggagagagctgtgaaggatgagctgctgtctgagaagccagaggtgaagcagaagtgggccagccggctgctggccaagctgaggaaggacatccggcctgagtacagagaagattttgtgctgactgtgacaggcaagaagccaccctgctgcgtgctgagcaacccagaccagaagggcaagatgagaagaattgactgcctgcggcaggccgacaaggtgtggaggctggacctggtgatggtgatcctcttcaagggcatccccctggagagcacagatggagagcggctggtgaagagcccccagtgcagcaaccctggcctgtgtgtgcagccccaccacatcggcgtgtctgtgaaggagctggacctgtacctggcctactttgtgcatgctgctgacagcagccagagcgagagccccagccagcccagtgatgctgacatcaaggaccagccagaaaatggccacctgggcttccaggacagctttgtgaccagcggggtcttctctgtgacagagctggtgcgggtgtcccagacccccatcgccgccggcaccggccccaacttcagcctgagtgacctggagagcagcagctactacagcatgagccctggggccatgagaagaagcctgcccagcaccagcagcaccagcagcaccaagaggctgaagtctgtggaggatgagatggacagccctggagaggagcccttctacacaggccagggccgcagccctggcagcggcagccagagcagcggctggcatgaggtggagcccggcatgcccagccccaccaccctgaagaagtctgagaagagcggcttcagcagccccagccccagccagaccagcagcctgggcacagccttcacccagcaccacaggcctgtgatcaccggcccccgggccagcccccacgccacccccagcaccctgcacttccccaccagccccatcatccagcagcccggcccctacttcagccacccagccatccgctaccacccccaggagaccctgaaggagtttgtgcagctggtgtgcccagatgctggccagcaggccggccaggtgggcttcctgaaccccaacggcagcagccagggcaaggtgcacaaccccttcctgcccacccccatgctgcccccacctcctcctccacccatggcccggcctgtgcccctgcctgtgcctgacaccaagccacccaccaccagcacagaaggaggagctgccagccccaccagccccacctacagcacccccagcaccagccctgccaacagatttgtgtctgtgggcccccgggaccccagctttgtgaacatcccccagcagacccagagctggtacctgggctag

SEQ ID NO: 162181 - DNA, 1497 bp, Artificial Sequence
  Description of Artificial Sequence: Synthetic coding sequence
atgtacagccccctgtgcctgacccaggatgagttccaccccttcatcgaggccctgctgccccacgtgcgggcctttgcctacacctggttcaacctgcaggccaggaagaggaagtacttcaagaagcatgagaagaggatgagcaaggaggaggagagagctgtgaaggatgagctgctgtctgagaagccagaggtgaagcagaagtgggccagccggctgctggccaagctgaggaaggacatccggcctgagtacagagaagattttgtgctgactgtgacaggcaagaagccaccctgctgcgtgctgagcaacccagaccagaagggcaagatgagaagaattgactgcctgcggcaggccgacaaggtgtggaggctggacctggtgatggtgatcctcttcaagggcatccccctggagagcacagatggagagcggctggtgaagagcccccagtgcagcaaccctggcctgtgtgtgcagccccaccacatcggcgtgtctgtgaaggagctggacctgtacctggcctactttgtgcatgctgctgacagcagccagagcgagagccccagccagcccagtgatgctgacatcaaggaccagccagaaaatggccacctgggcttccaggacagctttgtgaccagcggggtcttctctgtgacagagctggtgcgggtgtcccagacccccatcgccgccggcaccggccccaacttcagcctgagtgacctggagagcagcagctactacagcatgagccctggggccatgagaagaagcctgcccagcaccagcagcaccagcagcaccaagaggctgaagtctgtggaggatgagatggacagccctggagaggagcccttctacacaggccagggccgcagccctggcagcggcagccagagcagcggctggcatgaggtggagcccggcatgcccagccccaccaccctgaagaagtctgagaagagcggcttcagcagccccagccccagccagaccagcagcctgggcacagccttcacccagcaccacaggcctgtgatcaccggcccccgggccagcccccacgccacccccagcaccctgcacttccccaccagccccatcatccagcagcccggcccctacttcagccacccagccatccgctaccacccccaggagaccctgaaggagtttgtgcagctggtgtgcccagatgctggccagcaggccggccaggtgggcttcctgaaccccaacggcagcagccagggcaaggtgcacaaccccttcctgcccacccccatgctgcccccacctcctcctccacccatggcccggcctgtgcccctgcctgtgcctgacaccaagccacccaccaccagcacagaaggaggagctgccagccccaccagccccatcctggtgcccggcatcaaggtggccgccagccaccaccccccagaccggcccccagaccccttcagcaccctgtag

SEQ ID NO: 162182 - DNA, 603 bp, Artificial Sequence
  Description of Artificial Sequence: Synthetic coding sequence
atgatgtacagccccatctgcctgacccaggatgagttccaccccttcatcgaggccctgctgccccacgtgcgggccatcgcctacacctggttcaacctgcaggccaggaagaggaagtacttcaagaagcatgagaagaggatgagcaaggatgaggagagagctgtgaaggatgagctgctgtctgagaagccagagatcaagcagaagtgggccagccggctgctggccaagctgaggaaggacatccggcaggagtaccgggaggactttgtgctgactgtgacaggcaagaagcacccctgctgcgtgctgagcaacccagaccagaagggcaagatcagaagaattgactgcctgcggcaggccgacaaggtgtggaggctggacctggtgatggtgatcctcttcaagggcatccccctggagagcacagatggagagcggctgatgaagagcccccactgcaccaacccagccctgtgtgtgcagccccaccacatcaccgtgtctgtgaaggagctggacctcttcctggcctactacgtgcaggagcagggcaagaacttcttcagcagcaacaagtgcatcaagatctag

SEQ ID NO: 162183 - DNA, 507 bp, Artificial Sequence
  Description of Artificial Sequence: Synthetic coding sequence
atgaacagcggcgtgaacctgcagaggagcctgagcagcccccccagcagcaagaggcccaagaccatcagcattgatgagaacatggagcccagccccaccggggacttctaccccagccccagcagccctgctgctggcagcaggacctggcatgagcgggaccaggacatgagcagccccaccaccatgaagaagccagagaagcccctcttcagcagcgccagcccccaggacagcagcccccggctgagcaccttcccccagcaccaccaccctggcatccctggggtggcccacagcgtcatcagcaccaggaccccacctccacccagccccctgcccttccccacccaggccatcctgcccccagcccccagcagctacttcagccaccccaccatccgctacccaccccacctgaacccccaggacaccctgaagaactacgtgcccagctatgaccccagcagcccccagaccagccagagctggtacctgggctag

SEQ ID NO: 162184 - DNA, 1341 bp, Artificial Sequence
  Description of Artificial Sequence: Synthetic coding sequence
atggagcgcatccctgtgtctgtggacttctgggtggtgtgctgtgctgtgctgaagtgcaaccctggcatccccaagaggatgagcaccctgtgcttcggcttcagtgatgagttccaccccttcatcgaggccctgctgccccacgtgcgggccatcgcctacacctggttcaacctgcaggccaggaagaggaagtacttcaagaagcatgagaagaggatgagcaaggatgaggagagagctgtgaaggatgagctgctgtctgagaagccagagatcaagcagaagtgggccagccggctgctggccaagctgaggaaggacatccggcaggagtaccgggaggactttgtgctgactgtgacaggcaagaagcacccctgctgcgtgctgagcaacccagaccagaagggcaagatcagaagaattgactgcctgcggcaggccgacaaggtgtggaggctggacctggtgatggtgatcctcttcaagggcatccccctggagagcacagatggagagcggctgatgaagagcccccactgcaccaacccagccctgtgtgtgcagccccaccacatcaccgtgtctgtgaaggagctggacctcttcctggcctactacgtgcaggagcaggacagcggccagagcggcagccccagccacaatgaccctgccaagaaccccccaggctacctggaggacagctttgtgaagtctggagtcttcaacgtgtctgagctggtgcgggtgtccaggacccccatcacccagggcactggagtgaacttccccatcggggagatccccagccagccctactaccatgacatgaacagcggcgtgaacctgcagaggagcctgagcagcccccccagcagcaagaggcccaagaccatcagcattgatgagaacatggagcccagccccaccggggacttctaccccagccccagcagccctgctgctggcagcaggacctggcatgagcgggaccaggacatgagcagccccaccaccatgaagaagccagagaagcccctcttcagcagcgccagcccccaggacagcagcccccggctgagcaccttcccccagcaccaccaccctggcatccctggggtggcccacagcgtcatcagcaccaggaccccacctccacccagccccctgcccttccccacccaggccatcctgcccccagcccccagcagctacttcagccaccccaccatccgctacccaccccacctgaacccccaggacaccctgaagaactacgtgcccagctatgaccccagcagcccccagaccagccagagctggtacctgggctag

SEQ ID NO: 162185 - DNA, 1485 bp, Artificial Sequence
  Description of Artificial Sequence: Synthetic coding sequence
atgatgtacagccccatctgcctgacccaggatgagttccaccccttcatcgaggccctgctgccccacgtgcgggccatcgcctacacctggttcaacctgcaggccaggaagaggaagtacttcaagaagcatgagaagaggatgagcaaggatgaggagagagctgtgaaggatgagctgctgtctgagaagccagagatcaagcagaagtgggccagccggctgctggccaagctgaggaaggacatccggcaggagtaccgggaggactttgtgctgactgtgacaggcaagaagcacccctgctgcgtgctgagcaacccagaccagaagggcaagatcagaagaattgactgcctgcggcaggccgacaaggtgtggaggctggacctggtgatggtgatcctcttcaagggcatccccctggagagcacagatggagagcggctgatgaagagcccccactgcaccaacccagccctgtgtgtgcagccccaccacatcaccgtgtctgtgaaggagctggacctcttcctggcctactacgtgcaggagcaggacagcggccagagcggcagccccagccacaatgaccctgccaagaaccccccaggctacctggaggacagctttgtgaagtctggagtcttcaacgtgtctgagctggtgcgggtgtccaggacccccatcacccagggcactggagtgaacttccccatcggggagatccccagccagccctactaccatgacatgaacagcggcgtgaacctgcagaggagcctgagcagcccccccagcagcaagaggcccaagaccatcagcattgatgagaacatggagcccagccccaccggggacttctaccccagccccagcagccctgctgctggcagcaggacctggcatgagcgggaccaggacatgagcagccccaccaccatgaagaagccagagaagcccctcttcagcagcgccagcccccaggacagcagcccccggctgagcaccttcccccagcaccaccaccctggcatccctggggtggcccacagcgtcatcagcaccaggaccccacctccacccagccccctgcccttccccacccaggccatcctgcccccagcccccagcagctacttcagccaccccaccatccgctacccaccccacctgaacccccaggacaccctgaagaactacgtgcccagctatgaccccagcagcccccagaccagccagcccaatggaagtggccaggtggtgggcaaggtgcccggccacttcacccctgtgctggcccccagcccccaccccagcgctgtgcggcctgtgaccctgtccatgacagacaccaagcccatcaccaccagcacagaggcctacacagccagcggcaccagccaggccaaccgctacgtgggcctgagcccccgggaccccagcttcctgcaccagcagcagagctggtacctgggctag

SEQ ID NO: 162186 - DNA, 1263 bp, Artificial Sequence
  Description of Artificial Sequence: Synthetic coding sequence
atgatgtacagccccatctgcctgacccaggatgagttccaccccttcatcgaggccctgctgccccacgtgcgggccatcgcctacacctggttcaacctgcaggccaggaagaggaagtacttcaagaagcatgagaagaggatgagcaaggatgaggagagagctgtgaaggatgagctgctgtctgagaagccagagatcaagcagaagtgggccagccggctgctggccaagctgaggaaggacatccggcaggagtaccgggaggactttgtgctgactgtgacaggcaagaagcacccctgctgcgtgctgagcaacccagaccagaagggcaagatcagaagaattgactgcctgcggcaggccgacaaggtgtggaggctggacctggtgatggtgatcctcttcaagggcatccccctggagagcacagatggagagcggctgatgaagagcccccactgcaccaacccagccctgtgtgtgcagccccaccacatcaccgtgtctgtgaaggagctggacctcttcctggcctactacgtgcaggagcaggacagcggccagagcggcagccccagccacaatgaccctgccaagaaccccccaggctacctggaggacagctttgtgaagtctggagtcttcaacgtgtctgagctggtgcgggtgtccaggacccccatcacccagggcactggagtgaacttccccatcggggagatccccagccagccctactaccatgacatgaacagcggcgtgaacctgcagaggagcctgagcagcccccccagcagcaagaggcccaagaccatcagcattgatgagaacatggagcccagccccaccggggacttctaccccagccccagcagccctgctgctggcagcaggacctggcatgagcgggaccaggacatgagcagccccaccaccatgaagaagccagagaagcccctcttcagcagcgccagcccccaggacagcagcccccggctgagcaccttcccccagcaccaccaccctggcatccctggggtggcccacagcgtcatcagcaccaggaccccacctccacccagccccctgcccttccccacccaggccatcctgcccccagcccccagcagctacttcagccaccccaccatccgctacccaccccacctgaacccccaggacaccctgaagaactacgtgcccagctatgaccccagcagcccccagaccagccagagctggtacctgggctag

SEQ ID NO: 162187 - DNA, 1686 bp, Artificial Sequence
  Description of Artificial Sequence: Synthetic coding sequence
atgatgtacagccccatctgcctgacccaggatgagttccaccccttcatcgaggccctgctgccccacgtgcgggccatcgcctacacctggttcaacctgcaggccaggaagaggaagtacttcaagaagcatgagaagaggatgagcaaggatgaggagagagctgtgaaggatgagctgctgtctgagaagccagagatcaagcagaagtgggccagccggctgctggccaagctgaggaaggacatccggcaggagtaccgggaggactttgtgctgactgtgacaggcaagaagcacccctgctgcgtgctgagcaacccagaccagaagggcaagatcagaagaattgactgcctgcggcaggccgacaaggtgtggaggctggacctggtgatggtgatcctcttcaagggcatccccctggagagcacagatggagagcggctgatgaagagcccccactgcaccaacccagccctgtgtgtgcagccccaccacatcaccgtgtctgtgaaggagctggacctcttcctggcctactacgtgcaggagcaggacagcggccagagcggcagccccagccacaatgaccctgccaagaaccccccaggctacctggaggacagctttgtgaagtctggagtcttcaacgtgtctgagctggtgcgggtgtccaggacccccatcacccagggcactggagtgaacttccccatcggggagatccccagccagccctactaccatgacatgaacagcggcgtgaacctgcagaggagcctgagcagcccccccagcagcaagaggcccaagaccatcagcattgatgagaacatggagcccagccccaccggggacttctaccccagccccagcagccctgctgctggcagcaggacctggcatgagcgggaccaggacatgagcagccccaccaccatgaagaagccagagaagcccctcttcagcagcgccagcccccaggacagcagcccccggctgagcaccttcccccagcaccaccaccctggcatccctggggtggcccacagcgtcatcagcaccaggaccccacctccacccagccccctgcccttccccacccaggccatcctgcccccagcccccagcagctacttcagccaccccaccatccgctacccaccccacctgaacccccaggacaccctgaagaactacgtgcccagctatgaccccagcagcccccagaccagccagcccaatggaagtggccaggtggtgggcaaggtgcccggccacttcacccctgtgctggcccccagcccccaccccagcgctgtgcggcctgtgaccctgtccatgacagacaccaagcccatcaccaccagcacagaggcctacacagccagcggcaccagccaggccaaccgctacgtgggcctgagcccccgggaccccagcttcctgcaccagcagcagctgcgcatctgtgactggaccatgaaccagaatggccgccacctgtaccccagcaccagcgaggacaccctgggcatcacctggcagagccctggcacctgggccagcctggtgcccttccaggtgagcaacagaacacccatcctgcctgccaacgtgcagaactacggcctgaacatcatcggggagcccttcctgcaggccgagaccagcaactag

SEQ ID NO: 162188 - DNA, 1464 bp, Artificial Sequence
  Description of Artificial Sequence: Synthetic coding sequence
atgatgtacagccccatctgcctgacccaggatgagttccaccccttcatcgaggccctgctgccccacgtgcgggccatcgcctacacctggttcaacctgcaggccaggaagaggaagtacttcaagaagcatgagaagaggatgagcaaggatgaggagagagctgtgaaggatgagctgctgtctgagaagccagagatcaagcagaagtgggccagccggctgctggccaagctgaggaaggacatccggcaggagtaccgggaggactttgtgctgactgtgacaggcaagaagcacccctgctgcgtgctgagcaacccagaccagaagggcaagatcagaagaattgactgcctgcggcaggccgacaaggtgtggaggctggacctggtgatggtgatcctcttcaagggcatccccctggagagcacagatggagagcggctgatgaagagcccccactgcaccaacccagccctgtgtgtgcagccccaccacatcaccgtgtctgtgaaggagctggacctcttcctggcctactacgtgcaggagcaggacagcggccagagcggcagccccagccacaatgaccctgccaagaaccccccaggctacctggaggacagctttgtgaagtctggagtcttcaacgtgtctgagctggtgcgggtgtccaggacccccatcacccagggcactggagtgaacttccccatcggggagatccccagccagccctactaccatgacatgaacagcggcgtgaacctgcagaggagcctgagcagcccccccagcagcaagaggcccaagaccatcagcattgatgagaacatggagcccagccccaccggggacttctaccccagccccagcagccctgctgctggcagcaggacctggcatgagcgggaccaggacatgagcagccccaccaccatgaagaagccagagaagcccctcttcagcagcgccagcccccaggacagcagcccccggctgagcaccttcccccagcaccaccaccctggcatccctggggtggcccacagcgtcatcagcaccaggaccccacctccacccagccccctgcccttccccacccaggccatcctgcccccagcccccagcagctacttcagccaccccaccatccgctacccaccccacctgaacccccaggacaccctgaagaactacgtgcccagctatgaccccagcagcccccagaccagccagctgcgcatctgtgactggaccatgaaccagaatggccgccacctgtaccccagcaccagcgaggacaccctgggcatcacctggcagagccctggcacctgggccagcctggtgcccttccaggtgagcaacagaacacccatcctgcctgccaacgtgcagaactacggcctgaacatcatcggggagcccttcctgcaggccgagaccagcaactag

SEQ ID NO: 162189 - DNA, 1713 bp, Artificial Sequence
  Description of Artificial Sequence: Synthetic coding sequence
atgatgtacagccccatctgcctgacccaggatgagttccaccccttcatcgaggccctgctgccccacgtgcgggccatcgcctacacctggttcaacctgcaggccaggaagaggaagtacttcaagaagcatgagaagaggatgagcaaggatgaggagagagctgtgaaggatgagctgctgtctgagaagccagagatcaagcagaagtgggccagccggctgctggccaagctgaggaaggacatccggcaggagtaccgggaggactttgtgctgactgtgacaggcaagaagcacccctgctgcgtgctgagcaacccagaccagaagggcaagatcagaagaattgactgcctgcggcaggccgacaaggtgtggaggctggacctggtgatggtgatcctcttcaagggcatccccctggagagcacagatggagagcggctgatgaagagcccccactgcaccaacccagccctgtgtgtgcagccccaccacatcaccgtgtctgtgaaggagctggacctcttcctggcctactacgtgcaggagcaggacagcggccagagcggcagccccagccacaatgaccctgccaagaaccccccaggctacctggaggacagctttgtgaagtctggagtcttcaacgtgtctgagctggtgcgggtgtccaggacccccatcacccagggcactggagtgaacttccccatcggggagatccccagccagccctactaccatgacatgaacagcggcgtgaacctgcagaggagcctgagcagcccccccagcagcaagaggcccaagaccatcagcattgatgagaacatggagcccagccccaccggggacttctaccccagccccagcagccctgctgctggcagcaggacctggcatgagcgggaccaggacatgagcagccccaccaccatgaagaagccagagaagcccctcttcagcagcgccagcccccaggacagcagcccccggctgagcaccttcccccagcaccaccaccctggcatccctggggtggcccacagcgtcatcagcaccaggaccccacctccacccagccccctgcccttccccacccaggccatcctgcccccagcccccagcagctacttcagccaccccaccatccgctacccaccccacctgaacccccaggacaccctgaagaactacgtgcccagctatgaccccagcagcccccagaccagccagcccaatggaagtggccaggtggtgggcaaggtgcccggccacttcacccctgtgctggcccccagcccccaccccagcgctgtgcggcctgtgaccctgtccatgacagacaccaagcccatcaccaccagcacagaaggagaggccgccagccccacagccaccacctacacagccagcggcaccagccaggccaacagatatgtgggcctgagcccccgggaccccagcttcctgcaccagcagcagctgcgcatctgtgactggaccatgaaccagaatggccgccacctgtaccccagcaccagcgaggacaccctgggcatcacctggcagagccctggcacctgggccagcctggtgcccttccaggtgagcaacagaacacccatcctgcctgccaacgtgcagaactacggcctgaacatcattggagagcccttcctgcaggccgagaccagcaactag

SEQ ID NO: 162190 - DNA, 930 bp, Artificial Sequence
  Description of Artificial Sequence: Synthetic coding sequence
atgaacagcggcgtgaacctgcagaggagcctgagcagcccccccagcagcaagaggcccaagaccatcagcattgatgagaacatggagcccagccccaccggggacttctaccccagccccagcagccctgctgctggcagcaggacctggcatgagcgggaccaggacatgagcagccccaccaccatgaagaagccagagaagcccctcttcagcagcgccagcccccaggacagcagcccccggctgagcaccttcccccagcaccaccaccctggcatccctggggtggcccacagcgtcatcagcaccaggaccccacctccacccagccccctgcccttccccacccaggccatcctgcccccagcccccagcagctacttcagccaccccaccatccgctacccaccccacctgaacccccaggacaccctgaagaactacgtgcccagctatgaccccagcagcccccagaccagccagcccaatggaagtggccaggtggtgggcaaggtgcccggccacttcacccctgtgctggcccccagcccccaccccagcgctgtgcggcctgtgaccctgtccatgacagacaccaagcccatcaccaccagcacagaggcctacacagccagcggcaccagccaggccaaccgctacgtgggcctgagcccccgggaccccagcttcctgcaccagcagcagctgcgcatctgtgactggaccatgaaccagaatggccgccacctgtaccccagcaccagcgaggacaccctgggcatcacctggcagagccctggcacctgggccagcctggtgcccttccaggtgagcaacagaacacccatcctgcctgccaacgtgcagaactacggcctgaacatcatcggggagcccttcctgcaggccgagaccagcaactag

SEQ ID NO: 162191 - DNA, 1272 bp, Artificial Sequence
  Description of Artificial Sequence: Synthetic coding sequence
atgtacagcagccccctgtgcctgacccaggatgagttccaccccttcatcgaggccctgctgccccacgtgcgggcctttgcctacacctggttcaacctgcaggccaggaagaggaagtacttcaagaagcatgagaagaggatgagcaaggatgaggagagagctgtgaaggatgagctgctgggggagaagccagaggtgaagcagaagtgggccagccggctgctggccaagctgaggaaggacatccggccagaatgtcgggaggactttgtgctgagcatcaccgggaagaaggcccctggctgtgtgctgagcaacccagaccagaagggcaagatgagaagaattgactgcctgcggcaggccgacaaggtgtggaggctggacctggtgatggtgatcctcttcaagggcatccccctggagagcacagatggagagcggctggtgaaggccgcccagtgtggccaccctgtgctgtgtgtgcagccccaccacatcggcgtggccgtgaaggagctggacctgtacctggcctactttgtgcgggagagagatgctgagcagagcggcagccccaggacaggcatgggcagtgaccaggaggacagcaagcccatcaccctggacaccacagacttccaggagagctttgtgaccagcggggtcttctctgtgacagagctgatccaggtgtccaggacccctgtggtgactggaacaggccccaacttcagcctgggggagctgcagggccacctggcctatgacctgaacccagccagcacaggcctgcggaggaccctgcccagcaccagcagcagcggcagcaagaggcacaagagcggctccatggaggaggatgtggacaccagccctggaggagactactacaccagccccagcagccccaccagcagcagcaggaactggacagaggacatggagggcggcatcagcagccctgtgaagaagacagagatggacaagagccccttcaacagccccagcccccaggacagcccccggctgagcagcttcacccagcaccacaggcctgtgattgctgtgcacagcggcatcgcccggagcccccaccccagcagcgccctgcacttccccaccaccagcatcctgccccagacagccagcacctacttcccccacacagccatccgctacccaccccacctgaacccccaggaccccctgaaggacctggtgtccctggcctgtgaccctgccagccagcagcccggcccctag

SEQ ID NO: 162192 - DNA, 1287 bp, Artificial Sequence
  Description of Artificial Sequence: Synthetic coding sequence
atgtacagcagccccctgtgcctgacccaggatgagttccaccccttcatcgaggccctgctgccccacgtgcgggcctttgcctacacctggttcaacctgcaggccaggaagaggaagtacttcaagaagcatgagaagaggatgagcaaggatgaggagagagctgtgaaggatgagctgctgggggagaagccagaggtgaagcagaagtgggccagccggctgctggccaagctgaggaaggacatccggccagaatgtcgggaggactttgtgctgagcatcaccgggaagaaggcccctggctgtgtgctgagcaacccagaccagaagggcaagatgagaagaattgactgcctgcggcaggccgacaaggtgtggaggctggacctggtgatggtgatcctcttcaagggcatccccctggagagcacagatggagagcggctggtgaaggccgcccagtgtggccaccctgtgctgtgtgtgcagccccaccacatcggcgtggccgtgaaggagctggacctgtacctggcctactttgtgcgggagagagatgctgagcagagcggcagccccaggacaggcatgggcagtgaccaggaggacagcaagcccatcaccctggacaccacagacttccaggagagctttgtgaccagcggggtcttctctgtgacagagctgatccaggtgtccaggacccctgtggtgactggaacaggccccaacttcagcctgggggagctgcagggccacctggcctatgacctgaacccagccagcacaggcctgcggaggaccctgcccagcaccagcagcagcggcagcaagaggcacaagagcggctccatggaggaggatgtggacaccagccctggaggagactactacaccagccccagcagccccaccagcagcagcaggaactggacagaggacatggagggcggcatcagcagccctgtgaagaagacagagatggacaagagccccttcaacagccccagcccccaggacagcccccggctgagcagcttcacccagcaccacaggcctgtgattgctgtgcacagcggcatcgcccggagcccccaccccagcagcgccctgcacttccccaccaccagcatcctgccccagacagccagcacctacttcccccacacagccatccgctacccaccccacctgaacccccaggaccccctgaaggacctggtgtccctggcctgtgaccctgccagccagcagcccggccccagctggtacctgggctag

SEQ ID NO: 162193 - DNA, 1527 bp, Artificial Sequence
  Description of Artificial Sequence: Synthetic coding sequence
atgtacagcagccccctgtgcctgacccaggatgagttccaccccttcatcgaggccctgctgccccacgtgcgggcctttgcctacacctggttcaacctgcaggccaggaagaggaagtacttcaagaagcatgagaagaggatgagcaaggatgaggagagagctgtgaaggatgagctgctgggggagaagccagaggtgaagcagaagtgggccagccggctgctggccaagctgaggaaggacatccggccagaatgtcgggaggactttgtgctgagcatcaccgggaagaaggcccctggctgtgtgctgagcaacccagaccagaagggcaagatgagaagaattgactgcctgcggcaggccgacaaggtgtggaggctggacctggtgatggtgatcctcttcaagggcatccccctggagagcacagatggagagcggctggtgaaggccgcccagtgtggccaccctgtgctgtgtgtgcagccccaccacatcggcgtggccgtgaaggagctggacctgtacctggcctactttgtgcgggagagagatgctgagcagagcggcagccccaggacaggcatgggcagtgaccaggaggacagcaagcccatcaccctggacaccacagacttccaggagagctttgtgaccagcggggtcttctctgtgacagagctgatccaggtgtccaggacccctgtggtgactggaacaggccccaacttcagcctgggggagctgcagggccacctggcctatgacctgaacccagccagcacaggcctgcggaggaccctgcccagcaccagcagcagcggcagcaagaggcacaagagcggctccatggaggaggatgtggacaccagccctggaggagactactacaccagccccagcagccccaccagcagcagcaggaactggacagaggacatggagggcggcatcagcagccctgtgaagaagacagagatggacaagagccccttcaacagccccagcccccaggacagcccccggctgagcagcttcacccagcaccacaggcctgtgattgctgtgcacagcggcatcgcccggagcccccaccccagcagcgccctgcacttccccaccaccagcatcctgccccagacagccagcacctacttcccccacacagccatccgctacccaccccacctgaacccccaggaccccctgaaggacctggtgtccctggcctgtgaccctgccagccagcagcccggccccctgaatggaagtggccagctgaagatgcccagccactgcctgagcgcccagatgctggcccctcctcctcctggcctgccccggctggccctgcccccagccaccaagccagccaccaccagcgagggcggggccaccagccccaccagccccagctacagccccccagacaccagccctgccaacagaagctttgtgggcctgggcccccgggaccctgctggcatctaccaggcccagagctggggagatggatag

SEQ ID NO: 162194 - DNA, 1221 bp, Artificial Sequence
  Description of Artificial Sequence: Synthetic coding sequence
atggatgagttccaccccttcatcgaggccctgctgccccacgtgcgggcctttgcctacacctggttcaacctgcaggccaggaagaggaagtacttcaagaagcatgagaagaggatgagcaaggatgaggagagagctgtgaaggatgagctgctgggggagaagccagaggtgaagcagaagtgggccagccggctgctggccaagctgaggaaggacatccggcctgagtgcagagaagattttgtgctgagcatcaccgggaagaaggcccctggctgtgtgctgagcaacccagaccagaagggcaagatgagaagaattgactgcctgcggcaggccgacaaggtgtggaggctggacctggtgatggtgatcctcttcaagggcatccccctggagagcacagatggagagcggctggtgaaggccgcccagtgtggccaccctgtgctgtgtgtgcagccccaccacatcggcgtggccgtgaaggagctggacctgtacctggcctactttgtgcgggagcgggacaccacagacttccaggagagctttgtgaccagcggggtcttctctgtgacagagctgatccaggtgtccaggacccctgtggtgacaggcaccggccccaacttcagcctgggggagctgcagggccacctggcctatgacctgaacccagccagcacaggcctgcggaggaccctgcccagcaccagcagcagcggcagcaagaggcacaagagcggctccatggaggaggatgtggacaccagccctggaggagactactacaccagccccagcagccccaccagcagcagcaggaactggacagaggacatggagggcggcatcagcagccctgtgaagaagacagagatggacaagagccccttcaacagccccagcccccaggacagcccccggctgagcagcttcacccagcaccacaggcctgtgattgctgtgcacagcggcatcgcccggagcccccaccccagcagcgccctgcacttccccaccaccagcatcctgccccagacagccagcacctacttcccccacacagccatccgctacccaccccacctgaacccccaggaccccctgaaggacctggtgtccctggcctgtgaccctgccagccagcagcccggcccccccaccctgcggcccacccggcccctgcagacagtgcccctgtgggactag

SEQ ID NO: 162195 - DNA, 1293 bp, Artificial Sequence
  Description of Artificial Sequence: Synthetic coding sequence
atggatgagttccaccccttcatcgaggccctgctgccccacgtgcgggcctttgcctacacctggttcaacctgcaggccaggaagaggaagtacttcaagaagcatgagaagaggatgagcaaggatgaggagagagctgtgaaggatgagctgctgggggagaagccagaggtgaagcagaagtgggccagccggctgctggccaagctgaggaaggacatccggcctgagtgcagagaagattttgtgctgagcatcaccgggaagaaggcccctggctgtgtgctgagcaacccagaccagaagggcaagatgagaagaattgactgcctgcggcaggccgacaaggtgtggaggctggacctggtgatggtgatcctcttcaagggcatccccctggagagcacagatggagagcggctggtgaaggccgcccagtgtggccaccctgtgctgtgtgtgcagccccaccacatcggcgtggccgtgaaggagctggacctgtacctggcctactttgtgcgggagagagatgctgagcagagcggcagccccaggacaggcatgggcagtgaccaggaggacagcaagcccatcaccctggacaccacagacttccaggagagctttgtgaccagcggggtcttctctgtgacagagctgatccaggtgtccaggacccctgtggtgacaggcaccggccccaacttcagcctgggggagctgcagggccacctggcctatgacctgaacccagccagcacaggcctgcggaggaccctgcccagcaccagcagcagcggcagcaagaggcacaagagcggctccatggaggaggatgtggacaccagccctggaggagactactacaccagccccagcagccccaccagcagcagcaggaactggacagaggacatggagggcggcatcagcagccctgtgaagaagacagagatggacaagagccccttcaacagccccagcccccaggacagcccccggctgagcagcttcacccagcaccacaggcctgtgattgctgtgcacagcggcatcgcccggagcccccaccccagcagcgccctgcacttccccaccaccagcatcctgccccagacagccagcacctacttcccccacacagccatccgctacccaccccacctgaacccccaggaccccctgaaggacctggtgtccctggcctgtgaccctgccagccagcagcccggcccccccaccctgcggcccacccggcccctgcagacagtgcccctgtgggactag

SEQ ID NO: 162196 - DNA, 1500 bp, Artificial Sequence
  Description of Artificial Sequence: Synthetic coding sequence
atggatgagttccaccccttcatcgaggccctgctgccccacgtgcgggcctttgcctacacctggttcaacctgcaggccaggaagaggaagtacttcaagaagcatgagaagaggatgagcaaggatgaggagagagctgtgaaggatgagctgctgggggagaagccagaggtgaagcagaagtgggccagccggctgctggccaagctgaggaaggacatccggcctgagtgcagagaagattttgtgctgagcatcaccgggaagaaggcccctggctgtgtgctgagcaacccagaccagaagggcaagatgagaagaattgactgcctgcggcaggccgacaaggtgtggaggctggacctggtgatggtgatcctcttcaagggcatccccctggagagcacagatggagagcggctggtgaaggccgcccagtgtggccaccctgtgctgtgtgtgcagccccaccacatcggcgtggccgtgaaggagctggacctgtacctggcctactttgtgcgggagagagatgctgagcagagcggcagccccaggacaggcatgggcagtgaccaggaggacagcaagcccatcaccctggacaccacagacttccaggagagctttgtgaccagcggggtcttctctgtgacagagctgatccaggtgtccaggacccctgtggtgacaggcaccggccccaacttcagcctgggggagctgcagggccacctggcctatgacctgaacccagccagcacaggcctgcggaggaccctgcccagcaccagcagcagcggcagcaagaggcacaagagcggctccatggaggaggatgtggacaccagccctggaggagactactacaccagccccagcagccccaccagcagcagcaggaactggacagaggacatggagggcggcatcagcagccctgtgaagaagacagagatggacaagagccccttcaacagccccagcccccaggacagcccccggctgagcagcttcacccagcaccacaggcctgtgattgctgtgcacagcggcatcgcccggagcccccaccccagcagcgccctgcacttccccaccaccagcatcctgccccagacagccagcacctacttcccccacacagccatccgctacccaccccacctgaacccccaggaccccctgaaggacctggtgtccctggcctgtgaccctgccagccagcagcccggccccctgaatggcagcggccagctgaagatgcccagccactgcctgagcgcccagatgctggcccctcctcctcctggcctgccccggctggccctgcccccagccaccaagccagccaccaccagcgagggcggggccaccagccccaccagccccagctacagccccccagacaccagccctgccaacagaagctttgtgggcctgggcccccgggaccctgctggcatctaccaggcccagagctggtacctgggctag

SEQ ID NO: 162197 - DNA, 1500 bp, Artificial Sequence; identical to SEQ ID NO: 162196
  Description of Artificial Sequence: Synthetic coding sequence

SEQ ID NO: 162198 - DNA, 1212 bp, Artificial Sequence
  Description of Artificial Sequence: Synthetic coding sequence
atgggcgccacagagcccggcggggacaccagcagtgatgagttccaccccttcatcgaggccctgctgccccacgtgcgggccttctcctacacctggttcaacctgcaggccaggaagaggaagtacttcaagaagcatgagaagaggatgagcaaggatgaggagagagctgtgaaggatgagctgctgggggagaagccagagatcaagcagaagtgggccagccggctgctggccaagctgaggaaggacatccggcctgagttccgggaggactttgtgctgaccatcaccgggaagaagccaccctgctgcgtgctgagcaacccagaccagaagggcaagatcagaagaattgactgcctgcggcaggccgacaaggtgtggaggctggacctggtgatggtgatcctcttcaagggcatccccctggagagcacagatggagagcggctgtacaagagcccccagtgcagcaaccctggcctgtgtgtgcagccccaccacatcggcgtgaccatcaaggagctggacctgtacctggcctactttgtgcacaccccagagagcggccagagcgacagcagcaaccagcagggagatgctgacatcaagcccctgcccaacggccacctgtccttccaggactgctttgtgaccagcggcgtgtggaatgtgacagagctggtgcgggtgtcccagacccctgtggccacagccagcggccccaacttcagcctggccgacctggagagccccagctactacaacatcaaccaggtgaccctgggccgccgcagcatcaccagcccccccagcaccagcaccaccaagaggcccaagagcattgatgattctgagatggagagccctgtggatgatgtgttctacccaggcaccggccgcagccctgctgctggcagcagccagagcagcggctggcccaatgatgtggatgctggcagcccccgggccacagccagcgccctgcacttccccagcaccagcatcatccagcagagcagcccctacttcacccaccccaccatccgctaccaccaccaccacggccaggacagcctgaaggagtttgtgcagtttgtgtgcagtgatggcagcggccaggccaccggccagcacagccagaggcaggccccacccctgcccaccggcctgagcgccagtgaccccggcacagccaccttctag

SEQ ID NO: 162199 - DNA, 1383 bp, Artificial Sequence
  Description of Artificial Sequence: Synthetic coding sequence
atgctgcctgcctgccgcctgcaggatgagttccaccccttcatcgaggccctgctgccccacgtgcgggccttctcctacacctggttcaacctgcaggccaggaagaggaagtacttcaagaagcatgagaagaggatgagcaaggatgaggagagagctgtgaaggatgagctgctgggggagaagccagagatcaagcagaagtgggccagccggctgctggccaagctgaggaaggacatccggcctgagttccgggaggactttgtgctgaccatcaccgggaagaagccaccctgctgcgtgctgagcaacccagaccagaagggcaagatcagaagaattgactgcctgcggcaggccgacaaggtgtggaggctggacctggtgatggtgatcctcttcaagggcatccccctggagagcacagatggagagcggctgtacaagagcccccagtgcagcaaccctggcctgtgtgtgcagccccaccacatcggcgtgaccatcaaggagctggacctgtacctggcctactttgtgcacaccccagagagcggccagagcgacagcagcaaccagcagggagatgctgacatcaagcccctgcccaacggccacctgtccttccaggactgctttgtgaccagcggcgtgtggaatgtgacagagctggtgcgggtgtcccagacccctgtggccacagccagcggccccaacttcagcctggccgacctggagagccccagctactacaacatcaaccaggtgaccctgggccgccgcagcatcaccagcccccccagcaccagcaccaccaagaggcccaagagcattgatgattctgagatggagagccctgtggatgatgtgttctacccaggcaccggccgcagccctgctgctggcagcagccagagcagcggctggcccaatgatgtggatgctggcagcccccgggccacagccagcgccctgcacttccccagcaccagcatcatccagcagagcagcccctacttcacccaccccaccatccgctaccaccaccaccacggccaggacagcctgaaggagtttgtgcagtttgtgtgcagtgatggcagcggccaggccaccggccagcccaacggcagcggccagggcaaggtgcccggcagcttcctgctgcccccacctcctcctgtggcccggcctgtgcccctgcccatgccagacagcaagagcaccagcacagccccagatggagctgccctgaccccacccagccccagctttgccaccaccggggccagcagcgccaacagatttgtgtccatcggccccagagatggcaacttcctgaacatcccccagcagagccagagctggttcctgtag

SEQ ID NO: 162200 - DNA, 1326 bp, Artificial Sequence
  Description of Artificial Sequence: Synthetic coding sequence
atgtacagcccctactgcctgacccaggatgagttccaccccttcatcgaggccctgctgccccacgtgcgggccttctcctacacctggttcaacctgcaggccaggaagaggaagtacttcaagaagcatgagaagaggatgagcaaggatgaggagagagctgtgaaggatgagctgctgggggagaagccagagatcaagcagaagtgggccagccggctgctggccaagctgaggaaggacatccggcctgagttcagagaagattttgtgctgaccatcaccgggaagaagccaccctgctgcgtgctgagcaacccagaccagaagggcaagatcagaagaattgactgcctgcggcaggccgacaaggtgtggaggctggacctggtgatggtgatcctcttcaagggcatccccctggagagcacagatggagagcggctgtacaagagcccccagtgcagcaaccctggcctgtgtgtgcagccccaccacatcggcgtgaccatcaaggagctggacctgtacctggcctactttgtgcacaccccagagagcggccagagcgacagcagcaaccagcagggagatgctgacatcaagcccctgcccaacggccacctgtccttccaggactgctttgtgaccagcggcgtgtggaatgtgacagagctggtgcgggtgtcccagacccctgtggccacagccagcggccccaacttcagcctggccgacctggagagccccagctactacaacatcaaccaggtgaccctgggcagaagaagcatcaccagcccccccagcaccagcaccaccaagaggcccaagagcattgatgacagcgagatggagagccctgtggatgatgtgttctacccaggcaccggccgcagccctgctgctggcagcagccagagcagcggctggcccaatgatgtggatgctggccctgccagcctgaagaagagcggcaagctggacttctgcagcgccctgagcagccagggcagcagccccaggatggccttcacccaccaccccctgcctgtgctggccggcgtgcggcccggcagcccccgggccacagccagcgccctgcacttccccagcaccagcatcatccagcagagcagcccctacttcacccaccccaccatccgctaccaccaccaccacggccaggacagcctgaaggagtttgtgcagtttgtgtgcagtgatggcagcggccaggccaccggccagcacagccagaggcaggccccacccctgcccaccggcctgagcgccagtgaccccggcacagccaccttctag

SEQ ID NO: 162201 - DNA, 1509 bp, Artificial Sequence
  Description of Artificial Sequence: Synthetic coding sequence
atgtacagcccctactgcctgacccaggatgagttccaccccttcatcgaggccctgctgccccacgtgcgggccttctcctacacctggttcaacctgcaggccaggaagaggaagtacttcaagaagcatgagaagaggatgagcaaggatgaggagagagctgtgaaggatgagctgctgggggagaagccagagatcaagcagaagtgggccagccggctgctggccaagctgaggaaggacatccggcctgagttcagagaagattttgtgctgaccatcaccgggaagaagccaccctgctgcgtgctgagcaacccagaccagaagggcaagatcagaagaattgactgcctgcggcaggccgacaaggtgtggaggctggacctggtgatggtgatcctcttcaagggcatccccctggagagcacagatggagagcggctgtacaagagcccccagtgcagcaaccctggcctgtgtgtgcagccccaccacatcggcgtgaccatcaaggagctggacctgtacctggcctactttgtgcacaccccagagagcggccagagcgacagcagcaaccagcagggagatgctgacatcaagcccctgcccaacggccacctgtccttccaggactgctttgtgaccagcggcgtgtggaatgtgacagagctggtgcgggtgtcccagacccctgtggccacagccagcggccccaacttcagcctggccgacctggagagccccagctactacaacatcaaccaggtgaccctgggcagaagaagcatcaccagcccccccagcaccagcaccaccaagaggcccaagagcattgatgacagcgagatggagagccctgtggatgatgtgttctacccaggcaccggccgcagccctgctgctggcagcagccagagcagcggctggcccaatgatgtggatgctggccctgccagcctgaagaagagcggcaagctggacttctgcagcgccctgagcagccagggcagcagccccaggatggccttcacccaccaccccctgcctgtgctggccggcgtgcggcccggcagcccccgggccacagccagcgccctgcacttccccagcaccagcatcatccagcagagcagcccctacttcacccaccccaccatccgctaccaccaccaccacggccaggacagcctgaaggagtttgtgcagtttgtgtgcagtgatggcagcggccaggccaccggccagcccaacggcagcggccagggcaaggtgcccggcagcttcctgctgcccccacctcctcctgtggcccggcctgtgcccctgcccatgccagacagcaagagcaccagcacagccccagatggagctgccctgaccccacccagccccagctttgccaccaccggggccagcagcgccaacagatttgtgtccatcggccccagagatggcaacttcctgaacatcccccagcagagccagagctggttcctgtag

SEQ ID NO: 162202 - DNA, 633 bp, Artificial Sequence
  Description of Artificial Sequence: Synthetic coding sequence
atgagcaaggatgaggagagagctgtgaaggatgagctgctgggggagaagccagagatcaagcagaagtgggccagccggctgctggccaagctgaggaaggacatccggcctgagttccgggaggactttgtgctgaccatcaccgggaagaagccaccctgctgcgtgctgagcaacccagaccagaagggcaagatcagaagaattgactgcctgcggcaggccgacaaggtgtggaggctggacctggtgatggtgatcctcttcaagggcatccccctggagagcacagatggagagcggctgtacaagagcccccagtgcagcaaccctggcctgtgtgtgcagccccaccacatcggcgtgaccatcaaggagctggacctgtacctggcctactttgtgcacaccccagagagcggccagagcgacagcagcaaccagcagggagatgctgacatcaagcccctgcccaacggccacctgtccttccaggactgctttgtgaccagcggcgtgtggaatgtgacagagctggtgtaccaccggctgctgctgcagcagcaccagggccccaccagcccctggaggacctggagggtgcctgccaccaccaccagcaccaggtag

SEQ ID NO: 162203 - DNA, 1071 bp, Artificial Sequence
  Description of Artificial Sequence: Synthetic coding sequence
atggccggcgtggcctgcctgggcaaggctgctgatgctgatgagtggtgtgacagcggcctgggcagcctgggcccagatgctgctgcccctgggggccctggcctgggcgctgagctgggccctggcctgtcctgggcccccctggtgtttggctacgtgacagaagatggagacacagccctgcacctggccgtcatccaccagcacgagcccttcctggacttcctgctgggcttctctgctggaacagagtacatggacctgcagaatgacctgggccagacagccctgcacctggccgccatcctgggggagaccagcacagtggagaagctgtatgctgctggggccggcctgtgtgtggccgagcggcggggccacacagccctgcacctggcctgccgggtgggcgcccacgcctgtgcccgggccctgctgcagccccggccccggcggccccgggaggccccagacacctacctggcccagggccctgacaggaccccagacaccaaccacacccctgtggccctgtacccagacagcgacctggagaaggaggaggaggagagcgaggaggactggaagctgcagctggaggctgaaaattatgagggccacacccccctgcacgtggccgtcatccacaaggatgtggagatggtgcggctgctgagagatgctggagctgacctggacaagccagagcccacctgtggccgcagccccctgcacctggccgtggaggcccaggccgcagatgtgctggagctgctgctgcgggccggggccaacccagctgccaggatgtatggaggccgcacccccctgggcagcgccatgctgcggcccaaccccatcctggcccggctgctgcgggcccacggggcccctgagcctgagggggaggatgagaagagcggcccctgcagcagcagcagtgacagcgacagcggagatgaaggagatgaatatgatgacatcgtggtgcacagcagccgcagccagacccggctgccccccaccccagccagcaagcccctgcctgatgaccccaggcctgtgtag

SEQ ID NO: 162204 - DNA, 921 bp, Artificial Sequence
  Description of Artificial Sequence: Synthetic coding sequence
atgaatggagccacagctgcctgggccccctgggtgaggacccagaggcccccagaggacctgggctgggcccgctcctgggcccggggctgccggggcctgcccagcagcagcgccaccagcctgaggatgggcacccgcttctctgctggaacagagtacatggacctgcagaatgacctgggccagacagccctgcacctggccgccatcctgggggagaccagcacagtggagaagctgtatgctgctggggccggcctgtgtgtggccgagcggcggggccacacagccctgcacctggcctgccgggtgggcgcccacgcctgtgcccgggccctgctgcagccccggccccggcggccccgggaggccccagacacctacctggcccagggccctgacaggaccccagacaccaaccacacccctgtggccctgtacccagacagcgacctggagaaggaggaggaggagagcgaggaggactggaagctgcagctggaggctgaaaattatgagggccacacccccctgcacgtggccgtcatccacaaggatgtggagatggtgcggctgctgagagatgctggagctgacctggacaagccagagcccacctgtggccgcagccccctgcacctggccgtggaggcccaggccgcagatgtgctggagctgctgctgcgggccggggccaacccagctgccaggatgtatggaggccgcacccccctgggcagcgccatgctgcggcccaaccccatcctggcccggctgctgcgggcccacggggcccctgagcctgagggggaggatgagaagagcggcccctgcagcagcagcagtgacagcgacagcggagatgaaggagtgtcccaggaggagcggcagggcagccctgctgggggcagcggctag

SEQ ID NO: 162205 - DNA, 1086 bp, Artificial Sequence
  Description of Artificial Sequence: Synthetic coding sequence
ctgcagaacagccggcagagccctgccaccggcggccgcctgcggggggcccctgaggccgccggggccatggccggcgtggcctgcctgggcaaggccgcagatgctgatgagtggtgtgacagcggcctgggcagcctgggcccagatgctgctgcccctgggggccctggcctgggcgctgagctgggccctggcctgtcctgggcccccctggtgtttggctacgtgacagaagatggagacacagccctgcacctggccgtcatccaccagcacgagcccttcctggacttcctgctgggcttctctgctggaacagagtacatggacctgcagaatgacctgggccagacagccctgcacctggccgccatcctgggggagaccagcacagtggagaagctgtatgctgctggagctggcctgtgtgtggccgagcggcggggccacacagccctgcacctggcctgccgggtgggcgcccacgcctgtgcccgggccctgctgcagccccggccccggcggccccgggaggccccagacacctacctggcccagggccctgacaggaccccagacaccaaccacacccctgtggccctgtacccagacagcgacctggagaaggaggaggaggagagcgaggaggactggaagctgcagctggaggccgagaactatgagggccacacccccctgcacgtggccgtcatccacaaggatgtggagatggtgcggctgctgagagatgctggagctgacctggacaagccagagcccacctgtggccgcagccccctgcacctggccgtggaggcccaggccgcagatgtgctggagctgctgctgcgggccggggccaacccagctgccaggatgtatggaggccgcacccccctgggcagcgccatgctgcggcccaaccccatcctggcccggctgctgcgggcccatggagcccctgagccagaaggagaagatgagaagagcggcccctgcagcagcagcagtgacagcgacagcggagatgagggcgtgtcccaggaggagcggcagggcagccctgctgggggcagcggctag

SEQ ID NO: 162206 - DNA, 1791 bp, Artificial Sequence
  Description of Artificial Sequence: Synthetic coding sequence
atgattgtggacaagctgctggatgacagccggggcggggagggcctgagagatgctgctgggggctgcggcctgatgaccagccccctgaacctgagctacttctacggggccagccccccagctgctgcccctggggcctgtgatgccagctgcagcgtgctgggccccagcgcccctggcagccctggcagtgacagcagtgacttcagcagcgccagctctgtgagcagctgtggggctgtggagagccgcagccggggcggggcccgggcagagcggcagcctgtggagccccacatgggcgtgggccggcagcagaggggccccttccagggcgtgcgggtgaagaacagcgtgaaggagctgctgctgcacatccgcagccacaagcagaaggccagcggccaggccgtggatgacttcaagacccagggcgtgaacatcgagcagttccgggagctgaagaacacagtgtcctacagcggcaagaggaagggccctgacagcctgagtgatggccctgcctgcaagaggcctgccctgctgcacagccagttcctgaccccaccccagacccccaccccaggagagagcatggaggatgtgcacctgaatgagcccaagcaggagagcagcgctgacctgctgcagaacatcatcaacatcaagaatgaatgttctcctgtgtccctgaacacagtgcagaccagcagctctgtgcagcagcagaatgatgcccacctgcacagcttctccatgatgcccagcagcgcctgtgaggccatggtgggccacgagatggccagtgacagcagcaacaccagcctgcccttcagcaacatgggcaaccccatgaacaccacccagctgggcaagagcctcttccagtggcaggtggagcaggaggagagcaagctggccaacatcagccaggaccagttcctgagcaaggatgctgatggagacaccttcctgcacatcgctgtggcccagggccggcgggccctgtcctatgtgctggccaggaagatgaatgccctgcacatgctggacatcaaggagcacaacggccagagcgccttccaggtggccgtggccgccaaccagcacctgattgtgcaggacctggtgaacatcggggcccaggtgaacaccacagactgctggggccgcacccccctgcacgtgtgtgccgagaagggccacagccaggtgctgcaggccatccagaagggagctgtgggcagcaaccagtttgtggacctggaggccaccaactatgatggcctgacccccctgcactgtgctgtgattgcccacaatgctgtggtgcatgagctgcagaggaaccagcagccccacagccctgaggtgcaggagctgctgctgaagaacaagagcctggtggacaccatcaagtgcctgatccagatgggcgctgctgtggaggccaaggacaggaagagcggccgcacagccctgcacctggccgctgaggaggccaacctggagctgatccgcctcttcctggagctgcccagctgcctgagctttgtgaatgccaaggcctacaacggcaacacagccctgcacgtggccgccagcctgcagtaccgcctgacccagctggatgctgtgcggctgctgatgaggaaaggagctgaccccagcaccaggaacctggagaatgagcagcctgtgcacctggtgcctgatggccctgtgggggagcagatccgccgcatcctgaagggcaagagcatccagcagagggccccaccctactag

SEQ ID NO: 162207 - DNA, 2157 bp, Artificial Sequence
  Description of Artificial Sequence: Synthetic coding sequence
atgattgtggacaagctgctggatgacagccggggcggggagggcctgagagatgctgctgggggctgcggcctgatgaccagccccctgaacctgagctacttctacggggccagccccccagctgctgcccctggggcctgtgatgccagctgcagcgtgctgggccccagcgcccctggcagccctggcagtgacagcagtgacttcagcagcgccagctctgtgagcagctgtggggctgtggagagccgcagccggggcggggcccgggcagagcggcagcctgtggagccccacatgggcgtgggccggcagcagaggggccccttccagggcgtgcgggtgaagaacagcgtgaaggagctgctgctgcacatccgcagccacaagcagaaggccagcggccaggccgtggatgacttcaagacccagggcgtgaacatcgagcagttccgggagctgaagaacacagtgtcctacagcggcaagaggaagggccctgacagcctgagtgatggccctgcctgcaagaggcctgccctgctgcacagccagttcctgaccccaccccagacccccaccccaggagagagcatggaggatgtgcacctgaatgagcccaagcaggagagcagcgctgacctgctgcagaacatcatcaacatcaagaatgaatgttctcctgtgtccctgaacacagtgcaggtgtcctggctgaaccctgtggtggtgccccagagcagccctgctgagcagtgccaggacttccacggcggccaggtgttcagccccccccagaagtgccagcccttccaggtgcggggcagccagcagatgattgaccaggccagcctgtaccagtacagcccccagaaccagcacgtggagcagcagccccactacacccacaagcccaccctggagtacagccccttccccatccccccccagagccctgcctatgagcccaacctgtttgatggccctgagagccagttctgccccaaccagagcctggtgtccctgctgggggaccagcgggagagtgaaaatattgccaaccccatgcagaccagcagctctgtgcagcagcagaatgatgcccacctgcacagcttctccatgatgcccagcagcgcctgtgaggccatggtgggccacgagatggccagtgacagcagcaacaccagcctgcccttcagcaacatgggcaaccccatgaacaccacccagctgggcaagagcctcttccagtggcaggtggagcaggaggagagcaagctggccaacatcagccaggaccagttcctgagcaaggatgctgatggagacaccttcctgcacatcgctgtggcccagggccggcgggccctgtcctatgtgctggccaggaagatgaatgccctgcacatgctggacatcaaggagcacaacggccagagcgccttccaggtggccgtggccgccaaccagcacctgattgtgcaggacctggtgaacatcggggcccaggtgaacaccacagactgctggggccgcacccccctgcacgtgtgtgccgagaagggccacagccaggtgctgcaggccatccagaagggagctgtgggcagcaaccagtttgtggacctggaggccaccaactatgatggcctgacccccctgcactgtgctgtgattgcccacaatgctgtggtgcatgagctgcagaggaaccagcagccccacagccctgaggtgcaggagctgctgctgaagaacaagagcctggtggacaccatcaagtgcctgatccagatgggcgctgctgtggaggccaaggacaggaagagcggccgcacagccctgcacctggccgctgaggaggccaacctggagctgatccgcctcttcctggagctgcccagctgcctgagctttgtgaatgccaaggcctacaacggcaacacagccctgcacgtggccgccagcctgcagtaccgcctgacccagctggatgctgtgcggctgctgatgaggaaaggagctgaccccagcaccaggaacctggagaatgagcagcctgtgcacctggtgcctgatggccctgtgggggagcagatccgccgcatcctgaagggcaagagcatccagcagagggccccaccctactag

SEQ ID NO: 162208 - DNA, 1857 bp, Artificial Sequence
  Description of Artificial Sequence: Synthetic coding sequence
atgggcgtgggccggcagcagaggggccccttccagggcgtgcgggtgaagaacagcgtgaaggagctgctgctgcacatccgcagccacaagcagaaggccagcggccaggccgtggatgacttcaagacccagggcgtgaacatcgagcagttccgggagctgaagaacacagtgtcctacagcggcaagaggaagggccctgacagcctgagtgatggccctgcctgcaagaggcctgccctgctgcacagccagttcctgaccccaccccagacccccaccccaggagagagcatggaggatgtgcacctgaatgagcccaagcaggagagcagcgctgacctgctgcagaacatcatcaacatcaagaatgaatgttctcctgtgtccctgaacacagtgcaggtgtcctggctgaaccctgtggtggtgccccagagcagccctgctgagcagtgccaggacttccacggcggccaggtgttcagccccccccagaagtgccagcccttccaggtgcggggcagccagcagatgattgaccaggccagcctgtaccagtacagcccccagaaccagcacgtggagcagcagccccactacacccacaagcccaccctggagtacagccccttccccatccccccccagagccctgcctatgagcccaacctgtttgatggccctgagagccagttctgccccaaccagagcctggtgtccctgctgggggaccagcgggagagtgaaaatattgccaaccccatgcagaccagcagctctgtgcagcagcagaatgatgcccacctgcacagcttctccatgatgcccagcagcgcctgtgaggccatggtgggccacgagatggccagtgacagcagcaacaccagcctgcccttcagcaacatgggcaaccccatgaacaccacccagctgggcaagagcctcttccagtggcaggtggagcaggaggagagcaagctggccaacatcagccaggaccagttcctgagcaaggatgctgatggagacaccttcctgcacatcgctgtggcccagggccggcgggccctgtcctatgtgctggccaggaagatgaatgccctgcacatgctggacatcaaggagcacaacggccagagcgccttccaggtggccgtggccgccaaccagcacctgattgtgcaggacctggtgaacatcggggcccaggtgaacaccacagactgctggggccgcacccccctgcacgtgtgtgccgagaagggccacagccaggtgctgcaggccatccagaagggagctgtgggcagcaaccagtttgtggacctggaggccaccaactatgatggcctgacccccctgcactgtgctgtgattgcccacaatgctgtggtgcatgagctgcagaggaaccagcagccccacagccctgaggtgcaggagctgctgctgaagaacaagagcctggtggacaccatcaagtgcctgatccagatgggcgctgctgtggaggccaaggacaggaagagcggccgcacagccctgcacctggccgctgaggaggccaacctggagctgatccgcctcttcctggagctgcccagctgcctgagctttgtgaatgccaaggcctacaacggcaacacagccctgcacgtggccgccagcctgcagtaccgcctgacccagctggatgctgtgcggctgctgatgaggaaaggagctgaccccagcaccaggaacctggagaatgagcagcctgtgcacctggtgcctgatggccctgtgggggagcagatccgccgcatcctgaagggcaagagcatccagcagagggccccaccctactag

SEQ ID NO: 162209 - DNA, 333 bp, Artificial Sequence
  Description of Artificial Sequence: Synthetic coding sequence
atgattgtggacaagctgctggatgacagccggggcggggagggcctgagagatgctgctgggggctgcggcctgatgaccagccccctgaacctgagctacttctacggggccagccccccagctgctgcccctggggcctgtgatgccagctgcagcgtgctgggccccagcgcccctggcagccctggcagtgacagcagtgacttcagcagcgccagctctgtgagcagctgtggggctgtggagagccgcagccggggcggggcccgggcagagcggcagcctgtggagccccacatgggcgtgggccggcagcagaggggcccctag

SEQ ID NO: 162210 - DNA, 1806 bp, Artificial Sequence
  Description of Artificial Sequence: Synthetic coding sequence
atgggcgtgggccggcagcagaggggccccttccagggcgtgcgggtgaagaacagcgtgaaggagctgctgctgcacatccgcagccacaagcagaaggccagcggccaggccgtggatgacttcaagacccagggcgtgaacatcgagcagttccgggagctgaagaacacagtgtcctacagcggcaagaggaagggccctgacagcctgagtgatggccctgcctgcaagaggcctgccctgctgcacagccagttcctgaccccaccccagacccccaccccaggagagagcatggaggatgtgcacctgaatgagcccaagcaggagagcagcgctgacctgctgcagaacatcatcaacatcaagaatgaatgttctcctgtgtccctgaacacagtgcaggtgtcctggctgaaccctgtggtggtgccccagagcagccctgctgagcagtgccaggacttccacggcggccaggtgttcagccccccccagaagtgccagcccttccaggtgcggggcagccagcagatgattgaccaggccagcctgtaccagtacagcccccagaaccagcacgtggagcagcagccccactacacccacaagcccaccctggagtacagccccttccccatccccccccagagccctgcctatgagcccaacctgtttgatggccctgagagccagttctgccccaaccagagcctggtgtccctgctgggggaccagcgggagagtgaaaatattgccaaccccatgcagaccagcagctctgtgcagcagcagaatgatgcccacctgcacagcttctccatgatgcccagcagcgcctgtgaggccatggtgggccacgagatggccagtgacagcagcaacaccagcctgcccttcagcaacatgggcaaccccatgaacaccacccagctgggcaagagcctcttccagtggcaggtggagcaggaggagagcaagctggccaacatcagccaggaccagttcctgagcaaggatgctgatggagacaccttcctgcacatcgctgtggcccagggccggcgggccctgtcctatgtgctggccaggaagatgaatgccctgcacatgctggacatcaaggagcacaacggccagagcgccttccaggtggccgtggccgccaaccagcacctgattgtgcaggacctggtgaacatcggggcccaggtgaacaccacagactgctggggccgcacccccctgcacgtgtgtgccgagaagggccacagccaggtgctgcaggccatccagaagggagctgtgggcagcaaccagtttgtggacctggaggccaccaactatgatggcctgacccccctgcactgtgctgtgattgcccacaatgctgtggtgcatgagctgcagaggaaccagcagccccacagccctgaggtgcaggagctgctgctgaagaacaagagcctggtggacaccatcaagtgcctgatccagatgggcgctgctgtggaggccaaggacaggaagagcggccgcacagccctgcacctggccgctgaggaggccaacctggagctgatccgcctcttcctggagctgcccagctgcctgagctttgtgaatgccaaggcctacaacggcaacacagccctgcacgtggccgccagcctgcagtaccgcctgacccagctggatgctgtgcggctgctgatgaggaaaggagctgaccccagcaccaggaacctggagaatgagcagcctgtgcacctggtgcctgatggccctgtgggggagcagtag

SEQ ID NO: 162211 - DNA, 393 bp, Artificial Sequence
  Description of Artificial Sequence: Synthetic coding sequence
atgggcgtgggccggcagcagaggggccccttccagggcgtgcgggtgaagaacagcgtgaaggagctgctgctgcacatccgcagccacaagcagaaggccagcggccaggccgtggatgacttcaagacccagggcgtgaacatcgagcagttccgggagctgaagaacacagtgtcctacagcggcaagaggaagggccctgacagcctgagtgatggccctgcctgcaagaggcctgccctgctgcacagccagttcctgaccccaccccagacccccaccccaggagagagcatggaggatgtgcacctgaatgagcccaagcaggagagcagcgctgacctgctgcagaacatcatcaacatcaagaatgaatgttctcctgtgtag

SEQ ID NO: 162212 - DNA, 1101 bp, Artificial Sequence
  Description of Artificial Sequence: Synthetic coding sequence
atgagcaaccccagcccccaggtgcctgaggaggaggccagcacctctgtgtgccggcccaagagctccatggccagcaccagccggcggcagaggcgggagcggcgcttccgccgctacctgtctgctggccgcctggtgcgggcccaggccctgctgcagaggcaccctggcctggatgtggatgctggccagcccccacccctgcaccgggcctgtgcccggcatgatgccccagccctgtgcctgctgctgcggctgggcgctgaccctgcccaccaggacagacatggagacacagccctgcacgccgccgcccggcagggcccagatgcctacacagacttcttcctgcccctgctgagccgctgccccagcgccatgggcatcaagaacaaggatggagagaccccaggccagatcctgggctggggccccccctgggacagcgctgaggaggaggaggaggatgatgccagcaaggagcgggagtggaggcagaagctgcagggagatgccagccatgagacccaggagcctgagagcttcagcgcctggagcgaccggctggcccgggagcacgcccagaagtgccagcagcagcagcgggaggccgagggcagcagaagaccacccagggctgagggcagcagccagagctggaggcagcaggaggaggagcagaggctcttccgggagcgggcccgggccaaggaggaggagctgcgggagagccgggcccggcgggcccaggaggccctgggggaccgggagcccaagcccacccgggccggcccccgggaggagcaccccaggggggccggccggggcagcctgtggaggtttggagatgtgccctggccctgccctgggggcggggaccctgaggccatggccgccgccctggtggcccggggcccccccctggaggagcagggcgccctgcggcgctacctgcgggtgcagcaggtgcgctggcacccagaccgcttcctgcagcgcttccgcagccagatcgagacctgggagctgggccgggtgatgggcgctgtgacagccctgagccaggccctgaacagacatgctgaggccctgaagtag

SEQ ID NO: 162213 - DNA, 1077 bp, Artificial Sequence
  Description of Artificial Sequence: Synthetic coding sequence
atggccagcaccagccggcggcagaggcgggagcggcgcttccgccgctacctgtctgctggccgcctggtgcgggcccaggccctgctgcagaggcaccctggcctggatgtggatgctggccagcccccacccctgcaccgggcctgtgcccggcatgatgccccagccctgtgcctgctgctgcggctgggcgctgaccctgcccaccaggacagacatggagacacagccctgcatgctgctgcccggcagggcccagatgcctacacagacttcttcctgcccctgctgagccgctgccccagcgccatgggcatcaagaacaaggatggagagaccccaggccagatcctgggctggggccccccctgggacagcgctgaggaggaggaggaggatgatgccagcaaggagcgggagtggaggcagaagctgcagggcgagctggaggatgagtggcaggaggtgatgggccgctttgaaggagatgccagccatgagacccaggagcctgagagcttcagcgcctggagcgaccggctggcccgggagcacgcccagaagtgccagcagcagcagcgggaggccgagggcagcagaagaccacccagggctgagggcagcagccagagctggaggcagcaggaggaggagcagaggctcttccgggagcgggcccgggccaaggaggaggagctgcgggagagccgggcccggcgggcccaggaggccctgggggaccgggagcccaagcccacccgggccggcccccgggaggagcaccccaggggggccggccggggcagcctgtggaggtttggagatgtgccctggccctgccctgggggcggggaccctgaggccatggccgccgccctggtggcccggggcccccccctggaggagcagggcgccctgcggcgctacctgcgggtgcagcaggtgcgctggcacccagaccgcttcctgcagcgcttccgcagccagatcgagacctgggagctgggccgggtgatgggcgctgtgacagccctgagccaggccctgaacagacatgctgaggccctgaagtag

SEQ ID NO: 162214 - DNA, 1146 bp, Artificial Sequence
  Description of Artificial Sequence: Synthetic coding sequence
atgagcaaccccagcccccaggtgcctgaggaggaggccagcacctctgtgtgccggcccaagagctccatggccagcaccagccggcggcagaggcgggagcggcgcttccgccgctacctgtctgctggccgcctggtgcgggcccaggccctgctgcagaggcaccctggcctggatgtggatgctggccagcccccacccctgcaccgggcctgtgcccggcatgatgccccagccctgtgcctgctgctgcggctgggcgctgaccctgcccaccaggacagacatggagacacagccctgcacgccgccgcccggcagggcccagatgcctacacagacttcttcctgcccctgctgagccgctgccccagcgccatgggcatcaagaacaaggatggagagaccccaggccagatcctgggctggggccccccctgggacagcgctgaggaggaggaggaggatgatgccagcaaggagcgggagtggaggcagaagctgcagggcgagctggaggatgagtggcaggaggtgatgggccgctttgaaggagatgccagccatgagacccaggagcctgagagcttcagcgcctggagcgaccggctggcccgggagcacgcccagaagtgccagcagcagcagcgggaggccgagggcagccggcggccccccagggctgagggcagcagccagagctggaggcagcaggaggaggagcagaggctcttccgggagcgggcccgggccaaggaggaggagctgcgggagagccgggcccggcgggcccaggaggccctgggggaccgggagcccaagcccaccagggctggcccccgggaggagcaccccagaggagctggccggggcagcctgtggaggtttggagatgtgccctggccctgccctgggggcggggaccctgaggccatggctgctgccctggtggcccggggcccccccctggaggagcagggcgccctgcggcgctacctgcgggtgcagcaggtgcgctggcacccagaccgcttcctgcagcgcttccgcagccagatcgagacctgggagctgggccgggtgatgggcgctgtgacagccctgagccaggccctgaacagacatgctgaggccctgaagtag

SEQ ID NO: 162215 - DNA, 1101 bp, Artificial Sequence
  Description of Artificial Sequence: Synthetic coding sequence
atgagcaaccccagcccccaggtgcctgaggaggaggccagcacctctgtgtgccggcccaagagctccatggccagcaccagccggcggcagaggcgggagcggcgcttccgccgctacctgtctgctggccgcctggtgcgggcccaggccctgctgcagaggcaccctggcctggatgtggatgctggccagcccccacccctgcaccgggcctgtgcccggcatgatgccccagccctgtgcctgctgctgcggctgggcgctgaccctgcccaccaggacagacatggagacacagccctgcacgccgccgcccggcagggcccagatgcctacacagacttcttcctgcccctgctgagccgctgccccagcgccatgggcatcaagaacaaggatggagagaccccaggccagatcctgggctggggccccccctgggacagcgctgaggaggaggaggaggatgatgccagcaaggagcgggagtggaggcagaagctgcagggagatgccagccatgagacccaggagcctgagagcttcagcgcctggagcgaccggctggcccgggagcacgcccagaagtgccagcagcagcagcgggaggccgagggcagctgcaggcctcccagggctgagggcagcagccagagctggaggcagcaggaggaggagcagaggctcttccgggagcgggcccgggccaaggaggaggagctgcgggagagccgggcccggcgggcccaggaggccctgggggaccgggagcccaagcccacccgggccggcccccgggaggagcaccccaggggggccggccggggcagcctgtggaggtttggagatgtgccctggccctgccctgggggcggggaccctgaggccatggccgccgccctggtggcccggggcccccccctggaggagcagggcgccctgcggcgctacctgcgggtgcagcaggtgcgctggcacccagaccgcttcctgcagcgcttccgcagccagatcgagacctgggagctgggccgggtgatgggcgctgtgacagccctgagccaggccctgaacagacatgctgaggccctgaagtag

SEQ ID NO: 162216 - DNA, 1077 bp, Artificial Sequence
  Description of Artificial Sequence: Synthetic coding sequence
atggccagcaccagccggcggcagaggcgggagcggcgcttccgccgctacctgtctgctggccgcctggtgcgggcccaggccctgctgcagaggcaccctggcctggatgtggatgctggccagcccccacccctgcaccgggcctgtgcccggcatgatgccccagccctgtgcctgctgctgcggctgggcgctgaccctgcccaccaggacagacatggagacacagccctgcatgctgctgcccggcagggcccagatgcctacacagacttcttcctgcccctgctgagccgctgccccagcgccatgggcatcaagaacaaggatggagagaccccaggccagatcctgggctggggccccccctgggacagcgctgaggaggaggaggaggatgatgccagcaaggagcgggagtggaggcagaagctgcagggcgagctggaggatgagtggcaggaggtgatgggccgctttgaaggagatgccagccatgagacccaggagcctgagagcttcagcgcctggagcgaccggctggcccgggagcacgcccagaagtgccagcagcagcagcgggaggccgagggcagctgcaggcctcccagggctgagggcagcagccagagctggaggcagcaggaggaggagcagaggctcttccgggagcgggcccgggccaaggaggaggagctgcgggagagccgggcccggcgggcccaggaggccctgggggaccgggagcccaagcccacccgggccggcccccgggaggagcaccccaggggggccggccggggcagcctgtggaggtttggagatgtgccctggccctgccctgggggcggggaccctgaggccatggccgccgccctggtggcccggggcccccccctggaggagcagggcgccctgcggcgctacctgcgggtgcagcaggtgcgctggcacccagaccgcttcctgcagcgcttccgcagccagatcgagacctgggagctgggccgggtgatgggcgctgtgacagccctgagccaggccctgaacagacatgctgaggccctgaagtag

SEQ ID NO: 162217 - DNA, 1146 bp, Artificial Sequence
  Description of Artificial Sequence: Synthetic coding sequence
atgagcaaccccagcccccaggtgcctgaggaggaggccagcacctctgtgtgccggcccaagagctccatggccagcaccagccggcggcagaggcgggagcggcgcttccgccgctacctgtctgctggccgcctggtgcgggcccaggccctgctgcagaggcaccctggcctggatgtggatgctggccagcccccacccctgcaccgggcctgtgcccggcatgatgccccagccctgtgcctgctgctgcggctgggcgctgaccctgcccaccaggacagacatggagacacagccctgcacgccgccgcccggcagggcccagatgcctacacagacttcttcctgcccctgctgagccgctgccccagcgccatgggcatcaagaacaaggatggagagaccccaggccagatcctgggctggggccccccctgggacagcgctgaggaggaggaggaggatgatgccagcaaggagcgggagtggaggcagaagctgcagggcgagctggaggatgagtggcaggaggtgatgggccgctttgaaggagatgccagccatgagacccaggagcctgagagcttcagcgcctggagcgaccggctggcccgggagcacgcccagaagtgccagcagcagcagcgggaggccgagggcagctgccggccccccagggctgagggcagcagccagagctggaggcagcaggaggaggagcagaggctcttccgggagcgggcccgggccaaggaggaggagctgcgggagagccgggcccggcgggcccaggaggccctgggggaccgggagcccaagcccaccagggctggcccccgggaggagcaccccagaggagctggccggggcagcctgtggaggtttggagatgtgccctggccctgccctgggggcggggaccctgaggccatggctgctgccctggtggcccggggcccccccctggaggagcagggcgccctgcggcgctacctgcgggtgcagcaggtgcgctggcacccagaccgcttcctgcagcgcttccgcagccagatcgagacctgggagctgggccgggtgatgggcgctgtgacagccctgagccaggccctgaacagacatgctgaggccctgaagtag

SEQ ID NO: 162218 - DNA, 1101 bp, Artificial Sequence; identical to SEQ ID NO: 162215
  Description of Artificial Sequence: Synthetic coding sequence

SEQ ID NO: 162219 - DNA, 1146 bp, Artificial Sequence; identical to SEQ ID NO: 162217
  Description of Artificial Sequence: Synthetic coding sequence

SEQ ID NO: 162220 - DNA, 1101 bp, Artificial Sequence; identical to SEQ ID NO: 162215
  Description of Artificial Sequence: Synthetic coding sequence

SEQ ID NO: 162221 - DNA, 1101 bp, Artificial Sequence; identical to SEQ ID NO: 162215
  Description of Artificial Sequence: Synthetic coding sequence

SEQ ID NO: 162222 - DNA, 1146 bp, Artificial Sequence; identical to SEQ ID NO: 162217
  Description of Artificial Sequence: Synthetic coding sequence

SEQ ID NO: 162223 - DNA, 1077 bp, Artificial Sequence; identical to SEQ ID NO: 162216
  Description of Artificial Sequence: Synthetic coding sequence

SEQ ID NO: 162224 - DNA, 1101 bp, Artificial Sequence; identical to SEQ ID NO: 162215
  Description of Artificial Sequence: Synthetic coding sequence

SEQ ID NO: 162225 - DNA, 1077 bp, Artificial Sequence; identical to SEQ ID NO: 162216
  Description of Artificial Sequence: Synthetic coding sequence

SEQ ID NO: 162226 - DNA, 1146 bp, Artificial Sequence; identical to SEQ ID NO: 162217
  Description of Artificial Sequence: Synthetic coding sequence

SEQ ID NO: 162227 - DNA, 1077 bp, Artificial Sequence; identical to SEQ ID NO: 162216
  Description of Artificial Sequence: Synthetic coding sequence

SEQ ID NO: 162228 - DNA, 1146 bp, Artificial Sequence; identical to SEQ ID NO: 162217
  Description of Artificial Sequence: Synthetic coding sequence

SEQ ID NO: 162229 - DNA, 1101 bp, Artificial Sequence; identical to SEQ ID NO: 162215
  Description of Artificial Sequence: Synthetic coding sequence

SEQ ID NO: 162230 - DNA, 1077 bp, Artificial Sequence; identical to SEQ ID NO: 162216
  Description of Artificial Sequence: Synthetic coding sequence

SEQ ID NO: 162231 - DNA, 1146 bp, Artificial Sequence; identical to SEQ ID NO: 162217
  Description of Artificial Sequence: Synthetic coding sequence

SEQ ID NO: 162232 - DNA, 1077 bp, Artificial Sequence; identical to SEQ ID NO: 162216
  Description of Artificial Sequence: Synthetic coding sequence

SEQ ID NO: 162233 - DNA, 699 bp, Artificial Sequence
  Description of Artificial Sequence: Synthetic coding sequence
atggccagcaccagccggcggcagaggcgggagcggcgcttccgccgctacctgtctgctggccgcctggtgcgggcccaggccctgctgcagaggcaccctggcctggatgtggatgctggccagcccccacccctgcaccgggcctgtgcccggcatgatgccccagccctgtgcctgctgctgcggctgggcgctgaccctgcccaccaggacagacatggagacacagccctgcatgctgctgcccggcagggcccagatgcctacacagacttcttcctgcccctgctgagccgctgccccagcgccatgggcatcaagaacaaggatggagagaccccaggccagatcctgggctggggccccccctgggacagcgctgaggaggaggaggaggatgatgccagcaaggagcgggagtggaggcagaagctgcagggcgagctggaggatgagtggcaggaggtgatgggccgctttgaaggagatgccagccatgagacccaggagcctgagagcttcagcgcctggagcgaccggctggcccgggagcacgcccagaagtgccagcagcagcagcgggaggccgagggcagcagaagaccacccagggctgagggcagcagccagagctggaggcagcaggaggaggagcagaggctcttccgggagcgggcccgggccaaggaggagtag

SEQ ID NO: 162234 - DNA, 699 bp, Artificial Sequence
  Description of Artificial Sequence: Synthetic coding sequence
atggccagcaccagccggcggcagaggcgggagcggcgcttccgccgctacctgtctgctggccgcctggtgcgggcccaggccctgctgcagaggcaccctggcctggatgtggatgctggccagcccccacccctgcaccgggcctgtgcccggcatgatgccccagccctgtgcctgctgctgcggctgggcgctgaccctgcccaccaggacagacatggagacacagccctgcatgctgctgcccggcagggcccagatgcctacacagacttcttcctgcccctgctgagccgctgccccagcgccatgggcatcaagaacaaggatggagagaccccaggccagatcctgggctggggccccccctgggacagcgctgaggaggaggaggaggatgatgccagcaaggagcgggagtggaggcagaagctgcagggcgagctggaggatgagtggcaggaggtgatgggccgctttgaaggagatgccagccatgagacccaggagcctgagagcttcagcgcctggagcgaccggctggcccgggagcacgcccagaagtgccagcagcagcagcgggaggccgagggcagctgcaggcctcccagggctgagggcagcagccagagctggaggcagcaggaggaggagcagaggctcttccgggagcgggcccgggccaaggaggagtag

SEQ ID NO: 162235 - DNA, 699 bp, Artificial Sequence; identical to SEQ ID NO: 162234
  Description of Artificial Sequence: Synthetic coding sequence

SEQ ID NO: 162236 - DNA, 699 bp, Artificial Sequence; identical to SEQ ID NO: 162234
  Description of Artificial Sequence: Synthetic coding sequence

SEQ ID NO: 162237 - DNA, 699 bp, Artificial Sequence; identical to SEQ ID NO: 162234
  Description of Artificial Sequence: Synthetic coding sequence

SEQ ID NO: 162238 - DNA, 699 bp, Artificial Sequence; identical to SEQ ID NO: 162234
  Description of Artificial Sequence: Synthetic coding sequence

SEQ ID NO: 162239 - DNA, 699 bp, Artificial Sequence; identical to SEQ ID NO: 162234
  Description of Artificial Sequence: Synthetic coding sequence

SEQ ID NO: 162240 - DNA, 3900 bp, Artificial Sequence
  Description of Artificial Sequence: Synthetic coding sequence
atggacagcctggaccacatgctgacagaccccctggagctgggcccctgtggagatggccacggcacccgcatcatggaggactgcctgctgggcggcaccagggtgtccctgcctgaggacctgctggaggaccctgagatcttctttgatgtggtgtccctgagcacctggcaggaggtgctgagtgacagccagcgggagcacctgcagcagttcctgccccagttcccagaagattctgctgagcagcagaatgagctgatcctggccctcttcagcggggagaacttccgcttcggcaaccccctgcacatcgcccagaagctgttcagagatggccacttcaaccctgaggtggtgaagtaccggcagctgtgcttcaagagccagtacaagcgctacctgaacagccagcagcagtacttccaccggctgctgaagcagatcctggccagcagaagtgacctgctggagatggcccggcgcagcggccctgccctgcccttccggcagaagaggcccagccccagcaggaccccagaggagcgggagtggaggacccagcagcgctacctgaaggtgctgcgggaggtgaaggaggagtgtggggacacagccctgagcagtgatgaggaggacctgagctcctggctgcccagcagccctgcccggagccccagccctgctgtgcccctgcgggtggtgcccaccctgagcaccacagacatgaagacagctgacaaggtggagctgggggacagcgacctgaagatcatgctgaagaagcaccacgagaagaggaagcaccagcctgaccacccagacctgctgactggagacctgaccctgaatgacatcatgaccagggtgaatgccggcaggaagggcagcctggccgccctgtatgacctggccgtgctgaagaagaaggtgaaggagaaggaggagaagaagaagaagaagatcaagaccatcaagtctgaggccgaggacctggccgagcccctgagcagcacagagggcgtggcccccctgagccaggcccccagccccctggccatcccagccatcaaggaggagcccctggaggacctgaagccctgcctgggcatcaatgagatcagcagcagcttcttcagcctgctgctggagatcctgctgctggagagccaggccagcctgcccatgctggaggagcgggtgctggactggcagagcagccctgccagcagcctgaacagctggttctctgctgcccccaactgggccgagctggtgctgcctgccctgcagtacctggccggggagagcagagctgtgcccagcagcttcagcccctttgtggagttcaaggagaagacccagcagtggaagctgctgggccagagccaggacaatgagaaggagctggccgccctcttccagctgtggctggagaccaaggaccaggccttctgcaagcaggagaatgaagacagcagtgatgccaccacccctgtgccccgggtgaggacagattatgtggtgcggcccagcactggagaggagaagagggtcttccaggagcaggagcgctaccgctacagccagccccacaaggccttcaccttcaggatgcacggctttgaatctgtggtgggccctgtgaagggcgtgtttgacaaggagaccagcctgaacaaggcccgggagcacagcctgctgcggagtgacaggcctgcctacgtgaccatcctgagcctggtgagagatgctgctgcccggctgcccaacggggagggcaccagggctgagatctgtgagctgctgaaggacagccagttcctggccccagatgtgaccagcacccaggtgaacacagtggtgtctggggccctggaccggctgcactatgagaaggacccctgtgtgaagtatgacatcggcaggaagctgtggatctacctgcaccgggacagaagtgaggaggagtttgagcgcatccaccaggcccaggccgctgctgccaaggccaggaaggccctgcagcagaagcccaagccacccagcaaggtgaagagcagcagcaaggagagcagcatcaaggtgctgagcagcggccccagcgagcagagccagatgagcctgagtgacagctccatgccacccacccctgtgacccctgtgacccccaccaccccagccctgcctgccatccccatcagccccccacctgtgtctgctgtgaacaagagcggccccagcacagtgtctgagcccgccaagagcagcagtggagtgctgctggtgagcagccccaccatgccccacctgggcaccatgctgagccctgccagcagccagacagcccccagcagccaggccgccgcccgggtggtgagccacagcggcagcgctggcctgagccaggtgcgggtggtggcccagcccagcctgcctgctgtgccccagcagagcggcggccctgcccagaccctgccccagatgcctgctggcccccagatccgggtgcctgccacagccacccagaccaaggtggtgccccagacagtgatggccaccgtgcctgtgaaggcccagaccacagctgccaccgtgcagaggcctggccctggccagacaggcctgactgtgaccagcctgcctgccacagccagccctgtgtccaagccagccaccagcagccctggcaccagcgcccccagcgccagcacagctgctgtgatccagaatgtgacaggccagaacatcatcaagcaggtggccatcaccggccagctgggcgtgaagccccagacaggcaacagcatccccctgacagccaccaacttccgcatccagggcaaggatgtgctgcggctgccccccagcagcatcaccacagatgccaagggccagacagtgctgcgcatcaccccagacatgatggccaccctggccaagagccaggtgaccaccgtgaagctgacccaggacctgtttggaactggaggcaacaccaccgggaagggcatcagcgccaccctgcacgtgaccagcaaccctgtgcatgctgctgacagccctgccaaggccagcagcgccagcgcccccagcagcacccccaccggcaccaccgtggtgaaggtgaccccagacctgaagcccacagaggccagcagcagcgccttccggctgatgcctgccctgggcgtgtctgtggccgaccagaagggcaagagcacagtggccagcagcgaggccaagccagctgccaccatccgcatcgtgcagggcctgggcgtgatgccacccaaggccggccagaccatcaccgtggccacccacgccaagcagggcgcctctgtggccagcggcagcggcaccgtgcacaccagcgctgtgtccctgcccagcatgaatgctgctgtgtccaagacagtggccgtggccagcggggccgccagcacccccatcagcatcagcactggagcccccaccgtgcggcaggtgcctgtgtccaccaccgtggtgtccaccagccaggccggcaagctgcccacccgcatcaccgtgcccctgagcgtcatcagccagcccatgaagggcaagtctgtggtgacagcccccatcatcaagggcaacctgggcgccaacctgagcggcctgggcaggaacatcatcctgaccaccatgcctgctggcaccaagctgattgctggcaacaagcctgtgtccttcctgacagcccagcagctgcagcagctgcagcagcagggccaggccacccaggtgcgcatccagacagtgcctgccagccacctgcagcagggcacagccagcggcagcagcaaggctgtgtccacagtggtggtgaccacagcccccagccccaagcaggcccctgagcagcagtag

SEQ ID NO: 162241 - DNA, 3900 bp, Artificial Sequence; identical to SEQ ID NO: 162240
  Description of Artificial Sequence: Synthetic coding sequence

SEQ ID NO: 162242 - DNA, 3900 bp, Artificial Sequence; identical to SEQ ID NO: 162240
  Description of Artificial Sequence: Synthetic coding sequence

SEQ ID NO: 162243 - DNA, 3975 bp, Artificial Sequence
  Description of Artificial Sequence: Synthetic coding sequence
atgcacgtgtttgtgcagagcacctgtggggaggagaccatggacagcctggaccacatgctgacagaccccctggagctgggcccctgtggagatggccacggcacccgcatcatggaggactgcctgctgggcggcaccagggtgtccctgcctgaggacctgctggaggaccctgagatcttctttgatgtggtgtccctgagcacctggcaggaggtgctgagtgacagccagcgggagcacctgcagcagttcctgccccagtttcctgaggacagcgctgagcagcagaatgaactcatcctggccctcttctctggagagaacttccgctttggaaaccccctgcacatcgcccagaagctgttcagagatggccacttcaaccctgaggtggtgaagtaccggcagctgtgcttcaagagccagtacaagcgctacctgaacagccagcagcagtacttccaccggctgctgaagcagatcctggccagcagaagtgacctgctggagatggccaggagaagtggccctgccctgcccttccggcagaagaggcccagccccagcaggaccccagaggagcgggagtggaggacccagcagcgctacctgaaggtgctgcgggaggtgaaggaggagtgtggggacacagccctgagcagtgatgaggaggccaccctggacctgcaggagcagttctcctttgaggacctgagctcctggctgcccagcagccctgcccggagccccagccctgctgtgcccctgcgggtggtgcccaccctgagcaccacagacatgaagacagctgacaaggtggagctgggggacagcgacctgaagatcatgctgaagaagcaccacgagaagaggaagcaccagcctgaccacccagacctgctgaccggggacctgaccctgaatgacatcatgaccagggtgaatgccggcaggaagggcagcctggccgccctgtatgacctggccgtgctgaagaagaaggtgaaggagaaggaggagaagaagaagaagaagatcaagaccatcaagtctgaggccgaggacctggccgagcccctgagcagcacagaaggagtggcccccctgagccaggcccccagccccctggccatcccagccatcaaggaggagcccctggaggacctgaagccctgcctgggcatcaatgagatcagcagcagcttcttcagcctgctgctggagatcctgctgctggagagccaggccagcctgcccatgctggaggagcgggtgctggactggcagagcagccctgccagcagcctgaacagctggttctctgctgcccccaactgggccgagctggtgctgcctgccctgcagtacctggccggggagagcagagctgtgcccagcagcttcagcccctttgtggagttcaaggagaagacccagcagtggaagctgctgggccagagccaggacaatgagaaggagctggccgccctcttccagctgtggctggagaccaaggaccaggccttctgcaagcaggagaatgaagacagcagtgatgccaccacccctgtgccccgggtgaggacagattatgtggtgcggcccagcactggagaggagaagagggtcttccaggagcaggagcgctaccgctacagccagccccacaaggccttcaccttcaggatgcacggctttgagagcgtggtgggccctgtgaagggcgtgtttgacaaggagaccagcctgaacaaggcccgggagcacagcctgctgcggagtgacaggcctgcctacgtgaccatcctgagcctggtgagagatgctgctgcccggctgcccaatggagagggcaccagggctgagatctgtgagctgctgaaggacagccagttcctggccccagatgtgaccagcacccaggtgaacacagtggtgtctggggccctggaccggctgcactatgagaaggacccctgtgtgaagtatgacattggaaggaagctgtggatctacctgcaccgggacagaagtgaggaggagtttgagcgcatccaccaggcccaggccgccgccgccaaggccaggaaggccctgcagcagaagcccaagccacccagcaaggtgaagagcagcagcaaggagagcagcatcaaggtgctgagcagcggccccagcgagcagagccagatgagcctgagtgacagctccatgccacccacccctgtgacccctgtgacccccaccaccccagccctgcctgccatccccatcagccccccacctgtgtctgctgtgaacaagagcggccccagcacagtgtctgagcccgccaagagcagcagcggcgtgctgctggtgagcagccccaccatgccccacctgggcaccatgctgagccctgccagcagccagacagcccccagcagccaggccgccgcccgggtggtgagccacagcggcagcgctggcctgagccaggtgcgggtggtggcccagcccagcctgcctgctgtgccccagcagagcggcggccctgcccagaccctgccccagatgcctgctggcccccagatccgggtgcctgccacagccacccagaccaaggtggtgccccagacagtgatggccaccgtgcctgtgaaggcccagaccacagctgccaccgtgcagaggcctggccctggccagacaggcctgactgtgaccagcctgcctgccacagccagccctgtgtccaagccagccaccagcagccctggcaccagcgcccccagcgccagcacagctgctgtgatccagaatgtgacaggccagaacatcatcaagcaggtggccatcaccggccagctgggcgtgaagccccagacaggcaacagcatccccctgacagccaccaacttccgcatccagggcaaggatgtgctgcggctgccccccagcagcatcaccacagatgccaagggccagacagtgctgcgcatcaccccagacatgatggccaccctggccaagagccaggtgaccaccgtgaagctgacccaggacctgtttggcaccggcggcaacaccaccgggaagggcatcagcgccaccctgcacgtgaccagcaaccctgtgcacgccgctgacagccctgccaaggccagcagcgccagcgcccccagcagcacccccaccggcaccaccgtggtgaaggtgaccccagacctgaagcccacagaggccagcagcagcgccttccggctgatgcctgccctgggcgtgtctgtggccgaccagaagggcaagagcacagtggccagcagcgaggccaagccagctgccaccatcagaattgtgcagggcctgggcgtgatgccacccaaggccggccagaccatcaccgtggccacccacgccaagcagggcgcctctgtggccagcggcagcggcaccgtgcacaccagcgctgtgtccctgcccagcatgaatgctgctgtgtccaagacagtggccgtggccagcggggccgccagcacccccatcagcatcagcactggagcccccaccgtgcggcaggtgcctgtgtccaccaccgtggtgtccaccagccaggccggcaagctgcccacccgcatcaccgtgcccctgagcgtcatcagccagcccatgaagggcaagtctgtggtgacagcccccatcatcaagggcaacctgggcgccaacctgagcggcctgggcaggaacatcatcctgaccaccatgcctgctggcaccaagctgattgctggcaacaagcctgtgtccttcctgacagcccagcagctgcagcagctgcagcagcagggccaggccacccaggtgcgcatccagacagtgcctgccagccacctgcagcagggcacagccagcggcagcagcaaggctgtgtccacagtggtggtgaccacagcccccagccccaagcaggcccctgagcagcagtag

SEQ ID NO: 162244 - DNA, 1389 bp, Artificial Sequence
  Description of Artificial Sequence: Synthetic coding sequence
atgcagctgaggaagatgcagacagtgaagaaggagcaggccagcctggatgccagcagcaatgtggacaagatgatggtgctgaacagcgccctgacagaggtgtctgaggacagcaccactggagaggagctgctgctgtctgagggctctgtgggcaagaacaagagcagcgcctgcaggaggaagcgggagttcatcccagatgagaagaaggatgccatgtactgggagaagaggaggaagaacaatgaggccgccaagaggagccgggagaagaggcggctgaatgacctggtgctggagaacaagctgattgccctgggggaggagaatgccaccctgaaggccgagctgctgagcctgaagctgaagtttggcctcatcagcagcacagcctatgcccaggagatccagaagctgagcaacagcacagctgtgtacttccaggactaccagaccagcaagagcaatgtgtcctcctttgtggatgagcacgagcccagcatggtgagcagcagctgcatcagcgtcatcaagcacagcccccagagcagcctgagtgatgtgtctgaggtgtcctctgtggagcacacccaggagagctctgtgcagggcagctgccgcagccctgagaacaagttccagatcatcaagcaggagcccatggagctggagagctacacccgggagcccagagatgaccggggcagctacacagccagcatctaccagaactacatgggcaacagcttcagcggctacagccacagcccccccctgctgcaggtgaacagaagcagcagcaacagccccaggaccagcgagacagatgatggagtggtgggcaagagcagtgatggagaagatgagcagcaggtgcccaagggccccatccacagccctgtggagctgaagcacgtgcacgccaccgtggtgaaggtgcctgaggtgaacagcagcgccctgccccacaagctgcgcatcaaggccaaggccatgcagatcaaggtggaggcctttgacaatgaatttgaggccacccagaagctgagcagccccatcgacatgaccagcaagaggcactttgagctggagaagcacagcgcccccagcatggtgcacagcagcctgacccccttctctgtgcaggtgaccaacatccaggactggagcctgaagtctgagcactggcaccagaaggagctgagcggcaagacccagaacagcttcaagacaggagtggtggagatgaaggacagcggctacaaggtgtctgaccctgaaaatctctacctgaagcagggcatcgccaacctgtctgctgaggtggtgtccctgaagaggctgattgccacccagcccatcagcgccagtgacagcggctag

SEQ ID NO: 162245 - DNA, 1389 bp, Artificial Sequence; identical to SEQ ID NO: 162244
  Description of Artificial Sequence: Synthetic coding sequence

SEQ ID NO: 162246 - DNA, 1488 bp, Artificial Sequence
  Description of Artificial Sequence: Synthetic coding sequence
atggccgagcccaccagtgactttgagacccccatcggctggcacgccagccctgagctgacccccaccctgggccccctgagtgacacagccccaccccgggacagctggatgttctgggccatgctgcccccacctcctccacccctgaccagcagcctgcctgctgctggcagcaagcccagcagcgagagccagccccccatggaggcccagagcctgcccggggcccctcctccatttgatgcccagatcctgcccggggcccagcccccatttgatgcccagagccccctggacagccagccccagcccagcggccagccctggaacttccacgccagcacctcctggtactggaggcagagcagtgaccgcttccccaggcaccagaagagcttcaacccagctgtgaagaacagctactaccccaggaaatatgatgccaagttcacagacttcagcctgccccccagcaggaagcagaagaagaagaagaggaaggagcccgtcttccacttcttctgtgacacctgtgaccggggcttcaagaaccaggagaagtatgacaagcacatgtctgagcacaccaagtgcccagagctggactgcagcttcaccgcccacgagaagatcgtgcagttccactggaggaacatgcacgcccctggcatgaagaagatcaagctggacaccccagaggagatcgcccgctggagggaggagaggaggaagaactaccccaccctggccaacattgaaaggaagaagaagctgaagctggagaaggagaagagaggagctgtgctgaccaccacccagtatggcaagatgaagggcatgagccgccacagccagatggccaagatccgcagccctgggaagaaccacaagtggaagaatgacaacagccggcagagagctgtgacaggcagcggcagccacctgtgtgacctgaagctggagggccccccagaggccaatgctgaccccctgggcgtgctgatcaacagcgacagcgagagtgacaaggaggagaagccccagcacagcgtcatccccaaggaggtgaccccagccctgtgcagcctgatgagcagctatggcagcctgagcggcagcgagagcgagcctgaggagacccccatcaagacagaagcagatgtgctggccgagaaccaggtgctggacagcagcgcccccaagagccccagccaggatgtgaaggccaccgtgaggaacttcagcgaggccaagtcagaaaataggaagaagagctttgagaagaccaaccccaagaggaagaaggactaccacaactaccagaccctgtttgagcccaggacccaccacccctacctgctggagatgctgctggccccagacatcagacatgaaagaaatgtcatcctgcagtgtgtgcgctacatcatcaagaaggacttcttcggcctggacaccaacagcgccaagagcaaggatgtgtag

SEQ ID NO: 162247 - DNA, 648 bp, Artificial Sequence
  Description of Artificial Sequence: Synthetic coding sequence
atggagacccaggccgagcagcaggagctggagaccctgcccaccaccaagatggcccagaccaaccccaccccaggcagcctgggcccctggaagatcaccatctatgaccaggagaacttccagggcaagaggatggagttcaccagcagctgccccaacgtgtctgagaggagctttgacaacgtgcgcagcctgaaggtggagagcggggcctggattggctatgagcacaccagcttctgtggccagcagttcatcctggagcggggggagtacccccgctgggatgcctggagcggcagcaatgcctaccacatcgagcggctgatgtccttccggcccatctgcagcgccaaccacaaggagagcaagatgaccatctttgagaaggagaacttcatcggccggcagtgggagatcagtgatgactaccccagcctgcaggccatgggctggttcaacaatgaggtgggctccatgaagatccagagcggggcctgggtgtgctaccagtacccaggctaccggggctaccagtacatcctggagtgtgaccaccacggcggggactacaagcactggagggagtggggcagccacgcccagaccagccagatccagagcatccgccgcatccagcagtag

SEQ ID NO: 162248 - DNA, 2940 bp, Artificial Sequence
  Description of Artificial Sequence: Synthetic coding sequence
atgaccctgcacgccaccagaggagctgccctgctgtcctgggtgaacagcctgcacgtggccgaccctgtggaggccgtgctgcagctgcaggactgcagcatcttcatcaagatcatcgaccgcatccacggcacagaggagggccagcagatcctgaagcagcctgtgtctgagcggctggactttgtgtgcagcttcctgcagaagaacaggaagcaccccagcagcccagaatgtctggtgtctgcccagaaggtgctggagggcagcgagctggagctggccaagatgaccatgctgctgctgtaccacagcaccatgagcagcaagagcccccgggactgggagcagtttgagtacaagatccaggccgagctggccgtcatcctgaagtttgtgctggaccatgaagatggcctgaacctgaatgaagacctggagaacttcctgcagaaggcccctgtgcccagcacctgcagcagcaccttccctgaggagctgagcccccccagccaccaggccaagcgggagatccgcttcctggagctgcagaaggtggccagcagcagcagcggcaacaacttcctgagcggcagccctgccagccccatgggagacatcctgcagaccccccagttccagatgaggcggctgaagaagcagctggctgatgagaggagcaacagagatgagctggagctggagctggctgaaaataggaagctgctgacagagaaggatgcccagatcgccatgatgcagcagagaattgaccggctggccctgctgaatgagaagcaggccgccagccccctggagcccaaggagctggaggagctgcgggacaagaatgaaagcctgaccatgaggctgcacgagaccctgaagcagtgccaggacctgaagacagagaagagccagatggacaggaagatcaaccagctgtctgaagaaaatggagacctgtccttcaagctgcgggagtttgccagccacctgcagcagctgcaggatgccctgaatgagctgacagaggagcacagcaaggccacccaggagtggctggagaagcaggcccagctggagaaggagctgtctgctgccctgcaggacaagaagtgcctggaggagaagaatgagatcctgcagggcaagctgagccagctggaggagcacctgagccagctgcaggacaaccccccccaggagaagggggaggtgctgggagatgtgctgcaggtggaggagctgagcaagaagctggccgacagcgaccaggccagcaaggtgcagcagcagaagctgaaggctgtgcaggcccagggcggggagagccagcaggaggcccagaggctgcaggcccagctgaatgagctgcaggcccagctgagccagaaggagcaggccgctgagcactacaagctgcagatggagaaggccaagacccactatgatgccaagaagcagcagaaccaggagctgcaggagcagctgcggagcctggagcagctgcagaaggagaacaaggagctgcgggcagaggccgagcggctgggccacgagctgcagcaggccggcctgaagaccaaggaggccgagcagacctgccgccacctgacagcccaggtgcgcagcctggaggcccaggtggcccacgccgaccagcagctgcgggacctgggcaagttccaggtggccacagatgccctgaagagccgggagccccaggccaagccccagctggacctgagcattgacagcctggacctgagctgtgaggagggcacccccctgagcatcaccagcaagctgcccaggacccagccagatggcacctctgtgcctggagagcccgccagccccatcagccagaggctgccccccaaggtggagagcctggagagcctgtacttcacccccatcccagcccggagccaggcccccctggagagcagcctggacagcctgggagatgtgttcctggacagcggcaggaagaccaggtctgcccggcggaggaccacccagatcatcaacatcaccatgaccaagaagctggatgtggaggagccagacagcgccaacagcagcttctacagcaccaggtctgccccagccagccaggccagcctgcgggccaccagcagcacccagagcctggcccggctgggcagcccagactatggcaacagcgccctgctgagcctgcccggctaccggcccaccaccaggagcagcgcccggcgcagccaggccggcgtgtcctctggggcccctcctggaagaaattccttctacatgggcacctgccaggatgagcctgagcagctggatgactggaacagaattgctgagctgcagcagaggaacagagtgtgccccccccacctgaagacctgctaccccctggagagccggcccagcctgagcctgggcaccatcacagatgaggagatgaagacaggagacccccaggagaccctgcggcgggcctccatgcagcccatccagattgctgagggcaccggcatcaccacccggcagcagaggaagagggtgtccctggagccccaccagggccctggcaccccagagagcaagaaggccaccagctgcttcccccggcccatgaccccccgggacagacatgagggcaggaagcagagcaccacagaggcccagaagaaggccgccccagccagcaccaagcaggccgaccggcggcagagcatggccttcagcatcctgaacacccccaagaagctgggcaacagcctgctgcggcggggggccagcaagaaggccctgagcaaggccagccccaacaccaggagcggcaccaggaggagcccccgcatcgccaccaccacagccagcgctgccacagctgctgccatcggggccaccccccgggccaagggcaaggccaagcactag

SEQ ID NO: 162249 - DNA, 6306 bp, Artificial Sequence
  Description of Artificial Sequence: Synthetic coding sequence
atgaccctgcacgccaccagaggagctgccctgctgtcctgggtgaacagcctgcacgtggccgaccctgtggaggccgtgctgcagctgcaggactgcagcatcttcatcaagatcatcgaccgcatccacggcacagaggagggccagcagatcctgaagcagcctgtgtctgagcggctggactttgtgtgcagcttcctgcagaagaacaggaagcaccccagcagcccagaatgtctggtgtctgcccagaaggtgctggagggcagcgagctggagctggccaagatgaccatgctgctgctgtaccacagcaccatgagcagcaagagcccccgggactgggagcagtttgagtacaagatccaggccgagctggccgtcatcctgaagtttgtgctggaccatgaagatggcctgaacctgaatgaagacctggagaacttcctgcagaaggcccctgtgcccagcacctgcagcagcaccttccctgaggagctgagcccccccagccaccaggccaagcgggagatccgcttcctggagctgcagaaggtggccagcagcagcagcggcaacaacttcctgagcggcagccctgccagccccatgggagacatcctgcagaccccccagttccagatgaggcggctgaagaagcagctggctgatgagaggagcaacagagatgagctggagctggagctggctgaaaataggaagctgctgacagagaaggatgcccagatcgccatgatgcagcagagaattgaccggctggccctgctgaatgagaagcaggccgccagccccctggagcccaaggagctggaggagctgcgggacaagaatgaaagcctgaccatgaggctgcacgagaccctgaagcagtgccaggacctgaagacagagaagagccagatggacaggaagatcaaccagctgtctgaagaaaatggagacctgtccttcaagctgcgggagtttgccagccacctgcagcagctgcaggatgccctgaatgagctgacagaggagcacagcaaggccacccaggagtggctggagaagcaggcccagctggagaaggagctgtctgctgccctgcaggacaagaagtgcctggaggagaagaatgagatcctgcagggcaagctgagccagctggaggagcacctgagccagctgcaggacaaccccccccaggagaagggggaggtgctgggagatgtgctgcagctggagaccctgaagcaggaggccgccaccctggccgccaacaacacccagctgcaggcccgggtggagatgctggagacagagcggggccagcaggaggccaagctgctggccgagcggggccactttgaggaggagaagcagcagctgagcagcctcatcacagacctgcagagcagcatcagcaacctgagccaggccaaggaggagctggagcaggccagccaggcccacggggcccggctgacagcccaggtggccagcctgaccagcgagctgaccaccctgaatgccaccatccagcagcaggaccaggagctggccggcctgaagcagcaggccaaggagaagcaggcccagctggcccagaccctgcagcagcaggagcaggccagccagggcctgcggcaccaggtggagcagctgagcagcagcctgaagcagaaggagcagcagctgaaggaggtggccgagaagcaggaggccacccggcaggaccacgcccagcagctggccacagctgctgaggagcgggaggccagcctgcgggagagagatgctgccctgaagcagctggaggccctggagaaggagaaggccgccaagctggagatcctgcagcagcagctgcaggtggccaatgaggcccgggacagcgcccagacctctgtgacccaggcccagcgggagaaggccgagctgagcaggaaggtggaggagctgcaggcctgtgtggagacagcccggcaggagcagcacgaggcccaggcccaggtggccgagctggagctgcagctgcggtctgagcagcagaaggccacagagaaggagcgggtggcccaggagaaggaccagctgcaggagcagctgcaggccctgaaggagagcctgaaggtgaccaagggcagcctggaggaggagaagagaagagctgctgatgccctggaggagcagcagcgctgcatcagcgagctgaaggccgagaccaggagcctggtggagcagcacaagcgggagaggaaggagctggaggaggagcgggccggcaggaagggcctggaggcccggctgcagcagctgggggaggcccaccaggccgagacagaggtgctgcggcgggagctggccgaggccatggccgcccagcacacagctgagagtgaatgtgagcagctggtgaaggaggtggccgcctggagggagagatatgaggacagccagcaggaggaggcccagtatggagccatgttccaggagcagctgatgaccctgaaggaggagtgtgagaaggcccggcaggagctgcaggaggccaaggagaaggtggccggcatcgagagccacagcgagctgcagatcagccggcagcagaatgagctggccgagctgcacgccaacctggcccgggccctgcagcaggtgcaggagaaggaggtgcgggcccagaagctggctgatgacctgagcaccctgcaggagaagatggccgccaccagcaaggaggtggcccggctggagaccctggtgaggaaggccggggagcagcaggagacagccagccgggagctggtgaaggagcccgcccgggccggggaccggcagcctgagtggctggaggagcagcagggccggcagttctgcagcacccaggccgccctgcaggccatggagcgggaggccgagcagatgggaaatgagctggagcggctgcgggccgccctgatggagagccagggccagcagcaggaggagcggggccagcaggagcgggaggtggcccggctgacccaggagcggggccgggcccaggccgacctggccctggagaaggccgcccgggcagagctggagatgaggctgcagaatgccctgaatgagcagagggtggagtttgccaccctgcaggaggccctggcccacgccctgacagagaaggagggcaaggaccaggagctggccaagctgcggggcctggaggccgcccagatcaaggagctggaggagctgcggcagacagtgaagcagctgaaggagcagctggccaagaaggagaaggagcacgccagcggcagcggggcccagagcgaggccgccggccgcacagagcccaccggccccaagctggaggccctgcgggcagaggtgtccaagctggagcagcagtgccagaagcagcaggagcaggccgacagcctggagaggagcctggaggccgagcgggccagcagagctgagcgggacagcgccctggagaccctgcagggccagctggaggagaaggcccaggagctgggccacagccagagcgccctggccagcgcccagcgggagctggccgccttccgcaccaaggtgcaggaccacagcaaggccgaggatgagtggaaggcccaggtggcccggggccggcaggaggccgagaggaagaacagcctcatcagcagcctggaggaggaggtgtccatcctgaaccggcaggtgctggagaaggagggggagagcaaggagctgaagaggctggtgatggccgagagcgagaagagccagaagctggaggagcggctgcggctgctgcaggccgagacagccagcaacagcgcccgggctgctgagaggagcagcgccctgcgggaggaggtgcagagcctgcgggaggaggccgagaagcagagggtggccagcgagaacctgcggcaggagctgaccagccaggccgagcgggcagaggagctgggccaggagctgaaggcctggcaggagaagttcttccagaaggagcaggccctgagcaccctgcagctggagcacaccagcacccaggccctggtgtctgagctgctgcctgccaagcacctgtgccagcagctgcaggccgagcaggccgctgctgagaagaggcaccgggaggagctggagcagagcaagcaggccgccggcggcctgcgggcagagctgctgcgggcccagcgggagctgggggagctgatccccctgcggcagaaggtggccgagcaggagaggacagcccagcagctgcgggcagagaaggccagctatgcagagcagctgtccatgctgaagaaggcccacggcctgctggccgaggagaacagaggcctgggggagcgggccaacctgggccggcagttcctggaggtggagctggaccaggcccgggagaagtatgtgcaggagctggccgctgtgcgggcagatgctgagacccggctggccgaggtgcagcgggaggcccagagcacagcccgggagctggaggtgatgacagccaagtatgagggcgccaaggtgaaggtgctggaggagcggcagcgcttccaggaggagcggcagaagctgacagcccaggtggaggagctgagcaagaagctggccgacagcgaccaggccagcaaggtgcagcagcagaagctgaaggctgtgcaggcccagggcggggagagccagcaggaggcccagaggctgcaggcccagctgaatgagctgcaggcccagctgagccagaaggagcaggccgctgagcactacaagctgcagatggagaaggccaagacccactatgatgccaagaagcagcagaaccaggagctgcaggagcagctgcggagcctggagcagctgcagaaggagaacaaggagctgcgggcagaggccgagcggctgggccacgagctgcagcaggccggcctgaagaccaaggaggccgagcagacctgccgccacctgacagcccaggtgcgcagcctggaggcccaggtggcccacgccgaccagcagctgcgggacctgggcaagttccaggtggccacagatgccctgaagagccgggagccccaggccaagccccagctggacctgagcattgacagcctggacctgagctgtgaggagggcacccccctgagcatcaccagcaagctgcccaggacccagccagatggcacctctgtgcctggagagcccgccagccccatcagccagaggctgccccccaaggtggagagcctggagagcctgtacttcacccccatcccagcccggagccaggcccccctggagagcagcctggacagcctgggagatgtgttcctggacagcggcaggaagaccaggtctgcccggcggaggaccacccagatcatcaacatcaccatgaccaagaagctggatgtggaggagccagacagcgccaacagcagcttctacagcaccaggtctgccccagccagccaggccagcctgcgggccaccagcagcacccagagcctggcccggctgggcagcccagactatggcaacagcgccctgctgagcctgcccggctaccggcccaccaccaggagcagcgcccggcgcagccaggccggcgtgtcctctggggcccctcctggaagaaattccttctacatgggcacctgccaggatgagcctgagcagctggatgactggaacagaattgctgagctgcagcagaggaacagagtgtgccccccccacctgaagacctgctaccccctggagagccggcccagcctgagcctgggcaccatcacagatgaggagatgaagacaggagacccccaggagaccctgcggcgggcctccatgcagcccatccagattgctgagggcaccggcatcaccacccggcagcagaggaagagggtgtccctggagccccaccagggccctggcaccccagagagcaagaaggccaccagctgcttcccccggcccatgaccccccgggacagacatgagggcaggaagcagagcaccacagaggcccagaagaaggccgccccagccagcaccaagcaggccgaccggcggcagagcatggccttcagcatcctgaacacccccaagaagctgggcaacagcctgctgcggcggggggccagcaagaaggccctgagcaaggccagccccaacaccaggagcggcaccaggaggagcccccgcatcgccaccaccacagccagcgctgccacagctgctgccatcggggccaccccccgggccaagggcaaggccaagcactag

SEQ ID NO: 162250 - DNA, 4995 bp, Artificial Sequence
  Description of Artificial Sequence: Synthetic coding sequence
atgctggagacagagcggggccagcaggaggccaagctgctggccgagcggggccactttgaggaggagaagcagcagctgagcagcctcatcacagacctgcagagcagcatcagcaacctgagccaggccaaggaggagctggagcaggccagccaggcccatggagcccggctgacagcccaggtggccagcctgaccagcgagctgaccaccctgaatgccaccatccagcagcaggaccaggagctggccggcctgaagcagcaggccaaggagaagcaggcccagctggcccagaccctgcagcagcaggagcaggccagccagggcctgcggcaccaggtggagcagctgagcagcagcctgaagcagaaggagcagcagctgaaggaggtggccgagaagcaggaggccacccggcaggaccacgcccagcagctggccacagctgctgaggagcgggaggccagcctgcgggagagagatgctgccctgaagcagctggaggccctggagaaggagaaggccgccaagctggagatcctgcagcagcagctgcaggtggccaatgaggcccgggacagcgcccagacctctgtgacccaggcccagcgggagaaggccgagctgagcaggaaggtggaggagctgcaggcctgtgtggagacagcccggcaggagcagcacgaggcccaggcccaggtggccgagctggagctgcagctgcggtctgagcagcagaaggccacagagaaggagcgggtggcccaggagaaggaccagctgcaggagcagctgcaggccctgaaggagagcctgaaggtgaccaagggcagcctggaggaggagaagagaagagctgctgatgccctggaggagcagcagcgctgcatcagcgagctgaaggccgagaccaggagcctggtggagcagcacaagcgggagaggaaggagctggaggaggagagagctggcaggaagggcctggaggcccggctgcagcagctgggggaggcccaccaggccgagacagaggtgctgcggcgggagctggccgaggccatggccgcccagcacacagctgagagtgaatgtgagcagctggtgaaggaggtggccgcctggagggagagatatgaggacagccagcaggaggaggcccagtacggggccatgttccaggagcagctgatgaccctgaaggaggagtgtgagaaggcccggcaggagctgcaggaggccaaggagaaggtggccggcatcgagagccacagcgagctgcagatcagccggcagcagaatgagctggccgagctgcacgccaacctggcccgggccctgcagcaggtgcaggagaaggaggtgcgggcccagaagctggctgatgacctgagcaccctgcaggagaagatggccgccaccagcaaggaggtggcccggctggagaccctggtgaggaaggccggggagcagcaggagacagccagccgggagctggtgaaggagcccgcccgggccggggaccggcagcctgagtggctggaggagcagcagggccggcagttctgcagcacccaggccgccctgcaggccatggagcgggaggccgagcagatgggaaatgagctggagcggctgcgggccgccctgatggagagccagggccagcagcaggaggagcggggccagcaggagcgggaggtggcccggctgacccaggagcggggccgggcccaggccgacctggccctggagaaggccgcccgggcagagctggagatgaggctgcagaatgccctgaatgagcagagggtggagtttgccaccctgcaggaggccctggcccacgccctgacagagaaggagggcaaggaccaggagctggccaagctgcggggcctggaggccgcccagatcaaggagctggaggagctgcggcagacagtgaagcagctgaaggagcagctggccaagaaggagaaggagcacgccagcggcagcggggcccagagcgaggccgccggccgcacagagcccaccggccccaagctggaggccctgcgggcagaggtgtccaagctggagcagcagtgccagaagcagcaggagcaggccgacagcctggagaggagcctggaggccgagcgggccagcagagctgagcgggacagcgccctggagaccctgcagggccagctggaggagaaggcccaggagctgggccacagccagagcgccctggccagcgcccagcgggagctggccgccttccgcaccaaggtgcaggaccacagcaaggcagaagatgagtggaaggcccaggtggcccggggccggcaggaggccgagaggaagaacagcctcatcagcagcctggaggaggaggtgtccatcctgaaccggcaggtgctggagaaggagggggagagcaaggagctgaagaggctggtgatggccgagagcgagaagagccagaagctggaggagcggctgcggctgctgcaggccgagacagccagcaacagcgcccgggctgctgagaggagcagcgccctgcgggaggaggtgcagagcctgcgggaggaggccgagaagcagagggtggccagcgagaacctgcggcaggagctgaccagccaggccgagagagctgaggagctgggccaggagctgaaggcctggcaggagaagttcttccagaaggagcaggccctgagcaccctgcagctggagcacaccagcacccaggccctggtgtctgagctgctgcctgccaagcacctgtgccagcagctgcaggccgagcaggccgctgctgagaagaggcaccgggaggagctggagcagagcaagcaggccgccggcggcctgcgggcagagctgctgcgggcccagcgggagctgggggagctgatccccctgcggcagaaggtggccgagcaggagaggacagcccagcagctgcgggcagagaaggccagctatgcagagcagctgtccatgctgaagaaggcccacggcctgctggccgaggagaacagaggcctgggggagcgggccaacctgggccggcagttcctggaggtggagctggaccaggcccgggagaagtatgtgcaggagctggccgctgtgcgggcagatgctgagacccggctggccgaggtgcagcgggaggcccagagcacagcccgggagctggaggtgatgacagccaagtatgaaggagccaaggtgaaggtgctggaggagcggcagcgcttccaggaggagcggcagaagctgacagcccaggtggaggagctgagcaagaagctggccgacagcgaccaggccagcaaggtgcagcagcagaagctgaaggctgtgcaggcccagggcggggagagccagcaggaggcccagaggctgcaggcccagctgaatgagctgcaggcccagctgagccagaaggagcaggccgctgagcactacaagctgcagatggagaaggccaagacccactatgatgccaagaagcagcagaaccaggagctgcaggagcagctgcggagcctggagcagctgcagaaggagaacaaggagctgcgggcagaggccgagcggctgggccacgagctgcagcaggccggcctgaagaccaaggaggccgagcagacctgccgccacctgacagcccaggtgcgcagcctggaggcccaggtggcccatgctgaccagcagctgcgggacctgggcaagttccaggtggccacagatgccctgaagagccgggagccccaggccaagccccagctggacctgagcattgacagcctggacctgagctgtgaggagggcacccccctgagcatcaccagcaagctgcccaggacccagccagatggcacctctgtgcctggagagcccgccagccccatcagccagaggctgccccccaaggtggagagcctggagagcctgtacttcacccccatcccagcccggagccaggcccccctggagagcagcctggacagcctgggagatgtgttcctggacagcggcaggaagaccaggtctgcccggcggaggaccacccagatcatcaacatcaccatgaccaagaagctggatgtggaggagccagattctgccaacagcagcttctacagcaccaggtctgccccagccagccaggccagcctgcgggccaccagcagcacccagagcctggcccggctgggcagcccagactatggcaacagcgccctgctgagcctgcccggctaccggcccaccaccaggagcagcgcccggcgcagccaggccggcgtgagcagcggggcccctcctggcaggaacagcttctacatgggcacctgccaggatgagcctgagcagctggatgactggaacagaattgctgagctgcagcagaggaacagagtgtgccccccccacctgaagacctgctaccccctggagagccggcccagcctgagcctgggcaccatcacagatgaggagatgaagacaggagacccccaggagaccctgcggcgggcctccatgcagcccatccagattgctgagggcaccggcatcaccacccggcagcagaggaagagggtgtccctggagccccaccagggccctggcaccccagagagcaagaaggccaccagctgcttcccccggcccatgaccccccgggacagacatgagggcaggaagcagagcaccacagaggcccagaagaaggccgccccagccagcaccaagcaggccgaccggcggcagagcatggccttcagcatcctgaacacccccaagaagctgggcaacagcctgctgcggcggggggccagcaagaaggccctgagcaaggccagccccaacaccaggagcggcacccggcgcagccccagaattgccaccaccacagccagcgctgccacagctgctgccatcggggccaccccccgggccaagggcaaggccaagcactag

SEQ ID NO: 162251 - DNA, 228 bp, Artificial Sequence
  Description of Artificial Sequence: Synthetic coding sequence
atgaccctgcacgccaccagaggagctgccctgctgtcctgggtgaacagcctgcacgtggccgaccctgtggaggccgtgctgcagctgcaggactgcagcatcttcatcaagatcatcgaccgcatccacggcacagaggagggccagcagatcctgaagcagcctgtgtctgagcggctggactttgtgtgcagcttcctgcagaagaacaggaagcacccctag

SEQ ID NO: 162252 - DNA, 276 bp, Artificial Sequence
  Description of Artificial Sequence: Synthetic coding sequence
atgaccctgcacgccaccagaggagctgccctgctgtcctgggtgaacagcctgcacgtggccgaccctgtggaggccgtgctgcagctgcaggactgcagcatcttcatcaagatcatcgaccgcatccacggcacagaggagggccagcagatcctgaagcagcctgtgtctgagcggctggactttgtgtgcagcttcctgcagaagaacaggaagcaccccagcagcccagaatgtctggtgtctgcccagaaggtgctggagggcagctag

SEQ ID NO: 162253 - DNA, 6348 bp, Artificial Sequence
  Description of Artificial Sequence: Synthetic coding sequence
atgaccctgcacgccaccagaggagctgccctgctgtcctgggtgaacagcctgcacgtggccgaccctgtggaggccgtgctgcagctgcaggactgcagcatcttcatcaagatcatcgaccgcatccacggcacagaggagggccagcagatcctgaagcagcctgtgtctgagcggctggactttgtgtgcagcttcctgcagaagaacaggaagcaccccagcagcccagaatgtctggtgtctgcccagaaggtgctggagggcagcgagctggagctggccaagatgaccatgctgctgctgtaccacagcaccatgagcagcaagagcccccgggactgggagcagtttgagtacaagatccaggccgagctggccgtcatcctgaagtttgtgctggaccatgaagatggcctgaacctgaatgaagacctggagaacttcctgcagaaggcccctgtgcccagcacctgcagcagcaccttccctgaggagctgagcccccccagccaccaggccaagcgggagatccgcttcctggagctgcagaaggtggccagcagcagcagcggcaacaacttcctgagcggcagccctgccagccccatgggagacatcctgcagaccccccagttccagatgaggcggctgaagaagcagctggctgatgagaggagcaacagagatgagctggagctggagctggctgaaaataggaagctgctgacagagaaggatgcccagatcgccatgatgcagcagagaattgaccggctggccctgctgaatgagaagcaggccgccagccccctggagcccaaggagctggaggagctgcgggacaagaatgaaagcctgaccatgaggctgcacgagaccctgaagcagtgccaggacctgaagacagagaagagccagatggacaggaagatcaaccagctgtctgaagaaaatggagacctgtccttcaagctgcgggagtttgccagccacctgcagcagctgcaggatgccctgaatgagctgacagaggagcacagcaaggccacccaggagtggctggagaagcaggcccagctggagaaggagctgtctgctgccctgcaggacaagaagtgcctggaggagaagaatgagatcctgcagggcaagctgagccagctggaggagcacctgagccagctgcaggacaaccccccccaggagaagggggaggtgctgggagatgtgctgcagctggagaccctgaagcaggaggccgccaccctggccgccaacaacacccagctgcaggcccgggtggagatgctggagacagagcggggccagcaggaggccaagctgctggccgagcggggccactttgaggaggagaagcagcagctgagcagcctcatcacagacctgcagagcagcatcagcaacctgagccaggccaaggaggagctggagcaggccagccaggcccacggggcccggctgacagcccaggtggccagcctgaccagcgagctgaccaccctgaatgccaccatccagcagcaggaccaggagctggccggcctgaagcagcaggccaaggagaagcaggcccagctggcccagaccctgcagcagcaggagcaggccagccagggcctgcggcaccaggtggagcagctgagcagcagcctgaagcagaaggagcagcagctgaaggaggtggccgagaagcaggaggccacccggcaggaccacgcccagcagctggccacagctgctgaggagcgggaggccagcctgcgggagagagatgctgccctgaagcagctggaggccctggagaaggagaaggccgccaagctggagatcctgcagcagcagctgcaggtggccaatgaggcccgggacagcgcccagacctctgtgacccaggcccagcgggagaaggccgagctgagcaggaaggtggaggagctgcaggcctgtgtggagacagcccggcaggagcagcacgaggcccaggcccaggtggccgagctggagctgcagctgcggtctgagcagcagaaggccacagagaaggagcgggtggcccaggagaaggaccagctgcaggagcagctgcaggccctgaaggagagcctgaaggtgaccaagggcagcctggaggaggagaagagaagagctgctgatgccctggaggagcagcagcgctgcatcagcgagctgaaggccgagaccaggagcctggtggagcagcacaagcgggagaggaaggagctggaggaggagcgggccggcaggaagggcctggaggcccggctgcagcagctgggggaggcccaccaggccgagacagaggtgctgcggcgggagctggccgaggccatggccgcccagcacacagctgagagtgaatgtgagcagctggtgaaggaggtggccgcctggagggagagatatgaggacagccagcaggaggaggcccagtatggagccatgttccaggagcagctgatgaccctgaaggaggagtgtgagaaggcccggcaggagctgcaggaggccaaggagaaggtggccggcatcgagagccacagcgagctgcagatcagccggcagcagaatgagctggccgagctgcacgccaacctggcccgggccctgcagcaggtgcaggagaaggaggtgcgggcccagaagctggctgatgacctgagcaccctgcaggagaagatggccgccaccagcaaggaggtggcccggctggagaccctggtgaggaaggccggggagcagcaggagacagccagccgggagctggtgaaggagcccgcccgggccggggaccggcagcctgagtggctggaggagcagcagggccggcagttctgcagcacccaggccgccctgcaggccatggagcgggaggccgagcagatgggaaatgagctggagcggctgcgggccgccctgatggagagccagggccagcagcaggaggagcggggccagcaggagcgggaggtggcccggctgacccaggagcggggccgggcccaggccgacctggccctggagaaggccgcccgggcagagctggagatgaggctgcagaatgccctgaatgagcagagggtggagtttgccaccctgcaggaggccctggcccacgccctgacagagaaggagggcaaggaccaggagctggccaagctgcggggcctggaggccgcccagatcaaggagctggaggagctgcggcagacagtgaagcagctgaaggagcagctggccaagaaggagaaggagcacgccagcggcagcggggcccagagcgaggccgccggccgcacagagcccaccggccccaagctggaggccctgcgggcagaggtgtccaagctggagcagcagtgccagaagcagcaggagcaggccgacagcctggagaggagcctggaggccgagcgggccagcagagctgagcgggacagcgccctggagaccctgcagggccagctggaggagaaggcccaggagctgggccacagccagagcgccctggccagcgcccagcgggagctggccgccttccgcaccaaggtgcaggaccacagcaaggccgaggatgagtggaaggcccaggtggcccggggccggcaggaggccgagaggaagaacagcctcatcagcagcctggaggaggaggtgtccatcctgaaccggcaggtgctggagaaggagggggagagcaaggagctgaagaggctggtgatggccgagagcgagaagagccagaagctggaggagcggctgcggctgctgcaggccgagacagccagcaacagcgcccgggctgctgagaggagcagcgccctgcgggaggaggtgcagagcctgcgggaggaggccgagaagcagagggtggccagcgagaacctgcggcaggagctgaccagccaggccgagcgggcagaggagctgggccaggagctgaaggcctggcaggagaagttcttccagaaggagcaggccctgagcaccctgcagctggagcacaccagcacccaggccctggtgtctgagctgctgcctgccaagcacctgtgccagcagctgcaggccgagcaggccgctgctgagaagaggcaccgggaggagctggagcagagcaagcaggccgccggcggcctgcgggcagagctgctgcgggcccagcgggagctgggggagctgatccccctgcggcagaaggtggccgagcaggagaggacagcccagcagctgcgggcagagaaggccagctatgcagagcagctgtccatgctgaagaaggcccacggcctgctggccgaggagaacagaggcctgggggagcgggccaacctgggccggcagttcctggaggtggagctggaccaggcccgggagaagtatgtgcaggagctggccgctgtgcgggcagatgctgagacccggctggccgaggtgcagcgggaggcccagagcacagcccgggagctggaggtgatgacagccaagtatgagggcgccaaggtgaaggtgctggaggagcggcagcgcttccaggaggagcggcagaagctgacagcccaggtggagcagctggaggtgttccagcgggagcagaccaagcaggtggaggagctgagcaagaagctggccgacagcgaccaggccagcaaggtgcagcagcagaagctgaaggctgtgcaggcccagggcggggagagccagcaggaggcccagaggctgcaggcccagctgaatgagctgcaggcccagctgagccagaaggagcaggccgctgagcactacaagctgcagatggagaaggccaagacccactatgatgccaagaagcagcagaaccaggagctgcaggagcagctgcggagcctggagcagctgcagaaggagaacaaggagctgcgggcagaggccgagcggctgggccacgagctgcagcaggccggcctgaagaccaaggaggccgagcagacctgccgccacctgacagcccaggtgcgcagcctggaggcccaggtggcccacgccgaccagcagctgcgggacctgggcaagttccaggtggccacagatgccctgaagagccgggagccccaggccaagccccagctggacctgagcattgacagcctggacctgagctgtgaggagggcacccccctgagcatcaccagcaagctgcccaggacccagccagatggcacctctgtgcctggagagcccgccagccccatcagccagaggctgccccccaaggtggagagcctggagagcctgtacttcacccccatcccagcccggagccaggcccccctggagagcagcctggacagcctgggagatgtgttcctggacagcggcaggaagaccaggtctgcccggcggaggaccacccagatcatcaacatcaccatgaccaagaagctggatgtggaggagccagacagcgccaacagcagcttctacagcaccaggtctgccccagccagccaggccagcctgcgggccaccagcagcacccagagcctggcccggctgggcagcccagactatggcaacagcgccctgctgagcctgcccggctaccggcccaccaccaggagcagcgcccggcgcagccaggccggcgtgtcctctggggcccctcctggaagaaattccttctacatgggcacctgccaggatgagcctgagcagctggatgactggaacagaattgctgagctgcagcagaggaacagagtgtgccccccccacctgaagacctgctaccccctggagagccggcccagcctgagcctgggcaccatcacagatgaggagatgaagacaggagacccccaggagaccctgcggcgggcctccatgcagcccatccagattgctgagggcaccggcatcaccacccggcagcagaggaagagggtgtccctggagccccaccagggccctggcaccccagagagcaagaaggccaccagctgcttcccccggcccatgaccccccgggacagacatgagggcaggaagcagagcaccacagaggcccagaagaaggccgccccagccagcaccaagcaggccgaccggcggcagagcatggccttcagcatcctgaacacccccaagaagctgggcaacagcctgctgcggcggggggccagcaagaaggccctgagcaaggccagccccaacaccaggagcggcaccaggaggagcccccgcatcgccaccaccacagccagcgctgccacagctgctgccatcggggccaccccccgggccaagggcaaggccaagcactag

SEQ ID NO: 162254 - DNA, 330 bp, Artificial Sequence
  Description of Artificial Sequence: Synthetic coding sequence
atgaccctgcacgccaccagaggagctgccctgctgtcctgggtgaacagcctgcacgtggccgaccctgtggaggccgtgctgcagctgcaggactgcagcatcttcatcaagatcatcgaccgcatccacggcacagaggagggccagcagatcctgaagcagcctgtgtctgagcggctggactttgtgtgcagcttcctgcagaagaacaggaagcaccccagcagcccagaatgtctggtgtctgcccagaaggtgctggagggcagcgagctggagctggccaagatgaccatgctgctgctgtaccacagcaccatgtcctag

SEQ ID NO: 162255 - DNA, 186 bp, Artificial Sequence
  Description of Artificial Sequence: Synthetic coding sequence
atgaccctgcacgccaccagaggagctgccctgctgtcctgggtgaacagcctgcacgtggccgaccctgtggaggccgtgctgcagctgcaggactgcagcatcttcatcaagatcatcgaccgcatccacggcacagaggagggccagcagatcctgaagcagcctgtgtctgagcggctgtag

SEQ ID NO: 162256 - DNA, 180 bp, Artificial Sequence
  Description of Artificial Sequence: Synthetic coding sequence
atgaccctgcacgccaccagaggagctgccctgctgtcctgggtgaacagcctgcacgtggccgaccctgtggaggccgtgctgcagctgcaggactgcagcatcttcatcaagatcatcgaccgcatccacggcacagaggagggccagcagatcctgaagcagcctgtgtctgagtag

SEQ ID NO: 162257 - DNA, 441 bp, Artificial Sequence
  Description of Artificial Sequence: Synthetic coding sequence
atgaccctgcacgccaccagaggagctgccctgctgtcctgggtgaacagcctgcacgtggccgaccctgtggaggccgtgctgcagctgcaggactgcagcatcttcatcaagatcatcgaccgcatccacggcacagaggagggccagcagatcctgaagcagcctgtgtctgagcggctggactttgtgtgcagcttcctgcagaagaacaggaagcaccccagcagcccagaatgtctggtgtctgcccagaaggtgctggagggcagcgagctggagctggccaagatgaccatgctgctgctgtaccacagcaccatgagcagcaagagcccccgggactgggagcagtttgagtacaagatccaggccgagctggccgtcatcctgaagtttgtgctggaccatgaagatggcctgaacctgaatgaagattag

SEQ ID NO: 162258 - DNA, 3267 bp, Artificial Sequence
  Description of Artificial Sequence: Synthetic coding sequence
atgaggctgcagaatgccctgaatgagcagagggtggagtttgccaccctgcaggaggccctggcccacgccctgacagagaaggagggcaaggaccaggagctggccaagctgcggggcctggaggccgcccagatcaaggagctggaggagctgcggcagacagtgaagcagctgaaggagcagctggccaagaaggagaaggagcacgccagcggcagcggggcccagagcgaggccgccggccgcacagagcccaccggccccaagctggaggccctgcgggcagaggtgtccaagctggagcagcagtgccagaagcagcaggagcaggccgacagcctggagaggagcctggaggccgagcgggccagcagagctgagcgggacagcgccctggagaccctgcagggccagctggaggagaaggcccaggagctgggccacagccagagcgccctggccagcgcccagcgggagctggccgccttccgcaccaaggtgcaggaccacagcaaggcagaagatgagtggaaggcccaggtggcccggggccggcaggaggccgagaggaagaacagcctcatcagcagcctggaggaggaggtgtccatcctgaaccggcaggtgctggagaaggagggggagagcaaggagctgaagaggctggtgatggccgagagcgagaagagccagaagctggaggagcggctgcggctgctgcaggccgagacagccagcaacagcgcccgggctgctgagaggagcagcgccctgcgggaggaggtgcagagcctgcgggaggaggccgagaagcagagggtggccagcgagaacctgcggcaggagctgaccagccaggccgagagagctgaggagctgggccaggagctgaaggcctggcaggagaagttcttccagaaggagcaggccctgagcaccctgcagctggagcacaccagcacccaggccctggtgtctgagctgctgcctgccaagcacctgtgccagcagctgcaggccgagcaggccgctgctgagaagaggcaccgggaggagctggagcagagcaagcaggccgccggcggcctgcgggcagagctgctgcgggcccagcgggagctgggggagctgatccccctgcggcagaaggtggccgagcaggagaggacagcccagcagctgcgggcagagaaggccagctatgcagagcagctgtccatgctgaagaaggcccacggcctgctggccgaggagaacagaggcctgggggagcgggccaacctgggccggcagttcctggaggtggagctggaccaggcccgggagaagtatgtgcaggagctggccgctgtgcgggcagatgctgagacccggctggccgaggtgcagcgggaggcccagagcacagcccgggagctggaggtgatgacagccaagtatgaaggagccaaggtgaaggtgctggaggagcggcagcgcttccaggaggagcggcagaagctgacagcccaggtggaggagctgagcaagaagctggccgacagcgaccaggccagcaaggtgcagcagcagaagctgaaggctgtgcaggcccagggcggggagagccagcaggaggcccagaggctgcaggcccagctgaatgagctgcaggcccagctgagccagaaggagcaggccgctgagcactacaagctgcagatggagaaggccaagacccactatgatgccaagaagcagcagaaccaggagctgcaggagcagctgcggagcctggagcagctgcagaaggagaacaaggagctgcgggcagaggccgagcggctgggccacgagctgcagcaggccggcctgaagaccaaggaggccgagcagacctgccgccacctgacagcccaggtgcgcagcctggaggcccaggtggcccatgctgaccagcagctgcgggacctgggcaagttccaggtggccacagatgccctgaagagccgggagccccaggccaagccccagctggacctgagcattgacagcctggacctgagctgtgaggagggcacccccctgagcatcaccaggcacaaggccctgatgaccatcatcccagacctgagccccaacaaccccctgagcaagctgcccaggacccagccagatggcacctctgtgcctggagagcccgccagccccatcagccagaggctgccccccaaggtggagagcctggagagcctgtacttcacccccatcccagcccggagccaggcccccctggagagcagcctggacagcctgggagatgtgttcctggacagcggcaggaagaccaggtctgcccggcggaggaccacccagatcatcaacatcaccatgaccaagaagctggatgtggaggagccagattctgccaacagcagcttctacagcaccaggtctgccccagccagccaggccagcctgcgggccaccagcagcacccagagcctggcccggctgggcagcccagactatggcaacagcgccctgctgagcctgcccggctaccggcccaccaccaggagcagcgcccggcgcagccaggccggcgtgagcagcggggcccctcctggcaggaacagcttctacatgggcacctgccaggatgagcctgagcagctggatgactggaacagaattgctgagctgcagcagaggaacagagtgtgccccccccacctgaagacctgctaccccctggagagccggcccagcctgagcctgggcaccatcacagatgaggagatgaagacaggagacccccaggagaccctgcggcgggcctccatgcagcccatccagattgctgagggcaccggcatcaccacccggcagcagaggaagagggtgtccctggagccccaccagggccctggcaccccagagagcaagaaggccaccagctgcttcccccggcccatgaccccccgggacagacatgagggcaggaagcagagcaccacagaggcccagaagaaggccgccccagccagcaccaagcaggccgaccggcggcagagcatggccttcagcatcctgaacacccccaagaagctgggcaacagcctgctgcggcggggggccagcaagaaggccctgagcaaggccagccccaacaccaggagcggcacccggcgcagccccagaattgccaccaccacagccagcgctgccacagctgctgccatcggggccaccccccgggccaagggcaaggccaagcactag

SEQ ID NO: 162259 - DNA, 2076 bp, Artificial Sequence
  Description of Artificial Sequence: Synthetic coding sequence
atgaccctgcacgccaccagaggagctgccctgctgtcctgggtgaacagcctgcacgtggccgaccctgtggaggccgtgctgcagctgcaggactgcagcatcttcatcaagatcatcgaccgcatccacggcacagaggagggccagcagatcctgaagcagcctgtgtctgagcggctggactttgtgtgcagcttcctgcagaagaacaggaagcaccccagcagcccagaatgtctggtgtctgcccagaaggtgctggagggcagcgagctggagctggccaagatgaccatgctgctgctgtaccacagcaccatgagcagcaagagcccccgggactgggagcagtttgagtacaagatccaggccgagctggccgtcatcctgaagtttgtgctggaccatgaagatggcctgaacctgaatgaagacctggagaacttcctgcagaaggcccctgtgcccagcacctgcagcagcaccttccctgaggagctgagcccccccagccaccaggccaagcgggagatccgcttcctggagctgcagaaggtggccagcagcagcagcggcaacaacttcctgagcggcagccctgccagccccatgggagacatcctgcagaccccccagttccagatgaggcggctgaagaagcagctggctgatgagaggagcaacagagatgagctggagctggagctggctgaaaataggaagctgctgacagagaaggatgcccagatcgccatgatgcagcagagaattgaccggctggccctgctgaatgagaagcaggccgccagccccctggagcccaaggagctggaggagctgcgggacaagaatgaaagcctgaccatgaggctgcacgagaccctgaagcagtgccaggacctgaagacagagaagagccagatggacaggaagatcaaccagctgtctgaagaaaatggagacctgtccttcaagctgcgggagtttgccagccacctgcagcagctgcaggatgccctgaatgagctgacagaggagcacagcaaggccacccaggagtggctggagaagcaggcccagctggagaaggagctgtctgctgccctgcaggacaagaagtgcctggaggagaagaatgagatcctgcagggcaagctgagccagctggaggagcacctgagccagctgcaggacaaccccccccaggagaagggggaggtgctgggagatgtgctgcagctggagaccctgaagcaggaggccgccaccctggccgccaacaacacccagctgcaggcccgggtggagatgctggagacagagcggggccagcaggaggccaagctgctggccgagcggggccactttgaggaggagaagcagcagctgagcagcctcatcacagacctgcagagcagcatcagcaacctgagccaggccaaggaggagctggagcaggccagccaggcccacggggcccggctgacagcccaggtggccagcctgaccagcgagctgaccaccctgaatgccaccatccagcagcaggaccaggagctggccggcctgaagcagcaggccaaggagaagcaggcccagctggcccagaccctgcagcagcaggagcaggccagccagggcctgcggcaccaggtggagcagctgagcagcagcctgaagcagaaggagcagcagctgaaggaggtggccgagaagcaggaggccacccggcaggaccacgcccagcagctggccacagctgctgaggagcgggaggccagcctgcgggagagagatgctgccctgaagcagctggaggccctggagaaggagaaggccgccaagctggagatcctgcagcagcagctgcaggtggccaatgaggcccgggacagcgcccagacctctgtgacccaggcccagcgggagaaggccgagctgagcaggaaggtggaggagctgcaggcctgtgtggagacagcccggcaggagcagcacgaggcccaggcccaggtggccgagctggagctgcagctgcggtctgagcagcagaaggccacagagaaggagtag

SEQ ID NO: 162260 - DNA, 480 bp, Artificial Sequence
  Description of Artificial Sequence: Synthetic coding sequence
atgaccctgcacgccaccagaggagctgccctgctgtcctgggtgaacagcctgcacgtggccgaccctgtggaggccgtgctgcagctgcaggactgcagcatcttcatcaagatcatcgaccgcatccacggcacagaggagggccagcagatcctgaagcagcctgtgtctgagcggctggactttgtgtgcagcttcctgcagaagaacaggaagcaccccagcagcccagaatgtctggtgtctgcccagaaggtgctggagggcagcgagctggagctggccaagatgaccatgctgctgctgtaccacagcaccatgagcagcaagagcccccgggactgggagcagtttgagtacaagatccaggccgagctggccgtcatcctgaagtttgtgctggaccatgaagatggcctgaacctgaatgaagacctggagaacttcctgcagaaggcccctgtgcccagcacctag

SEQ ID NO: 162261 - DNA, 219 bp, Artificial Sequence
  Description of Artificial Sequence: Synthetic coding sequence
atgaccctgcacgccaccagaggagctgccctgctgtcctgggtgaacagcctgcacgtggccgaccctgtggaggccgtgctgcagctgcaggactgcagcatcttcatcaagatcatcgaccgcatccacggcacagaggagggccagcagatcctgaagcagcctgtgtctgagcggctggactttgtgtgcagcttcctgcagaagaacagatag

SEQ ID NO: 162262 - DNA, 252 bp, Artificial Sequence
  Description of Artificial Sequence: Synthetic coding sequence
atgaccctgcacgccaccagaggagctgccctgctgtcctgggtgaacagcctgcacgtggccgaccctgtggaggccgtgctgcagctgcaggactgcagcatcttcatcaagatcatcgaccgcatccacggcacagaggagggccagcagatcctgaagcagcctgtgtctgagcggctggactttgtgtgcagcttcctgcagaagaacaggaagcaccccagcagcccagaatgtctggtgtcctag

SEQ ID NO: 162263 - DNA, 2559 bp, Artificial Sequence
  Description of Artificial Sequence: Synthetic coding sequence
atgaccctgcacgccaccagaggagctgccctgctgtcctgggtgaacagcctgcacgtggccgaccctgtggaggccgtgctgcagctgcaggactgcagcatcttcatcaagatcatcgaccgcatccacggcacagaggagggccagcagatcctgaagcagcctgtgtctgagcggctggactttgtgtgcagcttcctgcagaagaacaggaagcaccccagcagcccagaatgtctggtgtctgcccagaaggtgctggagggcagcgagctggagctggccaagatgaccatgctgctgctgtaccacagcaccatgagcagcaagagcccccgggactgggagcagtttgagtacaagatccaggccgagctggccgtcatcctgaagtttgtgctggaccatgaagatggcctgaacctgaatgaagacctggagaacttcctgcagaaggcccctgtgcccagcacctgcagcagcaccttccctgaggagctgagcccccccagccaccaggccaagcgggagatccgcttcctggagctgcagaaggtggccagcagcagcagcggcaacaacttcctgagcggcagccctgccagccccatgggagacatcctgcagaccccccagttccagatgaggcggctgaagaagcagctggctgatgagaggagcaacagagatgagctggagctggagctggctgaaaataggaagctgctgacagagaaggatgcccagatcgccatgatgcagcagagaattgaccggctggccctgctgaatgagaagcaggccgccagccccctggagcccaaggagctggaggagctgcgggacaagaatgaaagcctgaccatgaggctgcacgagaccctgaagcagtgccaggacctgaagacagagaagagccagatggacaggaagatcaaccagctgtctgaagaaaatggagacctgtccttcaagctgcgggagtttgccagccacctgcagcagctgcaggatgccctgaatgagctgacagaggagcacagcaaggccacccaggagtggctggagaagcaggcccagctggagaaggagctgtctgctgccctgcaggacaagaagtgcctggaggagaagaatgagatcctgcagggcaagctgagccagctggaggagcacctgagccagctgcaggacaaccccccccaggagaagggggaggtgctgggagatgtgctgcagctggagaccctgaagcaggaggccgccaccctggccgccaacaacacccagctgcaggcccgggtggagatgctggagacagagcggggccagcaggaggccaagctgctggccgagcggggccactttgaggaggagaagcagcagctgagcagcctcatcacagacctgcagagcagcatcagcaacctgagccaggccaaggaggagctggagcaggccagccaggcccacggggcccggctgacagcccaggtggccagcctgaccagcgagctgaccaccctgaatgccaccatccagcagcaggaccaggagctggccggcctgaagcagcaggccaaggagaagcaggcccagctggcccagaccctgcagcagcaggagcaggccagccagggcctgcggcaccaggtggagcagctgagcagcagcctgaagcagaaggagcagcagctgaaggaggtggccgagaagcaggaggccacccggcaggaccacgcccagcagctggccacagctgctgaggagcgggaggccagcctgcgggagagagatgctgccctgaagcagctggaggccctggagaaggagaaggccgccaagctggagatcctgcagcagcagctgcaggtggccaatgaggcccgggacagcgcccagacctctgtgacccaggcccagcgggagaaggccgagctgagcaggaaggtggaggagctgcaggcctgtgtggagacagcccggcaggagcagcacgaggcccaggcccaggtggccgagctggagctgcagctgcggtctgagcagcagaaggccacagagaaggagcgggtggcccaggagaaggaccagctgcaggagcagctgcaggccctgaaggagagcctgaaggtgaccaagggcagcctggaggaggagaagagaagagctgctgatgccctggaggagcagcagcgctgcatcagcgagctgaaggccgagaccaggagcctggtggagcagcacaagcgggagaggaaggagctggaggaggagcgggccggcaggaagggcctggaggcccggctgcagcagctgggggaggcccaccaggccgagacagaggtgctgcggcgggagctggccgaggccatggccgcccagcacacagctgagagtgaatgtgagcagctggtgaaggaggtggccgcctggagggagagatatgaggacagccagcaggaggaggcccagtatggagccatgttccaggagcagctgatgaccctgaaggaggagtgtgagaaggcccggcaggagctgcaggaggcctag

SEQ ID NO: 162264 - DNA, 525 bp, Artificial Sequence
  Description of Artificial Sequence: Synthetic coding sequence
atgaccctgcacgccaccagaggagctgccctgctgtcctgggtgaacagcctgcacgtggccgaccctgtggaggccgtgctgcagctgcaggactgcagcatcttcatcaagatcatcgaccgcatccacggcacagaggagggccagcagatcctgaagcagcctgtgtctgagcggctggactttgtgtgcagcttcctgcagaagaacaggaagcaccccagcagcccagaatgtctggtgtctgcccagaaggtgctggagggcagcgagctggagctggccaagatgaccatgctgctgctgtaccacagcaccatgagcagcaagagcccccgggactgggagcagtttgagtacaagatccaggccgagctggccgtcatcctgaagtttgtgctggaccatgaagatggcctgaacctgaatgaagacctggagaacttcctgcagaaggcccctgtgcccagcacctgcagcagcaccttccctgaggagctgagcccccccagccaccagtag

SEQ ID NO: 162265 - DNA, 606 bp, Artificial Sequence
  Description of Artificial Sequence: Synthetic coding sequence
atgaccctgcacgccaccagaggagctgccctgctgtcctgggtgaacagcctgcacgtggccgaccctgtggaggccgtgctgcagctgcaggactgcagcatcttcatcaagatcatcgaccgcatccacggcacagaggagggccagcagatcctgaagcagcctgtgtctgagcggctggactttgtgtgcagcttcctgcagaagaacaggaagcaccccagcagcccagaatgtctggtgtctgcccagaaggtgctggagggcagcgagctggagctggccaagatgaccatgctgctgctgtaccacagcaccatgagcagcaagagcccccgggactgggagcagtttgagtacaagatccaggccgagctggccgtcatcctgaagtttgtgctggaccatgaagatggcctgaacctgaatgaagacctggagaacttcctgcagaaggcccctgtgcccagcacctgcagcagcaccttccctgaggagctgagcccccccagccaccaggccaagcgggagatccgcttcctggagctgcagaaggtggccagcagcagcagcggcaacaacttcctgagcggcagcccctag

SEQ ID NO: 162266 - DNA, 480 bp, Artificial Sequence; identical to SEQ ID NO: 162260
  Description of Artificial Sequence: Synthetic coding sequence

SEQ ID NO: 162267 - DNA, 663 bp, Artificial Sequence
  Description of Artificial Sequence: Synthetic coding sequence
atgaccctgcacgccaccagaggagctgccctgctgtcctgggtgaacagcctgcacgtggccgaccctgtggaggccgtgctgcagctgcaggactgcagcatcttcatcaagatcatcgaccgcatccacggcacagaggagggccagcagatcctgaagcagcctgtgtctgagcggctggactttgtgtgcagcttcctgcagaagaacaggaagcaccccagcagcccagaatgtctggtgtctgcccagaaggtgctggagggcagcgagctggagctggccaagatgaccatgctgctgctgtaccacagcaccatgagcagcaagagcccccgggactgggagcagtttgagtacaagatccaggccgagctggccgtcatcctgaagtttgtgctggaccatgaagatggcctgaacctgaatgaagacctggagaacttcctgcagaaggcccctgtgcccagcacctgcagcagcaccttccctgaggagctgagcccccccagccaccaggccaagcgggagatccgcttcctggagctgcagaaggtggccagcagcagcagcggcaacaacttcctgagcggcagccctgccagccccatgggagacatcctgcagaccccccagttccagatgaggcggctgaagtag

SEQ ID NO: 162268 - DNA, 171 bp, Artificial Sequence
  Description of Artificial Sequence: Synthetic coding sequence
atgaccctgcacgccaccagaggagctgccctgctgtcctgggtgaacagcctgcacgtggccgaccctgtggaggccgtgctgcagctgcaggactgcagcatcttcatcaagatcatcgaccgcatccacggcacagaggagggccagcagatcctgaagcagccctag

SEQ ID NO: 162269 - DNA, 1053 bp, Artificial Sequence
  Description of Artificial Sequence: Synthetic coding sequence
atgttctgctgcctgggctatgagtggctgagcggcggctgcaagacctggcacagcgcctgggtgatcaacaccctggccgaccaccgccaccggggcacagactttggaggcagcccctggctgctgatcatcaccgtcttcctgcggagctacaagtttgccatcagcctgtgcaccagctacctgtgtgtgtccttcctgaagaccatcttccccagccagaatggacatgatggcagcacagatgtgcagcagagggcccggcgcagcaacagaagacggcaggagggcatcaagatcgtgctggaggacatcttcaccctgtggaggcaggtggagaccaaggtgcgggccaagatcaggaagatgaaggtgaccaccaaggtgaacagacatgacaagatcaatggcaagaggaagacagccaaggagcacctgaggaagctgtccatgaaggagcgggagcacggggagaaggagcggcaggtgtctgaggccgaggagaatggcaagctggacatgaaggagatccacacctacatggagatgttccagagggcccaggccctgcggaggagagctgaggactactaccgctgcaagatcacccccagcgccaggaagcccctgtgcaacagagtgaggatggctgctgtggagcaccgccacagcagcggcctgccctactggccctacctgacagctgagaccctgaagaacaggatgggccaccagcccccaccacccacccagcagcacagcatcatcgacaacagcctgagcctgaagaccccatctgagtgcctgctgacccccctgcccccatctgccctgcccagcgcagatgacaacctgaagaccccagcagaatgtctgctgtaccccctgccccccagcgcagatgacaacctgaagaccccacctgagtgcctgctgacccccctgcccccatctgcccctccttctgtggatgacaacctgaagaccccaccagaatgtgtgtgcagcctgcccttccacccccagaggatgatcatcagcagaaattag

SEQ ID NO: 162270 - DNA, 1053 bp, Artificial Sequence; identical to SEQ ID NO: 162269
  Description of Artificial Sequence: Synthetic coding sequence

SEQ ID NO: 162271 - DNA, 1431 bp, Artificial Sequence
  Description of Artificial Sequence: Synthetic coding sequence
atggccagccccttcagcggggccctgcagctgacagacctggatgacttcatcggccccagccaggagtgcatcaagcctgtgaaggtggagaagagagctggcagcggcgtggccaagatcagaattgaagatgatggcagctacttccagatcaaccaggacggcggcacccggcggctggagaaggccaaggtgtccctgaatgactgcctggcctgcagcggctgcatcaccagcgctgagaccgtgctgatcacccagcagagccatgaggagctgaagaaggtgctggatgccaacaagatggccgcccccagccagcagaggctggtggtggtgtctgtgagcccccagagccgggccagcctggccgcccgcttccagctgaaccccacagacacagccaggaagctgaccagcttcttcaagaagattggagtgcactttgtgtttgacacagccttcagccgccacttcagcctgctggagagccagcgggagtttgtgcggcgcttccggggccaggccgactgccggcaggccctgcccctgctggccagcgcctgccccggctggatctgctacgccgagaagacccacggcagcttcatcctgccccacatcagcacagcccggagcccccagcaggtgatgggcagcctggtgaaggacttctttgcccagcagcagcacctgaccccagacaagatctaccacgtgacagtgatgccctgctatgacaagaagctggaggccagcaggccagacttcttcaaccaggagcaccagaccagagatgtggactgtgtgctgaccaccggggaggtgttccggctgctggaggaggagggcgtgtccctgcctgacctggagcccgcccccctggacagcctgtgcagcggggccagcgctgaggagcccaccagccacagaggaggcggcagcggcggctacctggagcacgtgttcagacatgctgcccgggagctgtttggcatccacgtggccgaggtgacctacaagcccctgaggaacaaggacttccaggaggtgaccctggagaaggagggccaggtgctgctgcactttgccatggcctacggcttcaggaacatccagaacctggtgcagaggctgaagaggggccgctgcccctaccactacgtggaggtgatggcctgccccagcggctgcctgaatggaggcggccagctgcaggccccagaccggcccagccgggagctgctgcagcacgtggagcggctgtatggcatggtgcgggcagaggccccagaagatgcccctggggtgcaggagctgtacacccactggctgcagggcacagattctgaatgtgccggccgcctgctgcacacccagtaccacgctgtggagaaggccagcacaggcctgggcatccgctggtag

SEQ ID NO: 162272 - DNA, 567 bp, Artificial Sequence
  Description of Artificial Sequence: Synthetic coding sequence
atggccagccccttcagcggggccctgcagctgacagacctggatgacttcatcggccccagccaggagtgcatcaagcctgtgaaggtggagaagagagctggcagcggcgtggccaagatcagaattgaagatgatggcagctacttccagatcaaccaggacggcggcacccggcggctggagaaggccaaggtgtccctgaatgactgcctggcctgcagcggctgcatcaccagcgctgagaccgtgctgatcacccagcagagccatgaggagctgaagaaggtgctggatgccaacaagggctgcaccagcagcagcaccccacccagccagggcaccagcgcctcctggagggccagcgagagcctgtgtggggacagcgaggaccggcccacagctgaccggcgctgcccctgctggcccctgcctgcccaggccggcagcgccatgccccggcggctgacagctgccagcagcagccccaccagcgcccctcctggccccaggagccgctcctgggccccctggagcaggaccagcagccccagcagcagcacctag

SEQ ID NO: 162273 - DNA, 1125 bp, Artificial Sequence
  Description of Artificial Sequence: Synthetic coding sequence
atggccgcccccagccagcagaggctggtggtggtgtctgtgagcccccagagccgggccagcctggccgcccgcttccagctgaaccccacagacacagccaggaagctgaccagcttcttcaagaagattggagtgcactttgtgtttgacacagccttcagccgccacttcagcctgctggagagccagcgggagtttgtgcggcgcttccggggccaggccgactgccggcaggccctgcccctgctggccagcgcctgccccggctggatctgctacgccgagaagacccacggcagcttcatcctgccccacatcagcacagcccggagcccccagcaggtgatgggcagcctggtgaaggacttctttgcccagcagcagcacctgaccccagacaagatctaccacgtgacagtgatgccctgctatgacaagaagctggaggccagcaggccagacttcttcaaccaggagcaccagaccagagatgtggactgtgtgctgaccaccggggaggtgttccggctgctggaggaggagggcgtgtccctgcctgacctggagcccgcccccctggacagcctgtgcagcggggccagcgctgaggagcccaccagccacagaggaggcggcagcggcggctacctggagcacgtgttcagacatgctgcccgggagctgtttggcatccacgtggccgaggtgacctacaagcccctgaggaacaaggacttccaggaggtgaccctggagaaggagggccaggtgctgctgcactttgccatggcctacggcttcaggaacatccagaacctggtgcagaggctgaagaggggccgctgcccctaccactacgtggaggtgatggcctgccccagcggctgcctgaatggaggcggccagctgcaggccccagaccggcccagccgggagctgctgcagcacgtggagcggctgtatggcatggtgcgggcagaggccccagaagatgcccctggggtgcaggagctgtacacccactggctgcagggcacagattctgaatgtgccggccgcctgctgcacacccagtaccacgctgtggagaaggccagcacaggcctgggcatccgctggtag

SEQ ID NO: 162274 - DNA, 4284 bp, Artificial Sequence
  Description of Artificial Sequence: Synthetic coding sequence
atgctgctgcccagtgatgtggcccggctggtgctgggctacctgcagcaggagaacctgatcagcacctgccagaccttcatcctggagagcagtgacctgaaggagtatgcagagcactgcacagatgagggcttcatcccagcctgcctgctgagcctgtttgggaagaacctgaccaccatcctgaatgaatatgtggccatgaagaccaaggagaccagcaacaacgtgcctgccatcatgagcagcctgtggaagaagctggaccacaccctgagccagatccgctccatgcagagcagccccaggtttgctggcagccagagggcccggaccaggactggaattgctgagatcaagaggcagaggaagctggccagccagacagccccagccagcgctgagctgctgaccctgccctacctgagcggccagttcaccaccccacccagcacaggcacccaggtgacccggcccagcggccagatcagtgaccccagccgcagctactttgtggtggtgaaccacagccagagccaggacacagtgaccaccggggaggccctgaatgtcatccctggggcccaggagaagaaggcccacgccagcctgatgagccctggccgcaggaagtctgagagccagaggaagagcaccaccctgagcggcccccacagcaccatccggaacttccaggaccccaatgcctttgctgtggagaagcagatggtgattgaaaatgcccgggagaagatcctgagcaacaagagcctgcaggagaagctggccgagaacatcaacaagttcctgaccagtgacaacaacatcgcccaggtgcccaagcagacagacaacaaccccacagagcctgagaccagcattgatgagttcctgggcctgcccagcgagatccacatgtctgaggaggccatccaggacatcctggagcagacagaaagtgaccctgccttccaggccctgtttgacctgtttgattatggcaagaccaagaacaacaagaacatcagccagagcatcagcagccagcccatggagagcaaccccagcatcgtgctggctgatgagaccaacctggccgtgaagggcagctttgaaacagaggagagtgatggccagagcggccagcctgccttctgcaccagctaccagaatgatgaccccctgaatgccctgaagaacagcaacaaccatgatgtgctgcggcaggaggaccaggagaacttcagccagatcagcaccagcatccagaagaaggccttcaagacagctgtgcccacagagcagaagtgtgacatcgacatcacctttgagagcgtgcccaacctgaatgacttcaaccagaggggcaacagcaatgctgagtgcaacccccactgtgccgagctgtacaccaaccagatgagcacagaaacagagatggccatcggcatcgagaagaacagcctgagcagcaatgtgcccagcgagagccagctgcagcctgaccagcctgacatccccatcaccagctttgtgtccctgggctgtgaggccaacaatgaaaacctgatcctgagcggcaagagcagccagctgctgagccaggacaccagcctgaccgggaagcccagcaagaagagccagttctgtgagaacagcaatgacacagtgaagctgaagatcaacttccacggcagcaagagcagtgacagcagcgaggtgcacaagagcaagattgagatcaacgtgctggagcctgtgatgagccagctgagcaactgccaggacaacagctgcctgcagagcgagatcctgcctgtgtctgtggagagcagccacctgaatgtgtctggccaggtggagatccacctgggggacagcctgagcagcaccaagcagcccagcaatgattctgcctctgtggagctgaaccacacagaaaatgaggcccaggccagcaagtctgagaacagccaggagcccagcagctctgtgaaggaggagaacaccatcttcctgagcctgggcggcaatgccaactgtgagaaggtggccctgaccccacctgagggcacccctgtggagaacagccacagcctgcccccagagagcgtgtgcagctctgtgggggacagccaccctgagagccagaacacagatgacaagcccagcagcaacaacagcgctgagattgatgccagcaacatcgtgtccctgaaggtgatcatcagtgatgacccctttgtgtccagtgacacagagctgaccagcgctgtgagcagcatcaacggggagaacctgcccaccatcatcctgagcagccccaccaagagccccaccaagaatgctgagctggtgaagtgcctgagcagcgaggagaccgtgggcgctgtggtgtatgcagaggtgggggacagcgcctccatggagcagagcctgctgaccttcaagtctgaggacagcgctgtgaacaacacccagaatgaagatggcatcgccttcagcgccaacgtgaccccctgtgtgtccaaggatggcggctacatccagctgatgcctgccaccagcacagccttcggcaacagcaacaacatcctgattgccacctgtgtgacagaccccacagccctgggcacctctgtgtcccagagcaatgtggtggtgctgcccggcaacagcgcccccatgacagcccagcccctgcccccccagctgcagaccccacccaggagcaacagcgtgtttgctgtgaaccaggccgtgagccccaacttcagccagggcagcgccatcatcatcgccagccctgtgcagcctgtgctgcagggcatggtgggcatgatccctgtgtctgtggtgggccagaatggaaacaacttcagcaccccaccccggcaggtgctgcacatgcccctgacagcccctgtgtgcaacagaagcatcccccagtttcctgtgccccccaagagccagaaggcccagggcctgaggaacaagccctgcatcggcaagcaggtgaacaacctggtggacagcagcggccacagcgtgggctgccacgcccagaagacagaggtgtctgacaagagcatcgccacagacctgggcaagaagtctgaggagaccaccgtgcccttccctgaggagagcatcgtgcctgctgccaagccctgccacagaagagtgctgtgctttgacagcaccacagcccctgtggccaacacccagggccccaaccacaagatggtgtcccagaacaaggagagaaatgctgtgtccttccccaacctggacagccccaacgtgagcagcaccctgaagccacccagcaacaatgccatcaagcgggagaaggagaagccacccctgcccaagatcctgagcaagtctgagagcgccatcagccgccacaccaccatccgggagacccagagcgagaagaaggtgagccccacagaaattgtgctggagagcttccacaaggccacagccaacaaggaaaatgagctgtgcagtgatgtggagcggcagaagaaccctgagaacagcaagctgagcatcggccagcagaatggaggcctgcggtctgagaagagcatcgccagcctgcaggagatgaccaagaagcagggcaccagcagcaacaacaagaatgtgctgtctgtgggcacagctgtgaaggacctgaagcaggagcagaccaagagcgccagcagcctcatcaccacagagatgctgcaggacatccagaggcacagctctgtgtcccggctggccgacagcagtgacctgcctgtgcccaggaccccaggcagcggggccggggagaagcacaaggaggagcccatcgacatcatcaaggcccccagcagccgccgcttcagcgaggacagcagcaccagcaaggtgatggtgccccctgtgaccccagacctgcctgcctgcagccctgccagcgagaccggctctgaaaattctgtgaacatggccgcccacaccctgatgatcctgagcagagctgccatcagcaggaccaccagcgccacccccctgaaggacaacacccagcagttccgggccagcagccgcagcaccaccaagaagaggaagattgaggagctggatgagcgggagaggaacagccggcccagcagcaagaacctgaccaacagcagcatccccatgaagaagaagaagatcaagaagaagaagctgcccagcagcttccctgctggcatggatgtggacaagttcctgctgagcctgcactatgatgaatag

SEQ ID NO: 162275 - DNA, 7284 bp, Artificial Sequence
  Description of Artificial Sequence: Synthetic coding sequence
atgcccctgaagaccaggacagccctgagtgatgatcctgacagcagcaccagcaccctgggcaacatgctggagctgcccggcaccagcagcagcagcaccagccaggagctgcccttctgccagcccaagaagaagagcacccccctgaagtatgaggtgggggacctgatctgggccaagttcaagaggcggccctggtggccctgccgcatctgcagcgaccccctcatcaacacccacagcaagatgaaggtgagcaacagaagaccctaccggcagtactacgtggaggccttcggggaccccagcgagcgggcctgggtggccggcaaggccatcgtgatgtttgagggccgccaccagtttgaggagctgcctgtgctgcggcggcggggcaagcagaaggagaagggctaccgccacaaggtgccccagaagatcctgagcaagtgggaggcctctgtgggcctggccgagcagtatgatgtgcccaagggcagcaagaacaggaagtgcatccctggcagcatcaagctggacagcgaggaggacatgccctttgaggactgcaccaatgaccctgagagcgagcatgacctgctgctgaatggctgcctgaagagcctggcctttgacagcgagcacagcgcagatgagaaggagaagccctgtgccaagagccgggccaggaagagcagtgacaaccccaagaggacctctgtgaagaagggccacatccagtttgaggcccacaaggatgagcggcggggcaagatccctgagaacctgggcctgaacttcatcagcggggacatcagtgacacccaggccagcaatgagctgagcagaattgccaacagcctgaccggcagcaacacagcccctggcagcttcctgttcagcagctgtgggaagaacacagccaagaaggagtttgagaccagcaatggagacagcctgctgggcctgcctgagggcgccctgatcagcaagtgcagccgggagaagaacaagccccagaggagcctggtgtgtggcagcaaggtgaagctgtgctacatcggggctggagatgaggagaagagaagtgacagcatcagcatctgcaccaccagtgatgatggcagcagtgacctggaccccatcgagcacagcagcgagagtgacaacagcgtgctggagatcccagatgcctttgacagaacagagaacatgctgtccatgcagaagaatgagaagatcaagtacagcagatttgctgccaccaacaccagggtgaaggccaagcagaagcccctcatcagcaacagccacacagaccacctgatgggctgcaccaagtctgctgagcccggcacagagaccagccaggtgaacctgagtgacctgaaggccagcaccctggtgcacaagccccagagcgacttcaccaatgatgccctgagccccaagttcaacctgagcagcagcatcagcagcgagaacagcctcatcaagggcggggccgccaaccaggccctgctgcacagcaagagcaagcagcccaagttccgcagcatcaagtgcaagcacaaggaaaatcctgtgatggccgagccccctgtgatcaatgaggagtgcagcctgaagtgctgcagcagtgacaccaagggcagccccctggccagcatcagcaagagcggcaaggtggatggcctgaagctgctgaacaacatgcatgagaagacccgggacagcagtgacattgaaacagctgtggtgaagcacgtgctgtctgagctgaaggagctgagctaccgcagcctgggagaagatgtgtctgacagcggcaccagcaagcccagcaagcccctgctcttcagcagcgccagcagccagaaccacatccccatcgagccagactacaagttcagcaccctgctgatgatgctgaaggacatgcatgacagcaagaccaaggagcagaggctgatgacagcccagaacctggtgtcctaccgcagccctggccgcggggactgcagcaccaacagccctgtgggcgtgtccaaggtgctggtgtctgggggcagcacccacaacagcgagaagaagggagatggcacccagaacagcgccaaccccagccccagcggcggggacagcgccctgtctggagagctgagcgccagcctgcccggcctgctgagtgacaagagggacctgcctgccagcggcaagagcagaagtgactgtgtgaccaggaggaactgtggccgcagcaagcccagcagcaagctgagagatgccttcagcgcccagatggtgaagaacacagtgaacaggaaggccctgaagacagagaggaagaggaagctgaaccagctgcccagcgtgaccctggatgctgtgctgcagggcgaccgggagcggggcggcagcctgcggggcggcgctgaggaccccagcaaagaagaccccctgcagatcatgggccacctgaccagtgaagatggagaccacttcagtgatgtgcactttgacagcaaggtgaagcagagcgaccccgggaagatcagcgagaagggcctgagctttgaaaatggcaagggccctgagctggacagcgtgatgaacagtgaaaatgatgagctgaatggagtgaaccaggtggtgcccaagaagcgctggcagaggctgaaccagaggaggaccaagcccaggaagaggatgaaccgcttcaaggagaaggagaacagtgaatgtgccttccgggtgctgctgcccagcgaccctgtgcaggagggcagagatgagttccctgagcacaggaccccatctgccagcatcctggaggagcccctgacagagcagaaccacgccgactgcctggacagcgctggcccccggctgaatgtgtgtgacaagagcagcgccagcattggagacatggagaaggagcccggcatccccagcctgaccccccaggccgagctgcctgagcctgctgtgcgctctgagaagaagaggctgaggaagcccagcaagtggctgctggagtacacagaggagtatgaccagatctttgcccccaagaagaagcagaagaaggtgcaggagcaggtgcacaaggtgagcagccgctgtgaggaggagagcctgctggcccggggccgcagcagcgcccagaacaagcaggtggatgagaacagcctcatcagcaccaaggaggagccccctgtgctggagcgggaggcccccttcctggagggccccctggcccagagcgagctgggcggcggccatgctgagctgccccagctgaccctgtctgtgcctgtggcccctgaggtgagccccaggcctgccctggagagcgaggagctgctggtgaagaccccaggcaactatgagagcaagaggcagaggaagcccaccaagaagctgctggagagcaatgacctggaccccggcttcatgcccaagaagggggacctgggcctgagcaagaagtgctatgaagctggccacctggagaatggcatcacagagagctgtgccaccagctacagcaaggactttggaggcggcaccaccaagatctttgacaagcccaggaagaggaagaggcagagacatgctgctgccaagatgcagtgcaagaaggtgaagaatgatgacagcagcaaggagatccctggcagcgagggggagctgatgccccacaggacagccaccagccccaaggagaccgtggaggagggcgtggagcatgaccccggcatgcctgccagcaagaagatgcagggcgagcggggcggcggggccgccctgaaggaaaatgtgtgccagaactgtgagaagctgggggagctgctgctgtgtgaggcccagtgctgcggggccttccacctggagtgcctgggcctgacagagatgccccggggcaagttcatctgcaatgaatgtagaacaggcatccacacctgctttgtgtgcaagcagagcggggaggatgtgaagcgctgcctgctgcccctgtgtgggaagttctaccatgaagaatgtgtgcagaagtacccacccaccgtgatgcagaacaagggcttccgctgcagcctgcacatctgcatcacctgccacgccgccaacccagccaacgtgtctgccagcaagggccgcctgatgagatgtgtgcgctgccctgtggcctaccacgccaatgacttctgcctggccgccggcagcaagatcctggccagcaacagcatcatctgccccaaccacttcaccccaagaagaggctgcagaaatcatgaacatgtgaatgtgtcctggtgctttgtgtgcagcgagggcggcagcctgctgtgctgtgacagctgcccagctgccttccacagagaatgtctgaacatcgacatccctgagggcaactggtactgcaatgactgcaaggccggcaagaagccccactaccgggagatcgtgtgggtgaaggtgggccgctaccgctggtggccagctgagatctgccaccccagggctgtgcccagcaacatcgacaagatgagacatgatgtgggggagttccctgtgctcttcttcggcagcaatgactacctgtggacccaccaggcccgggtcttcccctacatggagggagatgtgagcagcaaggacaagatgggcaaaggagtggatggcacctacaagaaggccctgcaggaggccgccgccaggtttgaggagctgaaggcccagaaggagctgcggcagctgcaggaggacaggaagaatgacaagaagcccccaccctacaagcacatcaaggtgaaccggcccatcggccgggtgcagatcttcaccgctgacctgtctgagatcccccgctgcaactgcaaggccacagatgagaacccctgtggcatcgacagcgagtgcatcaacaggatgctgctgtatgagtgccaccccaccgtgtgcccagctgggggccgctgccagaaccagtgcttcagcaagaggcagtacccagaggtggagatcttccgcaccctgcagaggggctggggcctgcggaccaagacagacatcaagaagggggagtttgtgaatgaatatgtgggggagctgattgatgaggaggagtgccgggcccgcatccgctatgcccaggagcatgacatcaccaacttctacatgctgaccctggacaaggaccgcatcattgatgctggccccaagggcaactatgcccgcttcatgaaccactgctgccagcccaactgtgagacccagaagtggagcgtgaatggagacaccagggtgggcctgtttgccctgagtgacatcaaggccggcacagagctgaccttcaactacaacctggagtgcctgggcaatggcaagacagtgtgcaagtgtggggcccccaactgcagcggcttcctgggcgtgcggcccaagaaccagcccatcgccacagaggagaagagcaagaagttcaagaagaagcagcagggcaagaggaggacccagggcgagatcaccaaggagagagaagatgagtgcttcagctgtggagatgctggccagctggtgtcctgcaagaagccaggctgccccaaggtgtaccacgccgactgcctgaacctgaccaagaggcctgctgggaagtgggagtgcccctggcaccagtgtgacatctgtgggaaggaggccgccagcttctgtgagatgtgccccagcagcttctgcaagcagcaccgggagggcatgctgttcatcagcaagctggatggccgcctgagctgcacagaacatgacccctgtggccccaaccccctggagcccggggagatccgggagtatgtgcccccacctgtgcccctgcccccaggccccagcacccacctggccgagcagagcacaggcatggccgcccaggcccccaagatgtctgacaagcccccagctgacaccaaccagatgctgagcctgagcaagaaggccctggccggcacctgccagaggcccctgctgcctgagcggcccctggagaggacagacagccggccccagcccctggacaaggtgcgggacctggccggcagcggcaccaagagccagagcctggtgagcagccagaggcccctggaccggcccccagctgtggccggcccccggccccagctgagtgacaagcccagccctgtgaccagccccagcagcagccccagcgtgcgcagccagcccctggagcggcccctgggcacagctgacccccggctggacaagagcatcggggccgccagcccccggccccagagcctggagaagacctctgtgcccaccggcctgcggctgcccccaccagaccggctgctgatcaccagcagccccaagccccagaccagtgaccggcccacagacaagccccacgccagcctgagccagaggctgcccccacctgagaaggtgctgtctgctgtggtgcagaccctggtggccaaggagaaggccctgcggcctgtggaccagaacacccagagcaagaacagagctgccctggtgatggacctgattgacctgaccccccggcagaaggagcgggccgccagcccccaccaggtgaccccccaggctgatgagaagatgcctgtgctggagagcagctcctggccagccagcaagggcctgggccacatgcccagggctgtggagaagggctgtgtgtctgaccccctgcagaccagcggcaaggctgctgcccccagcgaggacccctggcaggccgtgaagagcctgacccaggcccggctgctgagccagcccccagccaaggccttcctgtatgagcccaccacccaggccagcggccgggccagcgctggagctgagcagaccccaggccccctgagccagagccctggcctggtgaagcaggccaagcagatggtgggcggccagcagctgcctgccctggccgccaagagcggccagagcttccgcagcctgggcaaggccccagccagcctgcccacagaggagaagaagctggtgaccacagagcagagcccctgggccctgggcaaggccagcagcagagctggcctgtggcccatcgtggccggccagaccctggcccagagctgctggagcgctggcagcacccagaccctggcccagacctgctggagcctgggccggggccaggaccccaagccagagcagaacaccctgcctgccctgaaccaggcccccagcagccacaagtgtgccgagagcgagcagaagtag

SEQ ID NO: 162276 - DNA, 7284 bp, Artificial Sequence; identical to SEQ ID NO: 162275
  Description of Artificial Sequence: Synthetic coding sequence

SEQ ID NO: 162277 - DNA, 1692 bp, Artificial Sequence
  Description of Artificial Sequence: Synthetic coding sequence
atgcccctgaagaccaggacagccctgagtgatgatcctgacagcagcaccagcaccctgggcaacatgctggagctgcccggcaccagcagcagcagcaccagccaggagctgcccttctgccagcccaagaagaagagcacccccctgaagtatgaggtgggggacctgatctgggccaagttcaagaggcggccctggtggccctgccgcatctgcagcgaccccctcatcaacacccacagcaagatgaaggtgagcaacagaagaccctaccggcagtactacgtggaggccttcggggaccccagcgagcgggcctgggtggccggcaaggccatcgtgatgtttgagggccgccaccagtttgaggagctgcctgtgctgcggcggcggggcaagcagaaggagaagggctaccgccacaaggtgccccagaagatcctgagcaagtgggaggcctctgtgggcctggccgagcagtatgatgtgcccaagggcagcaagaacaggaagtgcatccctggcagcatcaagctggacagcgaggaggacatgccctttgaggactgcaccaatgaccctgagagcgagcatgacctgctgctgaatggctgcctgaagagcctggcctttgacagcgagcacagcgcagatgagaaggagaagccctgtgccaagagccgggccaggaagagcagtgacaaccccaagaggacctctgtgaagaagggccacatccagtttgaggcccacaaggatgagcggcggggcaagatccctgagaacctgggcctgaacttcatcagcggggacatcagtgacacccaggccagcaatgagctgagcagaattgccaacagcctgaccggcagcaacacagcccctggcagcttcctgttcagcagctgtgggaagaacacagccaagaaggagtttgagaccagcaatggagacagcctgctgggcctgcctgagggcgccctgatcagcaagtgcagccgggagaagaacaagccccagaggagcctggtgtgtggcagcaaggtgaagctgtgctacatcggggctggagatgaggagaagagaagtgacagcatcagcatctgcaccaccagtgatgatggcagcagtgacctggaccccatcgagcacagcagcgagagtgacaacagcgtgctggagatcccagatgcctttgacagaacagagaacatgctgtccatgcagaagaatgagaagatcaagtacagcagatttgctgccaccaacaccagggtgaaggccaagcagaagcccctcatcagcaacagccacacagaccacctgatgggctgcaccaagtctgctgagcccggcacagagaccagccaggtgaacctgagtgacctgaaggccagcaccctggtgcacaagccccagagcgacttcaccaatgatgccctgagccccaagttcaacctgagcagcagcatcagcagcgagaacagcctcatcaagggcggggccgccaaccaggccctgctgcacagcaagagcaagcagcccaagttccgcagcatcaagtgcaagcacaaggaaaatcctgtgatggccgagccccctgtgatcaatgaggagtgcagcctgaagtgctgcagcagtgacaccaagggcagccccctggccagcatcagcaagaccccaccctag

SEQ ID NO: 162278 - DNA, 7782 bp, Artificial Sequence
  Description of Artificial Sequence: Synthetic coding sequence
atggaccagacctgtgagctgcccaggaggaactgcctgctgcccttcagcaaccctgtgaacctggatgcccctgaggacaaggacagcccctttggaaatggccagagcaacttcagcgagcccctgaatggctgcaccatgcagctgagcacagtgtctggcaccagccagaatgcctacggccaggacagccccagctgctacatccccctgcggcggctgcaggacctggcctccatgatcaacgtggagtacctgaatggcagcgcagatggcagcgagagcttccaggaccctgagaagagtgacagccgggcccagacccccatcgtgtgcaccagcctgagccctgggggccccacagccctggccatgaagcaggagcccagctgcaacaacagccctgagctgcaggtgaaggtgaccaagaccatcaagaatggcttcctgcactttgagaacttcacctgtgtggatgatgctgatgtggacagcgagatggaccctgagcagcctgtgacagaagatgagagcattgaggagatctttgaggagacccagaccaatgccacctgcaactatgagaccaagtcagaaaatggagtgaaggtggccatgggcagcgagcaggacagcaccccagagagcagacatggagctgtgaagagccccttcctgcccctggccccccagacagagacccagaagaacaagcagagaaatgaggtggatggcagcaatgagaaggccgccctgctgcctgcccccttcagcctgggggacaccaacatcaccatcgaggagcagctgaacagcatcaacctgtccttccaggatgatcctgacagcagcaccagcaccctgggcaacatgctggagctgcccggcaccagcagcagcagcaccagccaggagctgccctttgtgccccagaagatcctgagcaagtgggaggcctctgtgggcctggccgagcagtatgatgtgcccaagggcagcaagaacaggaagtgcatccctggcagcatcaagctggacagcgaggaggacatgccctttgaggactgcaccaatgaccctgagagcgagcatgacctgctgctgaatggctgcctgaagagcctggcctttgacagcgagcacagcgcagatgagaaggagaagccctgtgccaagagccgggccaggaagagcagtgacaaccccaagaggacctctgtgaagaagggccacatccagtttgaggcccacaaggatgagcggcggggcaagatccctgagaacctgggcctgaacttcatcagcggggacatcagtgacacccaggccagcaatgagctgagcagaattgccaacagcctgaccggcagcaacacagcccctggcagcttcctgttcagcagctgtgggaagaacacagccaagaaggagtttgagaccagcaatggagacagcctgctgggcctgcctgagggcgccctgatcagcaagtgcagccgggagaagaacaagccccagaggagcctggtgtgtggcagcaaggtgaagctgtgctacatcggggctggagatgaggagaagagaagtgacagcatcagcatctgcaccaccagtgatgatggcagcagtgacctggaccccatcgagcacagcagcgagagtgacaacagcgtgctggagatcccagatgcctttgacagaacagagaacatgctgtccatgcagaagaatgagaagatcaagtacagcagatttgctgccaccaacaccagggtgaaggccaagcagaagcccctcatcagcaacagccacacagaccacctgatgggctgcaccaagtctgctgagcccggcacagagaccagccaggtgaacctgagtgacctgaaggccagcaccctggtgcacaagccccagagcgacttcaccaatgatgccctgagccccaagttcaacctgagcagcagcatcagcagcgagaacagcctcatcaagggcggggccgccaaccaggccctgctgcacagcaagagcaagcagcccaagttccgcagcatcaagtgcaagcacaaggaaaatcctgtgatggccgagccccctgtgatcaatgaggagtgcagcctgaagtgctgcagcagtgacaccaagggcagccccctggccagcatcagcaagagcggcaaggtggatggcctgaagctgctgaacaacatgcatgagaagacccgggacagcagtgacattgaaacagctgtggtgaagcacgtgctgtctgagctgaaggagctgagctaccgcagcctgggagaagatgtgtctgacagcggcaccagcaagcccagcaagcccctgctcttcagcagcgccagcagccagaaccacatccccatcgagccagactacaagttcagcaccctgctgatgatgctgaaggacatgcatgacagcaagaccaaggagcagaggctgatgacagcccagaacctggtgtcctaccgcagccctggccgcggggactgcagcaccaacagccctgtgggcgtgtccaaggtgctggtgtctgggggcagcacccacaacagcgagaagaagggagatggcacccagaacagcgccaaccccagccccagcggcggggacagcgccctgtctggagagctgagcgccagcctgcccggcctgctgagtgacaagagggacctgcctgccagcggcaagagcagaagtgactgtgtgaccaggaggaactgtggccgcagcaagcccagcagcaagctgagagatgccttcagcgcccagatggtgaagaacacagtgaacaggaaggccctgaagacagagaggaagaggaagctgaaccagctgcccagcgtgaccctggatgctgtgctgcagggcgaccgggagcggggcggcagcctgcggggcggcgctgaggaccccagcaaagaagaccccctgcagatcatgggccacctgaccagtgaagatggagaccacttcagtgatgtgcactttgacagcaaggtgaagcagagcgaccccgggaagatcagcgagaagggcctgagctttgaaaatggcaagggccctgagctggacagcgtgatgaacagtgaaaatgatgagctgaatggagtgaaccaggtggtgcccaagaagcgctggcagaggctgaaccagaggaggaccaagcccaggaagaggatgaaccgcttcaaggagaaggagaacagtgaatgtgccttccgggtgctgctgcccagcgaccctgtgcaggagggcagagatgagttccctgagcacaggaccccatctgccagcatcctggaggagcccctgacagagcagaaccacgccgactgcctggacagcgctggcccccggctgaatgtgtgtgacaagagcagcgccagcattggagacatggagaaggagcccggcatccccagcctgaccccccaggccgagctgcctgagcctgctgtgcgctctgagaagaagaggctgaggaagcccagcaagtggctgctggagtacacagaggagtatgaccagatctttgcccccaagaagaagcagaagaaggtgcaggagcaggtgcacaaggtgagcagccgctgtgaggaggagagcctgctggcccggggccgcagcagcgcccagaacaagcaggtggatgagaacagcctcatcagcaccaaggaggagccccctgtgctggagcgggaggcccccttcctggagggccccctggcccagagcgagctgggcggcggccatgctgagctgccccagctgaccctgtctgtgcctgtggcccctgaggtgagccccaggcctgccctggagagcgaggagctgctggtgaagaccccaggcaactatgagagcaagaggcagaggaagcccaccaagaagctgctggagagcaatgacctggaccccggcttcatgcccaagaagggggacctgggcctgagcaagaagtgctatgaagctggccacctggagaatggcatcacagagagctgtgccaccagctacagcaaggactttggaggcggcaccaccaagatctttgacaagcccaggaagaggaagaggcagagacatgctgctgccaagatgcagtgcaagaaggtgaagaatgatgacagcagcaaggagatccctggcagcgagggggagctgatgccccacaggacagccaccagccccaaggagaccgtggaggagggcgtggagcatgaccccggcatgcctgccagcaagaagatgcagggcgagcggggcggcggggccgccctgaaggaaaatgtgtgccagaactgtgagaagctgggggagctgctgctgtgtgaggcccagtgctgcggggccttccacctggagtgcctgggcctgacagagatgccccggggcaagttcatctgcaatgaatgtagaacaggcatccacacctgctttgtgtgcaagcagagcggggaggatgtgaagcgctgcctgctgcccctgtgtgggaagttctaccatgaagaatgtgtgcagaagtacccacccaccgtgatgcagaacaagggcttccgctgcagcctgcacatctgcatcacctgccacgccgccaacccagccaacgtgtctgccagcaagggccgcctgatgagatgtgtgcgctgccctgtggcctaccacgccaatgacttctgcctggccgccggcagcaagatcctggccagcaacagcatcatctgccccaaccacttcaccccaagaagaggctgcagaaatcatgaacatgtgaatgtgtcctggtgctttgtgtgcagcgagggcggcagcctgctgtgctgtgacagctgcccagctgccttccacagagaatgtctgaacatcgacatccctgagggcaactggtactgcaatgactgcaaggccggcaagaagccccactaccgggagatcgtgtgggtgaaggtgggccgctaccgctggtggccagctgagatctgccaccccagggctgtgcccagcaacatcgacaagatgagacatgatgtgggggagttccctgtgctcttcttcggcagcaatgactacctgtggacccaccaggcccgggtcttcccctacatggagggagatgtgagcagcaaggacaagatgggcaaaggagtggatggcacctacaagaaggccctgcaggaggccgccgccaggtttgaggagctgaaggcccagaaggagctgcggcagctgcaggaggacaggaagaatgacaagaagcccccaccctacaagcacatcaaggtgaaccggcccatcggccgggtgcagatcttcaccgctgacctgtctgagatcccccgctgcaactgcaaggccacagatgagaacccctgtggcatcgacagcgagtgcatcaacaggatgctgctgtatgagtgccaccccaccgtgtgcccagctgggggccgctgccagaaccagtgcttcagcaagaggcagtacccagaggtggagatcttccgcaccctgcagaggggctggggcctgcggaccaagacagacatcaagaagggggagtttgtgaatgaatatgtgggggagctgattgatgaggaggagtgccgggcccgcatccgctatgcccaggagcatgacatcaccaacttctacatgctgaccctggacaaggaccgcatcattgatgctggccccaagggcaactatgcccgcttcatgaaccactgctgccagcccaactgtgagacccagaagtggagcgtgaatggagacaccagggtgggcctgtttgccctgagtgacatcaaggccggcacagagctgaccttcaactacaacctggagtgcctgggcaatggcaagacagtgtgcaagtgtggggcccccaactgcagcggcttcctgggcgtgcggcccaagaaccagcccatcgccacagaggagaagagcaagaagttcaagaagaagcagcagggcaagaggaggacccagggcgagatcaccaaggagagagaagatgagtgcttcagctgtggagatgctggccagctggtgtcctgcaagaagccaggctgccccaaggtgtaccacgccgactgcctgaacctgaccaagaggcctgctgggaagtgggagtgcccctggcaccagtgtgacatctgtgggaaggaggccgccagcttctgtgagatgtgccccagcagcttctgcaagcagcaccgggagggcatgctgttcatcagcaagctggatggccgcctgagctgcacagaacatgacccctgtggccccaaccccctggagcccggggagatccgggagtatgtgcccccacctgtgcccctgcccccaggccccagcacccacctggccgagcagagcacaggcatggccgcccaggcccccaagatgtctgacaagcccccagctgacaccaaccagatgctgagcctgagcaagaaggccctggccggcacctgccagaggcccctgctgcctgagcggcccctggagaggacagacagccggccccagcccctggacaaggtgcgggacctggccggcagcggcaccaagagccagagcctggtgagcagccagaggcccctggaccggcccccagctgtggccggcccccggccccagctgagtgacaagcccagccctgtgaccagccccagcagcagccccagcgtgcgcagccagcccctggagcggcccctgggcacagctgacccccggctggacaagagcatcggggccgccagcccccggccccagagcctggagaagacctctgtgcccaccggcctgcggctgcccccaccagaccggctgctgatcaccagcagccccaagccccagaccagtgaccggcccacagacaagccccacgccagcctgagccagaggctgcccccacctgagaaggtgctgtctgctgtggtgcagaccctggtggccaaggagaaggccctgcggcctgtggaccagaacacccagagcaagaacagagctgccctggtgatggacctgattgacctgaccccccggcagaaggagcgggccgccagcccccaccaggtgaccccccaggctgatgagaagatgcctgtgctggagagcagctcctggccagccagcaagggcctgggccacatgcccagggctgtggagaagggctgtgtgtctgaccccctgcagaccagcggcaaggctgctgcccccagcgaggacccctggcaggccgtgaagagcctgacccaggcccggctgctgagccagcccccagccaaggccttcctgtatgagcccaccacccaggccagcggccgggccagcgctggagctgagcagaccccaggccccctgagccagagccctggcctggtgaagcaggccaagcagatggtgggcggccagcagctgcctgccctggccgccaagagcggccagagcttccgcagcctgggcaaggccccagccagcctgcccacagaggagaagaagctggtgaccacagagcagagcccctgggccctgggcaaggccagcagcagagctggcctgtggcccatcgtggccggccagaccctggcccagagctgctggagcgctggcagcacccagaccctggcccagacctgctggagcctgggccggggccaggaccccaagccagagcagaacaccctgcctgccctgaaccaggcccccagcagccacaagtgtgccgagagcgagcagaagtag

SEQ ID NO: 162279 - DNA, 8091 bp, Artificial Sequence
  Description of Artificial Sequence: Synthetic coding sequence
atggaccagacctgtgagctgcccaggaggaactgcctgctgcccttcagcaaccctgtgaacctggatgcccctgaggacaaggacagcccctttggaaatggccagagcaacttcagcgagcccctgaatggctgcaccatgcagctgagcacagtgtctggcaccagccagaatgcctacggccaggacagccccagctgctacatccccctgcggcggctgcaggacctggcctccatgatcaacgtggagtacctgaatggcagcgcagatggcagcgagagcttccaggaccctgagaagagtgacagccgggcccagacccccatcgtgtgcaccagcctgagccctgggggccccacagccctggccatgaagcaggagcccagctgcaacaacagccctgagctgcaggtgaaggtgaccaagaccatcaagaatggcttcctgcactttgagaacttcacctgtgtggatgatgctgatgtggacagcgagatggaccctgagcagcctgtgacagaagatgagagcattgaggagatctttgaggagacccagaccaatgccacctgcaactatgagaccaagtcagaaaatggagtgaaggtggccatgggcagcgagcaggacagcaccccagagagcagacatggagctgtgaagagccccttcctgcccctggccccccagacagagacccagaagaacaagcagagaaatgaggtggatggcagcaatgagaaggccgccctgctgcctgcccccttcagcctgggggacaccaacatcaccatcgaggagcagctgaacagcatcaacctgtccttccaggatgatcctgacagcagcaccagcaccctgggcaacatgctggagctgcccggcaccagcagcagcagcaccagccaggagctgcccttctgccagcccaagaagaagagcacccccctgaagtatgaggtgggggacctgatctgggccaagttcaagagaagaccctggtggccctgccgcatctgcagcgaccccctcatcaacacccacagcaagatgaaggtgagcaacagaagaccctaccggcagtactacgtggaggcctttggagaccccagcgagcgggcctgggtggccggcaaggccatcgtgatgtttgagggccgccaccagtttgaggagctgcctgtgctgcggcggcggggcaagcagaaggagaagggctaccgccacaaggtgccccagaagatcctgagcaagtgggaggcctctgtgggcctggccgagcagtatgatgtgcccaagggcagcaagaacaggaagtgcatccctggcagcatcaagctggacagcgaggaggacatgccctttgaggactgcaccaatgaccctgagagcgagcatgacctgctgctgaatggctgcctgaagagcctggcctttgattctgagcacagcgcagatgagaaggagaagccctgtgccaagagccgggccaggaagagcagtgacaaccccaagaggacctctgtgaagaagggccacatccagtttgaggcccacaaggatgaaagaagaggcaagatccctgagaacctgggcctgaacttcatcagcggggacatcagtgacacccaggccagcaatgagctgagccgcatcgccaacagcctgaccggcagcaacacagcccctggcagcttcctgttcagcagctgtgggaagaacacagccaagaaggagtttgagaccagcaatggagacagcctgctgggcctgcctgagggcgccctgatcagcaagtgcagccgggagaagaacaagccccagaggagcctggtgtgtggcagcaaggtgaagctgtgctacatcggggctggagatgaggagaagagaagtgacagcatcagcatctgcaccaccagtgatgatggcagcagtgacctggaccccatcgagcacagcagcgagagtgacaacagcgtgctggagatcccagatgcctttgacagaacagagaacatgctgtccatgcagaagaatgagaagatcaagtacagcagatttgctgccaccaacaccagggtgaaggccaagcagaagcccctcatcagcaacagccacacagaccacctgatgggctgcaccaagtctgctgagcctggaacagagaccagccaggtgaacctgagtgacctgaaggccagcaccctggtgcacaagccccagagcgacttcaccaatgatgccctgagccccaagttcaacctgagcagcagcatcagcagcgagaacagcctcatcaagggcggggccgccaaccaggccctgctgcacagcaagagcaagcagcccaagttccgcagcatcaagtgcaagcacaaggagaaccctgtgatggccgagccccctgtgatcaatgaagaatgttccctgaagtgctgcagcagtgacaccaagggcagccccctggccagcatcagcaagagcggcaaggtggatggcctgaagctgctgaacaacatgcatgagaagacccgggacagcagtgacatcgagacagctgtggtgaagcacgtgctgtctgagctgaaggagctgagctaccgcagcctgggggaggatgtgtctgattctggcaccagcaagcccagcaagcccctgctcttcagcagcgccagcagccagaaccacatccccattgaaccagactacaagttcagcaccctgctgatgatgctgaaggacatgcatgacagcaagaccaaggagcagaggctgatgacagcccagaacctggtgtcctaccgcagccctggccgcggggactgcagcaccaacagccctgtgggcgtgtccaaggtgctggtgtctgggggcagcacccacaacagcgagaagaagggagatggcacccagaacagcgccaaccccagccccagcggcggggacagcgccctgagcggggagctgagcgccagcctgcccggcctgctgagtgacaagagggacctgcctgccagcggcaagagcagaagtgactgtgtgaccaggaggaactgtggccgcagcaagcccagcagcaagctgagagatgccttcagcgcccagatggtgaagaacacagtgaacaggaaggccctgaagacagagaggaagaggaagctgaaccagctgcccagcgtgaccctggatgctgtgctgcagggcgaccgggagcggggcggcagcctgcggggcggcgctgaggaccccagcaaggaggaccccctgcagatcatgggccacctgaccagtgaagatggagaccacttcagtgatgtgcactttgacagcaaggtgaagcagagcgaccccgggaagatcagcgagaagggcctgagctttgaaaatggaaaaggacctgagctggacagcgtgatgaacagtgaaaatgatgagctgaatggagtgaaccaggtggtgcccaagaagcgctggcagaggctgaaccagaggaggaccaagcccaggaagaggatgaaccgcttcaaggagaaggaaaattctgaatgtgccttccgggtgctgctgcccagcgaccctgtgcaggagggcagagatgagttccctgagcacaggacccccagcgccagcatcctggaggagcccctgacagagcagaaccacgccgactgcctggacagcgctggcccccggctgaatgtgtgtgacaagagcagcgccagcatcggggacatggagaaggagcccggcatccccagcctgaccccccaggccgagctgcctgagcctgctgtgcgctctgagaagaagaggctgaggaagcccagcaagtggctgctggagtacacagaggagtatgaccagatctttgcccccaagaagaagcagaagaaggtgcaggagcaggtgcacaaggtgagcagccgctgtgaggaggagagcctgctggcccggggccgcagcagcgcccagaacaagcaggtggatgagaacagcctcatcagcaccaaggaggagccccctgtgctggagcgggaggcccccttcctggagggccccctggcccagagcgagctgggcggcggccacgccgagctgccccagctgaccctgtctgtgcctgtggcccctgaggtgagccccaggcctgccctggagagcgaggagctgctggtgaagaccccaggcaactatgagagcaagaggcagaggaagcccaccaagaagctgctggagagcaatgacctggaccccggcttcatgcccaagaagggggacctgggcctgagcaagaagtgctatgaggccggccacctggagaatggcatcacagagagctgtgccaccagctacagcaaggactttggaggcggcaccaccaagatctttgacaagcccaggaagaggaagaggcagagacatgctgctgccaagatgcagtgcaagaaggtgaagaatgatgacagcagcaaggagatccctggcagcgagggggagctgatgccccacaggacagccaccagccccaaggagaccgtggaggagggcgtggagcatgaccccggcatgcctgccagcaagaagatgcagggcgagcggggcggcggggccgccctgaaggaaaatgtgtgccagaactgtgagaagctgggggagctgctgctgtgtgaggcccagtgctgcggggccttccacctggagtgcctgggcctgacagagatgccccggggcaagttcatctgcaatgaatgtagaacaggcatccacacctgctttgtgtgcaagcagagcggagaagatgtgaagcgctgcctgctgcccctgtgtgggaagttctaccacgaggagtgtgtgcagaagtacccacccaccgtgatgcagaacaagggcttccgctgcagcctgcacatctgcatcacctgccacgccgccaacccagccaacgtgtctgccagcaagggccgcctgatgagatgtgtgcgctgccctgtggcctaccacgccaatgacttctgcctggccgccggcagcaagatcctggccagcaacagcatcatctgccccaaccacttcaccccccggcggggctgcaggaaccacgagcacgtgaatgtgtcctggtgctttgtgtgcagcgagggcggcagcctgctgtgctgtgacagctgcccagctgccttccaccgggagtgcctgaacatcgacatccctgagggcaactggtactgcaatgactgcaaggccggcaagaagccccactaccgggagatcgtgtgggtgaaggtgggccgctaccgctggtggccagctgagatctgccaccccagggctgtgcccagcaacatcgacaagatgagacatgatgtgggggagttccctgtgctcttcttcggcagcaatgactacctgtggacccaccaggcccgggtcttcccctacatggagggagatgtgagcagcaaggacaagatgggcaagggcgtggatggcacctacaagaaggccctgcaggaggccgccgccaggtttgaggagctgaaggcccagaaggagctgcggcagctgcaggaggacaggaagaatgacaagaagcccccaccctacaagcacatcaaggtgaaccggcccatcggccgggtgcagatcttcaccgctgacctgtctgagatcccccgctgcaactgcaaggccacagatgagaacccctgtggcattgattctgagtgcatcaacaggatgctgctgtatgagtgccaccccaccgtgtgcccagctgggggccgctgccagaaccagtgcttcagcaagaggcagtacccagaggtggagatcttccgcaccctgcagaggggctggggcctgcggaccaagacagacatcaagaagggggagtttgtgaatgaatatgtgggggagctgattgatgaggaggagtgccgggcccgcatccgctatgcccaggagcatgacatcaccaacttctacatgctgaccctggacaaggaccgcatcattgatgctggccccaagggcaactatgcccgcttcatgaaccactgctgccagcccaactgtgagacccagaagtggagcgtgaatggagacaccagggtgggcctgtttgccctgagtgacatcaaggccggcacagagctgaccttcaactacaacctggagtgcctgggcaatggcaagacagtgtgcaagtgtggggcccccaactgcagcggcttcctgggcgtgcggcccaagaaccagcccatcgccacagaggagaagagcaagaagttcaagaagaagcagcagggcaagaggaggacccagggcgagatcaccaaggagcgggaggatgagtgcttcagctgtggagatgctggccagctggtgtcctgcaagaagccaggctgccccaaggtgtaccacgccgactgcctgaacctgaccaagaggcctgctgggaagtgggagtgcccctggcaccagtgtgacatctgtgggaaggaggccgccagcttctgtgagatgtgccccagcagcttctgcaagcagcaccgggagggcatgctgttcatcagcaagctggatggccgcctgagctgcacagaacatgacccctgtggccccaaccccctggagcctggagagatccgggagtatgtgcccccacctgtgcccctgcccccaggccccagcacccacctggccgagcagagcacaggcatggccgcccaggcccccaagatgtctgacaagcccccagctgacaccaaccagatgctgagcctgagcaagaaggccctggccggcacctgccagaggcccctgctgcctgagcggcccctggagaggacagacagccggccccagcccctggacaaggtgcgggacctggccggcagcggcaccaagagccagagcctggtgagcagccagaggcccctggacaggcctcctgctgtggccggcccccggccccagctgagtgacaagcccagccctgtgaccagccccagcagcagccccagcgtgcgcagccagcccctggagcggcccctgggcacagctgacccccggctggacaagagcattggagctgccagcccccggccccagagcctggagaagacctctgtgcccaccggcctgcggctgcccccaccagaccggctgctgatcaccagcagccccaagccccagaccagtgaccggcccacagacaagccccacgccagcctgagccagaggctgcccccacctgagaaggtgctgtctgctgtggtgcagaccctggtggccaaggagaaggccctgcggcctgtggaccagaacacccagagcaagaacagagctgccctggtgatggacctgattgacctgaccccccggcagaaggagagagctgccagcccccaccaggtgaccccccaggctgatgagaagatgcctgtgctggagagcagctcctggccagccagcaagggcctgggccacatgcccagggctgtggagaagggctgtgtgtctgaccccctgcagaccagcggcaaggccgccgcccccagcgaggacccctggcaggccgtgaagagcctgacccaggcccggctgctgagccagcccccagccaaggccttcctgtatgagcccaccacccaggccagcggccgggccagcgctggagctgagcagaccccaggccccctgagccagagccctggcctggtgaagcaggccaagcagatggtgggcggccagcagctgcctgccctggccgccaagagcggccagagcttccgcagcctgggcaaggccccagccagcctgcccacagaggagaagaagctggtgaccacagagcagagcccctgggccctgggcaaggccagcagccgggccggcctgtggcccatcgtggccggccagaccctggcccagagctgctggagcgctggcagcacccagaccctggcccagacctgctggagcctgggccggggccaggaccccaagccagagcagaacaccctgcctgccctgaaccaggcccccagcagccacaagtgtgccgagagcgagcagaagtag

SEQ ID NO: 162280 - DNA, 468 bp, Artificial Sequence
  Description of Artificial Sequence: Synthetic coding sequence
atgcccctgaagaccaggacagccctgagtgatgatcctgacagcagcaccagcaccctgggcaacatgctggagctgcccggcaccagcagcagcagcaccagccaggagctgcccttctgccagcccaagaagaagagcacccccctgaagtatgaggtgggggacctgatctgggccaagttcaagaggcggccctggtggccctgccgcatctgcagcgaccccctcatcaacacccacagcaagatgaaggtgagcaacagaagaccctaccggcagtactacgtggaggccttcggggaccccagcgagcgggcctgggtggccggcaaggccatcgtgatgtttgagggccgccaccagtttgaggagctgcctgtgctgcggcggcggggcaagcagaaggagaagggctaccgccacaaggtgccccagaagatcctgagcaagtgggaggccagctag

SEQ ID NO: 162281 - DNA, 375 bp, Artificial Sequence
  Description of Artificial Sequence: Synthetic coding sequence
atgcccctgaagaccaggacagccctgagtgatgatcctgacagcagcaccagcaccctgggcaacatgctggagctgcccggcaccagcagcagcagcaccagccaggagctgcccttctgccagcccaagaagaagagcacccccctgaagtatgaggtgggggacctgatctgggccaagttcaagaggcggccctggtggccctgccgcatctgcagcgaccccctcatcaacacccacagcaagatgaaggtgagcaacagaagaccctaccggcagtactacgtggaggccttcggggaccccagcgagcgggcctgggtggccggcaaggccatcgtgatgtttgagggccgccaccagtttgaatag

SEQ ID NO: 162282 - DNA, 4200 bp, Artificial Sequence
  Description of Artificial Sequence: Synthetic coding sequence
atgagcggcctgggggacagcagcagtgaccctgccaacccagacagccacaagaggaagggcagcccctgtgacaccctggccagcagcacagagaagagaagaagagagcaggagaacaagtacctggaggagctggccgagctgctgagcgccaacatcagtgacatcgacagcctgtctgtgaagccagacaagtgcaagatcctgaagaagacagtggaccagatccagctgatgaagaggatggagcaggagaagagcaccacagatgatgatgtgcagaagagtgacatcagcagcagcagccagggcgtgattgagaaggagagcctgggccccctgctgctggaggccctggatggcttcttctttgtggtgaactgtgagggcagaattgtgtttgtgtctgaaaatgtgaccagctacctgggctacaaccaggaggagctgatgaacacctctgtgtacagcatcctgcacgtgggggaccacgccgagtttgtgaagaacctgctgcccaagagcctggtgaatggagtgccctggccccaggaggccaccaggaggaacagccacaccttcaactgcaggatgctgatccaccccccagatgagcctggaacagagaaccaggaggcctgccagagatatgaggtgatgcagtgcttcaccgtgtcccagcccaagagcatccaggaggatggagaggacttccagagctgcctgatctgcatcgcccggcggctgccccggcccccagccatcactggagtggagagcttcatgaccaagcaggacaccaccgggaagatcatcagcattgacaccagcagcctgcgggctgctggccgcacaggctgggaggacctggtgaggaagtgcatctatgccttcttccagccccagggccgggagcccagctatgcccggcagctgttccaggaggtgatgacccggggcacagccagcagccccagctaccgcttcatcctgaatgatggcaccatgctgagcgcccacaccaagtgcaagctgtgctacccccagagcccagacatgcagcccttcatcatgggcatccacatcatcgaccgggagcacagcggcctgagcccccaggatgacaccaacagcggcatgagcatcccccgggtgaaccccagcgtgaaccccagcatcagccctgcccacggcgtggcccggagcagcaccctgccccccagcaacagcaacatggtgtccacccgcatcaaccggcagcagagcagtgacctgcacagcagcagccacagcaacagcagcaacagccagggcagctttggctgcagccctggcagccagatcgtggccaacgtggccctgaaccagggccaggccagcagccagagcagcaaccccagcctgaacctgaacaacagccccatggagggcaccggcatcagcctggcccagttcatgagcccccggcggcaggtgaccagcggcctggccacccggcccaggatgcccaacaacagcttcccccccaacatcagcaccctgagcagccctgtgggcatgaccagcagcgcctgcaacaacaacaacagaagctacagcaacatccctgtgaccagcctgcagggcatgaatgaaggccccaacaacagcgtgggcttcagcgccagcagccctgtgctgcggcagatgagcagccagaacagccccagccggctgaacatccagcctgccaaggccgagagcaaggacaacaaggagatcgccagcatcctgaatgagatgatccagagcgacaacagcagcagtgatggcaagcccctggacagcggcctgctgcacaacaatgaccggctgagtgatggagacagcaagtacagccagaccagccacaagctggtgcagctgctgaccaccacagctgagcagcagctgcggcatgctgacatcgacaccagctgcaaggatgtgctgagctgcaccggcaccagcaacagcgccagcgccaacagcagcggcggcagctgccccagcagccacagcagcctgacagagcggcacaagatcctgcaccggctgctgcaggagggcagccccagcgacatcaccaccctgtctgtggagccagacaagaaggacagcgccagcacctctgtgtctgtgacaggccaggtgcagggcaacagcagcatcaagctggagctggatgccagcaagaagaaggagagcaaggaccaccagctgctgcgctacctgctggacaaggatgagaaggacctgcggagcacccccaacctgagcctggatgatgtgaaggtgaaggtggagaagaaggagcagatggacccctgcaacaccaaccccacccccatgaccaagcccaccccagaggagatcaagctggaggcccagagccagttcaccgctgacctggaccagtttgaccagctgctgcccaccctggagaaggccgcccagctgcccggcctgtgtgaaacagacaggatggatggagctgtgacctctgtgaccatcaagtctgagatcctgcctgccagcctgcagagcgccacagcccggcccaccagccggctgaaccggctgcctgagctggagctggaggccatcgacaaccagtttggccagcccggcactggagaccagatcccctggaccaacaacacagtgacagccatcaaccagagcaagtctgaggaccagtgcatcagcagccagctggatgagctgctgtgcccccccaccaccgtggagggcagaaatgatgagaaggccctgctggagcagctggtgtccttcctgagcggcaaggatgaaacagagctggccgagctggaccgggccctgggcatcgacaagctggtgcagggcggcggcctggatgtgctgtctgagcgcttccccccccagcaggccaccccacccctcatcatggaggagcggcccaacctgtacagccagccctacagcagccccagccccacagccaacctgcccagccccttccagggcatggtgcggcagaagcccagcctgggcaccatgcctgtgcaggtgaccccacccaggggggccttcagccctggcatgggcatgcagccccggcagaccctgaacagacctcctgctgcccccaaccagctgcggctgcagctgcagcagaggctgcagggccagcagcagctgatccaccagaaccggcaggccatcctgaaccagtttgctgccacagcccctgtgggcatcaacatgaggagcggcatgcagcagcagatcaccccccagccccccctgaatgcccagatgctggcccagaggcagcgggagctgtacagccagcagcaccggcagaggcagctgatccagcagcagagggccatgctgatgaggcagcagagctttggaaacaacctgccccccagcagcggcctgcctgtgcagatgggcaacccccggctgccccagggcgccccccagcagttcccctacccacccaactacggcaccaaccctggcaccccaccagccagcaccagccccttcagccagctggccgccaaccctgaggccagcctggccaacagaaattccatggtgtcccggggcatgacaggcaacattggaggccagtttggaacaggcatcaacccccagatgcagcagaatgtgttccagtacccaggagctggcatggtgccccagggcgaggccaactttgcccccagcctgagccctggcagctccatggtgcccatgcccatccccccaccccagagcagcctgctgcagcagaccccaccagccagcggctaccagagcccagacatgaaggcctggcagcagggcgccatcggcaacaacaacgtgttcagccaggccgtgcagaaccagcccaccccagcccagcccggggtgtacaacaacatgagcatcaccgtgtccatggccggcggcaacaccaacgtgcagaacatgaaccccatgatggcccagatgcagatgagcagcctgcagatgcctggcatgaacacagtgtgcccagagcagatcaatgaccctgccctgcggcacacaggcctgtactgcaaccagctgagcagcacagacctgctgaagacagaagcagatggcacccaggacaagaagacagaggagttcttctctgtggtgaccacagactag

SEQ ID NO: 162283 - DNA, 4326 bp, Artificial Sequence
  Description of Artificial Sequence: Synthetic coding sequence
atgagcggcctgggggacagcagcagtgaccctgccaacccagacagccacaagaggaagggcagcccctgtgacaccctggccagcagcacagagaagagaagaagagagcaggagaacaagtacctggaggagctggccgagctgctgagcgccaacatcagtgacatcgacagcctgtctgtgaagccagacaagtgcaagatcctgaagaagacagtggaccagatccagctgatgaagaggatggagcaggagaagagcaccacagatgatgatgtgcagaagagtgacatcagcagcagcagccagggcgtgattgagaaggagagcctgggccccctgctgctggaggccctggatggcttcttctttgtggtgaactgtgagggcagaattgtgtttgtgtctgaaaatgtgaccagctacctgggctacaaccaggaggagctgatgaacacctctgtgtacagcatcctgcacgtgggggaccacgccgagtttgtgaagaacctgctgcccaagagcctggtgaatggagtgccctggccccaggaggccaccaggaggaacagccacaccttcaactgcaggatgctgatccaccccccagatgagcctggaacagagaaccaggaggcctgccagagatatgaggtgatgcagtgcttcaccgtgtcccagcccaagagcatccaggaggatggagaggacttccagagctgcctgatctgcatcgcccggcggctgccccggcccccagccatcactggagtggagagcttcatgaccaagcaggacaccaccgggaagatcatcagcattgacaccagcagcctgcgggctgctggccgcacaggctgggaggacctggtgaggaagtgcatctatgccttcttccagccccagggccgggagcccagctatgcccggcagctgttccaggaggtgatgacccggggcacagccagcagccccagctaccgcttcatcctgaatgatggcaccatgctgagcgcccacaccaagtgcaagctgtgctacccccagagcccagacatgcagcccttcatcatgggcatccacatcatcgaccgggagcacagcggcctgagcccccaggatgacaccaacagcggcatgagcatcccccgggtgaaccccagcgtgaaccccagcatcagccctgcccacggcgtggcccggagcagcaccctgccccccagcaacagcaacatggtgtccacccgcatcaaccggcagcagagcagtgacctgcacagcagcagccacagcaacagcagcaacagccagggcagctttggctgcagccctggcagccagatcgtggccaacgtggccctgaaccagggccaggccagcagccagagcagcaaccccagcctgaacctgaacaacagccccatggagggcaccggcatcagcctggcccagttcatgagcccccggcggcaggtgaccagcggcctggccacccggcccaggatgcccaacaacagcttcccccccaacatcagcaccctgagcagccctgtgggcatgaccagcagcgcctgcaacaacaacaacagaagctacagcaacatccctgtgaccagcctgcagggcatgaatgaaggccccaacaacagcgtgggcttcagcgccagcagccctgtgctgcggcagatgagcagccagaacagccccagccggctgaacatccagcctgccaaggccgagagcaaggacaacaaggagatcgccagcatcctgaatgagatgatccagagcgacaacagcagcagtgatggcaagcccctggacagcggcctgctgcacaacaatgaccggctgagtgatggagacagcaagtacagccagaccagccacaagctggtgcagctgctgaccaccacagctgagcagcagctgcggcatgctgacatcgacaccagctgcaaggatgtgctgagctgcaccggcaccagcaacagcgccagcgccaacagcagcggcggcagctgccccagcagccacagcagcctgacagagcggcacaagatcctgcaccggctgctgcaggagggcagccccagcgacatcaccaccctgtctgtggagccagacaagaaggacagcgccagcacctctgtgtctgtgacaggccaggtgcagggcaacagcagcatcaagctggagctggatgccagcaagaagaaggagagcaaggaccaccagctgctgcgctacctgctggacaaggatgagaaggacctgcggagcacccccaacctgagcctggatgatgtgaaggtgaaggtggagaagaaggagcagatggacccctgcaacaccaaccccacccccatgaccaagcccaccccagaggagatcaagctggaggcccagagccagttcaccgctgacctggaccagtttgaccagctgctgcccaccctggagaaggccgcccagctgcccggcctgtgtgaaacagacaggatggatggagctgtgacctctgtgaccatcaagtctgagatcctgcctgccagcctgcagagcgccacagcccggcccaccagccggctgaaccggctgcctgagctggagctggaggccatcgacaaccagtttggccagcccggcactggagaccagatcccctggaccaacaacacagtgacagccatcaaccagagcaagtctgaggaccagtgcatcagcagccagctggatgagctgctgtgcccccccaccaccgtggagggcagaaatgatgagaaggccctgctggagcagctggtgtccttcctgagcggcaaggatgaaacagagctggccgagctggaccgggccctgggcatcgacaagctggtgcagggcggcggcctggatgtgctgtctgagcgcttccccccccagcaggccaccccacccctcatcatggaggagcggcccaacctgtacagccagccctacagcagccccagccccacagccaacctgcccagccccttccagggcatggtgcggcagaagcccagcctgggcaccatgcctgtgcaggtgaccccacccaggggggccttcagccctggcatgggcatgcagccccggcagaccctgaacagacctcctgctgcccccaaccagctgcggctgcagctgcagcagaggctgcagggccagcagcagctgatccaccagaaccggcaggccatcctgaaccagtttgctgccacagcccctgtgggcatcaacatgaggagcggcatgcagcagcagatcaccccccagccccccctgaatgcccagatgctggcccagaggcagcgggagctgtacagccagcagcaccggcagaggcagctgatccagcagcagagggccatgctgatgaggcagcagagctttggaaacaacctgccccccagcagcggcctgcctgtgcagatgggcaacccccggctgccccagggcgccccccagcagttcccctacccacccaactacggcaccaaccctggcaccccaccagccagcaccagccccttcagccagctggccgccaaccctgaggccagcctggccaacagaaattccatggtgtcccggggcatgacaggcaacattggaggccagtttggaacaggcatcaacccccagatgcagcagaatgtgttccagtacccaggagctggcatggtgccccagggcgaggccaactttgcccccagcctgagccctggcagctccatggtgcccatgcccatccccccaccccagagcagcctgctgcagcagaccccaccagccagcggctaccagagcccagacatgaaggcctggcagcagggcgccatcggcaacaacaacgtgttcagccaggccgtgcagaaccagcccaccccagcccagcccggggtgtacaacaacatgagcatcaccgtgtccatggccggcggcaacaccaacgtgcagaacatgaaccccatgatggcccagatgcagatgagcagcctgcagatgcctggcatgaacacagtgtgcccagagcagatcaatgaccctgccctgcggcacacaggcctgtactgcaaccagctgagcagcacagacctgctgaagacagaagcagatggcacccagcaggtgcagcaggtgcaggtgtttgctgatgtgcagtgcaccgtgaacctggtgggcggggacccctacctgaaccagcccggccccctgggcacccagaagcccaccagcggcccccagaccccccaggcccagcagaagagcctgctgcagcagctgctgacagaatag

SEQ ID NO: 162284 - DNA, 4323 bp, Artificial Sequence
  Description of Artificial Sequence: Synthetic coding sequence
atgagcggcctgggggacagcagcagtgaccctgccaacccagacagccacaagaggaagggcagcccctgtgacaccctggccagcagcacagagaagagaagaagagagcaggagaacaagtacctggaggagctggccgagctgctgagcgccaacatcagtgacatcgacagcctgtctgtgaagccagacaagtgcaagatcctgaagaagacagtggaccagatccagctgatgaagaggatggagcaggagaagagcaccacagatgatgatgtgcagaagagtgacatcagcagcagcagccagggcgtgattgagaaggagagcctgggccccctgctgctggaggccctggatggcttcttctttgtggtgaactgtgagggcagaattgtgtttgtgtctgaaaatgtgaccagctacctgggctacaaccaggaggagctgatgaacacctctgtgtacagcatcctgcacgtgggggaccacgccgagtttgtgaagaacctgctgcccaagagcctggtgaatggagtgccctggccccaggaggccaccaggaggaacagccacaccttcaactgcaggatgctgatccaccccccagatgagcctggaacagagaaccaggaggcctgccagagatatgaggtgatgcagtgcttcaccgtgtcccagcccaagagcatccaggaggatggagaggacttccagagctgcctgatctgcatcgcccggcggctgccccggcccccagccatcactggagtggagagcttcatgaccaagcaggacaccaccgggaagatcatcagcattgacaccagcagcctgcgggctgctggccgcacaggctgggaggacctggtgaggaagtgcatctatgccttcttccagccccagggccgggagcccagctatgcccggcagctgttccaggaggtgatgacccggggcacagccagcagccccagctaccgcttcatcctgaatgatggcaccatgctgagcgcccacaccaagtgcaagctgtgctacccccagagcccagacatgcagcccttcatcatgggcatccacatcatcgaccgggagcacagcggcctgagcccccaggatgacaccaacagcggcatgagcatcccccgggtgaaccccagcgtgaaccccagcatcagccctgcccacggcgtggcccggagcagcaccctgccccccagcaacagcaacatggtgtccacccgcatcaaccggcagcagagcagtgacctgcacagcagcagccacagcaacagcagcaacagccagggcagctttggctgcagccctggcagccagatcgtggccaacgtggccctgaaccagggccaggccagcagccagagcagcaaccccagcctgaacctgaacaacagccccatggagggcaccggcatcagcctggcccagttcatgagcccccggcggcaggtgaccagcggcctggccacccggcccaggatgcccaacaacagcttcccccccaacatcagcaccctgagcagccctgtgggcatgaccagcagcgcctgcaacaacaacaacagaagctacagcaacatccctgtgaccagcctgcagggcatgaatgaaggccccaacaacagcgtgggcttcagcgccagcagccctgtgctgcggcagatgagcagccagaacagccccagccggctgaacatccagcctgccaaggccgagagcaaggacaacaaggagatcgccagcatcctgaatgagatgatccagagcgacaacagcagcagtgatggcaagcccctggacagcggcctgctgcacaacaatgaccggctgagtgatggagacagcaagtacagccagaccagccacaagctggtgcagctgctgaccaccacagctgagcagcagctgcggcatgctgacatcgacaccagctgcaaggatgtgctgagctgcaccggcaccagcaacagcgccagcgccaacagcagcggcggcagctgccccagcagccacagcagcctgacagagcggcacaagatcctgcaccggctgctgcaggagggcagccccagcgacatcaccaccctgtctgtggagccagacaagaaggacagcgccagcacctctgtgtctgtgacaggccaggtgcagggcaacagcagcatcaagctggagctggatgccagcaagaagaaggagagcaaggaccaccagctgctgcgctacctgctggacaaggatgagaaggacctgcggagcacccccaacctgagcctggatgatgtgaaggtgaaggtggagaagaaggagcagatggacccctgcaacaccaaccccacccccatgaccaagcccaccccagaggagatcaagctggaggcccagagccagttcaccgctgacctggaccagtttgaccagctgctgcccaccctggagaaggccgcccagctgcccggcctgtgtgaaacagacaggatggatggagctgtgacctctgtgaccatcaagtctgagatcctgcctgccagcctgcagagcgccacagcccggcccaccagccggctgaaccggctgcctgagctggagctggaggccatcgacaaccagtttggccagcccggcactggagaccagatcccctggaccaacaacacagtgacagccatcaaccagagcaagtctgaggaccagtgcatcagcagccagctggatgagctgctgtgcccccccaccaccgtggagggcagaaatgatgagaaggccctgctggagcagctggtgtccttcctgagcggcaaggatgaaacagagctggccgagctggaccgggccctgggcatcgacaagctggtgcagggcggcggcctggatgtgctgtctgagcgcttccccccccagcaggccaccccacccctcatcatggaggagcggcccaacctgtacagccagccctacagcagccccagccccacagccaacctgcccagccccttccagggcatggtgcggcagaagcccagcctgggcaccatgcctgtgcaggtgaccccacccaggggggccttcagccctggcatgggcatgcagccccggcagaccctgaacagacctcctgctgcccccaaccagctgcggctgcagctgcagcagaggctgcagggccagcagcagctgatccaccagaaccggcaggccatcctgaaccagtttgctgccacagcccctgtgggcatcaacatgaggagcggcatgcagcagcagatcaccccccagccccccctgaatgcccagatgctggcccagaggcagcgggagctgtacagccagcagcaccggcagaggcagctgatccagcagcagagggccatgctgatgaggcagcagagctttggaaacaacctgccccccagcagcggcctgcctgtgcagatgggcaacccccggctgccccagggcgccccccagcagttcccctacccacccaactacggcaccaaccctggcaccccaccagccagcaccagccccttcagccagctggccgccaaccctgaggccagcctggccaacagaaattccatggtgtcccggggcatgacaggcaacattggaggccagtttggaacaggcatcaacccccagatgcagcagaatgtgttccagtacccaggagctggcatggtgccccagggcgaggccaactttgcccccagcctgagccctggcagctccatggtgcccatgcccatccccccaccccagagcagcctgctgcagcagaccccaccagccagcggctaccagagcccagacatgaaggcctggcagcagggcgccatcggcaacaacaacgtgttcagccaggccgtgcagaaccagcccaccccagcccagcccggggtgtacaacaacatgagcatcaccgtgtccatggccggcggcaacaccaacgtgcagaacatgaaccccatgatggcccagatgcagatgagcagcctgcagatgcctggcatgaacacagtgtgcccagagcagatcaatgaccctgccctgcggcacacaggcctgtactgcaaccagctgagcagcacagacctgctgaagacagaagcagatggcacccaggtgcagcaggtgcaggtgtttgctgatgtgcagtgcaccgtgaacctggtgggcggggacccctacctgaaccagcccggccccctgggcacccagaagcccaccagcggcccccagaccccccaggcccagcagaagagcctgctgcagcagctgctgacagaatag

SEQ ID NO: 162285 - DNA, 4200 bp, Artificial Sequence; identical to SEQ ID NO: 162282
  Description of Artificial Sequence: Synthetic coding sequence

SEQ ID NO: 162286 - DNA, 4326 bp, Artificial Sequence; identical to SEQ ID NO: 162283
  Description of Artificial Sequence: Synthetic coding sequence

SEQ ID NO: 162287 - DNA, 4200 bp, Artificial Sequence; identical to SEQ ID NO: 162282
  Description of Artificial Sequence: Synthetic coding sequence

SEQ ID NO: 162288 - DNA, 1659 bp, Artificial Sequence
  Description of Artificial Sequence: Synthetic coding sequence
atgcagctgacagctgagaacagccctgtgacccctgtgggcgcccagaagacagccctgcgcatcagccagagcaggatgattggcaacagcgccagccggcccaccatgcccagcggggagtgggccccccagagcagcgctgtgcgggtgacctgtgccgccaccaccagcgccatgaacagacctgtgcagggcggcatgatccggaacccagctgccagcatccccatgaggcccagcagccagcccggccagaggcagaccctgcagagccaggtgatgaacatcggccccagcgagctggagatgaacatgggcggcccccagtacagccagcagcaggccccacccaaccagacagccccctggccagagagcatcctgcccatcgaccaggccagctttgccagccagaaccggcagcccttcggcagcagcccagatgacctgctgtgcccccaccctgctgctgagagccccagtgatgaaggagccctgctggaccagctgtacctggccctgaggaactttgatggcctggaggagattgaccgggccctgggcatccctgagctggtgtcccagagccaggccgtggaccctgagcagttcagcagccaggacagcaacatcatgctggagcagaaggcccctgtgttcccccagcagtatgccagccaggcccagatggcccagggcagctacagccccatgcaggaccccaacttccacaccatgggccagaggcccagctatgccaccctgaggatgcagccccggcccggcctgcggcccaccggcctggtgcagaaccagcccaaccagctgcggctgcagctgcagcaccggctgcaggcccagcagaaccggcagcccctgatgaaccagatcagcaatgtgtccaatgtgaacctgaccctgcggcctggggtgcccacccaggcccccatcaatgcccagatgctggcccagaggcagcgggagatcctgaaccagcacctgcggcagaggcagatgcaccagcagcagcaggtgcagcagaggaccctgatgatgaggggccagggcctgaacatgacccccagcatggtggcccccagcggcatgcctgccaccatgagcaacccccgcatcccccaggccaatgcccagcagttccccttcccccccaactacggcatcagccagcagcctgaccccggcttcaccggggccaccaccccccagagccccctgatgagccccaggatggcccacacccagagccccatgatgcagcagagccaggccaacccagcctaccaggcccccagcgacatcaatggctgggcccagggcaacatgggcggcaacagcatgttcagccagcagagccccccccacttcggccagcaggccaacacctccatgtacagcaacaacatgaacatcaacgtgtccatggccaccaacacaggaggcatgagctccatgaaccagatgacaggccagatctccatgacctctgtgacctctgtgcccaccagcggcctgagctccatgggccctgagcaggtgaatgaccctgccctgcggggcggcaacctcttccccaaccagctgcccggcatggacatgatcaagcaggagggggacaccaccaggaagtactgctag

SEQ ID NO: 162289 - DNA, 4395 bp, Artificial Sequence
  Description of Artificial Sequence: Synthetic coding sequence
atgagcggcatgggagagaacaccagtgaccccagcagagctgagaccaggaagaggaaagaatgtcctgaccagctgggccccagccccaagaggaacacagagaagaggaaccgggagcaggagaacaagtacatcgaggagctggccgagctgatctttgccaacttcaatgacatcgacaacttcaacttcaagccagacaagtgtgccatcctgaaggagaccgtgaagcagatccggcagatcaaggagcaggagaaggctgctgctgccaacattgatgaggtgcagaagagtgatgtgagcagcacaggccagggcgtcatcgacaaggatgccctgggccccatgatgctggaggccctggatggcttcttctttgtggtgaacctggagggcaatgtggtgtttgtgtctgaaaatgtgacccagtacctgcgctacaaccaggaggagctgatgaacaagtctgtgtacagcatcctgcacgtgggggaccacacagaatttgtgaagaacctgctgcccaagagcatcgtgaatggaggctcctggagcggggagccccccaggaggaacagccacaccttcaactgcaggatgctggtgaagcccctgcctgacagcgaggaggagggccatgacaaccaggaggcccaccagaagtatgagaccatgcagtgctttgctgtgtcccagcccaagagcatcaaggaggagggggaggacctgcagagctgcctgatctgtgtggcccggcgggtgcccatgaaggagaggcctgtgctgcccagcagcgagagcttcaccacccggcaggacctgcagggcaagatcaccagcctggacaccagcaccatgagagctgccatgaagccaggctgggaggacctggtgcggcgctgcatccagaagttccacgcccagcatgaaggagagagcgtgtcctatgccaagaggcaccaccacgaggtgctgcggcagggcctggccttcagccagatctaccgcttcagcctgagtgatggcaccctggtggccgcccagaccaagagcaagctgatccgcagccagaccaccaatgagccccagctggtgatcagcctgcacatgctgcaccgggagcagaatgtgtgtgtgatgaacccagacctgaccggccagaccatgggcaagcccctgaaccccatcagcagcaacagccctgcccaccaggccctgtgcagcggcaaccctggccaggacatgaccctgagcagcaacatcaacttccccatcaatggccccaaggagcagatgggcatgcccatgggccgctttggaggcagcggcggcatgaaccacgtgtctggcatgcaggccaccaccccccagggcagcaactatgccctgaagatgaacagccccagccagagcagccctggcatgaaccctggccagcccacctccatgctgagccccaggcacaggatgagccctggggtggccggcagcccccgcatcccccccagccagttctccccagctggcagcctgcacagccctgtgggcgtgtgcagcagcactggaaacagccacagctacaccaacagcagcctgaatgccctgcaggccctgtctgagggccacggcgtgtccctgggcagcagcctggccagcccagacctgaagatgggcaacctgcagaacagccctgtgaacatgaaccccccacccctgagcaagatgggcagcctggacagcaaggactgcttcggcctgtatggagagcccagcgagggcaccaccggccaggccgagagcagctgccaccctggagagcagaaggagaccaatgaccccaacctgcccccagctgtgtcctctgagcgggcagatggccagagccggctgcatgacagcaagggccagaccaagctgctgcagctgctgaccaccaagagtgaccagatggagcccagccccctggccagcagcctgagtgacaccaacaaggacagcacaggcagcctgcccggcagcggcagcacccacggcaccagcctgaaggagaagcacaagatcctgcaccggctgctgcaggacagcagcagccctgtggacctggccaagctgacagctgaggccaccgggaaggacctgagccaggagagcagcagcacagcccctggcagcgaggtgaccatcaagcaggagcctgtgagccccaagaagaaggaaaatgccctgctgcgctacctgctggacaaggatgacaccaaggacatcggcctgcctgagatcacccccaagctggagcggctggacagcaagacagatcctgccagcaacaccaagctgattgccatgaagacagagaaggaggagatgagctttgagcccggggaccagcccggcagcgagctggacaacctggaggagatcctggatgacctgcagaacagccagctgccccagctgttcccagacaccaggcctggggccccagctggctctgtggacaagcaggccatcatcaatgacctgatgcagctgacagctgagaacagccctgtgacccctgtgggcgcccagaagacagccctgcgcatcagccagagcaccttcaacaaccccaggcctggccagctgggccgcctgctgcccaaccagaacctgcccctggacatcaccctgcagagccccactggagctggccccttcccccccatccggaacagcagcccctacagcgtcatcccccagcccggcatgatgggcaaccagggcatgattggcaaccagggcaacctgggcaacagcagcacaggcatgattggcaacagcgccagccggcccaccatgcccagcggggagtgggccccccagagcagcgctgtgcgggtgacctgtgccgccaccaccagcgccatgaacagacctgtgcagggcggcatgatccggaacccagctgccagcatccccatgaggcccagcagccagcccggccagaggcagaccctgcagagccaggtgatgaacatcggccccagcgagctggagatgaacatgggcggcccccagtacagccagcagcaggccccacccaaccagacagccccctggccagagagcatcctgcccatcgaccaggccagctttgccagccagaaccggcagcccttcggcagcagcccagatgacctgctgtgcccccaccctgctgctgagagccccagtgatgaaggagccctgctggaccagctgtacctggccctgaggaactttgatggcctggaggagattgaccgggccctgggcatccctgagctggtgtcccagagccaggccgtggaccctgagcagttcagcagccaggacagcaacatcatgctggagcagaaggcccctgtgttcccccagcagtatgccagccaggcccagatggcccagggcagctacagccccatgcaggaccccaacttccacaccatgggccagaggcccagctatgccaccctgaggatgcagccccggcccggcctgcggcccaccggcctggtgcagaaccagcccaaccagctgcggctgcagctgcagcaccggctgcaggcccagcagaaccggcagcccctgatgaaccagatcagcaatgtgtccaatgtgaacctgaccctgcggcctggggtgcccacccaggcccccatcaatgcccagatgctggcccagaggcagcgggagatcctgaaccagcacctgcggcagaggcagatgcaccagcagcagcaggtgcagcagaggaccctgatgatgaggggccagggcctgaacatgacccccagcatggtggcccccagcggcatgcctgccaccatgagcaacccccgcatcccccaggccaatgcccagcagttccccttcccccccaactacggcatcagccagcagcctgaccccggcttcaccggggccaccaccccccagagccccctgatgagccccaggatggcccacacccagagccccatgatgcagcagagccaggccaacccagcctaccaggcccccagcgacatcaatggctgggcccagggcaacatgggcggcaacagcatgttcagccagcagagccccccccacttcggccagcaggccaacacctccatgtacagcaacaacatgaacatcaacgtgtccatggccaccaacacaggaggcatgagctccatgaaccagatgacaggccagatctccatgacctctgtgacctctgtgcccaccagcggcctgagctccatgggccctgagcaggtgaatgaccctgccctgcggggcggcaacctcttccccaaccagctgcccggcatggacatgatcaagcaggagggggacaccaccaggaagtactgctag

SEQ ID NO: 162290 - DNA, 51 bp, Artificial Sequence
  Description of Artificial Sequence: Synthetic coding sequence
atgagcggcatgggagagaacaccagtgaccccagcagagctgagacctag

SEQ ID NO: 162291 - DNA, 27 bp, Artificial Sequence
  Description of Artificial Sequence: Synthetic coding sequence
atgagcggcatgggagagaacacctag

SEQ ID NO: 162292 - DNA, 4263 bp, Artificial Sequence
  Description of Artificial Sequence: Synthetic coding sequence
atgagcggcctgggggagaacctggaccccctggccagtgacagcaggaagaggaagctgccctgtgacaccccaggccagggcctgacctgcagcggggagaagagaagaagagagcaggagagcaagtacatcgaggagctggccgagctgatcagcgccaacctgagtgacatcgacaacttcaacgtgaagccagacaagtgtgccatcctgaaggagaccgtgcggcagatccggcagatcaaggagcagggcaagaccatcagcaatgatgatgatgtgcagaaggcagatgtgagcagcacaggccagggcgtcatcgacaaggacagcctgggccccctgctgctgcaggccctggatggcttcctgtttgtggtgaacagagatggcaacatcgtgtttgtgtctgaaaatgtgacccagtacctgcagtacaagcaggaggacctggtgaacacctctgtgtacaacatcctgcacgaggaggacaggaaggacttcctgaagaacctgcccaagagcacagtgaatggagtgtcctggaccaatgagacccagaggcagaagagccacaccttcaactgcaggatgctgatgaagacccctcatgacatcctggaggacatcaatgccagccctgagatgaggcagagatatgagaccatgcagtgctttgccctgagccagccccgggccatgatggaggagggggaggacctgcagagctgcatgatctgtgtggcccggcgcatcaccactggagagaggaccttccccagcaaccctgagagcttcatcaccaggcatgacctgagcggcaaggtggtgaacatcgacaccaacagcctgcggagctccatgaggcctggctttgaggacatcatccgccgctgcatccagcgcttcttcagcctgaatgatggccagagctggagccagaagaggcactaccaggaggcctacctgaatggacatgctgagacccctgtgtaccgcttcagcctggctgatggcaccatcgtgacagcccagaccaagagcaagctgttcagaaatcctgtgaccaatgacagacatggctttgtgtccacccacttcctgcagcgggagcagaatggctaccggcccaaccccaaccctgtgggccagggcatccggccccccatggccggctgcaacagctctgtgggcggcatgtccatgagccccaaccagggcctgcagatgcccagcagccgggcctacggcctggccgaccccagcaccaccggccagatgtctggggcccgctatggaggcagcagcaacatcgccagcctgaccccaggccctggcatgcagagccccagcagctaccagaacaacaactacggcctgaacatgagcagccccccccacggcagccctggcctggcccccaaccagcagaacatcatgatcagccccaggaacagaggcagccccaagatcgccagccaccagttcagccctgtggccggcgtgcacagccccatggccagcagcggcaacacaggcaaccacagcttcagcagcagcagcctgagcgccctgcaggccatcagcgagggcgtgggcaccagcctgctgagcaccctgagcagccctggccccaagctggacaacagccccaacatgaacatcacccagcccagcaaggtgagcaaccaggacagcaagagccccctgggcttctactgtgaccagaaccctgtggagagctccatgtgccagagcaacagccgggaccacctgagtgacaaggagagcaaggagagctctgtggagggcgctgagaaccagaggggccccctggagagcaagggccacaagaagctgctgcagctgctgacctgcagcagtgatgaccggggccacagcagcctgaccaacagccccctggacagcagctgcaaggagagctctgtgtctgtgaccagccccagcggcgtgagcagcagcaccagcggcggcgtgagcagcaccagcaacatgcacggcagcctgctgcaggagaagcaccgcatcctgcacaagctgctgcagaatggaaacagccctgctgaggtggccaagatcacagctgaggccaccgggaaggacaccagcagcatcaccagctgtggagatggaaatgtggtgaagcaggagcagctgagccccaagaagaaggaaaataatgccctgctgcgctacctgctggacagagatgaccccagtgatgccctgagcaaggagctgcagccccaggtggagggcgtggacaacaagatgagccagtgcaccagcagcaccatccccagcagcagccaggagaaggaccccaagatcaagacagagaccagcgaggagggcagcggggacctggacaacctggatgccatcctgggggacctgaccagcagtgacttctacaacaacagcatcagcagcaatggcagccacctgggcaccaagcagcaggtgttccagggcaccaacagcctgggcctgaagagcagccagagcgtgcagagcatccggcccccctacaacagagctgtgtccctggacagccctgtgtctgtgggcagcagcccccctgtgaagaacatcagcgccttccccatgctgcccaagcagcccatgctgggcggcaaccccaggatgatggacagccaggagaactacggcagctccatgggcggccccaacagaaatgtgacagtgacccagacccccagcagcggggactggggcctgcccaacagcaaggccggccgcatggagcccatgaacagcaacagcatgggccggcctggaggagactacaacaccagcctgcccaggcctgccctgggcggcagcatccccaccctgcccctgcggagcaacagcatccctggggcccggcctgtgctgcagcagcagcagcagatgctgcagatgaggcctggagagatccccatgggcatgggcgccaacccctacggccaggccgccgccagcaaccagctgggctcctggccagatggcatgctgtccatggagcaggtgagccacggcacccagaaccggcccctgctgaggaacagcctggatgacctggtgggcccccccagcaacctggagggccagagtgatgagcgggccctgctggaccagctgcacaccctgctgagcaacacagatgccaccggcctggaggagattgaccgggccctgggcatccctgagctggtgaaccagggccaggccctggagcccaagcaggatgccttccagggccaggaggccgctgtgatgatggaccagaaggccggcctgtatggccagacctacccagcccagggcccccccatgcagggcggcttccacctgcagggccagagccccagcttcaacagcatgatgaaccagatgaaccagcagggcaacttccccctgcagggcatgcacccccgggccaacatcatgaggcccaggaccaacacccccaagcagctgaggatgcagctgcagcagaggctgcagggccagcagttcctgaaccagagccggcaggccctggagctgaagatggagaaccccacagctgggggcgctgctgtgatgaggcccatgatgcagccccagcagggcttcctgaatgcccagatggtggcccagaggagccgggagctgctgagccaccacttccggcagcagagggtggccatgatgatgcagcagcagcagcagcagcagcagcagcagcagcagcagcagcagcagcagcagcagcagcagcagcagcagcagcagcagcagcagacccaggccttcagccccccaccaaatgtgacagccagccccagcatggatggcctgctggccggccccaccatgccccaggccccaccccagcagttcccctaccagcccaactacggcatgggccagcagcctgaccctgccttcggccgggtgagcagccccccaaatgccatgatgagcagcaggatgggccccagccagaaccccatgatgcagcacccccaggccgccagcatctaccagagcagcgagatgaagggctggcccagcggcaacctggccaggaacagcagcttcagccagcagcagtttgcccaccagggcaacccagctgtgtacagcatggtgcacatgaatggcagcagcggccacatgggccagatgaacatgaaccccatgcccatgagcggcatgcccatgggccctgaccagaagtactgctag

SEQ ID NO: 162293 - DNA, 4053 bp, Artificial Sequence
  Description of Artificial Sequence: Synthetic coding sequence
atgagcggcctgggggagaacctggaccccctggccagtgacagcaggaagaggaagctgccctgtgacaccccaggccagggcctgacctgcagcggggagaagagaagaagagagcaggagagcaagtacatcgaggagctggccgagctgatcagcgccaacctgagtgacatcgacaacttcaacgtgaagccagacaagtgtgccatcctgaaggagaccgtgcggcagatccggcagatcaaggagcagggcaagaccatcagcaatgatgatgatgtgcagaaggcagatgtgagcagcacaggccagggcgtcatcgacaaggacagcctgggccccctgctgctgcaggccctggatggcttcctgtttgtggtgaacagagatggcaacatcgtgtttgtgtctgaaaatgtgacccagtacctgcagtacaagcaggaggacctggtgaacacctctgtgtacaacatcctgcacgaggaggacaggaaggacttcctgaagaacctgcccaagagcacagtgaatggagtgtcctggaccaatgagacccagaggcagaagagccacaccttcaactgcaggatgctgatgaagacccctcatgacatcctggaggacatcaatgccagccctgagatgaggcagagatatgagaccatgcagtgctttgccctgagccagccccgggccatgatggaggagggggaggacctgcagagctgcatgatctgtgtggcccggcgcatcaccactggagagaggaccttccccagcaaccctgagagcttcatcaccaggcatgacctgagcggcaaggtggtgaacatcgacaccaacagcctgcggagctccatgaggcctggctttgaggacatcatccgccgctgcatccagcgcttcttcagcctgaatgatggccagagctggagccagaagaggcactaccaggaggtgaccagtgatggcatcttcagccccacagcctacctgaatggacatgctgagacccctgtgtaccgcttcagcctggctgatggcaccatcgtgacagcccagaccaagagcaagctgttcagaaatcctgtgaccaatgacagacatggctttgtgtccacccacttcctgcagcgggagcagaatggctaccggcccaaccccaaccctgtgggccagggcatccggccccccatggccggctgcaacagctctgtgggcggcatgtccatgagccccaaccagggcctgcagatgcccagcagccgggcctacggcctggccgaccccagcaccaccggccagatgtctggggcccgctatggaggcagcagcaacatcgccagcctgaccccaggccctggcatgcagagccccagcagctaccagaacaacaactacggcctgaacatgagcagccccccccacggcagccctggcctggcccccaaccagcagaacatcatgatcagccccaggaacagaggcagccccaagatcgccagccaccagttcagccctgtggccggcgtgcacagccccatggccagcagcggcaacacaggcaaccacagcttcagcagcagcagcctgagcgccctgcaggccatcagcgagggcgtgggcaccagcctgctgagcaccctgagcagccctggccccaagctggacaacagccccaacatgaacatcacccagcccagcaaggtgagcaaccaggacagcaagagccccctgggcttctactgtgaccagaaccctgtggagagctccatgtgccagagcaacagccgggaccacctgagtgacaaggagagcaaggagagctctgtggagggcgctgagaaccagaggggccccctggagagcaagggccacaagaagctgctgcagctgctgacctgcagcagtgatgaccggggccacagcagcctgaccaacagccccctggacagcagctgcaaggagagctctgtgtctgtgaccagccccagcggcgtgagcagcagcaccagcggcggcgtgagcagcaccagcaacatgcacggcagcctgctgcaggagaagcaccgcatcctgcacaagctgctgcagaatggaaacagccctgctgaggtggccaagatcacagctgaggccaccgggaaggacaccagcagcatcaccagctgtggagatggaaatgtggtgaagcaggagcagctgagccccaagaagaaggaaaataatgccctgctgcgctacctgctggacagagatgaccccagtgatgccctgagcaaggagctgcagccccaggtggagggcgtggacaacaagatgagccagtgcaccagcagcaccatccccagcagcagccaggagaaggaccccaagatcaagacagagaccagcgaggagggcagcggggacctggacaacctggatgccatcctgggggacctgaccagcagtgacttctacaacaacagcatcagcagcaatggcagccacctgggcaccaagcagcaggtgttccagggcaccaacagcctgggggactggggcctgcccaacagcaaggccggccgcatggagcccatgaacagcaacagcatgggccggcctggaggagactacaacaccagcctgcccaggcctgccctgggcggcagcatccccaccctgcccctgcggagcaacagcatccctggggcccggcctgtgctgcagcagcagcagcagatgctgcagatgaggcctggagagatccccatgggcatgggcgccaacccctacggccaggccgccgccagcaaccagctgggctcctggccagatggcatgctgtccatggagcaggtgagccacggcacccagaaccggcccctgctgaggaacagcctggatgacctggtgggcccccccagcaacctggagggccagagtgatgagcgggccctgctggaccagctgcacaccctgctgagcaacacagatgccaccggcctggaggagattgaccgggccctgggcatccctgagctggtgaaccagggccaggccctggagcccaagcaggatgccttccagggccaggaggccgctgtgatgatggaccagaaggccggcctgtatggccagacctacccagcccagggcccccccatgcagggcggcttccacctgcagggccagagccccagcttcaacagcatgatgaaccagatgaaccagcagggcaacttccccctgcagggcatgcacccccgggccaacatcatgaggcccaggaccaacacccccaagcagctgaggatgcagctgcagcagaggctgcagggccagcagttcctgaaccagagccggcaggccctggagctgaagatggagaaccccacagctgggggcgctgctgtgatgaggcccatgatgcagccccagcagggcttcctgaatgcccagatggtggcccagaggagccgggagctgctgagccaccacttccggcagcagagggtggccatgatgatgcagcagcagcagcagcagcagcagcagcagcagcagcagcagcagcagcagcagcagcagcagcagcagcagcagcagcagcagcagacccaggccttcagccccccaccaaatgtgacagccagccccagcatggatggcctgctggccggccccaccatgccccaggccccaccccagcagttcccctaccagcccaactacggcatgggccagcagcctgaccctgccttcggccgggtgagcagccccccaaatgccatgatgagcagcaggatgggccccagccagaaccccatgatgcagcacccccaggccgccagcatctaccagagcagcgagatgaagggctggcccagcggcaacctggccaggaacagcagcttcagccagcagcagtttgcccaccagggcaacccagctgtgtacagcatggtgcacatgaatggcagcagcggccacatgggccagatgaacatgaaccccatgcccatgagcggcatgcccatgggccctgaccagaagtactgctag

SEQ ID NO: 162294 - DNA, 4248 bp, Artificial Sequence
  Description of Artificial Sequence: Synthetic coding sequence
atgagcggcctgggggagaacctggaccccctggccagtgacagcaggaagaggaagctgccctgtgacaccccaggccagggcctgacctgcagcggggagaagagaagaagagagcaggagagcaagtacatcgaggagctggccgagctgatcagcgccaacctgagtgacatcgacaacttcaacgtgaagccagacaagtgtgccatcctgaaggagaccgtgcggcagatccggcagatcaaggagcagggcaagaccatcagcaatgatgatgatgtgcagaaggcagatgtgagcagcacaggccagggcgtcatcgacaaggacagcctgggccccctgctgctgcaggccctggatggcttcctgtttgtggtgaacagagatggcaacatcgtgtttgtgtctgaaaatgtgacccagtacctgcagtacaagcaggaggacctggtgaacacctctgtgtacaacatcctgcacgaggaggacaggaaggacttcctgaagaacctgcccaagagcacagtgaatggagtgtcctggaccaatgagacccagaggcagaagagccacaccttcaactgcaggatgctgatgaagacccctcatgacatcctggaggacatcaatgccagccctgagatgaggcagagatatgagaccatgcagtgctttgccctgagccagccccgggccatgatggaggagggggaggacctgcagagctgcatgatctgtgtggcccggcgcatcaccactggagagaggaccttccccagcaaccctgagagcttcatcaccaggcatgacctgagcggcaaggtggtgaacatcgacaccaacagcctgcggagctccatgaggcctggctttgaggacatcatccgccgctgcatccagcgcttcttcagcctgaatgatggccagagctggagccagaagaggcactaccaggaggtgaccagtgatggcatcttcagccccacagcctacctgaatggacatgctgagacccctgtgtaccgcttcagcctggctgatggcaccatcgtgacagcccagaccaagagcaagctgttcagaaatcctgtgaccaatgacagacatggctttgtgtccacccacttcctgcagcgggagcagaatggctaccggcccaaccccaaccctgtgggccagggcatccggccccccatggccggctgcaacagctctgtgggcggcatgtccatgagccccaaccagggcctgcagatgcccagcagccgggcctacggcctggccgaccccagcaccaccggccagatgtctggggcccgctatggaggcagcagcaacatcgccagcctgaccccaggccctggcatgcagagccccagcagctaccagaacaacaactacggcctgaacatgagcagccccccccacggcagccctggcctggcccccaaccagcagaacatcatgatcagccccaggaacagaggcagccccaagatcgccagccaccagttcagccctgtggccggcgtgcacagccccatggccagcagcggcaacacaggcaaccacagcttcagcagcagcagcctgagcgccctgcaggccatcagcgagggcgtgggcaccagcctgctgagcaccctgagcagccctggccccaagctggacaacagccccaacatgaacatcacccagcccagcaaggtgagcaaccaggacagcaagagccccctgggcttctactgtgaccagaaccctgtggagagctccatgtgccagagcaacagccgggaccacctgagtgacaaggagagcaaggagagctctgtggagggcgctgagaaccagaggggccccctggagagcaagggccacaagaagctgctgcagctgctgacctgcagcagtgatgaccggggccacagcagcctgaccaacagccccctggacagcagctgcaaggagagctctgtgtctgtgaccagccccagcggcgtgagcagcagcaccagcggcggcgtgagcagcaccagcaacatgcacggcagcctgctgcaggagaagcaccgcatcctgcacaagctgctgcagaatggaaacagccctgctgaggtggccaagatcacagctgaggccaccgggaaggacaccagcagcatcaccagctgtggagatggaaatgtggtgaagcaggagcagctgagccccaagaagaaggaaaataatgccctgctgcgctacctgctggacagagatgaccccagtgatgccctgagcaaggagctgcagccccaggtggagggcgtggacaacaagatgagccagtgcaccagcagcaccatccccagcagcagccaggagaaggaccccaagatcaagacagagaccagcgaggagggcagcggggacctggacaacctggatgccatcctgggggacctgaccagcagtgacttctacaacaacagcatcagcagcaatggcagccacctgggcaccaagcagcaggtgttccagggcaccaacagcctgggcctgaagagcagccagagcgtgcagagcatccggcccccctacaacagagctgtgtccctggacagccctgtgtctgtgggcagcagcccccctgtgaagaacatcagcgccttccccatgctgcccaagcagcccatgctgggcggcaaccccaggatgatggacagccaggagaactacggcagctccatgggagactggggcctgcccaacagcaaggccggccgcatggagcccatgaacagcaacagcatgggccggcctggaggagactacaacaccagcctgcccaggcctgccctgggcggcagcatccccaccctgcccctgcggagcaacagcatccctggggcccggcctgtgctgcagcagcagcagcagatgctgcagatgaggcctggagagatccccatgggcatgggcgccaacccctacggccaggccgccgccagcaaccagctgggctcctggccagatggcatgctgtccatggagcaggtgagccacggcacccagaaccggcccctgctgaggaacagcctggatgacctggtgggcccccccagcaacctggagggccagagtgatgagcgggccctgctggaccagctgcacaccctgctgagcaacacagatgccaccggcctggaggagattgaccgggccctgggcatccctgagctggtgaaccagggccaggccctggagcccaagcaggatgccttccagggccaggaggccgctgtgatgatggaccagaaggccggcctgtatggccagacctacccagcccagggcccccccatgcagggcggcttccacctgcagggccagagccccagcttcaacagcatgatgaaccagatgaaccagcagggcaacttccccctgcagggcatgcacccccgggccaacatcatgaggcccaggaccaacacccccaagcagctgaggatgcagctgcagcagaggctgcagggccagcagttcctgaaccagagccggcaggccctggagctgaagatggagaaccccacagctggaggagctgctgtgatgaggcccatgatgcagccccagcagggcttcctgaatgcccagatggtggcccagaggagccgggagctgctgagccaccacttccggcagcagagggtggccatgatgatgcagcagcagcagcagcagcagcagcagcagcagcagcagcagcagcagcagcagcagcagcagcagcagcagcagcagcagcagcagacccaggccttcagccccccacccaacgtgacagccagccccagcatggatggcctgctggccggccccaccatgccccaggccccaccccagcagttcccctaccagcccaactacggcatgggccagcagcctgaccctgccttcggccgggtgagcagccccccaaatgccatgatgagcagcaggatgggccccagccagaaccccatgatgcagcacccccaggccgccagcatctaccagagcagcgagatgaagggctggcccagcggcaacctggccaggaacagcagcttcagccagcagcagtttgcccaccagggcaacccagctgtgtacagcatggtgcacatgaatggcagcagcggccacatgggccagatgaacatgaaccccatgcccatgagcggcatgcccatgggccctgaccagaagtactgctag

SEQ ID NO: 162295 - DNA, 4275 bp, Artificial Sequence
  Description of Artificial Sequence: Synthetic coding sequence
atgagcggcctgggggagaacctggaccccctggccagtgacagcaggaagaggaagctgccctgtgacaccccaggccagggcctgacctgcagcggggagaagagaagaagagagcaggagagcaagtacatcgaggagctggccgagctgatcagcgccaacctgagtgacatcgacaacttcaacgtgaagccagacaagtgtgccatcctgaaggagaccgtgcggcagatccggcagatcaaggagcagggcaagaccatcagcaatgatgatgatgtgcagaaggcagatgtgagcagcacaggccagggcgtcatcgacaaggacagcctgggccccctgctgctgcaggccctggatggcttcctgtttgtggtgaacagagatggcaacatcgtgtttgtgtctgaaaatgtgacccagtacctgcagtacaagcaggaggacctggtgaacacctctgtgtacaacatcctgcacgaggaggacaggaaggacttcctgaagaacctgcccaagagcacagtgaatggagtgtcctggaccaatgagacccagaggcagaagagccacaccttcaactgcaggatgctgatgaagacccctcatgacatcctggaggacatcaatgccagccctgagatgaggcagagatatgagaccatgcagtgctttgccctgagccagccccgggccatgatggaggagggggaggacctgcagagctgcatgatctgtgtggcccggcgcatcaccactggagagaggaccttccccagcaaccctgagagcttcatcaccaggcatgacctgagcggcaaggtggtgaacatcgacaccaacagcctgcggagctccatgaggcctggctttgaggacatcatccgccgctgcatccagcgcttcttcagcctgaatgatggccagagctggagccagaagaggcactaccaggaggcctacctgaatggacatgctgagacccctgtgtaccgcttcagcctggctgatggcaccatcgtgacagcccagaccaagagcaagctgttcagaaatcctgtgaccaatgacagacatggctttgtgtccacccacttcctgcagcgggagcagaatggctaccggcccaaccccaaccctgtgggccagggcatccggccccccatggccggctgcaacagctctgtgggcggcatgtccatgagccccaaccagggcctgcagatgcccagcagccgggcctacggcctggccgaccccagcaccaccggccagatgtctggggcccgctatggaggcagcagcaacatcgccagcctgaccccaggccctggcatgcagagccccagcagctaccagaacaacaactacggcctgaacatgagcagccccccccacggcagccctggcctggcccccaaccagcagaacatcatgatcagccccaggaacagaggcagccccaagatcgccagccaccagttcagccctgtggccggcgtgcacagccccatggccagcagcggcaacacaggcaaccacagcttcagcagcagcagcctgagcgccctgcaggccatcagcgagggcgtgggcaccagcctgctgagcaccctgagcagccctggccccaagctggacaacagccccaacatgaacatcacccagcccagcaaggtgagcaaccaggacagcaagagccccctgggcttctactgtgaccagaaccctgtggagagctccatgtgccagagcaacagccgggaccacctgagtgacaaggagagcaaggagagctctgtggagggcgctgagaaccagaggggccccctggagagcaagggccacaagaagctgctgcagctgctgacctgcagcagtgatgaccggggccacagcagcctgaccaacagccccctggacagcagctgcaaggagagctctgtgtctgtgaccagccccagcggcgtgagcagcagcaccagcggcggcgtgagcagcaccagcaacatgcacggcagcctgctgcaggagaagcaccgcatcctgcacaagctgctgcagaatggaaacagccctgctgaggtggccaagatcacagctgaggccaccgggaaggacaccagcagcatcaccagctgtggagatggaaatgtggtgaagcaggagcagctgagccccaagaagaaggaaaataatgccctgctgcgctacctgctggacagagatgaccccagtgatgccctgagcaaggagctgcagccccaggtggagggcgtggacaacaagatgagccagtgcaccagcagcaccatccccagcagcagccaggagaaggaccccaagatcaagacagagaccagcgaggagggcagcggggacctggacaacctggatgccatcctgggggacctgaccagcagtgacttctacaacaacagcatcagcagcaatggcagccacctgggcaccaagcagcaggtgttccagggcaccaacagcctgggcctgaagagcagccagagcgtgcagagcatccggcccccctacaacagagctgtgtccctggacagccctgtgtctgtgggcagcagcccccctgtgaagaacatcagcgccttccccatgctgcccaagcagcccatgctgggcggcaaccccaggatgatggacagccaggagaactacggcagctccatgggcggccccaacagaaatgtgacagtgacccagacccccagcagcggggactggggcctgcccaacagcaaggccggccgcatggagcccatgaacagcaacagcatgggccggcctggaggagactacaacaccagcctgcccaggcctgccctgggcggcagcatccccaccctgcccctgcggagcaacagcatccctggggcccggcctgtgctgcagcagcagcagcagatgctgcagatgaggcctggagagatccccatgggcatgggcgccaacccctacggccaggccgccgccagcaaccagctgggctcctggccagatggcatgctgtccatggagcaggtgagccacggcacccagaaccggcccctgctgaggaacagcctggatgacctggtgggcccccccagcaacctggagggccagagtgatgagcgggccctgctggaccagctgcacaccctgctgagcaacacagatgccaccggcctggaggagattgaccgggccctgggcatccctgagctggtgaaccagggccaggccctggagcccaagcaggatgccttccagggccaggaggccgctgtgatgatggaccagaaggccggcctgtatggccagacctacccagcccagggcccccccatgcagggcggcttccacctgcagggccagagccccagcttcaacagcatgatgaaccagatgaaccagcagggcaacttccccctgcagggcatgcacccccgggccaacatcatgaggcccaggaccaacacccccaagcagctgaggatgcagctgcagcagaggctgcagggccagcagttcctgaaccagagccggcaggccctggagctgaagatggagaaccccacagctgggggcgctgctgtgatgaggcccatgatgcagccccaggtgagcagccagcagggcttcctgaatgcccagatggtggcccagaggagccgggagctgctgagccaccacttccggcagcagagggtggccatgatgatgcagcagcagcagcagcagcagcagcagcagcagcagcagcagcagcagcagcagcagcagcagcagcagcagcagcagcagcagcagacccaggccttcagccccccaccaaatgtgacagccagccccagcatggatggcctgctggccggccccaccatgccccaggccccaccccagcagttcccctaccagcccaactacggcatgggccagcagcctgaccctgccttcggccgggtgagcagccccccaaatgccatgatgagcagcaggatgggccccagccagaaccccatgatgcagcacccccaggccgccagcatctaccagagcagcgagatgaagggctggcccagcggcaacctggccaggaacagcagcttcagccagcagcagtttgcccaccagggcaacccagctgtgtacagcatggtgcacatgaatggcagcagcggccacatgggccagatgaacatgaaccccatgcccatgagcggcatgcccatgggccctgaccagaagtactgctag

SEQ ID NO: 162296 - DNA, 4263 bp, Artificial Sequence; identical to SEQ ID NO: 162292
  Description of Artificial Sequence: Synthetic coding sequence

SEQ ID NO: 162297 - DNA, 774 bp, Artificial Sequence
  Description of Artificial Sequence: Synthetic coding sequence
atgatggaggagggggaggacctgcagagctgcatgatctgtgtggcccggcgcatcaccactggagagaggaccttccccagcaaccctgagagcttcatcaccaggcatgacctgagcggcaaggtggtgaacatcgacaccaacagcctgcggagctccatgaggcctggctttgaggacatcatccgccgctgcatccagcgcttcttcagcctgaatgatggccagagctggagccagaagaggcactaccaggaggcctacctgaatggacatgctgagacccctgtgtaccgcttcagcctggctgatggcaccatcgtgacagcccagaccaagagcaagctgttcagaaatcctgtgaccaatgacagacatggctttgtgtccacccacttcctgcagcgggagcagaatggctaccggcccaaccccaaccctgtgggccagggcatccggccccccatggccggctgcaacagctctgtgggcggcatgtccatgagccccaaccagggcctgcagatgcccagcagccgggcctacggcctggccgaccccagcaccaccggccagatgtctggggcccgctatggaggcagcagcaacatcgccagcctgaccccaggccctggcatgcagagccccagcagctaccagaacaacaactacggcctgaacatgagcagccccccccacggcagccctggcctggcccccaaccagcagaacatcatgatcctgctggtgattgtgggcgtgcagaggtag

SEQ ID NO: 162298 - DNA, 864 bp, Artificial Sequence
  Description of Artificial Sequence: Synthetic coding sequence
atgaacaccttccaggaccagagcggcagcagcagcaaccgggagcccctgctgcgctgcagtgatgcccggcgggacctggagctggccatcggcggcgtgctgcgggcagagcagcagatcaaggacaacctgcgggaggtgaaggcccagatccacagctgcatcagccgccacctggagtgcctgcggagccgggaggtgtggctgtatgagcaggtggacctgatctaccagctgaaggaggagaccctgcagcagcaggcccagcagctgtacagcctgctgggccagttcaactgcctgacccaccagctggagtgcacccagaacaaggacctggccaaccaggtgtctgtgtgcctggagcggctgggcagcctgaccctgaagccagaggacagcacagtgctgctgtttgaggccgacaccatcaccctgcggcagaccatcaccaccttcggcagcctgaagaccatccagatccctgagcacctgatggcccacgccagcagcgccaacatcggccccttcctggagaagaggggctgcatctccatgcctgagcagaagagcgccagcggcatcgtggccgtgcccttcagcgagtggctgctgggcagcaagccagccagcggctaccaggccccctacatccccagcacagacccccaggactggctgacccagaagcagaccctggagaacagccagcaggaggtgctgctgaacagccccctgcaggaggagcacaacttccccccagaccactacggcctgcctgctgtgtgtgacctgtttgcctgcatgcagctgaaggtggacaaggagaagtggctgtaccgcacccccctgcaggtgtag

SEQ ID NO: 162299 - DNA, 1845 bp, Artificial Sequence
  Description of Artificial Sequence: Synthetic coding sequence
atgaacaccttccaggaccagagcggcagcagcagcaaccgggagcccctgctgcgctgcagtgatgcccggcgggacctggagctggccatcggcggcgtgctgcgggcagagcagcagatcaaggacaacctgcgggaggtgaaggcccagatccacagctgcatcagccgccacctggagtgcctgcggagccgggaggtgtggctgtatgagcaggtggacctgatctaccagctgaaggaggagaccctgcagcagcaggcccagcagctgtacagcctgctgggccagttcaactgcctgacccaccagctggagtgcacccagaacaaggacctggccaaccaggtgtctgtgtgcctggagcggctgggcagcctgaccctgaagccagaggacagcacagtgctgctgtttgaggccgacaccatcaccctgcggcagaccatcaccaccttcggcagcctgaagaccatccagatccctgagcacctgatggcccacgccagcagcgccaacatcggccccttcctggagaagaggggctgcatctccatgcctgagcagaagagcgccagcggcatcgtggccgtgcccttcagcgagtggctgctgggcagcaagccagccagcggctaccaggccccctacatccccagcacagacccccaggactggctgacccagaagcagaccctggagaacagccagaccagcagccgggcctgcaacttcttcaacaacgtgggcggcaacctgaagggcctggagaactggctgctgaagtctgagaagagcagctaccagaagtgcaacagccacagcaccaccagcagcttcagcattgagatggagaaggtgggggaccaggagctgcctgaccaggatgagatggacctgagtgactggctggtgaccccccaggagagccacaagctgaggaagccagaaaatggcagccgggagaccagcgagaagttcaagctgctcttccagagctacaacgtgaatgactggctggtgaagacagacagctgcaccaactgccagggcaaccagcccaagggcgtggagattgagaacctgggcaacctgaagtgcctgaatgaccacctggaggccaagaagcccctgagcacccccagcatggtgacagaggactggctggtgcagaaccaccaggacccctgcaaggtggaggaggtgtgccgggccaatgagccctgcaccagctttgctgaatgtgtgtgtgatgagaactgtgagaaggaggccctgtacaagtggctgctgaagaaggagggcaaggacaagaatggcatgcctgtggagcccaagccagagcctgagaagcacaaggacagcctgaacatgtggctgtgccccaggaaggaggtgattgagcagaccaaggcccccaaggccatgacccccagcagaattgctgacagcttccaggtgatcaagaacagccccctgtctgagtggctgatccggcccccctacaaggagggcagccccaaggaggtgcccggcacagaagatcgggccggcaagcagaagttcaagagccccatgaacacctcctggtgcagcttcaacacagctgactgggtgctgcccgggaagaagatgggcaacctgagccagctgagcagcggggaggacaagtggctgctgaggaagaaggcccaggaggtgctgctgaacagccccctgcaggaggagcacaacttccccccagaccactacggcctgcctgctgtgtgtgacctgtttgcctgcatgcagctgaaggtggacaaggagaagtggctgtaccgcacccccctgcagatgtag

SEQ ID NO: 162300 - DNA, 1728 bp, Artificial Sequence
  Description of Artificial Sequence: Synthetic coding sequence
atgaacaccttccaggaccagagcggcagcagcagcaaccgggagcccctgctgcgctgcagtgatgcccggcgggacctggagctggccatcggcggcgtgctgcgggcagagcagcagatcaaggacaacctgcgggaggtgaaggcccagatccacagctgcatcagccgccacctggagtgcctgcggagccgggaggtgtggctgtatgagcaggtggacctgatctaccagctgaaggaggagaccctgcagcagcaggcccagcagctgtacagcctgctgggccagttcaactgcctgacccaccagctggagtgcacccagaacaaggacctggccaaccaggtgtctgtgtgcctggagcggctgggcagcctgaccctgaagccagaggacagcacagtgctgctgtttgaggccgacaccatcaccctgcggcagaccatcaccaccttcggcagcctgaagaccatccagatccctgagcacctgatggcccacgccagcagcgccaacatcggccccttcctggagaagaggggctgcatctccatgcctgagcagaagagcgccagcggcatcgtggccgtgcccttcagcgagtggctgctgggcagcaagccagccagcggctaccaggccccctacatccccagcacagacccccaggactggctgacccagaagcagaccctggagaacagccagaccagcagccgggcctgcaacttcttcaacaacgtgggcggcaacctgaagggcctggagaactggctgctgaagtctgagaagagcagctaccagaagtgcaacagccacagcaccaccagcagcttcagcattgagatggagaaggtgggggaccaggagctgcctgaccaggatgagatggacctgagtgactggctggtgaccccccaggagagccacaagctgaggaagccagaaaatggcagccgggagaccagcgagaagttcaagctgctcttccagagctacaacgtgaatgactggctggtgaagacagacagctgcaccaactgccagggcaaccagcccaagggcgtggagattgagaacctgggcaacctgaagtgcctgaatgaccacctggaggccaagaagcccctgagcacccccagcatggtgacagaggactggctggtgcagaaccaccaggacccctgcaaggtggaggaggtgtgccgggccaatgagccctgcaccagctttgctgaatgtgtgtgtgatgagaactgtgagaaggaggccctgtacaagtggctgctgaagaaggagggcaaggacaagaatggcatgcctgtggagcccaagccagagcctgagaagcacaaggacagcctgaacatgtggctgtgccccaggaaggaggtgattgagcagaccaaggcccccaaggccatgacccccagcagaattgctgacagcttccaggtgatcaagaacagccccctgtctgagtggctgatccggcccccctacaaggagggcagccccaaggaggtgcccggcacagaagatcgggccggcaagcagaagtactacctgatccacctgtacagaagaaacatcaccagcccccagaccatcatggccagcctgcagtttgtgatcagcctgcctgtgtgcagcctgaagctgatcaagaggagcggctacatcgagctgctgtaccgctgtgagggcatggacaagagctag

SEQ ID NO: 162301 - DNA, 1845 bp, Artificial Sequence; identical to SEQ ID NO: 162299
  Description of Artificial Sequence: Synthetic coding sequence

SEQ ID NO: 162302 - DNA, 1347 bp, Artificial Sequence
  Description of Artificial Sequence: Synthetic coding sequence
atggcccacgccagcagcgccaacatcggccccttcctggagaagaggggctgcatctccatgcctgagcagaagagcgccagcggcatcgtggccgtgcccttcagcgagtggctgctgggcagcaagccagccagcggctaccaggccccctacatccccagcacagacccccaggactggctgacccagaagcagaccctggagaacagccagaccagcagccgggcctgcaacttcttcaacaacgtgggcggcaacctgaagggcctggagaactggctgctgaagtctgagaagagcagctaccagaagtgcaacagccacagcaccaccagcagcttcagcattgagatggagaaggtgggggaccaggagctgcctgaccaggatgagatggacctgagtgactggctggtgaccccccaggagagccacaagctgaggaagccagaaaatggcagccgggagaccagcgagaagttcaagctgctcttccagagctacaacgtgaatgactggctggtgaagacagacagctgcaccaactgccagggcaaccagcccaagggcgtggagattgagaacctgggcaacctgaagtgcctgaatgaccacctggaggccaagaagcccctgagcacccccagcatggtgacagaggactggctggtgcagaaccaccaggacccctgcaaggtggaggaggtgtgccgggccaatgagccctgcaccagctttgctgaatgtgtgtgtgatgagaactgtgagaaggaggccctgtacaagtggctgctgaagaaggagggcaaggacaagaatggcatgcctgtggagcccaagccagagcctgagaagcacaaggacagcctgaacatgtggctgtgccccaggaaggaggtgattgagcagaccaaggcccccaaggccatgacccccagcagaattgctgacagcttccaggtgatcaagaacagccccctgtctgagtggctgatccggcccccctacaaggagggcagccccaaggaggtgcccggcacagaagatcgggccggcaagcagaagttcaagagccccatgaacacctcctggtgcagcttcaacacagctgactgggtgctgcccgggaagaagatgggcaacctgagccagctgagcagcggggaggacaagtggctgctgaggaagaaggcccaggaggtgctgctgaacagccccctgcaggaggagcacaacttccccccagaccactacggcctgcctgctgtgtgtgacctgtttgcctgcatgcagctgaaggtggacaaggagaagtggctgtaccgcacccccctgcagatgtag

SEQ ID NO: 162303 - DNA, 1545 bp, Artificial Sequence
  Description of Artificial Sequence: Synthetic coding sequence
atgaaccgctggaccctcttcatcagcctgaagaggaggcacttcaacagccggctgagcagcagcacccggctgggcagcctgaccctgaagccagaggacagcacagtgctgctgtttgaggccgacaccatcaccctgcggcagaccatcaccaccttcggcagcctgaagaccatccagatccctgagcacctgatggcccacgccagcagcgccaacatcggccccttcctggagaagaggggctgcatctccatgcctgagcagaagagcgccagcggcatcgtggccgtgcccttcagcgagtggctgctgggcagcaagccagccagcggctaccaggccccctacatccccagcacagacccccaggactggctgacccagaagcagaccctggagaacagccagaccagcagccgggcctgcaacttcttcaacaacgtgggcggcaacctgaagggcctggagaactggctgctgaagtctgagaagagcagctaccagaagtgcaacagccacagcaccaccagcagcttcagcattgagatggagaaggtgggggaccaggagctgcctgaccaggatgagatggacctgagtgactggctggtgaccccccaggagagccacaagctgaggaagccagaaaatggcagccgggagaccagcgagaagttcaagctgctcttccagagctacaacgtgaatgactggctggtgaagacagacagctgcaccaactgccagggcaaccagcccaagggcgtggagattgagaacctgggcaacctgaagtgcctgaatgaccacctggaggccaagaagcccctgagcacccccagcatggtgacagaggactggctggtgcagaaccaccaggacccctgcaaggtggaggaggtgtgccgggccaatgagccctgcaccagctttgctgaatgtgtgtgtgatgagaactgtgagaaggaggccctgtacaagtggctgctgaagaaggagggcaaggacaagaatggcatgcctgtggagcccaagccagagcctgagaagcacaaggacagcctgaacatgtggctgtgccccaggaaggaggtgattgagcagaccaaggcccccaaggccatgacccccagcagaattgctgacagcttccaggtgatcaagaacagccccctgtctgagtggctgatccggcccccctacaaggagggcagccccaaggaggtgcccggcacagaagatcgggccggcaagcagaagttcaagagccccatgaacacctcctggtgcagcttcaacacagctgactgggtgctgcccgggaagaagatgggcaacctgagccagctgagcagcggggaggacaagtggctgctgaggaagaaggcccaggaggtgctgctgaacagccccctgcaggaggagcacaacttccccccagaccactacggcctgcctgctgtgtgtgacctgtttgcctgcatgcagctgaaggtggacaaggagaagtggctgtaccgcacccccctgcagatgtag

SEQ ID NO: 162304 - DNA, 795 bp, Artificial Sequence
  Description of Artificial Sequence: Synthetic coding sequence
tgatgcaccccagcctgggccgctgagctggacagcgtgtccaagcagaagaagaaccccaagcccaccttcaagaagaagacagaggagaggacctgtgaggtgaagaaggtgtcccggctgggcagcctgaccctgaagccagaggacagcacagtgctgctgtttgaggccgacaccatcaccctgcggcagaccatcaccaccttcggcagcctgaagaccatccagatccctgagcacctgatggcccacgccagcagcgccaacatcggccccttcctggagaagaggggctgcatctccatgcctgagcagaagagcgccagcggcatcgtggccgtgcccttcagcgagtggctgctgggcagcaagccagccagcggctaccaggccccctacatccccagcacagacccccaggactggctgacccagaagcagaccctggagaacagccagaccagcagccgggcctgcaacttcttcaacaacgtgggcggcaacctgaagggcctggagaactggctgctgaagtctgagaagagcagctaccagaagtgcaacagccacagcaccaccagcagcttcagcattgagatggagaaggtgggggaccaggagctgcctgaccaggatgagatggacctgagtgactggctggtgaccccccaggagagccacaagctgaggaagccagaaaatggcagccgggagaccagcgagaagttcaagctgctcttccagagctacaacgtgaatgactggctggtgaagacagacagctgcacctag

SEQ ID NO: 162305 - DNA, 1893 bp, Artificial Sequence
  Description of Artificial Sequence: Synthetic coding sequence
atgggcgcccagctgaccacctttgccctggccggggctgtgcggaggatgaacaccttccaggaccagagcggcagcagcagcaaccgggagcccctgctgcgctgcagtgatgcccggcgggacctggagctggccatcggcggcgtgctgcgggcagagcagcagatcaaggacaacctgcgggaggtgaaggcccagatccacagctgcatcagccgccacctggagtgcctgcggagccgggaggtgtggctgtatgagcaggtggacctgatctaccagctgaaggaggagaccctgcagcagcaggcccagcagctgtacagcctgctgggccagttcaactgcctgacccaccagctggagtgcacccagaacaaggacctggccaaccaggtgtctgtgtgcctggagcggctgggcagcctgaccctgaagccagaggacagcacagtgctgctgtttgaggccgacaccatcaccctgcggcagaccatcaccaccttcggcagcctgaagaccatccagatccctgagcacctgatggcccacgccagcagcgccaacatcggccccttcctggagaagaggggctgcatctccatgcctgagcagaagagcgccagcggcatcgtggccgtgcccttcagcgagtggctgctgggcagcaagccagccagcggctaccaggccccctacatccccagcacagacccccaggactggctgacccagaagcagaccctggagaacagccagaccagcagccgggcctgcaacttcttcaacaacgtgggcggcaacctgaagggcctggagaactggctgctgaagtctgagaagagcagctaccagaagtgcaacagccacagcaccaccagcagcttcagcattgagatggagaaggtgggggaccaggagctgcctgaccaggatgagatggacctgagtgactggctggtgaccccccaggagagccacaagctgaggaagccagaaaatggcagccgggagaccagcgagaagttcaagctgctcttccagagctacaacgtgaatgactggctggtgaagacagacagctgcaccaactgccagggcaaccagcccaagggcgtggagattgagaacctgggcaacctgaagtgcctgaatgaccacctggaggccaagaagcccctgagcacccccagcatggtgacagaggactggctggtgcagaaccaccaggacccctgcaaggtggaggaggtgtgccgggccaatgagccctgcaccagctttgctgaatgtgtgtgtgatgagaactgtgagaaggaggccctgtacaagtggctgctgaagaaggagggcaaggacaagaatggcatgcctgtggagcccaagccagagcctgagaagcacaaggacagcctgaacatgtggctgtgccccaggaaggaggtgattgagcagaccaaggcccccaaggccatgacccccagcagaattgctgacagcttccaggtgatcaagaacagccccctgtctgagtggctgatccggcccccctacaaggagggcagccccaaggaggtgcccggcacagaagatcgggccggcaagcagaagttcaagagccccatgaacacctcctggtgcagcttcaacacagctgactgggtgctgcccgggaagaagatgggcaacctgagccagctgagcagcggggaggacaagtggctgctgaggaagaaggcccaggaggtgctgctgaacagccccctgcaggaggagcacaacttccccccagaccactacggcctgcctgctgtgtgtgacctgtttgcctgcatgcagctgaaggtggacaaggagaagtggctgtaccgcacccccctgcagatgtag

SEQ ID NO: 162306 - DNA, 1845 bp, Artificial Sequence; identical to SEQ ID NO: 162299
  Description of Artificial Sequence: Synthetic coding sequence

SEQ ID NO: 162307 - DNA, 1953 bp, Artificial Sequence
  Description of Artificial Sequence: Synthetic coding sequence
atgggcgcccagctgaccacctttgccctggccggggctgtgcggaggatgaacaccttccaggaccagagcggcagcagcagcaaccgggagcccctgctgcgctgcagtgatgcccggcgggacctggagctggccatcggcggcgtgctgcgggcagagcagcagatcaaggacaacctgcgggaggtgaaggcccagatccacagctgcatcagccgccacctggagtgcctgcggagccgggaggtgtggctgtatgagcaggtggacctgatctaccagctgaaggaggagaccctgcagcagcaggcccagcagctgtacagcctgctgggccagttcaactgcctgacccaccagctggagtgcacccagaacaaggacctggccaaccaggtgtctgtgtgcctggagcggctgggcagcctgaccctgaagccagaggacagcacagtgctgctgtttgaggccgacaccatcaccctgcggcagaccatcaccaccttcggcagcctgaagaccatccagatccctgagcacctgatggcccacgccagcagcgccaacatcggccccttcctggagaagaggggctgcatctccatgcctgagcagaagagcgccagcggcatcgtggccgtgcccttcagcgagtggctgctgggcagcaagccagccagcggctaccaggccccctacatccccagcacagacccccaggactggctgacccagaagcagaccctggagaacagccagaccagcagccgggcctgcaacttcttcaacaacgtgggcggcaacctgaagggcctggagaactggctgctgaagtctgagaagagcagctaccagaagtgcaacagccacagcaccaccagcagcttcagcattgagatggagaaggtgggggaccaggagctgcctgaccaggatgagatggacctgagtgactggctggtgaccccccaggagagccacaagctgaggaagccagaaaatggcagccgggagaccagcgagaagttcaagctgctcttccagagctacaacgtgaatgactggctggtgaagacagacagctgcaccaactgccagggcaaccagcccaagggcgtggagattgagaacctgggcaacctgaagtgcctgaatgaccacctggaggccaagaagcccctgagcacccccagcatggtgacagaggactggctggtgcagaaccaccaggacccctgcaaggtggaggaggtgtgccgggccaatgagccctgcaccagctttgctgaatgtgtgtgtgatgagaactgtgagaaggaggccctgtacaagtggctgctgaagaaggagggcaaggacaagaatggcatgcctgtggagcccaagccagagcctgagaagcacaaggacagcctgaacatgtggctgtgccccaggaaggaggtgattgagcagaccaaggcccccaaggccatgacccccagcagaattgctgacagcttccaggtgatcaagaacagccccctgtctgagtggctgatccggcccccctacaaggagggcagccccaaggaggtgcccggcacagaagatcgggccggcaagcagaagttcaagagccccatgaacacctcctggtgcagcttcaacacagctgactgggtgctgcccgggaagaagatgggcaacctgagccagctgagcagcggggaggacaagtggctgctgaggaagaaggcccaggaggtgctgctgaacagccccctgcaggaggagcacaacttccccccagaccactacggcctgcctgctgtgtgtgacctgtttgcctgcatgcagctgaaggtggacaaggagaagtggctgtaccgcacccccctgcaggcctacttcaagatgaacttccaggatgtgacagtgggcaacttccagatcccctgtggcttctag

SEQ ID NO: 162308 - DNA, 6192 bp, Artificial Sequence
  Description of Artificial Sequence: Synthetic coding sequence
atggtgctggatgacctgcccaacctggaggacatctacaccagcctgtgcagcagcaccatggaggacagcgagatggactttgacagcggcctggaggatgatgacaccaagagtgacagcatcctggaggacagcaccatctttgtggccttcaagggcaacattgatgacaaggacttcaagtggaagctggatgccatcctgaagaatgtgcccaacctgctgcacatggagagcagcaagctgaaggtgcagaaggtggagccctggaacagcgtgcgggtgaccttcaacatcccccgggaggccgctgagcggctgcgcatcctggcccagagcaacaaccagcagctgcgggacctgggcatcctgtctgtgcagattgaaggagagggcgccatcaacctggccctggcccagaacagaagccaggatgtgaggatgaatggccccatgggcgccggcaacagcgtgaggatggaggccggcttccccatggccagcggccctggcatcatccgcatgaacaacccagccaccgtgatgatccccccaggcggcaatgtgagcagctccatgatggcccctggccccaaccctgagctgcagcccaggacccccaggcctgccagccagagtgatgccatggaccccctgctgagcggcctgcacatccagcagcagagccaccccagcggcagcctggccccaccccaccaccccatgcagcctgtgtctgtgaaccggcagatgaacccagccaacttcccccagctgcagcagcagcagcagcagcagcagcagcagcagcagcagcagcagcagcagcagcagcagcagcagcagcagcagctgcaggcccggcccccccagcagcaccagcagcagcagccccagggcatccggccccagttcaccgcccccacccaggtgcctgtgcccccaggctggaaccagctgcccagcggggccctgcagcccccaccagcccagggcagcctgggcaccatgacagccaaccagggctggaagaaggcccccctgcccggccccatgcagcagcagctgcaggcccggcccagcctggccaccgtgcagacccccagccaccccccaccaccctaccccttcggcagccagcaggccagccaggcccacaccaacttcccccagatgagcaaccctggccagttcaccgccccccagatgaagagcctgcagggcggccccagccgggtgcccacccccctgcagcagccccacctgaccaacaagagccctgccagcagccccagcagcttccagcagggcagccctgccagcagccccaccgtgaaccagacccagcagcagatgggccccaggcctccccagaacaaccccctgccccagggcttccagcagcctgtgagcagccctggcaggaaccccatggtgcagcagggcaatgtgccccccaacttcatggtgatgcagcagcagccccccaaccagggcccccagagcctgcaccctggcctgggcggcatgcccaagaggctgcccccaggcttctctgctggccaggccaaccccaacttcatgcagggccaggtgcccagcaccacagccaccaccccaggcaacagcggggccccccagctgcaggccaaccagaatgtgcagcacgccggcggccagggcgccggccccccccagaaccagatgcaggtgagccacggcccccccaacatgatgcagcccagcctgatgggcatccacggcaacatgaacaaccagcaggccggcaccagcggcgtgccccaggtgaacctgagcaacatgcagggccagccccagcagggcccccccagccagctgatgggcatgcaccagcagatcgtgcccagccagggccagatggtgcagcagcagggcaccctgaacccccagaaccccatgatcctgagccgggcccagctgatgccccagggccagatgatggtgaacccccccagccagaacctgggccccagcccccagaggatgaccccacccaagcagatgctgagccagcagggcccccagatgatggccccccacaaccagatgatgggcccccagggccaggtgctgctgcagcagaaccccatgattgagcagatcatgaccaaccagatgcagggcaacaagcagcagttcaacacccagaaccagagcaatgtgatgcctggccctgcccagatcatgaggggccccacccccaacatgcagggcaacatggtgcagttcaccggccagatgagcggccagatgctgccccagcagggccctgtgaacaacagccccagccaggtgatgggcatccagggccaggtgctgcggcccccaggccccagcccccacatggcccagcagcacggggaccctgccaccacagccaacaatgatgtgtccctgagccagatgatgccagatgtgtccatccagcagaccaacatggtgcccccccacgtgcaggccatgcagggcaacagcgccagcggcaaccacttcagcggccacggcatgtccttcaatgcccccttcagcggggcccccaacggcaaccagatgagctgtggccagaaccctggcttccctgtgaacaaggatgtgaccctgaccagccccctgctggtgaacctgctgcagagcgacatctctgctggccactttggagtgaacaacaagcagaacaacaccaatgccaacaagcccaagaagaagaagccacccaggaagaagaagaacagccagcaggacctgaacaccccagacaccaggcctgctggcctggaggaggccgaccagccccccctgcctggagagcagggcatcaacctggacaacagcggccccaagctgcctgagttcagcaaccggcccccaggctaccccagccagcctgtggagcagaggcccctgcagcagatgccaccccagctgatgcagcacgtggcccccccaccccagcccccccagcagcagccccagccccagctgccccagcagcagcagcccccaccacccagccagccccagagccagcagcagcagcagcagcagcagcagatgatgatgatgctgatgatgcagcaggaccccaagtctgtgcggctgcctgtgtcccagaatgtgcaccccccccggggccccctgaacccagacagccagaggatgcccatgcagcagagcggctctgtgcctgtgatggtgtccctgcagggccctgcctctgtgccccccagcccagacaagcagaggatgcccatgcctgtgaacacccccctgggcagcaacagcaggaagatggtgtaccaggagagcccccagaaccccagcagcagccccctggccgagatggccagcctgcctgaggccagcggcagcgaggcccccagcgtgcctgggggccccaacaacatgcccagccacgtggtgctgccccagaaccagctgatgatgacaggccccaagccaggccccagccccctgagcgccacccagggcgccaccccccagcagccccctgtgaacagcctgcccagcagccacggccaccacttccccaacgtggccgcccccacccagaccagccggcccaagacccccaacagagccagcccccggccctactacccccagacccccaacaacagaccacccagcacagagcccagcgagatcagcctgagccctgagcggctgaatgccagcattgctggcctcttccccccccagatcaacatccccctgcccccccggcccaacctgaacagaggatttgaccagcagggcctgaaccccaccaccctgaaggccatcggccaggcccccagcaacctgaccatgaaccccagcaactttgccaccccccagacccacaagctggacagcgtggtggtgaacagcggcaagcagagcaacagcggggccaccaagagggccagccccagcaacagccgccgcagcagccctggcagcagcaggaagaccacccccagccctggccggcagaacagcaaggcccccaagctgaccctggccagccagaccaatgctgccctgctgcagaatgtggagctgcccagaaatgtgctggtgagccccacccccctggccaacccccctgtgcccggcagcttccccaacaacagcggcctgaacccccagaacagcacagtgtctgtggccgctgtgggcggcgtggtggaggacaacaaggagagcctgaatgtgccccaggacagcgactgccagaacagccagagcaggaaggagcaggtgaacatcgagctgaaggctgtgcctgcccaggaggtgaagatggtggtgcctgaggaccagagcaagaaggatggccagcccagcgaccccaacaagctgcccagcgtggaggagaacaagaacctggtgtccccagccatgagggaggcccccaccagcctgagccagctgctggacaacagcggggcccccaacgtgaccatcaagcccccaggcctgacagacctggaggtgaccccacctgtggtgtctggagaggacctgaagaaggccagcgtcatccccaccctgcaggacctgagcagcagcaaggagcccagcaacagcctgaacctgccccacagcaatgagctgtgcagcagcctggtgcaccctgagctgtctgaggtgagcagcaatgtggcccccagcatcccccctgtgatgagcaggcctgtgagcagcagcagcatcagcacccccctgccccccaaccagatcaccgtgtttgtgaccagcaaccccatcaccaccagcgccaacaccagcgctgccctgcccacccacctgcagagcgccctgatgagcacagtggtgaccatgcccaatgccggcagcaaggtgatggtgtctgagggccagagcgctgcccagagcaatgcccggccccagttcatcacccctgtgttcatcaacagcagcagcatcatccaggtgatgaagggcagccagcccagcaccatcccagctgcccccctgaccaccaacagcggcctgatgcctccttctgtggccgtggtgggccccctgcacatcccccagaacatcaagttcagcagcgcccctgtgcccccaaatgccctgagcagcagccctgcccccaacatccagacaggccggcccctggtgctgagcagccgggccacccctgtgcagctgcccagccccccctgcaccagcagccctgtggtgcccagccacccccctgtgcagcaggtgaaggagctgaacccagatgaggccagcccccaggtgaacaccagcgctgaccagaacaccctgcccagcagccagagcaccaccatggtgagccccctgctgaccaacagccctggcagcagcggcaacagaagaagccctgtgagcagcagcaagggcaagggcaaggtggacaagattggccagatcctgctgaccaaggcctgcaagaaggtgacaggcagcctggagaagggggaggagcagtacggggctgatggagaaacagagggccagggcctggacaccacagcccctggcctgatgggcacagagcagctgagcacagagctggacagcaagacccccaccccaccagcccccaccctgctgaagatgaccagcagccctgtgggccctggaacagccagcgctggccccagcctgcccggcggggccctgcccacctctgtgcgcagcatcgtgaccaccctggtgcccagcgagctgatctctgctgtgcccaccaccaagagcaaccacggcggcatcgccagcgagagcctggccggcggcctggtggaggagaaggtgggcagccaccctgagctgctgcccagcatcgcccccagccagaacctggtgtccaaggagaccagcaccacagccctgcaggcctctgtggcccggcctgagctggaggtgaatgctgccatcgtgtctggccagagcagcgagcccaaggagatcgtggagaagagcaagatccctggaagaagaaacagcaggacagaggagcccaccgtggccagcgagagcgtggagaatggccacaggaagaggagcagcaggcctgccagcgccagcagcagcaccaaggacatcaccagcgctgtgcagagcaagaggaggaagagcaagtag

SEQ ID NO: 162309 - DNA, 6192 bp, Artificial Sequence; identical to SEQ ID NO: 162308
  Description of Artificial Sequence: Synthetic coding sequence

SEQ ID NO: 162310 - DNA, 1086 bp, Artificial Sequence
  Description of Artificial Sequence: Synthetic coding sequence
atggtgctggatgacctgcccaacctggaggacatctacaccagcctgtgcagcagcaccatggaggacagcgagatggactttgacagcggcctggaggatgatgacaccaagagtgacagcatcctggaggacagcaccatctttgtggccttcaagggcaacattgatgacaaggacttcaagtggaagctggatgccatcctgaagaatgtgcccaacctgctgcacatggagagcagcaagctgaaggtgcagaaggtggagccctggaacagcgtgcgggtgaccttcaacatcccccgggaggccgctgagcggctgcgcatcctggcccagagcaacaaccagcagctgcgggacctgggcatcctgtctgtgcagattgaaggagagggcgccatcaacctggccctggcccagaacagaagccaggatgtgaggatgaatggccccatgggcgccggcaacagcgtgaggatggaggccggcttccccatggccagcggcccagatgccatggaccccctgctgagcggcctgcacatccagcagcagagccaccccagcggcagcctggccccaccccaccaccccatgcagcctgtgtctgtgaaccggcagatgaacccagccaacttcccccagctgcagcagcagcagcagcagcagcagcagcagcagcagcagcagcagcagcagcagcagcagcagcagcagcagcagctgcaggcccggcccccccagcagcaccagcagcagcagccccagggcatccggccccagttcaccgcccccacccaggtgcctgtgcccccaggctggaaccagctgcccagcggggccctgcagcccccaccagcccagggcagcctgggcaccatgacagccaaccagggctggaagaaggcccccctgcccggccccatgcagcagcagctgcaggcccggcccagcctggccaccgtgcagacccccagccaccccccaccaccctaccccttcggcagccagcaggccagccaggcccacaccaacttcccccagatgagcaaccctggccagttcaccgccccccagatgtag

SEQ ID NO: 162311 - DNA, 549 bp, Artificial Sequence
  Description of Artificial Sequence: Synthetic coding sequence
atggccgaggagcaggtgaacagatctgctggcctggccccagactgtgaggccagcgccacagctgagaccaccgtgtcctctgtgggcacctgtgaggccgccggcaagagccctgagcccaaggactatgacagcacctgtgtgttctgcagaattgctggccggcaggaccctggaacagagctgctgcactgtgaaaatgaagatctcatctgcttcaaggacatcaagccagctgccacccaccactacctggtggtgcccaagaagcacatcggcaactgcaggaccctgaggaaggaccaggtggagctggtggagaacatggtgacagtgggcaagaccatcctggagaggaacaacttcacagacttcaccaacgtgaggatgggcttccacatgccacccttctgcagcatcagccacctgcacctgcacgtgctggcccctgtggaccagctgggcttcctgagcaagctggtgtacagagtgaacagctactggttcatcacagctgaccacctgattgagaagctgcggacctag

SEQ ID NO: 162312 - DNA, 552 bp, Artificial Sequence
  Description of Artificial Sequence: Synthetic coding sequence
atgggcgccgcccacagcgtgtgggaggtggaccacctgtacaccttctttgtgcagtggagcccagatgtgtatggcaaggatgccaaggagcagggctttgtggtggtggagaaggaggagctgaacatgattgacaacttcttcagcgagcccaccaccaagtcctgggagatcatcaccgtggaggaggccaagaggaggaagagcacctgcagctactatgaagatgaagatgaggaggtgctgcctgtgctgcggccccacagcgccctgctggagaacatgcacatcgagcagctggcccggcggctgcctgcccgggtgcagggctacccctggaggctggcctacagcaccctggagcacggcaccagcctgaagaccctgtacaggaagagcgccagcctggacagccctgtgctgctggtgatcaaggacatggacaaccagatctttggagcctatgccacccaccccttcaagttcagtgaccactactacggcaccggggagaccttcctgtacaccttcagcccccacttcaagtag

SEQ ID NO: 162313 - DNA, 2829 bp, Artificial Sequence
  Description of Artificial Sequence: Synthetic coding sequence
atggacaccaaggaggagaagaaggagaggaagcagagctactttgcccggctgaagaagaagaagcaggccaagcagaatgctgagacagccagcgctgtggccaccaggacccacacaggcaaggaggacaacaacacagtggtgctggagccagacaagtgcaacattgctgtggaggaggagtacatgacagatgagaagaagaagaggaagagcaaccagctgaaggagatccggaggacagagctgaagcgctactacagcattgatgacaaccagaacaagacccatgacaagaaggagaagaagatggtggtgcagaagccccacggcaccatggagtacacagctggcaaccaggacaccctgaacagcatcgccctgaagttcaacatcacccccaacaagctggtggagctgaacaagctgttcacccacaccatcgtgcccggccaggtgctgtttgtgcctgatgccaacagccccagcagcaccctgcggctgagcagcagcagccctggggccaccgtgagccccagcagcagtgatgctgaatatgacaagctgcctgatgctgacctggccaggaaggccctgaagcccatcgagcgggtgctgagcagcaccagtgaagaagatgagcccggggtggtgaagttcctgaagatgaactgccgctacttcacagatggaaaaggagtggtgggcggcgtgatgattgtgacccccaacaacatcatgtttgacccccacaagagtgaccccctggtgattgaaaatggctgtgaggagtatggcctcatctgccccatggaggaggtggtgtccatcgccctgtacaatgacatcagccacatgaagatcaaggatgccctgcccagcgacctgccccaggacctgtgccccctgtacagacctggagagtgggaggacctggccagcgagaaggacatcaaccccttcagcaagttcaagagcatcaacaaggagaagaggcagcagaatggagagaagatcatgaccagtgacagccggcccatcgtgcccctggagaagagcacaggccacacccccaccaagcccagcggcagctctgtgtctgagaagctgaagaagctggacagcagccgggagaccagccacggcagccccaccgtgaccaagctgagcaaggagcccagcgacaccagcagcgcctttgagagcacagccaaggagaacttcctgggggaggatgatgactttgtggacctggaggagctgagcagccagacaggaggcggcatgcacaagaaggacaccctgaaggagtgcctgagcctggaccctgaggagaggaagaaggccgagagccagatcaacaacagcgctgtggagatgcaggtgcagagcgccctggccttcctgggcacagaaaatgatgtggagctgaagggggccctggacctggagacctgtgagaagcaggacatcatgcctgaggtggacaagcagagcggcagccctgagagccgggtggagaacaccctgaacatccacgaggacctggacaaggtgaagctgattgagtactacctgaccaagaacaaggagggcccccaggtgtctgagaacctgcagaagacagagctgagtgatggcaagagcattgagcccggcggcatcgacatcaccctgagcagcagcctgagccaggccggggaccccatcacagagggcaacaaggagccagacaagacctgggtgaagaagggggagcccctgcctgtgaagctgaacagcagcacagaggccaacgtcatcaaggaggccctggacagcagcctggagagcaccctggacaacagctgccagggcgcccagatggacaacaagtctgaggtgcagctgtggctgctgaagaggatccaggtgcccatcgaggacatcctgcccagcaaggaggagaagagcaagaccccacccatgttcctgtgcatcaaggtgggcaagcccatgaggaagagctttgccacccacacagctgccatggtgcagcagtatggcaagaggaggaagcagcctgagtactggtttgctgtgccccgggagcgggtggaccacctgtacaccttctttgtgcagtggagcccagatgtgtatggcaaggatgccaaggagcagggctttgtggtggtggagaaggaggagctgaacatgattgacaacttcttcagcgagcccaccaccaagtcctgggagatcatcaccgtggaggaggccaagaggaggaagagcacctgcagctactatgaagatgaagatgaggaggtgctgcctgtgctgcggccccacagcgccctgctggagaacatgcacatcgagcagctggcccggcggctgcctgcccgggtgcagggctacccctggaggctggcctacagcaccctggagcacggcaccagcctgaagaccctgtacaggaagagcgccagcctggacagccctgtgctgctggtgatcaaggacatggacaaccagatctttggagcctatgccacccaccccttcaagttcagtgaccactactacggcaccggggagaccttcctgtacaccttcagcccccacttcaaggtgttcaagtggagcggggagaacagctacttcatcaacggggacatcagcagcctggagctgggcggcggcggcggccgcttcggcctgtggctggatgctgacctgtaccacggccgcagcaacagctgcagcaccttcaacaatgacatcctgagcaagaaggaggacttcatcgtgcaggacctggaggtgtgggcctttgattag

SEQ ID NO: 162314 - DNA, 2829 bp, Artificial Sequence; identical to SEQ ID NO: 162313
  Description of Artificial Sequence: Synthetic coding sequence

SEQ ID NO: 162315 - DNA, 1323 bp, Artificial Sequence
  Description of Artificial Sequence: Synthetic coding sequence
gatgctgacctggccaggaaggccctgaagcccatcgagcgggtgctgagcagcaccagcgaggaggatgagcccggggtggtgaagttcctgaagatgaactgccgctacttcacagatggcaagggcgtggtgggcggcgtgatgattgtgacccccaacaacatcatgtttgacccccacaagagtgaccccctggtgattgaaaatggctgtgaggagtatggcctcatctgccccatggaggaggtggtgtccatcgccctgtacaatgacatcagccacatgaagatcaaggatgccctgcccagccctggagagtgggaggacctggccagcgagaaggacatcaaccccttcagcaagttcaagagcatcaacaaggagaagaggcagcagaatggagagaagatcatgaccagtgacagccggcccatcgtgcccctggagaagagcacaggccacacccccaccaagcccagcggcagctctgtgtctgagaagctgaagaagctggacagcagccgggagaccagccacggcagccccaccgtgaccaagctgagcaaggagcccagcgacaccagcagcgcctttgagagcacagccaaggagaacttcctgggggaggatgatgactttgtggacctggaggagctgagcagccagacaggaggcggcatgcacaagaaggacaccctgaaggagtgcctgagcctggaccctgaggagaggaagaaggccgagagccagatcaacaacagcgctgtggagatgcaggtgcagagcgccctggccttcctgggcacagaaaatgatgtggagctgaagggggccctggacctggagacctgtgagaagcaggacatcatgcctgaggtggacaagcagagcggcagccctgagagccgggtggagaacaccctgaacatccacgaggacctggacaaggtgaagctgattgagtactacctgaccaagaacaaggagggcccccaggtgtctgagaacctgcagaagacagagctgagtgatggcaagagcattgagcccggcggcatcgacatcaccctgagcagcagcctgagccaggccggggaccccatcacagagggcaacaaggagccagacaagacctgggtgaagaagggggagcccctgcctgtgaagctgaacagcagcacagaggccaacgtcatcaaggaggccctggacagcagcctggagagcaccctggacaacagctgccagggcgcccagatggacaacaagtctgaggtgcagctgtggctgctgaagaggatccaggtgcccattgaatag

SEQ ID NO: 162316 - DNA, 576 bp, Artificial Sequence
  Description of Artificial Sequence: Synthetic coding sequence
atggacaccaaggaggagaagaaggagaggaagcagagctactttgcccggctgaagaagaagaagcaggccaagcagaatgctgagacagccagcgctgtggccaccaggacccacacaggcaaggaggacaacaacacagtggtgctggagccagacaagtgcaacattgctgtggaggaggagtacatgacagatgagaagaagaagaggaagagcaaccagctgaaggagatccggaggacagagctgaagcgctactacagcattgatgacaaccagaacaagacccatgacaagaaggagaagaagatggtggtgcagaagccccacggcaccatggagtacacagctggcaaccaggacaccctgaacagcatcgccctgaagttcaacatcacccccaacaagctggtggagctgaacaagctgttcacccacaccatcgtgcccggccaggtgctgtttgtgcctgatgccaacagccccagcagcaccctgcggctgagcagcagcagccctggggccaccgtgagccccagcagcagtgatgctgaatatgacaagctgccctag

SEQ ID NO: 162317 - DNA, 354 bp, Artificial Sequence
  Description of Artificial Sequence: Synthetic coding sequence
atggacaccaaggaggagaagaaggagaggaagcagagctactttgcccggctgaagaagaagaagcaggccaagcagaatgctgagacagccagcgctgtggccaccaggacccacacaggcaaggaggacaacaacacagtggtgctggagccagacaagtgcaacattgctgtggaggaggagtacatgacagatgagaagaagaagaggaagagcaaccagctgaaggagatccggaggacagagctgaagcgctactacagcattgatgacaaccagaacaagacccatgacaagaaggagaagaagatggtggtgcagaagccccacggcaccatggagtacacctag

SEQ ID NO: 162318 - DNA, 273 bp, Artificial Sequence
  Description of Artificial Sequence: Synthetic coding sequence
atggacaccaaggaggagaagaaggagaggaagcagagctactttgcccggctgaagaagaagaagcaggccaagcagaatgctgagacagccagcgctgtggccaccaggacccacacaggcaaggaggacaacaacacagtggtgctggagccagacaagtgcaacattgctgtggaggaggagtacatgacagatgagaagaagaagaggaagagcaaccagctgaaggagatccggaggacagagctgaagcgctactacagcatctag

SEQ ID NO: 162319 - DNA, 273 bp, Artificial Sequence; identical to SEQ ID NO: 162318
  Description of Artificial Sequence: Synthetic coding sequence

SEQ ID NO: 162320 - DNA, 552 bp, Artificial Sequence; identical to SEQ ID NO: 162312
  Description of Artificial Sequence: Synthetic coding sequence

SEQ ID NO: 162321 - DNA, 714 bp, Artificial Sequence
  Description of Artificial Sequence: Synthetic coding sequence
tgagagaagacctgcagcagcctggagcgggagccccacttcagcctgctgaccatgaggggccagaggctgcccctggacatccagatcttctactgtgcccggccagatgaggagccctttgtgaagatcatcaccgtggaggaggccaagaggaggaagagcacctgcagctactatgaagatgaagatgaggaggtgctgcctgtgctgcggccccacagcgccctgctggagaacatgcacatcgagcagctggcccggcggctgcctgcccgggtgcagggctacccctggaggctggcctacagcaccctggagcacggcaccagcctgaagaccctgtacaggaagagcgccagcctggacagccctgtgctgctggtgatcaaggacatggacaaccagatctttggagcctatgccacccaccccttcaagttcagtgaccactactatggaactggagagaccttcctgtacaccttcagcccccacttcaaggtgttcaagtggagcggagaaaattcctacttcatcaatggagacatcagcagcctggagctgggcggcggcggcggccgcttcggcctgtggctggatgctgacctgtaccacggccgcagcaacagctgcagcaccttcaacaatgacatcctgagcaagaaggaggacttcatcgtgcaggacctggaggtgtgggcctttgattag

SEQ ID NO: 162322 - DNA, 534 bp, Artificial Sequence
  Description of Artificial Sequence: Synthetic coding sequence
tgagagaagacctgcagcagcctggagcgggagccccacttcagcctgctgaccatgaggggccagaggctgcccctggacatccagatcttctactgtgcccggccagatgaggagccctttgtgaagatcatcaccgtggaggaggccaagaggaggaagagcacctgcagctactatgaagatgaagatgaggaggtgctgcctgtgctgcggccccacagcgccctgctggagaacatgcacatcgagcagctggcccggcggctgcctgcccgggtgcagggctacccctggaggctggcctacagcaccctggagcacggcaccagcctgaagaccctgtacaggaagagcgccagcctggacagccctgtgctgctggtgatcaaggacatggacaaccagatctttggagcctatgccacccaccccttcaagttcagtgaccactactatggaactggagagaccttcctgtacaccttcagcccccacttcaagggcaccatctggttcatggcccgctgctag

SEQ ID NO: 162323 - DNA, 573 bp, Artificial Sequence
  Description of Artificial Sequence: Synthetic coding sequence
tgagagaagacctgcagcagcctggagcgggagccccacttcagcctgctgaccatgaggggccagaggctgcccctggacatccagatcttctactgtgcccggccagatgaggagccctttgtgaagatcatcaccgtggaggaggccaagaggaggaagagcacctgcagctactatgaagatgaagatgaggaggtgctgcctgtgctgcggccccacagcgccctgctggagaacatgcacatcgagcagctggcccggcggctgcctgcccgggtgcagggctacccctggaggctggcctacagcaccctggagcacggcaccagcctgaagaccctgtacaggaagagcgccagcctggacagccctgtgctgctggtgatcaaggacatggacaaccagatctttggagcctatgccacccaccccttcaagttcagtgaccactactatggaactggagagaccttcctgtacaccttcagcccccacttcaagtggagcggggagaacagctacttcatcaacggggacatcagcagcctggagctgggcggcggcggctag

SEQ ID NO: 162324 - DNA, 273 bp, Artificial Sequence; identical to SEQ ID NO: 162318
  Description of Artificial Sequence: Synthetic coding sequence

SEQ ID NO: 162325 - DNA, 7566 bp, Artificial Sequence
  Description of Artificial Sequence: Synthetic coding sequence
atgagcggcagcacccagcctgtggcccagacctggagggccacagagccccgctacccaccccacagcctgagctaccctgtgcagatcgcccggacccacacagatgtgggcctgctggagtaccagcaccacagccgggactatgccagccacctgagccctggcagcatcatccagccccagaggcggcggcccagcctgctgtctgagttccagcctggaaatgaaagaagccaggagctgcacctgcggcctgagagccacagctacctgcctgagctgggcaagtctgagatggagttcatcgagagcaagaggccccggctggagctgctgcctgaccccctgctgcggcccagccccctgctggccaccggccagcctgctggcagcgaggacctgaccaaggacaggagcctgaccgggaagctggagcctgtgagcccccccagccccccccacacagatcctgagctggagctggtgcccccccggctgagcaaggaggagctgatccagaacatggacagagtggaccgggagatcaccatggtggagcagcagatcagcaagctgaagaagaagcagcagcagctggaggaggaggccgccaagcccccagagcctgagaagcctgtgagccccccacccatcgagagcaagcacaggagcctggtgcagatcatctatgatgaaaataggaagaaggccgaggccgcccaccgcatcctggagggcctgggcccccaggtggagctgcccctgtacaaccagcccagcgacacccggcagtaccacgagaacatcaagatcaaccaggccatgaggaagaagctgatcctgtacttcaagagaagaaatcatgccaggaagcagtgggagcagaagttctgccagagatatgaccagctgatggaggcctgggagaagaaggtggagagaattgagaacaacccccggcggcgggccaaggagagcaaggtgcgggagtactatgagaagcagtttcctgagatcaggaagcagcgggagctgcaggagaggatgcagagccgggtgggccagaggggcagcggcctgtccatgtctgctgcccggtctgagcacgaggtgtctgagatcattgatggcctgtctgagcaggagaacctggagaagcagatgaggcagctggccgtcatcccccccatgctgtatgatgctgaccagcagaggatcaagttcatcaacatgaatggcctgatggctgaccccatgaaggtgtacaaggaccggcaggtgatgaacatgtggagcgagcaggagaaggagaccttccgggagaagttcatgcagcaccccaagaactttggcctcatcgccagcttcctggagaggaagacagtggctgaatgtgtgctgtactactacctgaccaagaagaatgaaaactacaagagcctggtgcggcgcagctacagaagaagaggcaagagccagcagcagcagcagcagcagcagcagcagcagcagcagcagcagcagcagcccatgcccaggagcagccaggaggagaaggatgagaaggagaaggagaaggaggccgagaaggaggaggagaagccagaggtggagaatgacaaggaggacctgctgaaggagaagacagatgacaccagcggggaggacaatgatgagaaggaggccgtggccagcaaaggaaggaagacagccaacagccagggccgcaggaagggccgcatcaccaggtccatggccaatgaggccaacagcgaggaggccatcaccccccagcagagcgctgagctggcctccatggagctgaatgaaagcagccgctggacagaggaggagatggagacagccaagaagggcctgctggagcacggcaggaactggagcgccatcgccaggatggtgggcagcaagacagtgtcccagtgcaagaacttctacttcaactacaagaagaggcagaacctggatgagatcctgcagcagcacaagctgaagatggagaaggagagaaatgcccggaggaagaagaagaaggccccagctgctgccagcgaggaggccgccttcccccctgtggtggaggatgaggagatggaggccagcggcgtgtctggaaatgaggaggagatggtggaggaggccgaggccctgcacgccagcggaaatgaggtgcccagaggagaatgttctggccctgccaccgtgaacaacagcagtgacacagagagcatccccagcccccacacagaggccgccaaggacaccggccagaatggccccaagcccccagccaccctgggcgcagatggccccccacctggcccccccaccccacctcctgaggacatcccagcccccacagagcccaccccagccagcgaggccactggagcccccaccccacctccagccccacccagccccagcgcccctcctcctgtggtgcccaaggaggagaaggaggaggagacagctgctgcccctcctgtggaggagggggaggagcagaagcccccagctgctgaggagctggccgtggacaccgggaaggccgaggagcctgtgaagtcagaatgtacagaggaggccgaggagggccctgccaagggcaaggatgctgaggccgctgaggccacagctgagggcgccctgaaggccgagaagaaggagggcggcagcggccgggccaccacagccaagagcagcggggccccccaggacagcgacagcagcgccacctgcagcgcagatgaggtggatgaagctgagggcggggacaagaaccggctgctgagcccccggcccagcctgctgacccccaccggggacccccgggccaatgccagcccccagaagcccctggacctgaagcagctgaagcagagagctgctgccatcccccccatcgtgaccaaggtgcatgagcccccccgggaggatgctgcccccaccaagccagcccccccagcccctcctccaccccagaacctgcagcctgagagtgatgccccccagcagcccggcagcagcccccggggcaagagccgcagccctgcccctcctgctgacaaggaggccgagaagcctgtgttcttccctgcctttgctgctgaggcccagaagctgcccggggaccccccctgctggaccagcggcctgcccttccctgtgcccccccgggaggtgatcaaggccagcccccacgccccagaccccagcgccttctcctatgcccctcctggccaccccctgcccctgggcctgcatgacacagcccggcctgtgctgccccggccccccaccatcagcaaccccccacccctcatcagcagcgccaagcaccccagcgtgctggagcggcagattggagccatcagccagggcatgtctgtgcagctgcacgtgccctacagcgagcacgccaaggcccctgtgggccctgtgaccatgggcctgcccctgcccatggaccccaagaagctggcccccttcagcggcgtgaagcaggagcagctgagcccccggggccaggccggccccccagagagcctgggcgtgcccacagcccaggaggcctctgtgctgcggggcacagccctgggctctgtgcctgggggcagcatcaccaagggcatccccagcaccagggtgcccagcgacagcgccatcacctaccggggcagcatcacccacggcaccccagcagatgtgctgtacaagggcaccatcacccgcatcatcggggaggacagccccagccggctggaccggggccgggaggacagcctgcccaagggccacgtgatctatgagggcaagaagggccacgtgctgtcctatgaaggaggcatgtctgtgacccagtgcagcaaagaagatggccgcagcagcagcggcccccctcatgaaacagctgcccccaagaggacctatgacatgatggagggccgggtgggccgggccatcagcagcgccagcattgagggcctgatgggccgggccatccccccagagcggcacagcccccaccacctgaaggagcagcaccacatccggggcagcatcacccagggcatccccaggagctatgtggaggcccaggaggactacctgcggcgggaggccaagctgctgaagcgggagggcaccccacctcctcctccacccagccgggacctgacagaggcctacaagacccaggccctgggccccctgaagctgaagccagcccacgagggcctggtggccaccgtgaaggaggccggccgcagcatccacgagatcccccgggaggagctgcggcacaccccagagctgcccctggccccccggcccctgaaggagggcagcatcacccagggcacccccctgaagtatgacaccggggccagcaccaccggcagcaagaagcatgatgtgcgcagcctcatcggcagccctggccgcaccttcccccctgtgcaccccctggatgtgatggctgatgcccgggccctggagcgggcctgctatgaggagagcctgaagagcaggcctggaacagccagcagcagcggcggcagcatcgcccggggggcccctgtgattgtgcctgagctgggcaagccccggcagagccccctgacctatgaagatcatggagccccctttgctggccacctgccccggggcagccctgtgaccacccgggagcccaccccccggctgcaggagggcagcctgagcagcagcaaggccagccaggacaggaagctgaccagcaccccccgggagatcgccaagagcccccacagcacagtgcctgagcaccacccccaccccatcagcccctatgagcacctgctgcggggcgtgtctggagtggacctgtaccgcagccacatccccctggcctttgaccccaccagcatcccccggggcatccccctggatgctgctgctgcctactacctgcccaggcacctggcccccaaccccacctacccccacctgtacccaccctacctgatccggggctacccagacacagctgccctggagaaccggcagaccatcatcaatgactacatcaccagccagcagatgcaccacaatgctgccacagccatggcccagagagctgacatgctgcggggcctgagcccccgggagagcagcctggccctgaactatgctgctggcccccggggcatcatcgacctgagccaggtgccccacctgcctgtgctggtgccccccaccccaggcaccccagccacagccatggaccggctggcctacctgcccacagccccccagcccttcagcagccgccacagcagcagccccctgagccctgggggccccacccacctgaccaagcccaccaccaccagcagcagcgagcgggagcgggaccgggaccgggagcgggaccgggaccgggagcgggagaagagcatcctgaccagcaccaccaccgtggagcacgcccccatctggaggcctggaacagagcagagcagcggcagcagcggcggcggcggcggcagcagcagcaggcctgccagccacagccacgcccaccagcacagccccatcagccccaggacccaggatgccctgcagcagaggcccagcgtgctgcacaacacaggcatgaagggcatcatcacagctgtggagcccagcacccccaccgtgctgcggagcaccagcaccagcagccctgtgcggcctgctgccaccttccccccagccacccactgccccctgggcggcaccctggatggagtgtaccccaccctgatggagcctgtgctgctgcccaaggaggccccccgggtggcccggcctgagcggcccagggctgacaccggccacgccttcctggccaagcccccagcccggagcggcctggagcccgccagcagccccagcaaaggaagtgagccccggcccctggtgccccctgtgtctggccacgccaccatcgcccggaccccagccaagaacctggccccccaccacgccagcccagaccccccagcccccccagccagcgccagtgacccccaccgggagaagacccagagcaagcccttcagcatccaggagctggagctgcggagcctgggctaccacggcagcagctacagccctgagggcgtggagcctgtgtcccctgtgagcagccccagcctgacccatgacaagggcctgcccaagcacctggaggagctggacaagagccacctggagggggagctgcggcccaagcagcccggccctgtgaagctgggcggggaggccgcccacctgccccacctgcggcccctgcctgagagccagcccagcagcagccccctgctgcagacagcccctggggtgaagggccaccagagggtggtgaccctggcccagcacatcagcgaggtgatcacccaggactacaccaggcaccacccccagcagctgagcgcccccctgcctgcccccctgtacagcttccctggggccagctgccctgtgctggacctgcggcggcccccaagtgacctgtacctgcccccaccagaccacggggccccagcccggggcagcccccacagcgagggcggcaagaggagccctgagcccaacaagacctctgtgctgggcggcggagaagatggcatcgagcctgtgtccccacctgagggcatgacagagcccggccacagccgctctgctgtgtaccccctgctgtacagagatggagagcagacagagcccagcaggatgggcagcaagagccctggcaacaccagccagcccccagccttcttcagcaagctgacagagagcaacagcgccatggtgaagagcaagaagcaggagatcaacaagaagctgaacacccacaacagaaatgaacctgagtacaacatcagccagcctggaacagagatcttcaacatgcctgccatcaccggcaccggcctgatgacctaccgcagccaggccgtgcaggagcacgccagcaccaacatgggcctggaggccatcatcaggaaggccctgatgggcaagtatgaccagtgggaggagagcccccccctgagcgccaatgccttcaaccccctgaatgccagcgccagcctgcctgctgccatgcccatcacagctgctgatggccgcagtgaccacaccctgaccagccctgggggcggcggcaaggccaaggtgtctggccggcccagcagcaggaaggccaagagccctgcccctggcctggccagcggggacaggcctccttctgtgtcctctgtgcacagcgagggggactgcaacagaaggacccccctgaccaacagagtgtgggaggaccggcccagcagcgctggcagcacccccttcccctacaaccccctcatcatgaggctgcaggccggcgtgatggccagccccccacctcctggcctgcctgctggcagcggccccctggccggcccccaccacgcctgggatgaggagcccaagcccctgctgtgcagccagtatgagaccctgagtgacagcgagtag

SEQ ID NO: 162326 - DNA, 7380 bp, Artificial Sequence
  Description of Artificial Sequence: Synthetic coding sequence
atgagcggcagcacccagcctgtggcccagacctggagggccacagagccccgctacccaccccacagcctgagctaccctgtgcagatcgcccggacccacacagatgtgggcctgctggagtaccagcaccacagccgggactatgccagccacctgagccctggcagcatcatccagccccagaggcggcggcccagcctgctgtctgagttccagcctggaaatgaaagaagccaggagctgcacctgcggcctgagagccacagctacctgcctgagctgggcaagtctgagatggagttcatcgagagcaagaggccccggctggagctgctgcctgaccccctgctgcggcccagccccctgctggccaccggccagcctgctggcagcgaggacctgaccaaggacaggagcctgaccgggaagctggagcctgtgagcccccccagccccccccacacagatcctgagctggagctggtgcccccccggctgagcaaggaggagctgatccagaacatggacagagtggaccgggagatcaccatggtggagcagcagatcagcaagctgaagaagaagcagcagcagctggaggaggaggccgccaagcccccagagcctgagaagcctgtgagccccccacccatcgagagcaagcacaggagcctggtgcagatcatctatgatgaaaataggaagaaggccgaggccgcccaccgcatcctggagggcctgggcccccaggtggagctgcccctgtacaaccagcccagcgacacccggcagtaccacgagaacatcaagatcaaccaggccatgaggaagaagctgatcctgtacttcaagagaagaaatcatgccaggaagcagtgggagcagaagttctgccagagatatgaccagctgatggaggcctgggagaagaaggtggagagaattgagaacaacccccggcggcgggccaaggagagcaaggtgcgggagtactatgagaagcagtttcctgagatcaggaagcagcgggagctgcaggagaggatgcagagccgggtgggccagaggggcagcggcctgtccatgtctgctgcccggtctgagcacgaggtgtctgagatcattgatggcctgtctgagcaggagaacctggagaagcagatgaggcagctggccgtcatcccccccatgctgtatgatgctgaccagcagaggatcaagttcatcaacatgaatggcctgatggctgaccccatgaaggtgtacaaggaccggcaggtgatgaacatgtggagcgagcaggagaaggagaccttccgggagaagttcatgcagcaccccaagaactttggcctcatcgccagcttcctggagaggaagacagtggctgaatgtgtgctgtactactacctgaccaagaagaatgaaaactacaagagcctggtgcggcgcagctacagaagaagaggcaagagccagcagcagcagcagcagcagcagcagcagcagcagcagcagcagcagcagcccatgcccaggagcagccaggaggagaaggatgagaaggagaaggagaaggaggccgagaaggaggaggagaagccagaggtggagaatgacaaggaggacctgctgaaggagaagacagatgacaccagcggggaggacaatgatgagaaggaggccgtggccagcaaaggaaggaagacagccaacagccagggccgcaggaagggccgcatcaccaggtccatggccaatgaggccaacagcgaggaggccatcaccccccagcagagcgctgagctggcctccatggagctgaatgaaagcagccgctggacagaggaggagatggagacagccaagaagggcctgctggagcacggcaggaactggagcgccatcgccaggatggtgggcagcaagacagtgtcccagtgcaagaacttctacttcaactacaagaagaggcagaacctggatgagatcctgcagcagcacaagctgaagatggagaaggagagaaatgcccggaggaagaagaagaaggccccagctgctgccagcgaggaggccgccttcccccctgtggtggaggatgaggagatggaggccagcggcgtgtctggaaatgaggaggagatggtggaggaggccgaggccaccgtgaacaacagcagtgacacagagagcatccccagcccccacacagaagctgccaaggacaccggccagaatggccccaagcccccagccaccctgggcgcagatggccccccacctggcccccccaccccacctcctgaggacatcccagcccccacagagcccaccccagccagcgaggccaccggggcccccaccccacctccagccccacccagccccagcgcccctcctcctgtggtgcccaaggaggagaaggaggaggagacagctgctgcccctcctgtggaggagggggaggagcagaagcccccagctgctgaggagctggccgtggacaccgggaaggccgaggagcctgtgaagtctgagtgcacagaggaggccgaggagggccctgccaagggcaaggatgctgaggccgctgaggccacagctgagggcgccctgaaggccgagaagaaggagggcggcagcggccgggccaccacagccaagagcagcggggccccccaggacagcgacagcagcgccacctgcagcgcagatgaggtggatgaggccgagggcggggacaagaaccggctgctgagcccccggcccagcctgctgacccccactggagacccccgggccaatgccagcccccagaagcccctggacctgaagcagctgaagcagagagctgctgccatcccccccatccaggtgaccaaggtgcatgagcccccccgggaggatgctgcccccaccaagccagcccccccagcccctcctccaccccagaacctgcagcctgagagtgatgccccccagcagcccggcagcagcccccggggcaagagccgcagccctgcccctcctgctgacaaggaggccgagaagcctgtgttcttccctgcctttgctgctgaggcccagaagctgcccggggaccccccctgctggaccagcggcctgcccttccctgtgcccccccgggaggtgatcaaggccagcccccacgccccagaccccagcgccttctcctatgcccctcctggccaccccctgcccctgggcctgcatgacacagcccggcctgtgctgccccggccccccaccatcagcaaccccccacccctcatcagcagcgccaagcaccccagcgtgctggagcggcagattggagccatcagccagggcatgtctgtgcagctgcacgtgccctacagcgagcacgccaaggcccctgtgggccctgtgaccatgggcctgcccctgcccatggaccccaagaagctggcccccttcagcggcgtgaagcaggagcagctgagcccccggggccaggccggccccccagagagcctgggcgtgcccacagcccaggaggcctctgtgctgcggggcacagccctgggctctgtgcctgggggcagcatcaccaagggcatccccagcaccagggtgcccagcgacagcgccatcacctaccggggcagcatcacccacggcaccccagcagatgtgctgtacaagggcaccatcacccgcatcatcggggaggacagccccagccggctggaccggggccgggaggacagcctgcccaagggccacgtgatctatgagggcaagaagggccacgtgctgtcctatgaaggaggcatgtctgtgacccagtgcagcaaagaagatggccgcagcagcagcggcccccctcatgaaacagctgcccccaagaggacctatgacatgatggagggccgggtgggccgggccatcagcagcgccagcattgagggcctgatgggccgggccatccccccagagcggcacagcccccaccacctgaaggagcagcaccacatccggggcagcatcacccagggcatccccaggagctatgtggaggcccaggaggactacctgcggcgggaggccaagctgctgaagcgggagggcaccccacctcctcctccacccagccgggacctgacagaggcctacaagacccaggccctgggccccctgaagctgaagccagcccacgagggcctggtggccaccgtgaaggaggccggccgcagcatccacgagatcccccgggaggagctgcggcacaccccagagctgcccctggccccccggcccctgaaggagggcagcatcacccagggcacccccctgaagtatgacaccggggccagcaccaccggcagcaagaagcatgatgtgcgcagcctcatcggcagccctggccgcaccttcccccctgtgcaccccctggatgtgatggctgatgcccgggccctggagcgggcctgctatgaggagagcctgaagagcaggcctggaacagccagcagcagcggcggcagcatcgcccggggggcccctgtgattgtgcctgagctgggcaagccccggcagagccccctgacctatgaagatcatggagccccctttgctggccacctgccccggggcagccctgtgaccacccgggagcccaccccccggctgcaggagggcagcctgagcagcagcaaggccagccaggacaggaagctgaccagcaccccccgggagatcgccaagagcccccacagcacagtgcctgagcaccacccccaccccatcagcccctatgagcacctgctgcggggcgtgtctggagtggacctgtaccgcagccacatccccctggcctttgaccccaccagcatcccccggggcatccccctggatgctgctgctgcctactacctgcccaggcacctggcccccaaccccacctacccccacctgtacccaccctacctgatccggggctacccagacacagctgccctggagaaccggcagaccatcatcaatgactacatcaccagccagcagatgcaccacaatgctgccacagccatggcccagagagctgacatgctgcggggcctgagcccccgggagagcagcctggccctgaactatgctgctggcccccggggcatcatcgacctgagccaggtgccccacctgcctgtgctggtgccccccaccccaggcaccccagccacagccatggaccggctggcctacctgcccacagccccccagcccttcagcagccgccacagcagcagccccctgagccctgggggccccacccacctgaccaagcccaccaccaccagcagcagcgagcgggagcgggaccgggaccgggagcgggaccgggaccgggagcgggagaagagcatcctgaccagcaccaccaccgtggagcacgcccccatctggaggcctggaacagagcagagcagcggcagcagcggcggcggcggcggcagcagcagcaggcctgccagccacagccacgcccaccagcacagccccatcagccccaggacccaggatgccctgcagcagaggcccagcgtgctgcacaacacaggcatgaagggcatcatcacagctgtggagcccagcacccccaccgtgctgcggagcaccagcaccagcagccctgtgcggcctgctgccaccttccccccagccacccactgccccctgggcggcaccctggatggagtgtaccccaccctgatggagcctgtgctgctgcccaaggaggccccccgggtggcccggcctgagcggcccagggctgacaccggccacgccttcctggccaagcccccagcccggagcggcctggagcccgccagcagccccagcaaaggaagtgagccccggcccctggtgccccctgtgtctggccacgccaccatcgcccggaccccagccaagaacctggccccccaccacgccagcccagaccccccagcccccccagccagcgccagtgacccccaccgggagaagacccagagcaagcccttcagcatccaggagctggagctgcggagcctgggctaccacggcagcagctacagccctgagggcgtggagcctgtgtcccctgtgagcagccccagcctgacccatgacaagggcctgcccaagcacctggaggagctggacaagagccacctggagggggagctgcggcccaagcagcccggccctgtgaagctgggcggggaggccgcccacctgccccacctgcggcccctgcctgagagccagcccagcagcagccccctgctgcagacagcccctggggtgaagggccaccagagggtggtgaccctggcccagcacatcagcgaggtgatcacccaggactacaccaggcaccacccccagcagctgagcgcccccctgcctgcccccctgtacagcttccctggggccagctgccctgtgctggacctgcggcggcccccaagtgacctgtacctgcccccaccagaccacggggccccagcccggggcagcccccacagcgagggcggcaagaggagccctgagcccaacaagacctctgtgctgggcggcggagaagatggcatcgagcctgtgtccccacctgagggcatgacagagcccggccacagccgctctgctgtgtaccccctgctgtacagagatggagagcagacagagcccagcaggatgggcagcaagagccctggcaacaccagccagcccccagccttcttcagcaagctgacagagagcaacagcgccatggtgaagagcaagaagcaggagatcaacaagaagctgaacacccacaacagaaatgaacctgagtacaacatcagccagcctggaacagagatcttcaacatgcctgccatcaccggcaccggcctgatgacctaccgcagccaggccgtgcaggagcacgccagcaccaacatgggcctggaggccatcatcaggaaggccctgatgggcggcggcggcaaggccaaggtgtctggccggcccagcagcaggaaggccaagagccctgcccctggcctggccagcggggacaggcctccttctgtgtcctctgtgcacagcgagggggactgcaacagaaggacccccctgaccaacagagtgtgggaggaccggcccagcagcgctggcagcacccccttcccctacaaccccctcatcatgaggctgcaggccggcgtgatggccagccccccacctcctggcctgcctgctggcagcggccccctggccggcccccaccacgcctgggatgaggagcccaagcccctgctgtgcagccagtatgagaccctgagtgacagcgagtag

SEQ ID NO: 162327 - DNA, 6228 bp, Artificial Sequence
  Description of Artificial Sequence: Synthetic coding sequence
atgtggagcgagcaggagaaggagaccttccgggagaagttcatgcagcaccccaagaactttggcctcatcgccagcttcctggagaggaagacagtggctgaatgtgtgctgtactactacctgaccaagaagaatgaaaactacaagagcctggtgcggcgcagctacagaagaagaggcaagagccagcagcagcagcagcagcagcagcagcagcagcagcagcagcagcagcagcccatgcccaggagcagccaggaggagaaggatgagaaggagaaggagaaggaggccgagaaggaggaggagaagccagaggtggagaatgacaaggaggacctgctgaaggagaagacagatgacaccagcggggaggacaatgatgagaaggaggccgtggccagcaaaggaaggaagacagccaacagccagggccgcaggaagggccgcatcaccaggtccatggccaatgaggccaacagcgaggaggccatcaccccccagcagagcgctgagctggcctccatggagctgaatgaaagcagccgctggacagaggaggagatggagacagccaagaagggcctgctggagcacggcaggaactggagcgccatcgccaggatggtgggcagcaagacagtgtcccagtgcaagaacttctacttcaactacaagaagaggcagaacctggatgagatcctgcagcagcacaagctgaagatggagaaggagagaaatgcccggaggaagaagaagaaggccccagctgctgccagcgaggaggccgccttcccccctgtggtggaggatgaggagatggaggccagcggcgtgtctggaaatgaggaggagatggtggaggaggccgaggccaccgtgaacaacagcagtgacacagagagcatccccagcccccacacagaagctgccaaggacaccggccagaatggccccaagcccccagccaccctgggcgcagatggccccccacctggcccccccaccccacctcctgaggacatcccagcccccacagagcccaccccagccagcgaggccaccggggcccccaccccacctccagccccacccagccccagcgcccctcctcctgtggtgcccaaggaggagaaggaggaggagacagctgctgcccctcctgtggaggagggggaggagcagaagcccccagctgctgaggagctggccgtggacaccgggaaggccgaggagcctgtgaagtctgagtgcacagaggaggccgaggagggccctgccaagggcaaggatgctgaggccgctgaggccacagctgagggcgccctgaaggccgagaagaaggagggcggcagcggccgggccaccacagccaagagcagcggggccccccaggacagcgacagcagcgccacctgcagcgcagatgaggtggatgaggccgagggcggggacaagaaccggctgctgagcccccggcccagcctgctgacccccactggagacccccgggccaatgccagcccccagaagcccctggacctgaagcagctgaagcagagagctgctgccatcccccccatccaggtgaccaaggtgcatgagcccccccgggaggatgctgcccccaccaagccagcccccccagcccctcctccaccccagaacctgcagcctgagagtgatgccccccagcagcccggcagcagcccccggggcaagagccgcagccctgcccctcctgctgacaaggaggccgagaagcctgtgttcttccctgcctttgctgctgaggcccagaagctgcccggggaccccccctgctggaccagcggcctgcccttccctgtgcccccccgggaggtgatcaaggccagcccccacgccccagaccccagcgccttctcctatgcccctcctggccaccccctgcccctgggcctgcatgacacagcccggcctgtgctgccccggccccccaccatcagcaaccccccacccctcatcagcagcgccaagcaccccagcgtgctggagcggcagattggagccatcagccagggcatgtctgtgcagctgcacgtgccctacagcgagcacgccaaggcccctgtgggccctgtgaccatgggcctgcccctgcccatggaccccaagaagctggcccccttcagcggcgtgaagcaggagcagctgagcccccggggccaggccggccccccagagagcctgggcgtgcccacagcccaggaggcctctgtgctgcggggcacagccctgggctctgtgcctgggggcagcatcaccaagggcatccccagcaccagggtgcccagcgacagcgccatcacctaccggggcagcatcacccacggcaccccagcagatgtgctgtacaagggcaccatcacccgcatcatcggggaggacagccccagccggctggaccggggccgggaggacagcctgcccaagggccacgtgatctatgagggcaagaagggccacgtgctgtcctatgaaggaggcatgtctgtgacccagtgcagcaaagaagatggccgcagcagcagcggcccccctcatgaaacagctgcccccaagaggacctatgacatgatggagggccgggtgggccgggccatcagcagcgccagcattgagggcctgatgggccgggccatccccccagagcggcacagcccccaccacctgaaggagcagcaccacatccggggcagcatcacccagggcatccccaggagctatgtggaggcccaggaggactacctgcggcgggaggccaagctgctgaagcgggagggcaccccacctcctcctccacccagccgggacctgacagaggcctacaagacccaggccctgggccccctgaagctgaagccagcccacgagggcctggtggccaccgtgaaggaggccggccgcagcatccacgagatcccccgggaggagctgcggcacaccccagagctgcccctggccccccggcccctgaaggagggcagcatcacccagggcacccccctgaagtatgacaccggggccagcaccaccggcagcaagaagcatgatgtgcgcagcctcatcggcagccctggccgcaccttcccccctgtgcaccccctggatgtgatggctgatgcccgggccctggagcgggcctgctatgaggagagcctgaagagcaggcctggaacagccagcagcagcggcggcagcatcgcccggggggcccctgtgattgtgcctgagctgggcaagccccggcagagccccctgacctatgaagatcatggagccccctttgctggccacctgccccggggcagccctgtgaccacccgggagcccaccccccggctgcaggagggcagcctgagcagcagcaaggccagccaggacaggaagctgaccagcaccccccgggagatcgccaagagcccccacagcacagtgcctgagcaccacccccaccccatcagcccctatgagcacctgctgcggggcgtgtctggagtggacctgtaccgcagccacatccccctggcctttgaccccaccagcatcccccggggcatccccctggatgctgctgctgcctactacctgcccaggcacctggcccccaaccccacctacccccacctgtacccaccctacctgatccggggctacccagacacagctgccctggagaaccggcagaccatcatcaatgactacatcaccagccagcagatgcaccacaatgctgccacagccatggcccagagagctgacatgctgcggggcctgagcccccgggagagcagcctggccctgaactatgctgctggcccccggggcatcatcgacctgagccaggtgccccacctgcctgtgctggtgccccccaccccaggcaccccagccacagccatggaccggctggcctacctgcccacagccccccagcccttcagcagccgccacagcagcagccccctgagccctgggggccccacccacctgaccaagcccaccaccaccagcagcagcgagcgggagcgggaccgggaccgggagcgggaccgggaccgggagcgggagaagagcatcctgaccagcaccaccaccgtggagcacgcccccatctggaggcctggaacagagcagagcagcggcagcagcggcggcggcggcggcagcagcagcaggcctgccagccacagccacgcccaccagcacagccccatcagccccaggacccaggatgccctgcagcagaggcccagcgtgctgcacaacacaggcatgaagggcatcatcacagctgtggagcccagcacccccaccgtgctgcggagcaccagcaccagcagccctgtgcggcctgctgccaccttccccccagccacccactgccccctgggcggcaccctggatggagtgtaccccaccctgatggagcctgtgctgctgcccaaggaggccccccgggtggcccggcctgagcggcccagggctgacaccggccacgccttcctggccaagcccccagcccggagcggcctggagcccgccagcagccccagcaaaggaagtgagccccggcccctggtgccccctgtgtctggccacgccaccatcgcccggaccccagccaagaacctggccccccaccacgccagcccagaccccccagcccccccagccagcgccagtgacccccaccgggagaagacccagagcaagcccttcagcatccaggagctggagctgcggagcctgggctaccacggcagcagctacagccctgagggcgtggagcctgtgtcccctgtgagcagccccagcctgacccatgacaagggcctgcccaagcacctggaggagctggacaagagccacctggagggggagctgcggcccaagcagcccggccctgtgaagctgggcggggaggccgcccacctgccccacctgcggcccctgcctgagagccagcccagcagcagccccctgctgcagacagcccctggggtgaagggccaccagagggtggtgaccctggcccagcacatcagcgaggtgatcacccaggactacaccaggcaccacccccagcagctgagcgcccccctgcctgcccccctgtacagcttccctggggccagctgccctgtgctggacctgcggcggcccccaagtgacctgtacctgcccccaccagaccacggggccccagcccggggcagcccccacagcgagggcggcaagaggagccctgagcccaacaagacctctgtgctgggcggcggagaagatggcatcgagcctgtgtccccacctgagggcatgacagagcccggccacagccgctctgctgtgtaccccctgctgtacagagatggagagcagacagagcccagcaggatgggcagcaagagccctggcaacaccagccagcccccagccttcttcagcaagctgacagagagcaacagcgccatggtgaagagcaagaagcaggagatcaacaagaagctgaacacccacaacagaaatgaacctgagtacaacatcagccagcctggaacagagatcttcaacatgcctgccatcaccggcaccggcctgatgacctaccgcagccaggccgtgcaggagcacgccagcaccaacatgggcctggaggccatcatcaggaaggccctgatgggcaagtatgaccagtgggaggagagcccccccctgagcgccaatgccttcaaccccctgaatgccagcgccagcctgcctgctgccatgcccatcacagctgctgatggccgcagtgaccacaccctgaccagccctgggggcggcggcaaggccaaggtgtctggccggcccagcagcaggaaggccaagagccctgcccctggcctggccagcggggacaggcctccttctgtgtcctctgtgcacagcgagggggactgcaacagaaggacccccctgaccaacagagtgtgggaggaccggcccagcagcgctggcagcacccccttcccctacaaccccctcatcatgaggctgcaggccggcgtgatggccagccccccacctcctggcctgcctgctggcagcggccccctggccggcccccaccacgcctgggatgaggagcccaagcccctgctgtgcagccagtatgagaccctgagtgacagcgagtag

SEQ ID NO: 162328 - DNA, 7377 bp, Artificial Sequence
  Description of Artificial Sequence: Synthetic coding sequence
atgagcggcagcacccagcctgtggcccagacctggagggccacagagccccgctacccaccccacagcctgagctaccctgtgcagatcgcccggacccacacagatgtgggcctgctggagtaccagcaccacagccgggactatgccagccacctgagccctggcagcatcatccagccccagaggcggcggcccagcctgctgtctgagttccagcctggaaatgaaagaagccaggagctgcacctgcggcctgagagccacagctacctgcctgagctgggcaagtctgagatggagttcatcgagagcaagaggccccggctggagctgctgcctgaccccctgctgcggcccagccccctgctggccaccggccagcctgctggcagcgaggacctgaccaaggacaggagcctgaccgggaagctggagcctgtgagcccccccagccccccccacacagatcctgagctggagctggtgcccccccggctgagcaaggaggagctgatccagaacatggacagagtggaccgggagatcaccatggtggagcagcagatcagcaagctgaagaagaagcagcagcagctggaggaggaggccgccaagcccccagagcctgagaagcctgtgagccccccacccatcgagagcaagcacaggagcctggtgcagatcatctatgatgaaaataggaagaaggccgaggccgcccaccgcatcctggagggcctgggcccccaggtggagctgcccctgtacaaccagcccagcgacacccggcagtaccacgagaacatcaagatcaaccaggccatgaggaagaagctgatcctgtacttcaagagaagaaatcatgccaggaagcagtgggagcagaagttctgccagagatatgaccagctgatggaggcctgggagaagaaggtggagagaattgagaacaacccccggcggcgggccaaggagagcaaggtgcgggagtactatgagaagcagtttcctgagatcaggaagcagcgggagctgcaggagaggatgcagagggtgggccagaggggcagcggcctgtccatgtctgctgcccggagtgaacatgaggtgtctgagatcattgatggcctgtctgagcaggagaacctggagaagcagatgaggcagctggccgtcatcccccccatgctgtatgatgctgaccagcagaggatcaagttcatcaacatgaatggcctgatggctgaccccatgaaggtgtacaaggaccggcaggtgatgaacatgtggagcgagcaggagaaggagaccttccgggagaagttcatgcagcaccccaagaactttggcctgattgccagcttcctggagaggaagacagtggccgagtgtgtgctgtactactacctgaccaagaagaatgaaaactacaagagcctggtgagaagaagctacagaagaagaggcaagagccagcagcagcagcagcagcagcagcagcagcagcagcagcagcagcagcagcccatgcccaggagcagccaggaggagaaggatgagaaggagaaggagaaggaggccgagaaggaggaggagaagccagaggtggagaatgacaaggaggacctgctgaaggagaagacagatgacaccagcggagaagataatgatgagaaggaggccgtggccagcaagggcaggaagacagccaacagccagggccgcaggaagggccgcatcaccaggtccatggccaatgaggccaacagcgaggaggccatcaccccccagcagagcgctgagctggcctccatggagctgaatgaaagcagccgctggacagaggaggagatggagacagccaagaagggcctgctggagcacggcaggaactggagcgccatcgccaggatggtgggcagcaagacagtgtcccagtgcaagaacttctacttcaactacaagaagaggcagaacctggatgagatcctgcagcagcacaagctgaagatggagaaggagagaaatgcccggaggaagaagaagaaggccccagctgctgccagcgaggaggccgccttcccccctgtggtggaggatgaggagatggaggccagcggcgtgtctggaaatgaggaggagatggtggaggaggccgaggccaccgtgaacaacagcagtgacacagagagcatccccagcccccacacagaggccgccaaggacaccggccagaatggccccaagcccccagccaccctgggcgcagatggccccccacctggcccccccaccccacctcctgaggacatcccagcccccacagagcccaccccagccagcgaggccactggagcccccaccccacctccagccccacccagccccagcgcccctcctcctgtggtgcccaaggaggagaaggaggaggagacagctgctgcccctcctgtggaggagggggaggagcagaagcccccagctgctgaggagctggccgtggacaccgggaaggccgaggagcctgtgaagtcagaatgtacagaggaggccgaggagggccctgccaagggcaaggatgctgaggccgctgaggccacagctgagggcgccctgaaggccgagaagaaggagggcggcagcggccgggccaccacagccaagagcagcggggccccccaggacagcgacagcagcgccacctgcagcgcagatgaggtggatgaagctgagggcggggacaagaaccggctgctgagcccccggcccagcctgctgacccccaccggggacccccgggccaatgccagcccccagaagcccctggacctgaagcagctgaagcagagagctgctgccatcccccccatccaggtgaccaaggtgcatgagcccccaagagaagatgctgcccccaccaagccagcccccccagcccctcctccaccccagaacctgcagcctgagagtgatgccccccagcagcccggcagcagcccccggggcaagagccgcagccctgcccccccagctgacaaggaggccgagaagcctgtgttcttccctgcctttgctgctgaggcccagaagctgcccggggaccccccctgctggaccagcggcctgcccttccctgtgcccccccgggaggtgatcaaggccagcccccacgccccagaccccagcgccttctcctatgcccctcctggccaccccctgcccctgggcctgcatgacacagcccggcctgtgctgcccaggcctcccaccatcagcaaccccccacccctcatcagcagcgccaagcaccccagcgtgctggagcggcagatcggggccatcagccagggcatgtctgtgcagctgcacgtgccctacagcgagcacgccaaggcccctgtgggccctgtgaccatgggcctgcccctgcccatggaccccaagaagctggcccccttctctggagtgaagcaggagcagctgagcccccggggccaggccggccccccagagagcctgggcgtgcccacagcccaggaggcctctgtgctgcggggcacagccctgggctctgtgcctgggggcagcatcaccaagggcatccccagcaccagggtgcccagcgacagcgccatcacctaccggggcagcatcacccacggcaccccagcagatgtgctgtacaagggcaccatcacccgcatcattggagaggacagccccagccggctggaccggggccgggaggacagcctgcccaagggccacgtgatctatgagggcaagaagggccacgtgctgtcctatgagggcggcatgtctgtgacccagtgcagcaaggaggatggccgcagcagcagcggcccccctcatgaaacagctgcccccaagaggacctatgacatgatggagggccgggtgggccgggccatcagcagcgccagcattgagggcctgatgggccgggccatccccccagagcggcacagcccccaccacctgaaggagcagcaccacatccggggcagcatcacccagggcatccccaggagctatgtggaggcccaggaggactacctgcggcgggaggccaagctgctgaagcgggagggcaccccacctcctcctccacccagccgggacctgacagaggcctacaagacccaggccctgggccccctgaagctgaagccagcccacgagggcctggtggccaccgtgaaggaggccggccgcagcatccacgagatcccccgggaggagctgcggcacaccccagagctgcccctggccccccggcccctgaaggagggcagcatcacccagggcacccccctgaagtatgacacaggagccagcaccaccggcagcaagaagcatgatgtgcgcagcctgattggcagccctggccgcaccttcccccctgtgcaccccctggatgtgatggctgatgcccgggccctggagcgggcctgctatgaggagagcctgaagagccggcccggcacagccagcagcagcggcggcagcatcgcccggggggcccctgtgattgtgcctgagctgggcaagccccggcagagccccctgacctatgaggaccacggggccccctttgctggccacctgccccggggcagccctgtgaccacccgggagcccaccccccggctgcaggagggcagcctgagcagcagcaaggccagccaggacaggaagctgaccagcaccccccgggagatcgccaagagcccccacagcacagtgcctgagcaccacccccaccccatcagcccctatgagcacctgctgcggggcgtgtctggagtggacctgtaccgcagccacatccccctggcctttgaccccaccagcatcccccggggcatccccctggatgctgctgctgcctactacctgcccaggcacctggcccccaaccccacctacccccacctgtacccaccctacctgatccggggctacccagacacagctgccctggagaaccggcagaccatcatcaatgactacatcaccagccagcagatgcaccacaatgctgccacagccatggcccagagagctgacatgctgcggggcctgagcccccgggagagcagcctggccctgaactatgctgctggcccccggggcatcatcgacctgagccaggtgccccacctgcctgtgctggtgccccccaccccaggcaccccagccacagccatggaccggctggcctacctgcccacagccccccagcccttcagcagccgccacagcagcagccccctgagccctgggggccccacccacctgaccaagcccaccaccaccagcagcagcgagcgggagcgggaccgggaccgggagcgggaccgggaccgggagcgggagaagagcatcctgaccagcaccaccaccgtggagcacgcccccatctggaggcctggaacagagcagagcagcggcagcagcggcggcggcggcggcagcagcagcaggcctgccagccacagccacgcccaccagcacagccccatcagccccaggacccaggatgccctgcagcagaggccttctgtgctgcacaacacaggcatgaagggcatcatcacagctgtggagcccagcacccccaccgtgctgcggagcaccagcaccagcagccctgtgcggcctgctgccaccttccccccagccacccactgccccctgggcggcaccctggatggagtgtaccccaccctgatggagcctgtgctgctgcccaaggaggccccccgggtggcccggcctgagcggcccagggctgacaccggccacgccttcctggccaagcccccagcccggagcggcctggagcccgccagcagccccagcaagggcagcgagccccggcccctggtgccccctgtgtctggccacgccaccatcgcccggaccccagccaagaacctggccccccaccacgccagcccagaccccccagcccccccagccagcgccagtgacccccaccgggagaagacccagagcaagcccttcagcatccaggagctggagctgcggagcctgggctaccacggcagcagctacagccctgagggcgtggagcctgtgtcccctgtgagcagccccagcctgacccatgacaagggcctgcccaagcacctggaggagctggacaagagccacctggagggggagctgcggcccaagcagcccggccctgtgaagctgggcggggaggccgcccacctgccccacctgcggcccctgcctgagagccagcccagcagcagccccctgctgcagacagcccctggggtgaagggccaccagagggtggtgaccctggcccagcacatcagcgaggtgatcacccaggactacaccaggcaccacccccagcagctgagcgcccccctgcctgcccccctgtacagcttccctggggccagctgccctgtgctggacctgcggcggccccccagcgacctgtacctgcccccaccagaccatggagccccagcccggggcagcccccacagcgagggcggcaagaggagccctgagcccaacaagacctctgtgctgggcggcggggaggatggcatcgagcctgtgagccccccagagggcatgacagagcccggccacagccgctctgctgtgtaccccctgctgtacagagatggagagcagacagagcccagcaggatgggcagcaagagccctggcaacaccagccagcccccagccttcttcagcaagctgacagagagcaacagcgccatggtgaagagcaagaagcaggagatcaacaagaagctgaacacccacaacagaaatgaacctgagtacaacatcagccagcccggcacagagatcttcaacatgcctgccatcactggaacaggcctgatgacctaccgcagccaggccgtgcaggagcacgccagcaccaacatgggcctggaggccatcatcaggaaggccctgatgggcggcggcggcaaggccaaggtgtctggccggcccagcagcaggaaggccaagagccctgcccctggcctggccagcggggaccggccccccagcgtgtcctctgtgcacagcgagggggactgcaacagaaggacccccctgaccaacagagtgtgggaggaccggcccagcagcgctggcagcacccccttcccctacaaccccctcatcatgaggctgcaggccggcgtgatggccagccccccacctcctggcctgcctgctggcagcggccccctggccggcccccaccacgcctgggatgaggagcccaagcccctgctgtgcagccagtatgagaccctgagtgacagcgagtag

SEQ ID NO: 162329 - DNA, 7545 bp, Artificial Sequence
  Description of Artificial Sequence: Synthetic coding sequence
atgagcggcagcacccagcctgtggcccagacctggagggccacagagccccgctacccaccccacagcctgagctaccctgtgcagatcgcccggacccacacagatgtgggcctgctggagtaccagcaccacagccgggactatgccagccacctgagccctggcagcatcatccagccccagaggcggcggcccagcctgctgtctgagttccagcctggaaatgaaagaagccaggagctgcacctgcggcctgagagccacagctacctgcctgagctgggcaagtctgagatggagttcatcgagagcaagaggccccggctggagctgctgcctgaccccctgctgcggcccagccccctgctggccaccggccagcctgctggcagcgaggacctgaccaaggacaggagcctgaccgggaagctggagcctgtgagcccccccagccccccccacacagatcctgagctggagctggtgcccccccggctgagcaaggaggagctgatccagaacatggacagagtggaccgggagatcaccatggtggagcagcagatcagcaagctgaagaagaagcagcagcagctggaggaggaggccgccaagcccccagagcctgagaagcctgtgagccccccacccatcgagagcaagcacaggagcctggtgcagatcatctatgatgaaaataggaagaaggccgaggccgcccaccgcatcctggagggcctgggcccccaggtggagctgcccctgtacaaccagcccagcgacacccggcagtaccacgagaacatcaagatcaaccaggccatgaggaagaagctgatcctgtacttcaagagaagaaatcatgccaggaagcagtgggagcagaagttctgccagagatatgaccagctgatggaggcctgggagaagaaggtggagagaattgagaacaacccccggcggcgggccaaggagagcaaggtgcgggagtactatgagaagcagtttcctgagatcaggaagcagcgggagctgcaggagaggatgcagagccgggtgggccagaggggcagcggcctgtccatgtctgctgcccggtctgagcacgaggtgtctgagatcattgatggcctgtctgagcaggagaacctggagaagcagatgaggcagctggccgtcatcccccccatgctgtatgatgctgaccagcagaggatcaagttcatcaacatgaatggcctgatggctgaccccatgaaggtgtacaaggaccggcaggtgatgaacatgtggagcgagcaggagaaggagaccttccgggagaagttcatgcagcaccccaagaactttggcctcatcgccagcttcctggagaggaagacagtggctgaatgtgtgctgtactactacctgaccaagaagaatgaaaactacaagagcctggtgcggcgcagctacagaagaagaggcaagagccagcagcagcagcagcagcagcagcagcagcagcagcagcagcagcagcagcccatgcccaggagcagccaggaggagaaggatgagaaggagaaggagaaggaggccgagaaggaggaggagaagccagaggtggagaatgacaaggaggacctgctgaaggagaagacagatgacaccagcggggaggacaatgatgagaaggaggccgtggccagcaaaggaaggaagacagccaacagccagggccgcaggaagggccgcatcaccaggtccatggccaatgaggccaacagcgaggaggccatcaccccccagcagagcgctgagctggcctccatggagctgaatgaaagcagccgctggacagaggaggagatggagacagccaagaagggcctgctggagcacggcaggaactggagcgccatcgccaggatggtgggcagcaagacagtgtcccagtgcaagaacttctacttcaactacaagaagaggcagaacctggatgagatcctgcagcagcacaagctgaagatggagaaggagagaaatgcccggaggaagaagaagaaggccccagctgctgccagcgaggaggccgccttcccccctgtggtggaggatgaggagatggaggccagcggcgtgtctggaaatgaggaggagatggtggaggaggccgaggccctgcacgccagcggaaatgaggtgcccagaggagaatgttctggccctgccaccgtgaacaacagcagtgacacagagagcatccccagcccccacacagaggccgccaaggacaccggccagaatggccccaagcccccagccaccctgggcgcagatggccccccacctggcccccccaccccacctcctgaggacatcccagcccccacagagcccaccccagccagcgaggccactggagcccccaccccacctccagccccacccagccccagcgcccctcctcctgtggtgcccaaggaggagaaggaggaggagacagctgctgcccctcctgtggaggagggggaggagcagaagcccccagctgctgaggagctggccgtggacaccgggaaggccgaggagcctgtgaagtcagaatgtacagaggaggccgaggagggccctgccaagggcaaggatgctgaggccgctgaggccacagctgagggcgccctgaaggccgagaagaaggagggcggcagcggccgggccaccacagccaagagcagcggggccccccaggacagcgacagcagcgccacctgcagcgcagatgaggtggatgaagctgagggcggggacaagaaccggctgctgagcccccggcccagcctgctgacccccaccggggacccccgggccaatgccagcccccagaagcccctggacctgaagcagctgaagcagagagctgctgccatcccccccatccaggtgaccaaggtgcatgagcccccaagagaagatgctgcccccaccaagccagcccccccagcccctcctccaccccagaacctgcagcctgagagtgatgccccccagcagcccggcagcagcccccggggcaagagccgcagccctgcccccccagctgacaaggaggcctttgctgctgaggcccagaagctgcccggggaccccccctgctggaccagcggcctgcccttccctgtgcccccccgggaggtgatcaaggccagcccccacgccccagaccccagcgccttctcctatgcccctcctggccaccccctgcccctgggcctgcatgacacagcccggcctgtgctgcccaggcctcccaccatcagcaaccccccacccctcatcagcagcgccaagcaccccagcgtgctggagcggcagatcggggccatcagccagggcatgtctgtgcagctgcacgtgccctacagcgagcacgccaaggcccctgtgggccctgtgaccatgggcctgcccctgcccatggaccccaagaagctggcccccttctctggagtgaagcaggagcagctgagcccccggggccaggccggccccccagagagcctgggcgtgcccacagcccaggaggcctctgtgctgcggggcacagccctgggctctgtgcctgggggcagcatcaccaagggcatccccagcaccagggtgcccagcgacagcgccatcacctaccggggcagcatcacccacggcaccccagcagatgtgctgtacaagggcaccatcacccgcatcattggagaggacagccccagccggctggaccggggccgggaggacagcctgcccaagggccacgtgatctatgagggcaagaagggccacgtgctgtcctatgagggcggcatgtctgtgacccagtgcagcaaggaggatggccgcagcagcagcggcccccctcatgaaacagctgcccccaagaggacctatgacatgatggagggccgggtgggccgggccatcagcagcgccagcattgagggcctgatgggccgggccatccccccagagcggcacagcccccaccacctgaaggagcagcaccacatccggggcagcatcacccagggcatccccaggagctatgtggaggcccaggaggactacctgcggcgggaggccaagctgctgaagcgggagggcaccccacctcctcctccacccagccgggacctgacagaggcctacaagacccaggccctgggccccctgaagctgaagccagcccacgagggcctggtggccaccgtgaaggaggccggccgcagcatccacgagatcccccgggaggagctgcggcacaccccagagctgcccctggccccccggcccctgaaggagggcagcatcacccagggcacccccctgaagtatgacacaggagccagcaccaccggcagcaagaagcatgatgtgcgcagcctgattggcagccctggccgcaccttcccccctgtgcaccccctggatgtgatggctgatgcccgggccctggagcgggcctgctatgaggagagcctgaagagccggcccggcacagccagcagcagcggcggcagcatcgcccggggggcccctgtgattgtgcctgagctgggcaagccccggcagagccccctgacctatgaggaccacggggccccctttgctggccacctgccccggggcagccctgtgaccacccgggagcccaccccccggctgcaggagggcagcctgagcagcagcaaggccagccaggacaggaagctgaccagcaccccccgggagatcgccaagagcccccacagcacagtgcctgagcaccacccccaccccatcagcccctatgagcacctgctgcggggcgtgtctggagtggacctgtaccgcagccacatccccctggcctttgaccccaccagcatcccccggggcatccccctggatgctgctgctgcctactacctgcccaggcacctggcccccaaccccacctacccccacctgtacccaccctacctgatccggggctacccagacacagctgccctggagaaccggcagaccatcatcaatgactacatcaccagccagcagatgcaccacaatgctgccacagccatggcccagagagctgacatgctgcggggcctgagcccccgggagagcagcctggccctgaactatgctgctggcccccggggcatcatcgacctgagccaggtgccccacctgcctgtgctggtgccccccaccccaggcaccccagccacagccatggaccggctggcctacctgcccacagccccccagcccttcagcagccgccacagcagcagccccctgagccctgggggccccacccacctgaccaagcccaccaccaccagcagcagcgagcgggagcgggaccgggaccgggagcgggaccgggaccgggagcgggagaagagcatcctgaccagcaccaccaccgtggagcacgcccccatctggaggcctggaacagagcagagcagcggcagcagcggcggcggcggcggcagcagcagcaggcctgccagccacagccacgcccaccagcacagccccatcagccccaggacccaggatgccctgcagcagaggccttctgtgctgcacaacacaggcatgaagggcatcatcacagctgtggagcccagcacccccaccgtgctgcggagcaccagcaccagcagccctgtgcggcctgctgccaccttccccccagccacccactgccccctgggcggcaccctggatggagtgtaccccaccctgatggagcctgtgctgctgcccaaggaggccccccgggtggcccggcctgagcggcccagggctgacaccggccacgccttcctggccaagcccccagcccggagcggcctggagcccgccagcagccccagcaagggcagcgagccccggcccctggtgccccctgtgtctggccacgccaccatcgcccggaccccagccaagaacctggccccccaccacgccagcccagaccccccagcccccccagccagcgccagtgacccccaccgggagaagacccagagcaagcccttcagcatccaggagctggagctgcggagcctgggctaccacggcagcagctacagccctgagggcgtggagcctgtgtcccctgtgagcagccccagcctgacccatgacaagggcctgcccaagcacctggaggagctggacaagagccacctggagggggagctgcggcccaagcagcccggccctgtgaagctgggcggggaggccgcccacctgccccacctgcggcccctgcctgagagccagcccagcagcagccccctgctgcagacagcccctggggtgaagggccaccagagggtggtgaccctggcccagcacatcagcgaggtgatcacccaggactacaccaggcaccacccccagcagctgagcgcccccctgcctgcccccctgtacagcttccctggggccagctgccctgtgctggacctgcggcggccccccagcgacctgtacctgcccccaccagaccatggagccccagcccggggcagcccccacagcgagggcggcaagaggagccctgagcccaacaagacctctgtgctgggcggcggggaggatggcatcgagcctgtgagccccccagagggcatgacagagcccggccacagccgctctgctgtgtaccccctgctgtacagagatggagagcagacagagcccagcaggatgggcagcaagagccctggcaacaccagccagcccccagccttcttcagcaagctgacagagagcaacagcgccatggtgaagagcaagaagcaggagatcaacaagaagctgaacacccacaacagaaatgaacctgagtacaacatcagccagcccggcacagagatcttcaacatgcctgccatcactggaacaggcctgatgacctaccgcagccaggccgtgcaggagcacgccagcaccaacatgggcctggaggccatcatcaggaaggccctgatgggcaagtatgaccagtgggaggagagcccccccctgagcgccaatgccttcaaccccctgaatgccagcgccagcctgcctgctgccatgcccatcacagctgctgatggccgcagtgaccacaccctgaccagccctgggggcggcggcaaggccaaggtgtctggccggcccagcagcaggaaggccaagagccctgcccctggcctggccagcggggaccggccccccagcgtgtcctctgtgcacagcgagggggactgcaacagaaggacccccctgaccaacagagtgtgggaggaccggcccagcagcgctggcagcacccccttcccctacaaccccctcatcatgaggctgcaggccggcgtgatggccagccccccacctcctggcctgcctgctggcagcggccccctggccggcccccaccacgcctgggatgaggagcccaagcccctgctgtgcagccagtatgagaccctgagtgacagcgagtag

SEQ ID NO: 162330 - DNA, 7515 bp, Artificial Sequence
  Description of Artificial Sequence: Synthetic coding sequence
atgagcggcagcacccagcctgtggcccagacctggagggccacagagccccgctacccaccccacagcctgagctaccctgtgcagatcgcccggacccacacagatgtgggcctgctggagtaccagcaccacagccgggactatgccagccacctgagccctggcagcatcatccagccccagaggcggcggcccagcctgctgtctgagttccagcctggaaatgaaagaagccaggagctgcacctgcggcctgagagccacagctacctgcctgagctgggcaagtctgagatggagttcatcgagagcaagaggccccggctggagctgctgcctgaccccctgctgcggcccagccccctgctggccaccggccagcctgctggcagcgaggacctgaccaaggacaggagcctgaccgggaagctggagcctgtgagcccccccagccccccccacacagatcctgagctggagctggtgcccccccggctgagcaaggaggagctgatccagaacatggacagagtggaccgggagatcaccatggtggagcagcagatcagcaagctgaagaagaagcagcagcagctggaggaggaggccgccaagcccccagagcctgagaagcctgtgagccccccacccatcgagagcaagcacaggagcctggtgcagatcatctatgatgaaaataggaagaaggccgaggccgcccaccgcatcctggagggcctgggcccccaggtggagctgcccctgtacaaccagcccagcgacacccggcagtaccacgagaacatcaagatcaaccaggccatgaggaagaagctgatcctgtacttcaagagaagaaatcatgccaggaagcagtgggagcagaagttctgccagagatatgaccagctgatggaggcctgggagaagaaggtggagagaattgagaacaacccccggcggcgggccaaggagagcaaggtgcgggagtactatgagaagcagtttcctgagatcaggaagcagcgggagctgcaggagaggatgcagagggtgggccagaggggcagcggcctgtccatgtctgctgcccggagtgaacatgaggtgtctgagatcattgatggcctgtctgagcaggagaacctggagaagcagatgaggcagctggccgtcatcccccccatgctgtatgatgctgaccagcagaggatcaagttcatcaacatgaatggcctgatggctgaccccatgaaggtgtacaaggaccggcaggtgatgaacatgtggagcgagcaggagaaggagaccttccgggagaagttcatgcagcaccccaagaactttggcctgattgccagcttcctggagaggaagacagtggccgagtgtgtgctgtactactacctgaccaagaagaatgaaaactacaagagcctggtgagaagaagctacagaagaagaggcaagagccagcagcagcagcagcagcagcagcagcagcagcagcagcagcagcagcagcccatgcccaggagcagccaggaggagaaggatgagaaggagaaggagaaggaggccgagaaggaggaggagaagccagaggtggagaatgacaaggaggacctgctgaaggagaagacagatgacaccagcggagaagataatgatgagaaggaggccgtggccagcaagggcaggaagacagccaacagccagggccgcaggaagggccgcatcaccaggtccatggccaatgaggccaacagcgaggaggccatcaccccccagcagagcgctgagctggcctccatggagctgaatgaaagcagccgctggacagaggaggagatggagacagccaagaagggcctgctggagcacggcaggaactggagcgccatcgccaggatggtgggcagcaagacagtgtcccagtgcaagaacttctacttcaactacaagaagaggcagaacctggatgagatcctgcagcagcacaagctgaagatggagaaggagagaaatgcccggaggaagaagaagaaggccccagctgctgccagcgaggaggccgccttcccccctgtggtggaggatgaggagatggaggccagcggcgtgtctggaaatgaggaggagatggtggaggaggccgaggccaccgtgaacaacagcagtgacacagagagcatccccagcccccacacagaggccgccaaggacaccggccagaatggccccaagcccccagccaccctgggcgcagatggccccccacctggcccccccaccccacctcctgaggacatcccagcccccacagagcccaccccagccagcgaggccactggagcccccaccccacctccagccccacccagccccagcgcccctcctcctgtggtgcccaaggaggagaaggaggaggagacagctgctgcccctcctgtggaggagggggaggagcagaagcccccagctgctgaggagctggccgtggacaccgggaaggccgaggagcctgtgaagtcagaatgtacagaggaggccgaggagggccctgccaagggcaaggatgctgaggccgctgaggccacagctgagggcgccctgaaggccgagaagaaggagggcggcagcggccgggccaccacagccaagagcagcggggccccccaggacagcgacagcagcgccacctgcagcgcagatgaggtggatgaagctgagggcggggacaagaaccggctgctgagcccccggcccagcctgctgacccccaccggggacccccgggccaatgccagcccccagaagcccctggacctgaagcagctgaagcagagagctgctgccatcccccccatccaggtgaccaaggtgcatgagcccccaagagaagatgctgcccccaccaagccagcccccccagcccctcctccaccccagaacctgcagcctgagagtgatgccccccagcagcccggcagcagcccccggggcaagagccgcagccctgcccccccagctgacaaggaggccgagaagcctgtgttcttccctgcctttgctgctgaggcccagaagctgcccggggaccccccctgctggaccagcggcctgcccttccctgtgcccccccgggaggtgatcaaggccagcccccacgccccagaccccagcgccttctcctatgcccctcctggccaccccctgcccctgggcctgcatgacacagcccggcctgtgctgcccaggcctcccaccatcagcaaccccccacccctcatcagcagcgccaagcaccccagcgtgctggagcggcagatcggggccatcagccagggcatgtctgtgcagctgcacgtgccctacagcgagcacgccaaggcccctgtgggccctgtgaccatgggcctgcccctgcccatggaccccaagaagctggcccccttctctggagtgaagcaggagcagctgagcccccggggccaggccggccccccagagagcctgggcgtgcccacagcccaggaggcctctgtgctgcggggcacagccctgggctctgtgcctgggggcagcatcaccaagggcatccccagcaccagggtgcccagcgacagcgccatcacctaccggggcagcatcacccacggcaccccagcagatgtgctgtacaagggcaccatcacccgcatcattggagaggacagccccagccggctggaccggggccgggaggacagcctgcccaagggccacgtgatctatgagggcaagaagggccacgtgctgtcctatgagggcggcatgtctgtgacccagtgcagcaaggaggatggccgcagcagcagcggcccccctcatgaaacagctgcccccaagaggacctatgacatgatggagggccgggtgggccgggccatcagcagcgccagcattgagggcctgatgggccgggccatccccccagagcggcacagcccccaccacctgaaggagcagcaccacatccggggcagcatcacccagggcatccccaggagctatgtggaggcccaggaggactacctgcggcgggaggccaagctgctgaagcgggagggcaccccacctcctcctccacccagccgggacctgacagaggcctacaagacccaggccctgggccccctgaagctgaagccagcccacgagggcctggtggccaccgtgaaggaggccggccgcagcatccacgagatcccccgggaggagctgcggcacaccccagagctgcccctggccccccggcccctgaaggagggcagcatcacccagggcacccccctgaagtatgacacaggagccagcaccaccggcagcaagaagcatgatgtgcgcagcctgattggcagccctggccgcaccttcccccctgtgcaccccctggatgtgatggctgatgcccgggccctggagcgggcctgctatgaggagagcctgaagagccggcccggcacagccagcagcagcggcggcagcatcgcccggggggcccctgtgattgtgcctgagctgggcaagccccggcagagccccctgacctatgaggaccacggggccccctttgctggccacctgccccggggcagccctgtgaccacccgggagcccaccccccggctgcaggagggcagcctgagcagcagcaaggccagccaggacaggaagctgaccagcaccccccgggagatcgccaagagcccccacagcacagtgcctgagcaccacccccaccccatcagcccctatgagcacctgctgcggggcgtgtctggagtggacctgtaccgcagccacatccccctggcctttgaccccaccagcatcccccggggcatccccctggatgctgctgctgcctactacctgcccaggcacctggcccccaaccccacctacccccacctgtacccaccctacctgatccggggctacccagacacagctgccctggagaaccggcagaccatcatcaatgactacatcaccagccagcagatgcaccacaatgctgccacagccatggcccagagagctgacatgctgcggggcctgagcccccgggagagcagcctggccctgaactatgctgctggcccccggggcatcatcgacctgagccaggtgccccacctgcctgtgctggtgccccccaccccaggcaccccagccacagccatggaccggctggcctacctgcccacagccccccagcccttcagcagccgccacagcagcagccccctgagccctgggggccccacccacctgaccaagcccaccaccaccagcagcagcgagcgggagcgggaccgggaccgggagcgggaccgggaccgggagcgggagaagagcatcctgaccagcaccaccaccgtggagcacgcccccatctggaggcctggaacagagcagagcagcggcagcagcggcggcggcggcggcagcagcagcaggcctgccagccacagccacgcccaccagcacagccccatcagccccaggacccaggatgccctgcagcagaggccttctgtgctgcacaacacaggcatgaagggcatcatcacagctgtggagcccagcacccccaccgtgctgcggagcaccagcaccagcagccctgtgcggcctgctgccaccttccccccagccacccactgccccctgggcggcaccctggatggagtgtaccccaccctgatggagcctgtgctgctgcccaaggaggccccccgggtggcccggcctgagcggcccagggctgacaccggccacgccttcctggccaagcccccagcccggagcggcctggagcccgccagcagccccagcaagggcagcgagccccggcccctggtgccccctgtgtctggccacgccaccatcgcccggaccccagccaagaacctggccccccaccacgccagcccagaccccccagcccccccagccagcgccagtgacccccaccgggagaagacccagagcaagcccttcagcatccaggagctggagctgcggagcctgggctaccacggcagcagctacagccctgagggcgtggagcctgtgtcccctgtgagcagccccagcctgacccatgacaagggcctgcccaagcacctggaggagctggacaagagccacctggagggggagctgcggcccaagcagcccggccctgtgaagctgggcggggaggccgcccacctgccccacctgcggcccctgcctgagagccagcccagcagcagccccctgctgcagacagcccctggggtgaagggccaccagagggtggtgaccctggcccagcacatcagcgaggtgatcacccaggactacaccaggcaccacccccagcagctgagcgcccccctgcctgcccccctgtacagcttccctggggccagctgccctgtgctggacctgcggcggccccccagcgacctgtacctgcccccaccagaccatggagccccagcccggggcagcccccacagcgagggcggcaagaggagccctgagcccaacaagacctctgtgctgggcggcggggaggatggcatcgagcctgtgagccccccagagggcatgacagagcccggccacagccgctctgctgtgtaccccctgctgtacagagatggagagcagacagagcccagcaggatgggcagcaagagccctggcaacaccagccagcccccagccttcttcagcaagctgacagagagcaacagcgccatggtgaagagcaagaagcaggagatcaacaagaagctgaacacccacaacagaaatgaacctgagtacaacatcagccagcccggcacagagatcttcaacatgcctgccatcactggaacaggcctgatgacctaccgcagccaggccgtgcaggagcacgccagcaccaacatgggcctggaggccatcatcaggaaggccctgatgggcaagtatgaccagtgggaggagagcccccccctgagcgccaatgccttcaaccccctgaatgccagcgccagcctgcctgctgccatgcccatcacagctgctgatggccgcagtgaccacaccctgaccagccctgggggcggcggcaaggccaaggtgtctggccggcccagcagcaggaaggccaagagccctgcccctggcctggccagcggggaccggccccccagcgtgtcctctgtgcacagcgagggggactgcaacagaaggacccccctgaccaacagagtgtgggaggaccggcccagcagcgctggcagcacccccttcccctacaaccccctcatcatgaggctgcaggccggcgtgatggccagccccccacctcctggcctgcctgctggcagcggccccctggccggcccccaccacgcctgggatgaggagcccaagcccctgctgtgcagccagtatgagaccctgagtgacagcgagtag

SEQ ID NO: 162331 - DNA, 7542 bp, Artificial Sequence
  Description of Artificial Sequence: Synthetic coding sequence
atgagcggcagcacccagcctgtggcccagacctggagggccacagagccccgctacccaccccacagcctgagctaccctgtgcagatcgcccggacccacacagatgtgggcctgctggagtaccagcaccacagccgggactatgccagccacctgagccctggcagcatcatccagccccagaggcggcggcccagcctgctgtctgagttccagcctggaaatgaaagaagccaggagctgcacctgcggcctgagagccacagctacctgcctgagctgggcaagtctgagatggagttcatcgagagcaagaggccccggctggagctgctgcctgaccccctgctgcggcccagccccctgctggccaccggccagcctgctggcagcgaggacctgaccaaggacaggagcctgaccgggaagctggagcctgtgagcccccccagccccccccacacagatcctgagctggagctggtgcccccccggctgagcaaggaggagctgatccagaacatggacagagtggaccgggagatcaccatggtggagcagcagatcagcaagctgaagaagaagcagcagcagctggaggaggaggccgccaagcccccagagcctgagaagcctgtgagccccccacccatcgagagcaagcacaggagcctggtgcagatcatctatgatgaaaataggaagaaggccgaggccgcccaccgcatcctggagggcctgggcccccaggtggagctgcccctgtacaaccagcccagcgacacccggcagtaccacgagaacatcaagatcaaccaggccatgaggaagaagctgatcctgtacttcaagagaagaaatcatgccaggaagcagtgggagcagaagttctgccagagatatgaccagctgatggaggcctgggagaagaaggtggagagaattgagaacaacccccggcggcgggccaaggagagcaaggtgcgggagtactatgagaagcagtttcctgagatcaggaagcagcgggagctgcaggagaggatgcagagccgggtgggccagaggggcagcggcctgtccatgtctgctgcccggtctgagcacgaggtgtctgagatcattgatggcctgtctgagcaggagaacctggagaagcagatgaggcagctggccgtcatcccccccatgctgtatgatgctgaccagcagaggatcaagttcatcaacatgaatggcctgatggctgaccccatgaaggtgtacaaggaccggcaggtgatgaacatgtggagcgagcaggagaaggagaccttccgggagaagttcatgcagcaccccaagaactttggcctcatcgccagcttcctggagaggaagacagtggctgaatgtgtgctgtactactacctgaccaagaagaatgaaaactacaagagcctggtgcggcgcagctacagaagaagaggcaagagccagcagcagcagcagcagcagcagcagcagcagcagcagcagcagcagcagcccatgcccaggagcagccaggaggagaaggatgagaaggagaaggagaaggaggccgagaaggaggaggagaagccagaggtggagaatgacaaggaggacctgctgaaggagaagacagatgacaccagcggggaggacaatgatgagaaggaggccgtggccagcaaaggaaggaagacagccaacagccagggccgcaggaagggccgcatcaccaggtccatggccaatgaggccaacagcgaggaggccatcaccccccagcagagcgctgagctggcctccatggagctgaatgaaagcagccgctggacagaggaggagatggagacagccaagaagggcctgctggagcacggcaggaactggagcgccatcgccaggatggtgggcagcaagacagtgtcccagtgcaagaacttctacttcaactacaagaagaggcagaacctggatgagatcctgcagcagcacaagctgaagatggagaaggagagaaatgcccggaggaagaagaagaaggccccagctgctgccagcgaggaggccgccttcccccctgtggtggaggatgaggagatggaggccagcggcgtgtctggaaatgaggaggagatggtggaggaggccgaggccctgcacgccagcggaaatgaggtgcccagaggagaatgttctggccctgccaccgtgaacaacagcagtgacacagagagcatccccagcccccacacagaggccgccaaggacaccggccagaatggccccaagcccccagccaccctgggcgcagatggccccccacctggcccccccaccccacccaggaggaccagccggcccacagagcccaccccagccagcgaggccaccggggcccccaccccacctccagccccacccagccccagcgcccctcctcctgtggtgcccaaggaggagaaggaggaggagacagctgctgcccctcctgtggaggagggggaggagcagaagcccccagctgctgaggagctggccgtggacaccgggaaggccgaggagcctgtgaagtctgagtgcacagaggaggccgaggagggccctgccaagggcaaggatgctgaggccgctgaggccacagctgagggcgccctgaaggccgagaagaaggagggcggcagcggccgggccaccacagccaagagcagcggggccccccaggacagcgacagcagcgccacctgcagcgcagatgaggtggatgaggccgagggcggggacaagaaccggctgctgagcccccggcccagcctgctgacccccactggagacccccgggccaatgccagcccccagaagcccctggacctgaagcagctgaagcagagagctgctgccatcccccccatccaggtgaccaaggtgcatgagcccccccgggaggatgctgcccccaccaagccagcccccccagcccctcctccaccccagaacctgcagcctgagagtgatgccccccagcagcccggcagcagcccccggggcaagagccgcagccctgcccctcctgctgacaaggaggcctttgctgctgaggcccagaagctgcccggggaccccccctgctggaccagcggcctgcccttccctgtgcccccccgggaggtgatcaaggccagcccccacgccccagaccccagcgccttctcctatgcccctcctggccaccccctgcccctgggcctgcatgacacagcccggcctgtgctgccccggccccccaccatcagcaaccccccacccctcatcagcagcgccaagcaccccagcgtgctggagcggcagattggagccatcagccagggcatgtctgtgcagctgcacgtgccctacagcgagcacgccaaggcccctgtgggccctgtgaccatgggcctgcccctgcccatggaccccaagaagctggcccccttcagcggcgtgaagcaggagcagctgagcccccggggccaggccggccccccagagagcctgggcgtgcccacagcccaggaggcctctgtgctgcggggcacagccctgggctctgtgcctgggggcagcatcaccaagggcatccccagcaccagggtgcccagcgacagcgccatcacctaccggggcagcatcacccacggcaccccagcagatgtgctgtacaagggcaccatcacccgcatcatcggggaggacagccccagccggctggaccggggccgggaggacagcctgcccaagggccacgtgatctatgagggcaagaagggccacgtgctgtcctatgaaggaggcatgtctgtgacccagtgcagcaaagaagatggccgcagcagcagcggcccccctcatgaaacagctgcccccaagaggacctatgacatgatggagggccgggtgggccgggccatcagcagcgccagcattgagggcctgatgggccgggccatccccccagagcggcacagcccccaccacctgaaggagcagcaccacatccggggcagcatcacccagggcatccccaggagctatgtggaggcccaggaggactacctgcggcgggaggccaagctgctgaagcgggagggcaccccacctcctcctccacccagccgggacctgacagaggcctacaagacccaggccctgggccccctgaagctgaagccagcccacgagggcctggtggccaccgtgaaggaggccggccgcagcatccacgagatcccccgggaggagctgcggcacaccccagagctgcccctggccccccggcccctgaaggagggcagcatcacccagggcacccccctgaagtatgacaccggggccagcaccaccggcagcaagaagcatgatgtgcgcagcctcatcggcagccctggccgcaccttcccccctgtgcaccccctggatgtgatggctgatgcccgggccctggagcgggcctgctatgaggagagcctgaagagcaggcctggaacagccagcagcagcggcggcagcatcgcccggggggcccctgtgattgtgcctgagctgggcaagccccggcagagccccctgacctatgaagatcatggagccccctttgctggccacctgccccggggcagccctgtgaccacccgggagcccaccccccggctgcaggagggcagcctgagcagcagcaaggccagccaggacaggaagctgaccagcaccccccgggagatcgccaagagcccccacagcacagtgcctgagcaccacccccaccccatcagcccctatgagcacctgctgcggggcgtgtctggagtggacctgtaccgcagccacatccccctggcctttgaccccaccagcatcccccggggcatccccctggatgctgctgctgcctactacctgcccaggcacctggcccccaaccccacctacccccacctgtacccaccctacctgatccggggctacccagacacagctgccctggagaaccggcagaccatcatcaatgactacatcaccagccagcagatgcaccacaatgctgccacagccatggcccagagagctgacatgctgcggggcctgagcccccgggagagcagcctggccctgaactatgctgctggcccccggggcatcatcgacctgagccaggtgccccacctgcctgtgctggtgccccccaccccaggcaccccagccacagccatggaccggctggcctacctgcccacagccccccagcccttcagcagccgccacagcagcagccccctgagccctgggggccccacccacctgaccaagcccaccaccaccagcagcagcgagcgggagcgggaccgggaccgggagcgggaccgggaccgggagcgggagaagagcatcctgaccagcaccaccaccgtggagcacgcccccatctggaggcctggaacagagcagagcagcggcagcagcggcggcggcggcggcagcagcagcaggcctgccagccacagccacgcccaccagcacagccccatcagccccaggacccaggatgccctgcagcagaggcccagcgtgctgcacaacacaggcatgaagggcatcatcacagctgtggagcccagcacccccaccgtgctgcggagcaccagcaccagcagccctgtgcggcctgctgccaccttccccccagccacccactgccccctgggcggcaccctggatggagtgtaccccaccctgatggagcctgtgctgctgcccaaggaggccccccgggtggcccggcctgagcggcccagggctgacaccggccacgccttcctggccaagcccccagcccggagcggcctggagcccgccagcagccccagcaaaggaagtgagccccggcccctggtgccccctgtgtctggccacgccaccatcgcccggaccccagccaagaacctggccccccaccacgccagcccagaccccccagcccccccagccagcgccagtgacccccaccgggagaagacccagagcaagcccttcagcatccaggagctggagctgcggagcctgggctaccacggcagcagctacagccctgagggcgtggagcctgtgtcccctgtgagcagccccagcctgacccatgacaagggcctgcccaagcacctggaggagctggacaagagccacctggagggggagctgcggcccaagcagcccggccctgtgaagctgggcggggaggccgcccacctgccccacctgcggcccctgcctgagagccagcccagcagcagccccctgctgcagacagcccctggggtgaagggccaccagagggtggtgaccctggcccagcacatcagcgaggtgatcacccaggactacaccaggcaccacccccagcagctgagcgcccccctgcctgcccccctgtacagcttccctggggccagctgccctgtgctggacctgcggcggcccccaagtgacctgtacctgcccccaccagaccacggggccccagcccggggcagcccccacagcgagggcggcaagaggagccctgagcccaacaagacctctgtgctgggcggcggagaagatggcatcgagcctgtgtccccacctgagggcatgacagagcccggccacagccgctctgctgtgtaccccctgctgtacagagatggagagcagacagagcccagcaggatgggcagcaagagccctggcaacaccagccagcccccagccttcttcagcaagctgacagagagcaacagcgccatggtgaagagcaagaagcaggagatcaacaagaagctgaacacccacaacagaaatgaacctgagtacaacatcagccagcctggaacagagatcttcaacatgcctgccatcaccggcaccggcctgatgacctaccgcagccaggccgtgcaggagcacgccagcaccaacatgggcctggaggccatcatcaggaaggccctgatgggcaagtatgaccagtgggaggagagcccccccctgagcgccaatgccttcaaccccctgaatgccagcgccagcctgcctgctgccatgcccatcacagctgctgatggccgcagtgaccacaccctgaccagccctgggggcggcggcaaggccaaggtgtctggccggcccagcagcaggaaggccaagagccctgcccctggcctggccagcggggacaggcctccttctgtgtcctctgtgcacagcgagggggactgcaacagaaggacccccctgaccaacagagtgtgggaggaccggcccagcagcgctggcagcacccccttcccctacaaccccctcatcatgaggctgcaggccggcgtgatggccagccccccacctcctggcctgcctgctggcagcggccccctggccggcccccaccacgcctgggatgaggagcccaagcccctgctgtgcagccagtatgagaccctgagtgacagcgagtag

SEQ ID NO: 162332 - DNA, 1821 bp, Artificial Sequence
  Description of Artificial Sequence: Synthetic coding sequence
ctgcagagcggggccacccactgccccctgggcggcaccctggatggagtgtaccccaccctgatggagcctgtgctgctgcccaaggaggccccccgggtggcccggcctgagcggcccagggctgacaccggccacgccttcctggccaagcccccagcccggagcggcctggagcccgccagcagccccagcaagggcagcgagccccggcccctggtgccccctgtgtctggccacgccaccatcgcccggaccccagccaagaacctggccccccaccacgccagcccagaccccccagcccccccagccagcgccagtgacccccaccgggagaagacccagagcaagcccttcagcatccaggagctggagctgcggagcctgggctaccacggcagcagctacagccctgagggcgtggagcctgtgtcccctgtgagcagccccagcctgacccatgacaagggcctgcccaagcacctggaggagctggacaagagccacctggagggggagctgcggcccaagcagcccggccctgtgaagctgggcggggaggccgcccacctgccccacctgcggcccctgcctgagagccagcccagcagcagccccctgctgcagacagcccctggggtgaagggccaccagagggtggtgaccctggcccagcacatcagcgaggtgatcacccaggactacaccaggcaccacccccagcagctgagcgcccccctgcctgcccccctgtacagcttccctggggccagctgccctgtgctggacctgcggcggccccccagcgacctgtacctgcccccaccagaccatggagccccagcccggggcagcccccacagcgagggcggcaagaggagccctgagcccaacaagacctctgtgctgggcggcggggaggatggcatcgagcctgtgagccccccagagggcatgacagagcccggccacagccgctctgctgtgtaccccctgctgtacagagatggagagcagacagagcccagcaggatgggcagcaagagccctggcaacaccagccagcccccagccttcttcagcaagctgacagagagcaacagcgccatggtgaagagcaagaagcaggagatcaacaagaagctgaacacccacaacagaaatgaacctgagtacaacatcagccagcccggcacagagatcttcaacatgcctgccatcactggaacaggcctgatgacctaccgcagccaggccgtgcaggagcacgccagcaccaacatgggcctggaggccatcatcaggaaggccctgatgggcaagtatgaccagtgggaggagagcccccccctgagcgccaatgccttcaaccccctgaatgccagcgccagcctgcctgctgccatgcccatcacagctgctgatggccgcagtgaccacaccctgaccagccctgggggcggcggcaaggccaaggtgtctggccggcccagcagcaggaaggccaagagccctgcccctggcctggccagcggggaccggccccccagcgtgtcctctgtgcacagcgagggggactgcaacagaaggacccccctgaccaacagagtgtgggaggaccggcccagcagcgctggcagcacccccttcccctacaaccccctcatcatgaggctgcaggccggcgtgatggccagccccccacctcctggcctgcctgctggcagcggccccctggccggcccccaccacgcctgggatgaggagcccaagcccctgctgtgcagccagtatgagaccctgagtgacagcgagtag

SEQ ID NO: 162333 - DNA, 726 bp, Artificial Sequence
  Description of Artificial Sequence: Synthetic coding sequence
atgttctacagcggcctgctgacagagggcggcaggaaggagacagacatgagggaggccgccagcctgcggcagcagaggaggatgaagcaggccgtgcagttcatccacaaggacagcgctgacctgctgcccctggatggcctgaagaagctgggcagcagcaaggacatgcagccccacaacatcctgcagaggcggctgatggagaccaacctgagcaagctgcggagcggcccccgggtgccctgggccagcaagaccaacaagctgaaccaggccaagtctgagggcctgaagaagtctgaggaggatgacatgatcctggtgtcctgccagtgtgccggcaaggatgtgaaggccctggtggacaccggctgcctgtacaacctgatcagcctggcctgtgtggaccggctgggcctgaaggagcacgtgaagagccacaagcatgaaggagagaagctgagcctgcccaggcacctgaaggtggtgggccagatcgagcacctggtgatcaccctgggcagcctgcggctggactgcccagctgctgtggtggatgacaatgagaagaacctgagcctgggcctgcagaccctgcggagcctgaagtgcatcatcaacctggacaagcacaggctcatcatgggcaagacagacaaggaggagatcccctttgtggagaccgtgtccctgaatgaagacaacaccagcgaggcctag

SEQ ID NO: 162334 - DNA, 774 bp, Artificial Sequence
  Description of Artificial Sequence: Synthetic coding sequence
atgagcaccagccagcccggggcctgcccctgccagggcgccgccagcaggcctgccatcctgtatgccctgctgagcagcagcctgaaggctgtgccccggcccaggagccgctgcctgtgccggcagcacaggcctgtgcagctgtgtgccccccacaggacctgccgggaggccctggatgtgctggccaagacagtggccttcctgaggaacctgcccagcttctggcagctgcccccccaggaccagaggcggctgctgcagggctgctggggccccctcttcctgctgggcctggcccaggatgctgtgacctttgaggtggccgaggcccctgtgcccagcatcctgaagaagatcctgctggaggagcccagcagcagcggcggcagcggccagctgcctgaccggccccagcccagcctggccgctgtgcagtggctgcagtgctgcctggagagcttctggagcctggagctgagccccaaggagtatgcctgcctgaagggcaccatcctcttcaacccagatgtgcccggcctgcaggccgccagccacatcggccacctgcagcaggaggcccactgggtgctgtgtgaggtgctggagccctggtgcccagctgcccagggccgcctgaccagggtgctgctgacagccagcaccctgaagagcatccccaccagcctgctgggggacctcttcttccggcccatcattggagatgtggacattgctggcctgctgggggacatgctgctgctgaggtag

SEQ ID NO: 162335 - DNA, 1845 bp, Artificial Sequence
  Description of Artificial Sequence: Synthetic coding sequence
atgaccaccctggacagcaacaacaacacaggaggagtcatcacctacatcggcagcagcggcagcagccccagcaggaccagccctgagagcctgtacagcgacaacagcaatggcagcttccagagcctgacccagggctgccccacctacttcccccccagccccaccggcagcctgacccaggaccctgcccggagctttggcagcatcccccccagcctgagtgatgatggcagccccagcagcagcagcagcagcagcagcagcagcagcagcttctacaacggcagccccccaggcagcctgcaggtggccatggaggacagcagccgggtgagccccagcaagagcaccagcaacatcaccaagctgaatggcatggtgctgctgtgcaaggtgtgtggagatgtggccagcggcttccactacggcgtgcacgcctgtgagggctgcaagggcttcttcagaagaagcatccagcagaacatccagtacaagcgctgcctgaagaatgaaaactgcagcatcgtgcgcatcaacagaaaccgctgccagcagtgccgcttcaagaagtgcctgtctgtgggcatgagcagagatgctgtgcgcttcggccgcatccccaagcgggagaagcagaggatgctggccgagatgcagagcgccatgaacctggccaacaaccagctgagcagccagtgccccctggagaccagccccacccagcaccccaccccaggccccatgggccccagccccccaccagcccctgtgcccagccccctggtgggcttcagccagttcccccagcagctgaccccacccaggagccccagccctgagcccaccgtggaggatgtgatcagccaggtggcccgggcccaccgggagatcttcacctacgcccatgacaagctgggcagcagccctggcaacttcaatgccaaccacgccagcggcagccccccagccaccaccccccaccgctgggagaaccagggctgccccccagccccaaatgacaacaacaccctggccgcccagaggcacaatgaggccctgaatggcctgcggcaggcccccagcagctacccacccacctggcccccaggccctgcccaccacagctgccaccagagcaacagcaatggccaccggctgtgccccacccacgtgtatgctgcccctgagggcaaggccccagccaacagcccccggcagggcaacagcaagaatgtgctgctggcctgccccatgaacatgtacccccacggccgcagcggccgcacagtgcaggagatctgggaggacttctccatgtccttcaccccagctgtgcgggaggtggtggagtttgccaagcacatccctggcttccgggacctgagccagcacgaccaggtgaccctgctgaaggccggcacctttgaggtgctgatggtgcgctttgccagcctcttcaacgtgaaggaccagacagtgatgttcctgagcaggaccacctacagcctgcaggagctgggcgccatgggcatgggagacctgctgagcgccatgtttgacttcagcgagaagctgaacagcctggccctgacagaggaggagctgggcctcttcaccgctgtggtgctggtgtctgctgacagaagtggcatggagaacagcgcctctgtggagcagctgcaggagaccctgctgcgggccctgcgggccctggtgctgaagaaccggcccctggagaccagccgcttcaccaagctgctgctgaagctgcctgacctgcggaccctgaacaacatgcacagcgagaagctgctgtccttccgggtggatgcccagtag

SEQ ID NO: 162336 - DNA, 1383 bp, Artificial Sequence
  Description of Artificial Sequence: Synthetic coding sequence
atgagcagccccaccaccagcagcctggacacccccctgcctggaaatggccccccccagcccggggcccccagcagcagccccaccgtgaaggaggagggccctgagccctggccaggcggccctgaccctgatgtgcctggaacagatgaggccagcagcgcctgcagcacagactgggtgatcccagaccctgaggaggagcctgagaggaagaggaagaagggccctgcccccaagatgctgggccacgagctgtgccgggtgtgtggggacaaggccagcggcttccactacaacgtgctgagctgtgagggctgcaagggcttcttccgccgctctgtggtgcggggcggggccaggagatatgcctgccggggcggcggcacctgccagatggatgccttcatgaggaggaagtgccagcagtgccgcctgaggaagtgcaaggaggccggcatgagggagcagtgtgtgctgtctgaggagcagatcaggaagaagaagatcaggaagcagcagcaggagagccagagccagagccagagccctgtgggcccccagggcagcagcagcagcgccagcggccctggggccagccctgggggcagcgaggccggcagccagggcagcggggagggggagggcgtgcagctgacagctgcccaggagctgatgatccagcagctggtggccgcccagctgcagtgcaacaagaggagcttcagtgaccagcccaaggtgaccccctggcccctgggcgctgacccccagagcagagatgcccggcagcagagatttgcccacttcacagagctggccatcatctctgtgcaggagatcgtggactttgccaagcaggtgcccggcttcctgcagctgggccgggaggaccagatcgccctgctgaaggccagcaccatcgagatcatgctgctggagacagcccggcgctacaaccatgaaacagagtgcatcaccttcctgaaggacttcacctacagcaaggatgacttccaccgggccggcctgcaggtggagttcatcaaccccatctttgagttcagccgggccatgaggcggctgggcctggatgatgctgaatatgccctgctgattgccatcaacatcttctctgctgaccggcccaacgtgcaggagcccggccgggtggaggccctgcagcagccctacgtggaggccctgctgagctacacccgcatcaagaggccccaggaccagctgcgcttccccaggatgctgatgaagctggtgtccctgcggaccctgagctctgtgcacagcgagcaggtgtttgccctgcggctgcaggacaagaagctgccccccctgctgtctgagatctgggatgtgcatgaatag

SEQ ID NO: 162337 - DNA, 1377 bp, Artificial Sequence
  Description of Artificial Sequence: Synthetic coding sequence
atgagcagccccaccaccagcagcctggacacccccctgcctggaaatggccccccccagcccggggcccccagcagcagccccaccgtgaaggaggagggccctgagccctggccaggcggccctgaccctgatgtgcctggaacagatgaggccagcagcgcctgcagcacagactgggtgatcccagaccctgaggaggagcctgagaggaagaggaagaagggccctgcccccaagatgctgggccacgagctgtgccgggtgtgtggggacaaggccagcggcttccactacaacgtgctgagctgtgagggctgcaagggcttcttccgccgctctgtggtgcggggcggggccaggagatatgcctgccggggcggcggcacctgccagatggatgccttcatgaggaggaagtgccagcagtgccgcctgaggaagtgcaaggaggccggcatgagggagcagtgtgtgctgtctgaggagcagatcaggaagaagaagatcaggaagcagcagcaggagagccagagccagagccagagccctgtgggcccccagggcagcagcagcagcgccagcggccctggggccagccctgggggcagcgaggccggcagccagggcagcggggagggggagggcgtgcagctgacagctgcccaggagctgatgatccagcagctggtggccgcccagctgcagtgcaacaagaggagcttcagtgaccagcccaaggtgaccccctggcccctgggcgctgacccccagagcagagatgcccggcagcagagatttgcccacttcacagagctggccatcatctctgtgcaggagatcgtggactttgccaagcaggtgcccggcttcctgcagctgggccgggaggaccagatcgccctgctgaaggccagcaccatcgagatcatgctgctggagacagcccggcgctacaaccatgaaacagagtgcatcaccttcctgaaggacttcacctacagcaaggatgacttccaccgggccggcctgcaggtggagttcatcaaccccatctttgagttcagccgggccatgaggcggctgggcctggatgatgctgaatatgccctgctgattgccatcaacatcttctctgctgaccggcccaacggggccggcccccggggcggcgtggccgccgccctgcggggcggcgctgctgtgctgcacgcccaccaggaggccgctgaccagctgcgcttccccaggatgctgatgaagctggtgtccctgcggaccctgagctctgtgcacagcgagcaggtgtttgccctgcggctgcaggacaagaagctgccccccctgctgtctgagatctgggatgtgcatgaatag

SEQ ID NO: 162338 - DNA, 1092 bp, Artificial Sequence
  Description of Artificial Sequence: Synthetic coding sequence
atgagcagccccaccaccagcagcctggacacccccctgcctggaaatggccccccccagcccggggcccccagcagcagccccaccgtgaaggaggagggccctgagccctggccaggcggccctgaccctgatgtgcctggaacagatgaggccagcagcgcctgcagcacagactggggcgtgctgtctgaggagcagatcaggaagaagaagatcaggaagcagcagcaggagagccagagccagagccagagccctgtgggcccccagggcagcagcagcagcgccagcggccctggggccagccctgggggcagcgaggccggcagccagggcagcggggagggggagggcgtgcagctgacagctgcccaggagctgatgatccagcagctggtggccgcccagctgcagtgcaacaagaggagcttcagtgaccagcccaaggtgaccccctggcccctgggcgctgacccccagagcagagatgcccggcagcagagatttgcccacttcacagagctggccatcatctctgtgcaggagatcgtggactttgccaagcaggtgcccggcttcctgcagctgggccgggaggaccagatcgccctgctgaaggccagcaccatcgagatcatgctgctggagacagcccggcgctacaaccacgagacagagtgcatcaccttcctgaaggacttcacctacagcaaggatgacttccacagagctggcctgcaggtggagttcatcaaccccatctttgagttcagccgggccatgaggcggctgggcctggatgatgctgaatatgccctgctgattgccatcaacatcttctctgctgaccggcccaacgtgcaggagcccggccgggtggaggccctgcagcagccctacgtggaggccctgctgagctacacccgcatcaagaggccccaggaccagctgcgcttccccaggatgctgatgaagctggtgtccctgcggaccctgagctctgtgcacagcgagcaggtgtttgccctgcggctgcaggacaagaagctgccccccctgctgtctgagatctgggatgtgcatgaatag

SEQ ID NO: 162339 - DNA, 576 bp, Artificial Sequence
  Description of Artificial Sequence: Synthetic coding sequence
atgatccagcagctggtggccgcccagctgcagtgcaacaagaggagcttcagtgaccagcccaaggtgaccctgggccgggaggaccagatcgccctgctgaaggccagcaccatcgagatcatgctgctggagacagcccggcgctacaaccacgagacagagtgcatcaccttcctgaaggacttcacctacagcaaggatgacttccacagagctggcctgcaggtggagttcatcaaccccatctttgagttcagccgggccatgaggcggctgggcctggatgatgctgaatatgccctgctgattgccatcaacatcttctctgctgaccggcccaacgtgcaggagcccggccgggtggaggccctgcagcagccctacgtggaggccctgctgagctacacccgcatcaagaggccccaggaccagctgcgcttccccaggatgctgatgaagctggtgtccctgcggaccctgagctctgtgcacagcgagcaggtgtttgccctgcggctgcaggacaagaagctgccccccctgctgtctgagatctgggatgtgcatgaatag

SEQ ID NO: 162340 - DNA, 1422 bp, Artificial Sequence
  Description of Artificial Sequence: Synthetic coding sequence
atgacagtgaccaggacccaccacttcaaggagggcagcctgcgggccccagccatccccctgcacagcgctgctgctgagctggccagcaaccacccccggggccctgaggccaacctggaggtgcggcccaaggagagctggaaccacgccgactttgtgcactgtgaggacacagaatctgtgcctgggaagcccagcgtgaatgctgatgaggaggtgggcggcccccagatctgccgggtgtgtggggacaaggccaccggctaccacttcaacgtgatgacctgtgagggctgcaagggcttcttcagaagagccatgaagagaaatgcccggctgcgctgccccttcaggaagggggcctgtgagatcaccaggaagacccggcggcagtgccaggcctgccgcctgaggaagtgcctggagagcggcatgaagaaggagatgatcatgtctgatgaggccgtggaggagcggcgggccctgatcaagaggaagaagtctgagaggacaggcacccagcccctgggcgtgcagggcctgacagaggagcagaggatgatgatccgggagctgatggatgcccagatgaagacctttgacaccaccttcagccacttcaagaacttccggctgcccggggtgctgagcagcggctgtgagctgcctgagagcctgcaggcccccagccgggaggaggccgccaagtggagccaggtgaggaaggacctgtgcagcctgaaggtgtccctgcagctgcggggagaagatggctctgtgtggaactacaagcccccagctgacagcggcggcaaggagatcttcagcctgctgccccacatggctgacatgagcacctacatgttcaagggcatcatcagctttgccaaggtgatctcctacttccgggacctgcccatcgaggaccagatcagcctgctgaagggggccgcctttgagctgtgccagctgcgcttcaacacagtgttcaatgctgagaccggcacctgggagtgtggccgcctgagctactgcctggaggacacagctgggggcttccagcagctgctgctggagcccatgctgaagttccactacatgctgaagaagctgcagctgcacgaggaggagtatgtgctgatgcaggccatcagcctcttctccccagacaggcctggggtgctgcagcaccgggtggtggaccagctgcaggagcagtttgccatcaccctgaagagctacatcgagtgcaaccggccccagcctgcccaccgcttcctgttcctgaagatcatggccatgctgacagagctgcggagcatcaatgcccagcacacccagaggctgctgcgcatccaggacatccacccctttgccacccccctgatgcaggagctgtttggcatcaccggcagctag

SEQ ID NO: 162341 - DNA, 1305 bp, Artificial Sequence
  Description of Artificial Sequence: Synthetic coding sequence
ctggaggtgcggcccaaggagagctggaaccacgccgactttgtgcactgtgaggacacagagagcgtgcctgggaagcccagcgtgaatgctgatgaggaggtgggcggcccccagatctgccgggtgtgtggggacaaggccaccggctaccacttcaacgtgatgacctgtgagggctgcaagggcttcttccggcgggccatgaagagaaatgcccggctgcgctgccccttcagaaaaggagcctgtgagatcaccaggaagacccggcggcagtgccaggcctgccgcctgaggaagtgcctggagagcggcatgaagaaggagatgatcatgtctgatgaagctgtggaggagcggcgggccctgatcaagaggaagaagtctgagaggacaggcacccagcccctgggcgtgcagggcctgacagaggagcagaggatgatgatccgggagctgatggatgcccagatgaagacctttgacaccaccttcagccacttcaagaacttccggctgcccggggtgctgagcagcggctgtgagctgcctgagagcctgcaggcccccagccgggaggaggccgccaagtggagccaggtgaggaaggacctgtgcagcctgaaggtgtccctgcagctgcggggggaggatggctctgtgtggaactacaagcccccagctgacagcggcggcaaggagatcttcagcctgctgccccacatggctgacatgagcacctacatgttcaagggcatcatcagctttgccaaggtgatctcctacttccgggacctgcccatcgaggaccagatcagcctgctgaagggagctgcctttgagctgtgccagctgcgcttcaacacagtgttcaatgctgagaccggcacctgggagtgtggccgcctgagctactgcctggaggacacagctgggggcttccagcagctgctgctggagcccatgctgaagttccactacatgctgaagaagctgcagctgcacgaggaggagtatgtgctgatgcaggccatcagcctcttctccccagacaggcctggggtgctgcagcaccgggtggtggaccagctgcaggagcagtttgccatcaccctgaagagctacatcgagtgcaaccggccccagcctgcccaccgcttcctgttcctgaagatcatggccatgctgacagagctgcggagcatcaatgcccagcacacccagaggctgctgcgcatccaggacatccacccctttgccacccccctgatgcaggagctgtttggcatcaccggcagctag

SEQ ID NO: 162342 - DNA, 1194 bp, Artificial Sequence
  Description of Artificial Sequence: Synthetic coding sequence
ctggaggtgcggcccaaggagagctggaaccacgccgactttgtgcactgtgaggacacagagagcgtgcctgggaagcccagcgtgaatgctgatgaggaggtgggcggcccccagatctgccgggtgtgtggggacaaggccaccggctaccacttcaacgtgatgacctgtgagggctgcaagggcttcttccggcgggccatgaagagaaatgcccggctgcgctgccccttcagaaaaggagcctgtgagatcaccaggaagacccggcggcagtgccaggcctgccgcctgaggaagtgcctggagagcggcatgaagaaggagatgatcatgtctgatgaagctgtggaggagcggcgggccctgatcaagaggaagaagtctgagaggacaggcacccagcccctgggcgtgcagggcctgacagaggagcagaggatgatgatccgggagctgatggatgcccagatgaagacctttgacaccaccttcagccacttcaagaacttccgggtgtccctgcagctgcggggagaagatggctctgtgtggaactacaagcccccagctgacagcggcggcaaggagatcttcagcctgctgccccacatggctgacatgagcacctacatgttcaagggcatcatcagctttgccaaggtgatctcctacttccgggacctgcccatcgaggaccagatcagcctgctgaagggggccgcctttgagctgtgccagctgcgcttcaacacagtgttcaatgctgagaccggcacctgggagtgtggccgcctgagctactgcctggaggacacagctgggggcttccagcagctgctgctggagcccatgctgaagttccactacatgctgaagaagctgcagctgcacgaggaggagtatgtgctgatgcaggccatcagcctcttctccccagacaggcctggggtgctgcagcaccgggtggtggaccagctgcaggagcagtttgccatcaccctgaagagctacatcgagtgcaaccggccccagcctgcccaccgcttcctgttcctgaagatcatggccatgctgacagagctgcggagcatcaatgcccagcacacccagaggctgctgcgcatccaggacatccacccctttgccacccccctgatgcaggagctgtttggcatcaccggcagctag

SEQ ID NO: 162343 - DNA, 1848 bp, Artificial Sequence
  Description of Artificial Sequence: Synthetic coding sequence
atgaccagccccagcccccgcatccagatcatcagcacagattctgctgtggccagcccccagaggatccagggcagcgagcccgccagcggccccctgagcgtcttcaccagcctgaacaaggagaagatcgtgacagaccagcagacaggccagaagatccagatcgtgacagctgtggatgccagcggcagccccaagcagcagttcatcctgaccagcccagatggagctggcaccgggaaggtgatcctggccagccctgagaccagcagcgccaagcagctgatcttcaccaccagtgacaacctggtgcccggccgcatccagatcgtgacagattctgcctctgtggagcggctgctgggcaagacagatgtgcagaggccccaggtggtggagtactgtgtggtgtgtggggacaaggccagcggccgccactacggggctgtgtcctgtgagggctgcaagggcttcttcaagaggtctgtgaggaagaacctgacctacagctgccgcagcaaccaggactgcatcatcaacaagcaccacaggaaccgctgccagttctgccgcctgaagaagtgcctggagatgggcatgaagatggagagcgtgcagagcgagaggaagccctttgatgtgcagcgggagaagcccagcaactgtgccgccagcacagagaagatctacatcaggaaggacctgcggagccccctgattgccacccccacctttgtggccgacaaggatggagcccggcagacaggcctgctggaccccggcatgctggtgaacatccagcagcccctcatccgggaggatggcaccgtgctgctggccacagacagcaaggccgagaccagccagggcgccctgggcaccctggccaacgtggtgaccagcctggccaacctgtctgagagcctgaacaacggggacaccagcgagatccagcctgaggaccagagcgccagcgagatcacccgggcctttgacaccctggccaaggccctgaacaccacagacagcagcagcagccccagcctggctgatggcatcgacaccagcggcggcggcagcatccacgtgatcagccgggaccagagcacccccatcatcgaggtggagggccccctgctgagtgacacccacgtgaccttcaagctgaccatgcccagccccatgcctgagtacctgaatgtgcactacatctgtgagagcgccagccggctgctcttcctgtccatgcactgggcccggagcatcccagccttccaggccctgggccaggactgcaacaccagcctggtgcgggcctgctggaatgaactcttcaccctgggcctggcccagtgtgcccaggtgatgagcctgagcaccatcctggccgccatcgtgaaccacctgcagaacagcatccaggaggacaagctgagcggggaccgcatcaagcaggtgatggagcacatctggaagctgcaggagttctgcaacagcatggccaagctggacattgatggctatgaatatgcctacctgaaggccatcgtgctcttctccccagaccaccctggcctgaccagcaccagccagatcgagaagttccaggagaaggcccagatggagctgcaggactatgtgcagaagacctacagcgaggacacctaccgcctggcccgcatcctggtgcggctgcctgccctgcggctgatgagcagcaacatcacagaggagctgttcttcaccggcctgattggaaatgtgtccattgacagcatcatcccctacatcctgaagatggagacagctgagtacaacggccagatcactggagccagcctgtag

SEQ ID NO: 162344 - DNA, 1791 bp, Artificial Sequence
  Description of Artificial Sequence: Synthetic coding sequence
atgaccagccccagcccccgcatccagatcatcagcacagattctgctgtggccagcccccagaggatccagatcgtgacagaccagcagacaggccagaagatccagatcgtgacagctgtggatgccagcggcagccccaagcagcagttcatcctgaccagcccagatggagctggcaccgggaaggtgatcctggccagccctgagaccagcagcgccaagcagctgatcttcaccaccagtgacaacctggtgcccggccgcatccagatcgtgacagacagcgcctctgtggagcggctgctgggcaagacagatgtgcagaggccccaggtggtggagtactgtgtggtgtgtggggacaaggccagcggccgccactatggagctgtgtcctgtgagggctgcaagggcttcttcaagaggtctgtgaggaagaacctgacctacagctgccgcagcaaccaggactgcatcatcaacaagcaccacaggaaccgctgccagttctgccgcctgaagaagtgcctggagatgggcatgaagatggagagcgtgcagagcgagaggaagccctttgatgtgcagcgggagaagcccagcaactgtgccgccagcacagagaagatctacatcaggaaggacctgcggagccccctcatcgccacccccacctttgtggccgacaaggatggagcccggcagacaggcctgctggaccccggcatgctggtgaacatccagcagcccctcatcagagaagatggcaccgtgctgctggccacagacagcaaggccgagaccagccagggcgccctgggcaccctggccaacgtggtgaccagcctggccaacctgtctgagagcctgaacaatggagacaccagcgagatccagcctgaggaccagagcgccagcgagatcacccgggcctttgacaccctggccaaggccctgaacaccacagacagcagcagcagccccagcctggctgatggcatcgacaccagcggcggcggcagcatccacgtgatcagccgggaccagagcacccccatcatcgaggtggagggccccctgctgagtgacacccacgtgaccttcaagctgaccatgcccagccccatgcctgagtacctgaatgtgcactacatctgtgagagcgccagccggctgctcttcctgtccatgcactgggcccggagcatcccagccttccaggccctgggccaggactgcaacaccagcctggtgcgggcctgctggaatgagctgttcaccctgggcctggcccagtgtgcccaggtgatgagcctgagcaccatcctggccgccatcgtgaaccacctgcagaacagcatccaggaggacaagctgagcggggaccgcatcaagcaggtgatggagcacatctggaagctgcaggagttctgcaacagcatggccaagctggacattgatggctatgaatatgcctacctgaaggccatcgtgctcttctccccagaccaccctggcctgaccagcaccagccagatcgagaagttccaggagaaggcccagatggagctgcaggactatgtgcagaagacctacagcgaggacacctaccgcctggcccgcatcctggtgcggctgcctgccctgcggctgatgagcagcaacatcacagaggagctgttcttcaccggcctgattggaaatgtgtccattgacagcatcatcccctacatcctgaagatggagacagctgagtacaacggccagatcaccggggccagcctgtag

SEQ ID NO: 162345 - DNA, 1791 bp, Artificial Sequence; identical to SEQ ID NO: 162344
  Description of Artificial Sequence: Synthetic coding sequence

SEQ ID NO: 162346 - DNA, 1791 bp, Artificial Sequence; identical to SEQ ID NO: 162344
  Description of Artificial Sequence: Synthetic coding sequence

SEQ ID NO: 162347 - DNA, 111 bp, Artificial Sequence
  Description of Artificial Sequence: Synthetic coding sequence
atgaccagccccagcccccgcatccagatcatcagcacagattctgctgtggccagcccccagaggatccagggcagcgagcccgccagcggccccctgagcgtcttctag

SEQ ID NO: 162348 - DNA, 618 bp, Artificial Sequence
  Description of Artificial Sequence: Synthetic coding sequence
atgaccagccccagcccccgcatccagatcatcagcacagattctgctgtggccagcccccagaggatccagggcagcgagcccgccagcggccccctgagcgtcttcaccagcctgaacaaggagaagatcgtgacagaccagcagacaggccagaagatccagatcgtgacagctgtggatgccagcggcagccccaagcagcagttcatcctgaccagcccagatggagctggcaccgggaaggtgatcctggccagccctgagaccagcagcgccaagcagctgatcttcaccaccagtgacaacctggtgcccggccgcatccagatcgtgacagattctgcctctgtggagcggctgctgggcaagacagatgtgcagaggccccaggtggtggagtactgtgtggtgtgtggggacaaggccagcggccgccactacggggctgtgtcctgtgagggctgcaagggcttcttcaagaggtctgtgaggaagaacctgacctacagctgccgcagcaaccaggactgcatcatcaacaagcaccacaggaaccgctgccagttctgccgcctgaagaagtgcctggagatgggcatgaagatggagtgctag

SEQ ID NO: 162349 - DNA, 1269 bp, Artificial Sequence
  Description of Artificial Sequence: Synthetic coding sequence
atgttccgggccggggctgagggcgctgagaaggagcccagccccaggcctgagtgcagagctgaccccggccctggcctgggcttccccctgggcagcggcctgccctggcccagcctgctggagagccctgggggccgcatcctggacatcccctgcaaggtgtgtggggacaggagcagcggcaagcactatggagtgtatgcctgtgatggctgcagcggcttcttcaagaggagcatcagaagaaacagaacctacgtgtgcaagagcggcaaccagggcggctgccctgtggacaagacccacaggaaccagtgccgggcctgccgcctgaagaagtgcctggaggtgaacatgaacaaggatgctgtgcagcacgagcggggccccaggaccagcaccatcaggaagcaggtggccctgtacttccggggccacaaggaggagaatggagctgctgcccacttccccagcgctgccctgcctgccccagccttcttcaccgctgtgacccagctggagccccacggcctggagctggccgctgtgtccaccaccccagagcggcagaccctggtgtccctggcccagcccacccccaagtacccccatgaggtgaatggcacccccatgtacctgtatgaggtggccacagaatctgtgtgtgagagcgctgcccggctgctcttcatgagcatcaagtgggccaagtctgtgcctgccttcagcaccctgagcctgcaggaccagctgatgctgctggaggatgcctggagggagctgtttgtgctgggcatcgcccagtgggccatccctgtggatgccaacaccctgctggccgtgtctggcatgaatggagacaacacagacagccagaagctgaacaagatcatcagcgagatccaggccctgcaggaggtggtggcccgcttccggcagctgcggctggatgccacagaatttgcctgcctgaagtgcatcgtgaccttcaaggctgtgcccacccacagcggcagcgagctgcggagcttcagaaatgctgctgccatcgccgccctgcaggatgaggcccagctgaccctgaacagctacatccacacccgctaccccacccagccctgccgctttgggaagctgctgctgctgctgcctgccctgcggagcatcagccccagcaccatcgaggaggtgttcttcaagaagaccatcggaaatgtgcccatcacccggctgctgagtgacatgtacaagagcagtgacatctag

SEQ ID NO: 162350 - DNA, 1158 bp, Artificial Sequence
  Description of Artificial Sequence: Synthetic coding sequence
atgagcaagccagctggcagcaccagccgcatcctggacatcccctgcaaggtgtgtggggacaggagcagcggcaagcactacggcgtgtatgcctgtgatggctgcagcggcttcttcaagaggagcatcagaagaaacagaacctacgtgtgcaagagcggcaaccagggcggctgccctgtggacaagacccacaggaaccagtgccgggcctgccgcctgaagaagtgcctggaggtgaacatgaacaaggatgctgtgcagcacgagcggggccccaggaccagcaccatcaggaagcaggtggccctgtacttccggggccacaaggaggagaatggagctgctgcccacttccccagcgctgccctgcctgccccagccttcttcaccgctgtgacccagctggagccccacggcctggagctggccgctgtgtccaccaccccagagcggcagaccctggtgtccctggcccagcccacccccaagtacccccatgaggtgaatggcacccccatgtacctgtatgaggtggccacagagagcgtgtgtgagagcgctgcccggctgctcttcatgagcatcaagtgggccaagtctgtgcctgccttcagcaccctgagcctgcaggaccagctgatgctgctggaggatgcctggagggagctgtttgtgctgggcatcgcccagtgggccatccctgtggatgccaacaccctgctggccgtgtctggcatgaatggagacaacacagacagccagaagctgaacaagatcatcagcgagatccaggccctgcaggaggtggtggcccgcttccggcagctgcggctggatgccacagaatttgcctgcctgaagtgcatcgtgaccttcaaggctgtgcccacccacagcggcagcgagctgcgctccttcagaaatgctgctgccatcgccgccctgcaggatgaggcccagctgaccctgaacagctacatccacacccgctaccccacccagccctgccgctttgggaagctgctgctgctgctgcctgccctgcggagcatcagccccagcaccatcgaggaggtgttcttcaagaagaccatcggaaatgtgcccatcacccggctgctgagtgacatgtacaagagcagtgacatctag

SEQ ID NO: 162351 - DNA, 141 bp, Artificial Sequence
  Description of Artificial Sequence: Synthetic coding sequence
atgaacaaggatgctgtgcagcacgagcggggccccaggaccagcaccatcaggaagcaggtggccctgtacttccggggccacaaggaggagaatggagctgctgcccacttccccagcgctgccctgcctgccccctag

SEQ ID NO: 162352 - DNA, 1272 bp, Artificial Sequence
  Description of Artificial Sequence: Synthetic coding sequence
atggccatggtggtgtcctcctggagggacccccaggatgatgtggccggcggcaaccctgggggccccaacccagctgcccaggccgcccggggcggcggcggcggggccggggagcagcagcagcaggccggcagcggggccccccacaccccccagaccccaggccagcccggggccccagccaccccaggcacagctggggacaagggccagggccccccaggcagcggccagagccagcagcacattgaatgtgtggtgtgtggggacaagagcagcggcaagcactacggccagttcacctgtgagggctgcaagagcttcttcaagaggtctgtgagaagaaacctgacctacacctgccgggccaacagaaactgccccatcgaccagcaccacaggaaccagtgccagtactgccgcctgaagaagtgcctgaaggtgggcatgaggcgggaggccgtgcagaggggccgcatgccacccacccagcccaaccctggccagtatgccctgaccaatggagaccccctgaatggccactgctacctgagcggctacatcagcctgctgctgcgggcagagccctaccccaccagccgctatggcagccagtgcatgcagcccaacaacatcatgggcatcgagaacatctgtgagctggccgcccggctgctcttctctgctgtggagtgggccaggaacatccccttcttcccagacctgcagatcacagaccaggtgtccctgctgcggctgacctggagcgagctgtttgtgctgaatgctgcccagtgcagcatgcccctgcacgtggcccccctgctggccgccgccggcctgcacgccagccccatgtctgctgacagagtggtggccttcatggaccacatccgcatcttccaggagcaggtggagaagctgaaggccctgcacgtggacagcgctgagtacagctgcctgaaggccatcgtgctcttcaccagtgatgcctgtggcctgagtgatgctgcccacatcgagagcctgcaggagaagagccagtgtgccctggaggagtatgtgcgcagccagtaccccaaccagcccagcagatttgggaagctgctgctgcggctgcccagcctgaggacagtgagcagctctgtgattgagcagctgttctttgtgcggctggtgggcaagacccccatcgagaccctcatccgggacatgctgctgagcggcagcagcttcaactggccctacatgagcatccagtgcagctag

SEQ ID NO: 162353 - DNA, 1245 bp, Artificial Sequence
  Description of Artificial Sequence: Synthetic coding sequence
atggccatggtggtgtccacctggagggacccccaggatgaggtgcccggcagccagggcagccaggccagccaggcccctcctgtgcccggccccccacctggggccccccacaccccccagaccccaggccagggcggccctgccagcaccccagcccagacagctgctgggggccagggcggccctgggggccctggcagtgacaagcagcagcagcagcagcacattgaatgtgtggtgtgtggggacaagagcagcggcaagcactacggccagttcacctgtgagggctgcaagagcttcttcaagaggtctgtgagaagaaacctgagctacacctgccgggccaacagaaactgccccatcgaccagcaccacaggaaccagtgccagtactgccgcctgaagaagtgcctgaaggtgggcatgagaagagaggccgtgcagaggggccgcatgccacccacccagcccacccacggccagtttgccctgaccaacggggaccccctgaactgccacagctacctgagcggctacatcagcctgctgctgcgggcagagccctaccccaccagccgcttcggcagccagtgcatgcagcccaacaacatcatgggcatcgagaacatctgtgagctggccgccaggatgctgttctctgctgtggagtgggccaggaacatccccttcttcccagacctgcagatcacagaccaggtggccctgctgcggctgacctggagcgagctgtttgtgctgaatgctgcccagtgcagcatgcccctgcacgtggcccccctgctggccgctgctggcctgcacgccagccccatgtctgctgacagagtggtggccttcatggaccacatccgcatcttccaggagcaggtggagaagctgaaggccctgcacgtggacagcgctgagtacagctgcctgaaggccatcgtgctcttcaccagtgatgcctgtggcctgagtgatgtggcccacgtggagagcctgcaggagaagagccagtgtgccctggaggagtatgtgcgcagccagtaccccaaccagcccaccaggtttgggaagctgctgctgcggctgcccagcctgaggacagtgagcagcagcgtcatcgagcagctgttctttgtgcggctggtgggcaagacccccatcgagaccctcatccgggacatgctgctgagcggcagcagcttcaactggccctacatggccatccagtag

SEQ ID NO: 162354 - DNA, 786 bp, Artificial Sequence
  Description of Artificial Sequence: Synthetic coding sequence
atgccacccacccagcccacccacggccagtttgccctgaccaatggagaccccctgaactgccacagctacctgagcggctacatcagcctgctgctgcgggcagagccctaccccaccagcagatttggcagccagtgcatgcagcccaacaacatcatgggcatcgagaacatctgtgagctggccgccaggatgctgttctctgctgtggagtgggccaggaacatccccttcttcccagacctgcagatcacagaccaggtggccctgctgcggctgacctggagcgagctgtttgtgctgaatgctgcccagtgcagcatgcccctgcacgtggcccccctgctggccgccgccggcctgcacgccagccccatgtctgctgacagagtggtggccttcatggaccacatccgcatcttccaggagcaggtggagaagctgaaggccctgcacgtggacagcgctgagtacagctgcctgaaggccatcgtgctcttcaccagtgatgcctgtggcctgagtgatgtggcccacgtggagagcctgcaggagaagagccagtgtgccctggaggagtatgtgcgcagccagtaccccaaccagcccaccaggtttgggaagctgctgctgcggctgcccagcctgaggacagtgagcagctctgtgattgagcagctgttctttgtgcggctggtgggcaagacccccatcgagaccctcatccgggacatgctgctgagcggcagcagcttcaactggccctacatggccatccagtag

SEQ ID NO: 162355 - DNA, 846 bp, Artificial Sequence
  Description of Artificial Sequence: Synthetic coding sequence
atgcaggccgtgtgggacctggagcagggcaagtatggctttgctgtgcagaggggccgcatgccacccacccagcccacccacggccagtttgccctgaccaatggagaccccctgaactgccacagctacctgagcggctacatcagcctgctgctgcgggcagagccctaccccaccagcagatttggcagccagtgcatgcagcccaacaacatcatgggcatcgagaacatctgtgagctggccgccaggatgctgttctctgctgtggagtgggccaggaacatccccttcttcccagacctgcagatcacagaccaggtggccctgctgcggctgacctggagcgagctgtttgtgctgaatgctgcccagtgcagcatgcccctgcacgtggcccccctgctggccgccgccggcctgcacgccagccccatgtctgctgacagagtggtggccttcatggaccacatccgcatcttccaggagcaggtggagaagctgaaggccctgcacgtggacagcgctgagtacagctgcctgaaggccatcgtgctcttcaccagtgatgcctgtggcctgagtgatgtggcccacgtggagagcctgcaggagaagagccagtgtgccctggaggagtatgtgcgcagccagtaccccaaccagcccaccaggtttgggaagctgctgctgcggctgcccagcctgaggacagtgagcagctctgtgattgagcagctgttctttgtgcggctggtgggcaagacccccatcgagaccctcatccgggacatgctgctgagcggcagcagcttcaactggccctacatggccatccagtag

SEQ ID NO: 162356 - DNA, 786 bp, Artificial Sequence; identical to SEQ ID NO: 162354
  Description of Artificial Sequence: Synthetic coding sequence

SEQ ID NO: 162357 - DNA, 1215 bp, Artificial Sequence
  Description of Artificial Sequence: Synthetic coding sequence
atggccatggtgactggaggctggggcggccctggaggagacaccaacggggtggacaaggccggcggctaccccagggctgctgaagatgacagcgccagccccccaggggccgccagtgatgctgagcctggagatgaggagcggcccggcctgcaggtggactgtgtggtgtgtggggacaagagcagcggcaagcactacggcgtcttcacctgtgagggctgcaagagcttcttcaagaggagcatcagaagaaacctgagctacacctgccgcagcaacagagactgccagattgaccagcaccacaggaaccagtgccagtactgccgcctgaagaagtgcttccgggtgggcatgaggaaggaggccgtgcagaggggccgcatcccccacagcctgcccggggctgtggccgccagcagcggcagccccccaggcagcgccctggccgctgtggccagcggcggggacctcttccctggccagcctgtgtctgagctgattgcccagctgctgcgggcagagccctacccagctgctgctggccgctttggagctgggggcggcgctgctggagctgtgctgggcatcgacaacgtgtgtgagctggccgcccggctgctcttcagcacagtggagtgggcccggcatgcccccttcttccctgagctgcctgtggccgaccaggtggccctgctgcggctgtcctggagcgagctgtttgtgctgaatgctgcccaggccgccctgcccctgcacacagcccccctgctggccgctgctggcctgcatgctgcccccatggctgctgagagagctgtggccttcatggaccaggtgcgggccttccaggagcaggtggacaagctgggccgcctgcaggtggacagcgcagaatatggctgcctgaaggccatcgccctcttcaccccagatgcctgtggcctgagtgaccctgcccacgtggagagcctgcaggagaaggcccaggtggccctgacagaatatgtgcgggcccagtaccccagccagccccagcgcttcggccgcctgctgctgcggctgcctgccctgcgggctgtgcctgccagcctcatcagccagctgttcttcatgaggctggtgggcaagacccccatcgagaccctcatccgggacatgctgctgagcggcagcaccttcaactggccctacggcagcggccagtag

SEQ ID NO: 162358 - DNA, 1134 bp, Artificial Sequence
  Description of Artificial Sequence: Synthetic coding sequence
atggccatggtgactggaggctggggcggccctggaggagatgctgagcctggagatgaggagaggcctggcctgcaggtggactgtgtggtgtgtggggacaagagcagcggcaagcactatggagtcttcacctgtgagggctgcaagagcttcttcaagaggagcatcagaagaaacctgagctacacctgccgcagcaacagagactgccagattgaccagcaccacaggaaccagtgccagtactgccgcctgaagaagtgcttccgggtgggcatgaggaaggaggccgtgcagaggggccgcatcccccacagcctgcctggagctgtggccgccagcagcggcagccccccaggcagcgccctggccgctgtggccagcggcggggacctcttccctggccagcctgtgtctgagctgattgcccagctgctgcgggcagagccctacccagctgctgctggccgctttggagctgggggcggggccgccggggctgtgctgggcatcgacaacgtgtgtgagctggccgcccggctgctcttcagcacagtggagtgggcccggcatgcccccttcttccctgagctgcctgtggccgaccaggtggccctgctgcggctgtcctggagcgagctgtttgtgctgaatgctgcccaggccgccctgcccctgcacacagcccccctgctggccgccgccggcctgcacgccgcccccatggctgctgagagagctgtggccttcatggaccaggtgcgggccttccaggagcaggtggacaagctgggccgcctgcaggtggacagcgcagaatatggctgcctgaaggccatcgccctcttcaccccagatgcctgtggcctgagtgaccctgcccacgtggagagcctgcaggagaaggcccaggtggccctgacagaatatgtgcgggcccagtaccccagccagccccagagatttggccgcctgctgctgcggctgcctgccctgcgggctgtgcctgccagcctcatcagccagctgttcttcatgaggctggtgggcaagacccccatcgagaccctcatccgggacatgctgctgagcggcagcaccttcaactggccctacggcagcggccagtag

SEQ ID NO: 162359 - DNA, 2121 bp, Artificial Sequence
  Description of Artificial Sequence: Synthetic coding sequence
atggagaccaagggctaccacagcctgcctgagggcctggacatggagcggcgctggggccaggtgtcccaggccgtggagaggagcagcctgggccccacagagaggacagatgagaacaactacatggagatcgtgaatgtgtcctgtgtgtctggggccatccccaacaacagcacccagggcagcagcaaggagaagcaggagctgctgccctgcctgcagcaggacaacaacagacctggcatcctgaccagtgacatcaagacagagctggagagcaaggagctgagcgccaccgtggccgagagcatgggcctgtacatggattctgtgagagatgctgactacagctatgagcagcagaaccagcagggctccatgagccctgccaagatctaccagaatgtggagcagctggtgaagttctacaagggaaatggccaccggcccagcaccctgagctgtgtgaacacccccctgcgctccttcatgtctgacagcggcagctctgtgaatggaggagtgatgagagctgtggtgaagagccccatcatgtgccacgagaagagccccagcgtgtgcagccccctgaacatgaccagctctgtgtgcagccctgctggcatcaacagcgtgagcagcaccacagccagctttggcagcttccctgtgcacagccccatcacccagggcacccccctgacctgcagccccaacgtggagaacagaggcagccgcagccacagccctgcccacgccagcaatgtgggcagccccctgagcagccccctgagctccatgaagagcagcatcagcagcccccccagccactgcagcgtgaagagccctgtgagcagccccaacaacgtgaccctgcggagctctgtgagcagccctgccaacatcaacaacagccgctgcagcgtgagcagccccagcaacaccaacaacagaagcaccctgagcagccctgctgccagcacagtgggcagcatctgcagccctgtgaacaatgccttctcctacacagccagcggcaccagcgctggcagcagcaccctgagagatgtggtgcccagcccagacacccaggagaagggggcccaggaggtgcccttccccaagacagaggaggtggagagcgccatcagcaatggagtgacaggccagctgaacatcgtgcagtacatcaagccagagccagatggagccttcagcagcagctgcctgggcggcaacagcaagatcaacagcgacagcagcttctctgtgcccatcaagcaggagagcaccaagcacagctgcagcggcaccagcttcaagggcaaccccaccgtgaaccccttccccttcatggatggcagctacttctccttcatggatgacaaggactactacagcctgagcggcatcctgggcccccctgtgcccggctttgatggcaactgtgagggcagcggcttccctgtgggcatcaagcaggagccagatgatggcagctactacccagaggccagcatccccagcagcgccatcgtgggcgtgaacagcggcggccagagcttccactacagaattggagcccagggcaccatcagcctgagccgcagcgcccgggaccagagcttccagcacctgagcagcttcccccctgtgaacaccctggtggagagctggaagagccatggagacctgagcagcagaagaagtgatggctaccctgtgctggagtacatcccagaaaatgtgagcagcagcaccctgcggtctgtgtccacaggcagcagccggcccagcaagatctgcctggtgtgtggagatgaggccagcggctgccactatggagtggtgacctgtggcagctgcaaggtgttcttcaagagagctgtggagggccagcacaactacctgtgtgccggcagaaatgactgcatcatcgacaagatccggaggaagaactgcccagcctgccgcctgcagaagtgcctgcaggccggcatgaacctgggggagcggcgctgcatcagcctgccctgcatgaactatgcccggggctgcaccaagagcgccttcagcagctttgactgcagcagccccctgaagaacacccccagctag

SEQ ID NO: 162360 - DNA, 2955 bp, Artificial Sequence
  Description of Artificial Sequence: Synthetic coding sequence
atggagaccaagggctaccacagcctgcctgagggcctggacatggagcggcgctggggccaggtgtcccaggccgtggagaggagcagcctgggccccacagagaggacagatgagaacaactacatggagatcgtgaatgtgtcctgtgtgtctggggccatccccaacaacagcacccagggcagcagcaaggagaagcaggagctgctgccctgcctgcagcaggacaacaacagacctggcatcctgaccagtgacatcaagacagagctggagagcaaggagctgagcgccaccgtggccgagagcatgggcctgtacatggattctgtgagagatgctgactacagctatgagcagcagaaccagcagggctccatgagccctgccaagatctaccagaatgtggagcagctggtgaagttctacaagggaaatggccaccggcccagcaccctgagctgtgtgaacacccccctgcgctccttcatgtctgacagcggcagctctgtgaatggaggagtgatgagagctgtggtgaagagccccatcatgtgccacgagaagagccccagcgtgtgcagccccctgaacatgaccagctctgtgtgcagccctgctggcatcaacagcgtgagcagcaccacagccagctttggcagcttccctgtgcacagccccatcacccagggcacccccctgacctgcagccccaacgtggagaacagaggcagccgcagccacagccctgcccacgccagcaatgtgggcagccccctgagcagccccctgagctccatgaagagcagcatcagcagcccccccagccactgcagcgtgaagagccctgtgagcagccccaacaacgtgaccctgcggagctctgtgagcagccctgccaacatcaacaacagccgctgcagcgtgagcagccccagcaacaccaacaacagaagcaccctgagcagccctgctgccagcacagtgggcagcatctgcagccctgtgaacaatgccttctcctacacagccagcggcaccagcgctggcagcagcaccctgagagatgtggtgcccagcccagacacccaggagaagggggcccaggaggtgcccttccccaagacagaggaggtggagagcgccatcagcaatggagtgacaggccagctgaacatcgtgcagtacatcaagccagagccagatggagccttcagcagcagctgcctgggcggcaacagcaagatcaacagcgacagcagcttctctgtgcccatcaagcaggagagcaccaagcacagctgcagcggcaccagcttcaagggcaaccccaccgtgaaccccttccccttcatggatggcagctacttctccttcatggatgacaaggactactacagcctgagcggcatcctgggcccccctgtgcccggctttgatggcaactgtgagggcagcggcttccctgtgggcatcaagcaggagccagatgatggcagctactacccagaggccagcatccccagcagcgccatcgtgggcgtgaacagcggcggccagagcttccactacagaattggagcccagggcaccatcagcctgagccgcagcgcccgggaccagagcttccagcacctgagcagcttcccccctgtgaacaccctggtggagagctggaagagccatggagacctgagcagcagaagaagtgatggctaccctgtgctggagtacatcccagaaaatgtgagcagcagcaccctgcggtctgtgtccacaggcagcagccggcccagcaagatctgcctggtgtgtggagatgaggccagcggctgccactatggagtggtgacctgtggcagctgcaaggtgttcttcaagagagctgtggagggccagcacaactacctgtgtgccggcagaaatgactgcatcatcgacaagatccggaggaagaactgcccagcctgccgcctgcagaagtgcctgcaggccggcatgaacctgggcgccaggaagagcaagaagctgggcaagctgaagggcatccacgaggagcagccccagcagcagcagcccccacctcctcctcctccaccccagagccctgaggagggcaccacctacatcgccccagccaaggagcccagcgtgaacacagccctggtgccccagctgagcaccatcagccgggccctgacccccagccctgtgatggtgctggagaacatcgagcctgagatcgtgtatgccggctatgacagcagcaagccagacacagctgagaacctgctgagcaccctgaaccggctggccggcaagcagatgatccaggtggtgaagtgggccaaggtgctgcccggcttcaagaacctgcccctggaggaccagatcaccctcatccagtacagctggatgtgcctgagcagctttgccctgtcctggaggagctacaagcacaccaacagccagttcctgtactttgccccagacctggtgttcaatgaggagaagatgcaccagagcgccatgtatgagctgtgccagggcatgcaccagatcagcctgcagtttgtgcggctgcagctgacctttgaggagtacaccatcatgaaggtgctgctgctgctgagcaccatccccaaggatggcctgaagagccaggccgcctttgaggagatgaggaccaactacatcaaggagctgaggaagatggtgaccaagtgccccaacaacagcggccagagctggcagcgcttctaccagctgaccaagctgctggacagcatgcatgacctggtgtctgacctgctggagttctgcttctacaccttccgggagagccacgccctgaaggtggagttccctgccatgctggtggagatcatcagtgaccagctgcccaaggtggagagcggaaatgccaagcccctgtacttccacaggaagtag

SEQ ID NO: 162361 - DNA, 2967 bp, Artificial Sequence
  Description of Artificial Sequence: Synthetic coding sequence
atggagaccaagggctaccacagcctgcctgagggcctggacatggagcggcgctggggccaggtgtcccaggccgtggagaggagcagcctgggccccacagagaggacagatgagaacaactacatggagatcgtgaatgtgtcctgtgtgtctggggccatccccaacaacagcacccagggcagcagcaaggagaagcaggagctgctgccctgcctgcagcaggacaacaacagacctggcatcctgaccagtgacatcaagacagagctggagagcaaggagctgagcgccaccgtggccgagagcatgggcctgtacatggattctgtgagagatgctgactacagctatgagcagcagaaccagcagggctccatgagccctgccaagatctaccagaatgtggagcagctggtgaagttctacaagggaaatggccaccggcccagcaccctgagctgtgtgaacacccccctgcgctccttcatgtctgacagcggcagctctgtgaatggaggagtgatgagagctgtggtgaagagccccatcatgtgccacgagaagagccccagcgtgtgcagccccctgaacatgaccagctctgtgtgcagccctgctggcatcaacagcgtgagcagcaccacagccagctttggcagcttccctgtgcacagccccatcacccagggcacccccctgacctgcagccccaacgtggagaacagaggcagccgcagccacagccctgcccacgccagcaatgtgggcagccccctgagcagccccctgagctccatgaagagcagcatcagcagcccccccagccactgcagcgtgaagagccctgtgagcagccccaacaacgtgaccctgcggagctctgtgagcagccctgccaacatcaacaacagccgctgcagcgtgagcagccccagcaacaccaacaacagaagcaccctgagcagccctgctgccagcacagtgggcagcatctgcagccctgtgaacaatgccttctcctacacagccagcggcaccagcgctggcagcagcaccctgagagatgtggtgcccagcccagacacccaggagaagggggcccaggaggtgcccttccccaagacagaggaggtggagagcgccatcagcaatggagtgacaggccagctgaacatcgtgcagtacatcaagccagagccagatggagccttcagcagcagctgcctgggcggcaacagcaagatcaacagcgacagcagcttctctgtgcccatcaagcaggagagcaccaagcacagctgcagcggcaccagcttcaagggcaaccccaccgtgaaccccttccccttcatggatggcagctacttctccttcatggatgacaaggactactacagcctgagcggcatcctgggcccccctgtgcccggctttgatggcaactgtgagggcagcggcttccctgtgggcatcaagcaggagccagatgatggcagctactacccagaggccagcatccccagcagcgccatcgtgggcgtgaacagcggcggccagagcttccactacagaattggagcccagggcaccatcagcctgagccgcagcgcccgggaccagagcttccagcacctgagcagcttcccccctgtgaacaccctggtggagagctggaagagccatggagacctgagcagcagaagaagtgatggctaccctgtgctggagtacatcccagaaaatgtgagcagcagcaccctgcggtctgtgtccacaggcagcagccggcccagcaagatctgcctggtgtgtggagatgaggccagcggctgccactatggagtggtgacctgtggcagctgcaaggtgttcttcaagagagctgtggagggcaagtgctcctggcagcacaactacctgtgtgccggcagaaatgactgcatcatcgacaagatccggaggaagaactgcccagcctgccgcctgcagaagtgcctgcaggccggcatgaacctgggcgccaggaagagcaagaagctgggcaagctgaagggcatccacgaggagcagccccagcagcagcagcccccacctcctcctcctccaccccagagccctgaggagggcaccacctacatcgccccagccaaggagcccagcgtgaacacagccctggtgccccagctgagcaccatcagccgggccctgacccccagccctgtgatggtgctggagaacatcgagcctgagatcgtgtatgccggctatgacagcagcaagccagacacagctgagaacctgctgagcaccctgaaccggctggccggcaagcagatgatccaggtggtgaagtgggccaaggtgctgcccggcttcaagaacctgcccctggaggaccagatcaccctcatccagtacagctggatgtgcctgagcagctttgccctgtcctggaggagctacaagcacaccaacagccagttcctgtactttgccccagacctggtgttcaatgaggagaagatgcaccagagcgccatgtatgagctgtgccagggcatgcaccagatcagcctgcagtttgtgcggctgcagctgacctttgaggagtacaccatcatgaaggtgctgctgctgctgagcaccatccccaaggatggcctgaagagccaggccgcctttgaggagatgaggaccaactacatcaaggagctgaggaagatggtgaccaagtgccccaacaacagcggccagagctggcagcgcttctaccagctgaccaagctgctggacagcatgcatgacctggtgtctgacctgctggagttctgcttctacaccttccgggagagccacgccctgaaggtggagttccctgccatgctggtggagatcatcagtgaccagctgcccaaggtggagagcggaaatgccaagcccctgtacttccacaggaagtag

SEQ ID NO: 162362 - DNA, 2955 bp, Artificial Sequence; identical to SEQ ID NO: 162360
  Description of Artificial Sequence: Synthetic coding sequence

SEQ ID NO: 162363 - DNA, 2967 bp, Artificial Sequence; identical to SEQ ID NO: 162361
  Description of Artificial Sequence: Synthetic coding sequence

SEQ ID NO: 162364 - DNA, 2604 bp, Artificial Sequence
  Description of Artificial Sequence: Synthetic coding sequence
atggagaccaagggctaccacagcctgcctgagggcctggacatggagcggcgctggggccaggtgtcccaggccgtggagaggagcagcctgggccccacagagaggacagatgagaacaactacatggagatcgtgaatgtgtcctgtgtgtctggggccatccccaacaacagcacccagggcagcagcaaggagaagcaggagctgctgccctgcctgcagcaggacaacaacagacctggcatcctgaccagtgacatcaagacagagctggagagcaaggagctgagcgccaccgtggccgagagcatgggcctgtacatggattctgtgagagatgctgactacagctatgagcagcagaaccagcagggctccatgagccctgccaagatctaccagaatgtggagcagctggtgaagttctacaagggaaatggccaccggcccagcaccctgagctgtgtgaacacccccctgcgctccttcatgtctgacagcggcagctctgtgaatggaggagtgatgagagctgtggtgaagagccccatcatgtgccacgagaagagccccagcgtgtgcagccccctgaacatgaccagctctgtgtgcagccctgctggcatcaacagcgtgagcagcaccacagccagctttggcagcttccctgtgcacagccccatcacccagggcacccccctgacctgcagccccaacgtggagaacagaggcagccgcagccacagccctgcccacgccagcaatgtgggcagccccctgagcagccccctgagctccatgaagagcagcatcagcagcccccccagccactgcagcgtgaagagccctgtgagcagccccaacaacgtgaccctgcggagctctgtgagcagccctgccaacatcaacaacagccgctgcagcgtgagcagccccagcaacaccaacaacagaagcaccctgagcagccctgctgccagcacagtgggcagcatctgcagccctgtgaacaatgccttctcctacacagccagcggcaccagcgctggcagcagcaccctgagagatgtggtgcccagcccagacacccaggagaagggggcccaggaggtgcccttccccaagacagaggaggtggagagcgccatcagcaatggagtgacaggccagctgaacatcgtgcagtacatcaagccagagccagatggagccttcagcagcagctgcctgggcggcaacagcaagatcaacagcgacagcagcttctctgtgcccatcaagcaggagagcaccaagcacagctgcagcggcaccagcttcaagggcaaccccaccgtgaaccccttccccttcatggatggcagctacttctccttcatggatgacaaggactactacagcctgagcggcatcctgggcccccctgtgcccggctttgatggcaactgtgagggcagcggcttccctgtgggcatcaagcaggagccagatgatggcagctactacccagaggccagcatccccagcagcgccatcgtgggcgtgaacagcggcggccagagcttccactacagaattggagcccagggcaccatcagcctgagccgcagcgcccgggaccagagcttccagcacctgagcagcttcccccctgtgaacaccctggtggagagctggaagagccatggagacctgagcagcagaagaagtgatggctaccctgtgctggagtacatcccagaaaatgtgagcagcagcaccctgcggtctgtgtccacaggcagcagccggcccagcaagatctgcctggtgtgtggagatgaggccagcggctgccactatggagtggtgacctgtggcagctgcaaggtgttcttcaagagagctgtggagggccagcacaactacctgtgtgccggcagaaatgactgcatcatcgacaagatccggaggaagaactgcccagcctgccgcctgcagaagtgcctgcaggccggcatgaacctgggcggcttcaagaacctgcccctggaggaccagatcaccctcatccagtacagctggatgtgcctgagcagctttgccctgtcctggaggagctacaagcacaccaacagccagttcctgtactttgccccagacctggtgttcaatgaggagaagatgcaccagagcgccatgtatgagctgtgccagggcatgcaccagatcagcctgcagtttgtgcggctgcagctgacctttgaggagtacaccatcatgaaggtgctgctgctgctgagcaccatccccaaggatggcctgaagagccaggccgcctttgaggagatgaggaccaactacatcaaggagctgaggaagatggtgaccaagtgccccaacaacagcggccagagctggcagcgcttctaccagctgaccaagctgctggacagcatgcatgacctggtgtctgacctgctggagttctgcttctacaccttccgggagagccacgccctgaaggtggagttccctgccatgctggtggagatcatcagtgaccagctgcccaaggtggagagcggaaatgccaagcccctgtacttccacaggaagtag

SEQ ID NO: 162365 - DNA, 1920 bp, Artificial Sequence
  Description of Artificial Sequence: Synthetic coding sequence
atggagaccaagggctaccacagcctgcctgagggcctggacatggagcggcgctggggccaggtgtcccaggccgtggagaggagcagcctgggccccacagagaggacagatgagaacaactacatggagatcgtgaatgtgtcctgtgtgtctggggccatccccaacaacagcacccagggcagcagcaaggagaagcaggagctgctgccctgcctgcagcaggacaacaacagacctggcatcctgaccagtgacatcaagacagagctggagagcaaggagctgagcgccaccgtggccgagagcatgggcctgtacatggattctgtgagagatgctgactacagctatgagcagcagaaccagcagggctccatgagccctgccaagatctaccagaatgtggagcagctggtgaagttctacaagggaaatggccaccggcccagcaccctgagctgtgtgaacacccccctgcgctccttcatgtctgacagcggcagctctgtgaatggaggagtgatgagagctgtggtgaagagccccatcatgtgccacgagaagagccccagcgtgtgcagccccctgaacatgaccagctctgtgtgcagccctgctggcatcaacagcgtgagcagcaccacagccagctttggcagcttccctgtgcacagccccatcacccagggcacccccctgacctgcagccccaacgtggagaacagaggcagccgcagccacagccctgcccacgccagcaatgtgggcagccccctgagcagccccctgagctccatgaagagcagcatcagcagcccccccagccactgcagcgtgaagagccctgtgagcagccccaacaacgtgaccctgcggagctctgtgagcagccctgccaacatcaacaacagccgctgcagcgtgagcagccccagcaacaccaacaacagaagcaccctgagcagccctgctgccagcacagtgggcagcatctgcagccctgtgaacaatgccttctcctacacagccagcggcaccagcgctggcagcagcaccctgagagatgtggtgcccagcccagacacccaggagaagggggcccaggaggtgcccttccccaagacagaggaggtggagagcgccatcagcaatggagtgacaggccagctgaacatcgtgcagtacatcaagccagagccagatggagccttcagcagcagctgcctgggcggcaacagcaagatcaacagcgacagcagcttctctgtgcccatcaagcaggagagcaccaagcacagctgcagcggcaccagcttcaagggcaaccccaccgtgaaccccttccccttcatggatggcagctacttctccttcatggatgacaaggactactacagcctgagcggcatcctgggcccccctgtgcccggctttgatggcaactgtgagggcagcggcttccctgtgggcatcaagcaggagccagatgatggcagctactacccagaggccagcatccccagcagcgccatcgtgggcgtgaacagcggcggccagagcttccactacagaattggagcccagggcaccatcagcctgagccgcagcgcccgggaccagagcttccagcacctgagcagcttcccccctgtgaacaccctggtggagagctggaagagccatggagacctgagcagcagaagaagtgatggctaccctgtgctggagtacatcccagaaaatgtgagcagcagcaccctgcggtctgtgtccacaggcagcagccggcccagcaagaagaacatctaccgcttcctgctgtgcaacaacagaacccggggcgtgggccagcagctgcccctgagccccaggagcagcacagtgttctgcatcaccggcatccacaccaggtag

SEQ ID NO: 162366 - DNA, 1797 bp, Artificial Sequence
  Description of Artificial Sequence: Synthetic coding sequence
atgccctgcatccaggcccagtatggcaccccagcccccagccctggcccccgggaccacctggccagtgaccccctgaccccagagttcatcaagcccaccatggacctggccagccctgaggccgccccagctgcccccacagccctgcccagcttcagcaccttcatggatggctacacaggagaatttgacaccttcctgtaccagctgcccggcaccgtgcagccctgcagcagcgccagcagcagcgccagcagcaccagcagcagcagcgccaccagccctgccagcgccagcttcaagtttgaggacttccaggtgtatggctgctacccaggccccctgagcggccctgtggatgaggccctgagcagcagcggcagtgactactacggcagcccctgcagcgcccccagccccagcacccccagcttccagcccccccagctgagcccctgggatggcagctttggccacttcagccccagccagacctatgagggcctgcgggcctggacagagcagctgcccaaggccagcggccccccccagcccccagccttcttctccttcagcccccccaccggccccagccccagcctggcccagagccccctgaagctgttccccagccaggccacccaccagctgggggagggggagagctacagcatgcccacagccttccctggcctggcccccaccagcccccacctggagggcagcggcatcctggacacccctgtgaccagcaccaaggcccggagcggggcccctgggggcagcgagggccgctgtgctgtgtgtggggacaatgccagctgccagcactatggagtgaggacctgtgagggctgcaagggcttcttcaagaggacagtgcagaagaatgccaagtacatctgcctggccaacaaggactgccctgtggacaagagaagaagaaaccgctgccagttctgccgcttccagaagtgcctggccgtgggcatggtgaaggaggtggtgaggacagacagcctgaagggcagaagaggccgcctgcccagcaagcccaagcagcccccagatgccagccctgccaacctgctgaccagcctggtgcgggcccacctggacagcggccccagcacagccaagctggactacagcaagttccaggagctggtgctgccccactttgggaaggaggatgctggagatgtgcagcagttctatgacctgctgagcggcagcctggaggtgatcaggaagtgggccgagaagatccctggctttgctgagctgagccctgctgaccaggacctgctgctggagagcgccttcctggagctgttcatcctgcggctggcctaccgcagcaagccaggagagggcaagctgatcttctgcagcggcctggtgctgcaccggctgcagtgtgcccggggctttggagactggattgacagcatcctggccttcagccgcagcctgcacagcctgctggtggatgtgcctgcctttgcctgcctgagcgccctggtgctgatcacagacagacatggcctgcaggagccccggcgggtggaggagctgcagaacagaattgccagctgcctgaaggagcacgtggccgctgtggccggggagccccagcctgccagctgcctgagccggctgctgggcaagctgcctgagctgcggaccctgtgcacccagggcctgcagaggatcttctacctgaagctggaggacctggtgcccccaccacccatcatcgacaagatcttcatggacaccctgcccttctag

SEQ ID NO: 162367 - DNA, 1836 bp, Artificial Sequence
  Description of Artificial Sequence: Synthetic coding sequence
atgtggctggccaaggcctgctggagcatccagagcgagatgccctgcatccaggcccagtatggcaccccagcccccagccctggcccccgggaccacctggccagtgaccccctgaccccagagttcatcaagcccaccatggacctggccagccctgaggccgccccagctgcccccacagccctgcccagcttcagcaccttcatggatggctacaccggggagtttgacaccttcctgtaccagctgcccggcaccgtgcagccctgcagcagcgccagcagcagcgccagcagcaccagcagcagcagcgccaccagccctgccagcgccagcttcaagtttgaggacttccaggtgtatggctgctacccaggccccctgagcggccctgtggatgaggccctgagcagcagcggcagtgactactacggcagcccctgcagcgcccccagccccagcacccccagcttccagcccccccagctgagcccctgggatggcagctttggccacttcagccccagccagacctatgagggcctgcgggcctggacagagcagctgcccaaggccagcggccccccccagcccccagccttcttctccttcagccccccaacaggccccagccccagcctggcccagagccccctgaagctgttccccagccaggccacccaccagctgggggagggggagagctacagcatgcccacagccttccctggcctggcccccaccagcccccacctggagggcagcggcatcctggacacccctgtgaccagcaccaaggcccggagcggggcccctgggggcagcgagggccgctgtgctgtgtgtggggacaatgccagctgccagcactacggcgtgaggacctgtgagggctgcaagggcttcttcaagaggacagtgcagaagaatgccaagtacatctgcctggccaacaaggactgccctgtggacaagagaagaagaaaccgctgccagttctgccgcttccagaagtgcctggccgtgggcatggtgaaggaggtggtgaggacagacagcctgaagggccggcggggccgcctgcccagcaagcccaagcagcccccagatgccagccctgccaacctgctgaccagcctggtgcgggcccacctggacagcggccccagcacagccaagctggactacagcaagttccaggagctggtgctgccccactttgggaaggaggatgctggagatgtgcagcagttctatgacctgctgagcggcagcctggaggtgatcaggaagtgggccgagaagatccctggctttgctgagctgagccctgctgaccaggacctgctgctggagagcgccttcctggagctgttcatcctgcggctggcctaccgcagcaagccaggagagggcaagctgatcttctgcagcggcctggtgctgcaccggctgcagtgtgcccggggctttggagactggattgacagcatcctggccttcagccgcagcctgcacagcctgctggtggatgtgcctgcctttgcctgcctgagcgccctggtgctgatcacagacagacatggcctgcaggagcccaggagagtggaggagctgcagaaccgcatcgccagctgcctgaaggagcacgtggccgctgtggccggggagccccagcctgccagctgcctgagccggctgctgggcaagctgcctgagctgcggaccctgtgcacccagggcctgcagaggatcttctacctgaagctggaggacctggtgcccccaccacccatcatcgacaagatcttcatggacaccctgcccttctag

SEQ ID NO: 162368 - DNA, 1797 bp, Artificial Sequence; identical to SEQ ID NO: 162366
  Description of Artificial Sequence: Synthetic coding sequence

SEQ ID NO: 162369 - DNA, 1797 bp, Artificial Sequence; identical to SEQ ID NO: 162366
  Description of Artificial Sequence: Synthetic coding sequence

SEQ ID NO: 162370 - DNA, 1959 bp, Artificial Sequence
  Description of Artificial Sequence: Synthetic coding sequence
atgaccagcgcccagtacaagatcaagatcctgattgagggcctgcaccacggccagaggcctggccctgccccaccccggcagcccggcagcttctgctgggccctgaaggcagatggcatcatgtggctggccaaggcctgctggagcatccagagcgagatgccctgcatccaggcccagtatggcaccccagcccccagccctggcccccgggaccacctggccagtgaccccctgaccccagagttcatcaagcccaccatggacctggccagccctgaggccgccccagctgcccccacagccctgcccagcttcagcaccttcatggatggctacacaggagaatttgacaccttcctgtaccagctgcccggcaccgtgcagccctgcagcagcgccagcagcagcgccagcagcaccagcagcagcagcgccaccagccctgccagcgccagcttcaagtttgaggacttccaggtgtatggctgctacccaggccccctgagcggccctgtggatgaggccctgagcagcagcggcagtgactactacggcagcccctgcagcgcccccagccccagcacccccagcttccagcccccccagctgagcccctgggatggcagctttggccacttcagccccagccagacctatgagggcctgcgggcctggacagagcagctgcccaaggccagcggccccccccagcccccagccttcttctccttcagcccccccaccggccccagccccagcctggcccagagccccctgaagctgttccccagccaggccacccaccagctgggggagggggagagctacagcatgcccacagccttccctggcctggcccccaccagcccccacctggagggcagcggcatcctggacacccctgtgaccagcaccaaggcccggagcggggcccctgggggcagcgagggccgctgtgctgtgtgtggggacaatgccagctgccagcactatggagtgaggacctgtgagggctgcaagggcttcttcaagaggacagtgcagaagaatgccaagtacatctgcctggccaacaaggactgccctgtggacaagagaagaagaaaccgctgccagttctgccgcttccagaagtgcctggccgtgggcatggtgaaggaggtggtgaggacagacagcctgaagggcagaagaggccgcctgcccagcaagcccaagcagcccccagatgccagccctgccaacctgctgaccagcctggtgcgggcccacctggacagcggccccagcacagccaagctggactacagcaagttccaggagctggtgctgccccactttgggaaggaggatgctggagatgtgcagcagttctatgacctgctgagcggcagcctggaggtgatcaggaagtgggccgagaagatccctggctttgctgagctgagccctgctgaccaggacctgctgctggagagcgccttcctggagctgttcatcctgcggctggcctaccgcagcaagccaggagagggcaagctgatcttctgcagcggcctggtgctgcaccggctgcagtgtgcccggggctttggagactggattgacagcatcctggccttcagccgcagcctgcacagcctgctggtggatgtgcctgcctttgcctgcctgagcgccctggtgctgatcacagacagacatggcctgcaggagccccggcgggtggaggagctgcagaacagaattgccagctgcctgaaggagcacgtggccgctgtggccggggagccccagcctgccagctgcctgagccggctgctgggcaagctgcctgagctgcggaccctgtgcacccagggcctgcagaggatcttctacctgaagctggaggacctggtgcccccaccacccatcatcgacaagatcttcatggacaccctgcccttctag

SEQ ID NO: 162371 - DNA, 978 bp, Artificial Sequence
  Description of Artificial Sequence: Synthetic coding sequence
atgccctgcatccaggcccagtatggcaccccagcccccagccctggcccccgggaccacctggccagtgaccccctgaccccagagttcatcaagcccaccatggacctggccagccctgaggccgccccagctgcccccacagccctgcccagcttcagcaccttcatggatggctacacaggagaatttgacaccttcctgtaccagctgcccggcaccgtgcagccctgcagcagcgccagcagcagcgccagcagcaccagcagcagcagcgccaccagccctgccagcgccagcttcaagtttgaggacttccaggtgtatggctgctacccaggccccctgagcggccctgtggatgaggccctgagcagcagcggcagtgactactacggcagcccctgcagcgcccccagccccagcacccccagcttccagcccccccagctgagcccctgggatggcagctttggccacttcagccccagccagacctatgagggcctgcgggcctggacagagcagctgcccaaggccagcggccccccccagcccccagccttcttctccttcagcccccccaccggccccagccccagcctggcccagagccccctgaagctgttccccagccaggccacccaccagctgggggagggggagagctacagcatgcccacagccttccctggcctggcccccaccagcccccacctggagggcagcggcatcctggacacccctgtgaccagcaccaaggcccggagcggggcccctgggggcagcgagggccgctgtgctgtgtgtggggacaatgccagctgccagcactatggagtgaggacctgtgagggctgcaagggcttcttcaaggtgcccaggagcccccgctggggcctgctgctggagatggagcggggctggccccaccccatcggcacctgtggcctgcccctgggcagcccccccagctag

SEQ ID NO: 162372 - DNA, 1836 bp, Artificial Sequence; identical to SEQ ID NO: 162367
  Description of Artificial Sequence: Synthetic coding sequence

SEQ ID NO: 162373 - DNA, 1797 bp, Artificial Sequence
  Description of Artificial Sequence: Synthetic coding sequence
atgccctgtgtgcaggcccagtatggcagcagcccccagggcgccagccctgccagccagagctacagctaccacagcagtggagagtacagcagtgacttcctgaccccagagtttgtgaagttctccatggacctgaccaacacagagatcacagccaccaccagcctgcccagcttcagcaccttcatggacaactacagcacaggctatgatgtgaagccaccctgcctgtaccagatgcccctgagcggccagcagagcagcatcaaggtggaggacatccagatgcacaactaccagcagcacagccacctgcccccccagagcgaggagatgatgccccacagcggctctgtgtactacaagcccagcagcccccccacccccaccaccccaggcttccaggtgcagcacagccccatgtgggatgaccccggcagcctgcacaacttccaccagaactacgtggccaccacccacatgattgagcagaggaagacccctgtgtcccggctgagcctcttctccttcaagcagagccccccaggcacccctgtgagcagctgccagatgagatttgatggccccctgcacgtgcccatgaaccctgagcctgctggcagccaccacgtggtggatggccagacctttgctgtgcccaaccccatcaggaagccagcctccatgggcttccctggcctgcagattggacatgccagccagctgctggacacccaggtgcccagcccccccagccggggcagccccagcaatgaaggcctgtgtgctgtgtgtggggacaatgctgcctgccagcactatggagtgaggacctgtgagggctgcaagggcttcttcaagaggacagtgcagaagaatgccaagtatgtgtgcctggccaacaagaactgccctgtggacaagagaagaagaaaccgctgccagtactgccgcttccagaagtgcctggccgtgggcatggtgaaggaggtggtgaggacagacagcctgaagggcagaagaggccgcctgcccagcaagcccaagagcccccaggagcccagcccccccagcccccctgtgtccctcatcagcgccctggtgcgggcccacgtggacagcaacccagccatgaccagcctggactacagccgcttccaggccaacccagactaccagatgtctggagatgacacccagcacatccagcagttctatgacctgctgaccggctccatggagatcatccggggctgggccgagaagatccctggctttgctgacctgcccaaggctgaccaggacctgctgtttgaaagtgccttcctggagctgtttgtgctgcggctggcctaccgcagcaaccctgtggagggcaagctgatcttctgcaatggagtggtgctgcaccggctgcagtgtgtgcggggctttggagagtggattgacagcatcgtggagttcagcagcaacctgcagaacatgaacatcgacatcagcgccttcagctgcatcgccgccctggccatggtgacagagcggcacggcctgaaggagcccaagagggtggaggagctgcagaacaagatcgtgaactgcctgaaggaccacgtgaccttcaacaatggaggcctgaaccggcccaactacctgagcaagctgctgggcaagctgcctgagctgcggaccctgtgcacccagggcctgcagaggatcttctacctgaagctggaggacctggtgcccccaccagccatcatcgacaagctgttcctggacaccctgcccttctag

SEQ ID NO: 162374 - DNA, 1797 bp, Artificial Sequence; identical to SEQ ID NO: 162373
  Description of Artificial Sequence: Synthetic coding sequence

SEQ ID NO: 162375 - DNA, 1179 bp, Artificial Sequence
  Description of Artificial Sequence: Synthetic coding sequence
atggacaactacagcacaggctatgatgtgaagccaccctgcctgtaccagatgcccctgagcggccagcagagcagcatcaaggtggaggacatccagatgcacaactaccagcagcacagccacctgcccccccagagcgaggagatgatgccccacagcggctctgtgtactacaagcccagcagcccccccacccccaccaccccaggcttccaggtgcagcacagccccatgtgggatgatcctggcagcctgcacaacttccaccagaactacgtggccaccacccacatgattgagcagaggaagacccctgtgtcccggctgagcctcttctccttcaagcagagccccccaggcacccctgtgagcagctgccagatgagatttgatggccccctgcacgtgcccatgaaccctgagcccgccggcagccaccacgtggtggatggccagacctttgctgtgcccaaccccatcaggaagccagcctccatgggcttccctggcctgcagatcggccacgccagccagctgctggacacccaggtgcccagcccccccagccggggcagccccagcaatgaaggcctgtgtgctgtgtgtggggacaatgctgcctgccagcactacggcgtgaggacctgtgagggctgcaagggcttcttcaagaggacagtgcagaagaatgccaagtatgtgtgcctggccaacaagaactgccctgtggacaagagaagaagaaaccgctgccagtactgccgcttccagaagtgcctggccgtgggcatggtgaaggaggtggtgaggacagacagcctgaagggccggcggggccgcctgcccagcaagcccaagagcccccaggagcccagcccccccagcccccctgtgtccctcatcagcgccctggtgcgggcccacgtggacagcaacccagccatgaccagcctggactacagccgcttccaggccaacccagactaccagatgtctggagatgacacccagcacatccagcagttctatgacctgctgaccggctccatggagatcatccggggctgggccgagaagatccctggctttgctgacctgcccaaggctgaccaggacctgctgtttgagagcgccttcctggagctgtttgtgctgcggctggcctaccgcatctag

SEQ ID NO: 162376 - DNA, 1179 bp, Artificial Sequence; identical to SEQ ID NO: 162375
  Description of Artificial Sequence: Synthetic coding sequence

SEQ ID NO: 162377 - DNA, 777 bp, Artificial Sequence
  Description of Artificial Sequence: Synthetic coding sequence
atgccctgtgtgcaggcccagtatggcagcagcccccagggcgccagccctgccagccagagctacagctaccacagcagtggagagtacagcagtgacttcctgaccccagagtttgtgaagttctccatggacctgaccaacacagagatcacagccaccaccagcctgcccagcttcagcaccttcatggacaactacagcacaggctatgatgtgaagccaccctgcctgtaccagatgcccctgagcggccagcagagcagcatcaaggtggaggacatccagatgcacaactaccagcagcacagccacctgcccccccagagcgaggagatgatgccccacagcggctctgtgtactacaagcccagcagcccccccacccccaccaccccaggcttccaggtgcagcacagccccatgtgggatgaccccggcagcctgcacaacttccaccagaactacgtggccaccacccacatgattgagcagaggaagacccctgtgtcccggctgagcctcttctccttcaagcagagccccccaggcacccctgtgagcagctgccagatgagatttgatggccccctgcacgtgcccatgaaccctgagcctgctggcagccaccacgtggtggatggccagacctttgctgtgcccaaccccatcaggaagccagcctccatgggcttccctggcctgcagattggacatgccagccagctgctggacacccaggtgcccagcccccccagccggggcagccccagctag

SEQ ID NO: 162378 - DNA, 1608 bp, Artificial Sequence
  Description of Artificial Sequence: Synthetic coding sequence
atggacaactacagcacaggctatgatgtgaagccaccctgcctgtaccagatgcccctgagcggccagcagagcagcatcaaggtggaggacatccagatgcacaactaccagcagcacagccacctgcccccccagagcgaggagatgatgccccacagcggctctgtgtactacaagcccagcagcccccccacccccaccaccccaggcttccaggtgcagcacagccccatgtgggatgatcctggcagcctgcacaacttccaccagaactacgtggccaccacccacatgattgagcagaggaagacccctgtgtcccggctgagcctcttctccttcaagcagagccccccaggcacccctgtgagcagctgccagatgagatttgatggccccctgcacgtgcccatgaaccctgagcccgccggcagccaccacgtggtggatggccagacctttgctgtgcccaaccccatcaggaagccagcctccatgggcttccctggcctgcagatcggccacgccagccagctgctggacacccaggtgcccagcccccccagccggggcagccccagcaatgaaggcctgtgtgctgtgtgtggggacaatgctgcctgccagcactacggcgtgaggacctgtgagggctgcaagggcttcttcaagaggacagtgcagaagaatgccaagtatgtgtgcctggccaacaagaactgccctgtggacaagagaagaagaaaccgctgccagtactgccgcttccagaagtgcctggccgtgggcatggtgaaggaggtggtgaggacagacagcctgaagggccggcggggccgcctgcccagcaagcccaagagcccccaggagcccagcccccccagcccccctgtgtccctcatcagcgccctggtgcgggcccacgtggacagcaacccagccatgaccagcctggactacagccgcttccaggccaacccagactaccagatgtctggagatgacacccagcacatccagcagttctatgacctgctgaccggctccatggagatcatccggggctgggccgagaagatccctggctttgctgacctgcccaaggctgaccaggacctgctgtttgagagcgccttcctggagctgtttgtgctgcggctggcctaccgcagcaaccctgtggagggcaagctgatcttctgcaatggagtggtgctgcaccggctgcagtgtgtgcggggctttggagagtggattgacagcatcgtggagttcagcagcaacctgcagaacatgaacatcgacatcagcgccttcagctgcatcgccgccctggccatggtgacagaaagacatggcctgaaggagcccaagagggtggaggagctgcagaacaagatcgtgaactgcctgaaggaccacgtgaccttcaacaacggcggcctgaaccggcccaactacctgagcaagctgctgggcaagctgcctgagctgcggaccctgtgcacccagggcctgcagaggatcttctacctgaagctggaggacctggtgcccccaccagccatcatcgacaagctgttcctggacaccctgcccttctag

SEQ ID NO: 162379 - DNA, 1830 bp, Artificial Sequence
  Description of Artificial Sequence: Synthetic coding sequence
atgaatgaagatagaagaggagagctgctgaccatgccctgtgtgcaggcccagtatggcagcagcccccagggcgccagccctgccagccagagctacagctaccacagcagcggggagtacagcagtgacttcctgaccccagagtttgtgaagttctccatggacctgaccaacacagagatcacagccaccaccagcctgcccagcttcagcaccttcatggacaactacagcacaggctatgatgtgaagccaccctgcctgtaccagatgcccctgagcggccagcagagcagcatcaaggtggaggacatccagatgcacaactaccagcagcacagccacctgcccccccagagcgaggagatgatgccccacagcggctctgtgtactacaagcccagcagcccccccacccccaccaccccaggcttccaggtgcagcacagccccatgtgggatgatcctggcagcctgcacaacttccaccagaactacgtggccaccacccacatgattgagcagaggaagacccctgtgtcccggctgagcctcttctccttcaagcagagccccccaggcacccctgtgagcagctgccagatgagatttgatggccccctgcacgtgcccatgaaccctgagcccgccggcagccaccacgtggtggatggccagacctttgctgtgcccaaccccatcaggaagccagcctccatgggcttccctggcctgcagatcggccacgccagccagctgctggacacccaggtgcccagcccccccagccggggcagccccagcaatgaaggcctgtgtgctgtgtgtggggacaatgctgcctgccagcactacggcgtgaggacctgtgagggctgcaagggcttcttcaagaggacagtgcagaagaatgccaagtatgtgtgcctggccaacaagaactgccctgtggacaagagaagaagaaaccgctgccagtactgccgcttccagaagtgcctggccgtgggcatggtgaaggaggtggtgaggacagacagcctgaagggccggcggggccgcctgcccagcaagcccaagagcccccaggagcccagcccccccagcccccctgtgtccctcatcagcgccctggtgcgggcccacgtggacagcaacccagccatgaccagcctggactacagccgcttccaggccaacccagactaccagatgtctggagatgacacccagcacatccagcagttctatgacctgctgaccggctccatggagatcatccggggctgggccgagaagatccctggctttgctgacctgcccaaggctgaccaggacctgctgtttgagagcgccttcctggagctgtttgtgctgcggctggcctaccgcagcaaccctgtggagggcaagctgatcttctgcaatggagtggtgctgcaccggctgcagtgtgtgcggggctttggagagtggattgacagcatcgtggagttcagcagcaacctgcagaacatgaacatcgacatcagcgccttcagctgcatcgccgccctggccatggtgacagaaagacatggcctgaaggagcccaagagggtggaggagctgcagaacaagatcgtgaactgcctgaaggaccacgtgaccttcaacaacggcggcctgaaccggcccaactacctgagcaagctgctgggcaagctgcctgagctgcggaccctgtgcacccagggcctgcagaggatcttctacctgaagctggaggacctggtgcccccaccagccatcatcgacaagctgttcctggacaccctgcccttctag

SEQ ID NO: 162380 - DNA, 738 bp, Artificial Sequence
  Description of Artificial Sequence: Synthetic coding sequence
gtggaggaggagggagatgtgagcaacagaggagtggagctgctgcagctggagccagatgaggaccaggtgcgggcccgcatcctgggctgcctgcaggagcccaccaagagcaggccagaccagcctgctgccttcggcctgctgtgcaggatggctgaccagaccttcatcagcatcgtggactgggcccggcgctgcatggtgttcaaggagctggaggtggccgaccagatgaccctgctgcagaactgctggagcgagctgctggtgtttgaccacatctaccggcaggtgcagcacggcaaggagggcagcatcctgctggtgacaggccaggaggtggagctgaccaccgtggccacccaggccggcagcctgctgcacagcctggtgctgcgggcccaggagctggtgctgcagctgctggccctgcagctggaccggcaggagtttgtgtgcctgaagttcatcatcctcttcagcctggacctgaagttcctgaacaaccacatcctggtgaaggatgcccaggagaaggccaatgctgccctgctggactacaccctgtgccactacccccactgtggggacaagttccagcagctgctgctgtgcctggtggaggtgcgggccctgtccatgcaggccaaggagtacctgtaccacaagcacctgggcaatgagatgcccaggaacaacctgctgattgagatgctgcaggccaagcagacctag

SEQ ID NO: 162381 - DNA, 1386 bp, Artificial Sequence
  Description of Artificial Sequence: Synthetic coding sequence
atggactacagctatgatgaggacctggatgagctgtgccctgtgtgtggggacaaggtgtctggctaccactacggcctgctgacctgtgagagctgcaagggcttcttcaagaggacagtgcagaacaacaagcactacacctgcacagagagccagagctgcaagattgacaagacccagaggaagcgctgccccttctgccgcttccagaagtgcctgactgtgggcatgaggctggaggccgtgcgggctgacaggatgaggggcggcaggaacaagtttggccccatgtacaagagggaccgggccctgaagcagcagaagaaggcccagatccgggccaacggcttcaagctggagaccggcccccccatgggcgtgcccccacctcctcctccagccccagactatgtgctgccccccagcctgcacggccctgagcccaagggcctggccgccggccccccagctggccccctgggggactttggagccccagccctgcccatggctgtgcctggggcccacggccccctggccggctacctgtacccagccttccctggccgggccatcaagtctgagtacccagagccctatgccagccccccccagcccggcctgccctacggctacccagagcccttcagcggcggccccaacgtgcctgagctgatcctgcagctgctgcagctggagccagatgaggaccaggtgcgggcccgcatcctgggctgcctgcaggagcccaccaagagcaggccagaccagcctgctgccttcggcctgctgtgcaggatggctgaccagaccttcatcagcatcgtggactgggcccggcgctgcatggtgttcaaggagctggaggtggccgaccagatgaccctgctgcagaactgctggagcgagctgctggtgtttgaccacatctaccggcaggtgcagcacggcaaggagggcagcatcctgctggtgacaggccaggaggtggagctgaccaccgtggccacccaggccggcagcctgctgcacagcctggtgctgcgggcccaggagctggtgctgcagctgctggccctgcagctggaccggcaggagtttgtgtgcctgaagttcatcatcctcttcagcctggacctgaagttcctgaacaaccacatcctggtgaaggatgcccaggagaaggccaatgctgccctgctggactacaccctgtgccactacccccactgtggggacaagttccagcagctgctgctgtgcctggtggaggtgcgggccctgtccatgcaggccaaggagtacctgtaccacaagcacctgggcaatgagatgcccaggaacaacctgctgattgagatgctgcaggccaagcagacctag

SEQ ID NO: 162382 - DNA, 537 bp, Artificial Sequence
  Description of Artificial Sequence: Synthetic coding sequence
atggactacagctatgatgaggacctggatgagctgtgccctgtgtgtggggacaaggtgtctggctaccactacggcctgctgacctgtgagagctgcaagggcttcttcaagaggacagtgcagaacaacaagcactacacctgcacagagagccagagctgcaagattgacaagacccagaggaagcgctgccccttctgccgcttccagaagtgcctgactgtgggcatgaggctggaggccgtgcgggctgacaggatgaggggcggcaggaacaagtttggccccatgtacaagagggaccgggccctgaagcagcagaagaaggcccagatccgggccaacggcttcaagctggagaccggcccccccatgggcgtgcccccacctcctcctccagccccagactatgtgctgccccccagcctgcacggccctgagcccaagggcctggccgccggccccccagctggccccctgggggactttggagccccagccctgcccatggctgtgcctggggcccatggatag

SEQ ID NO: 162383 - DNA, 972 bp, Artificial Sequence
  Description of Artificial Sequence: Synthetic coding sequence
gacctggaggagctgtgccctgtgtgtggggacaaggtgtctggctaccactacggcctgctgacctgtgagagctgcaagggcttcttcaagaggacagtgcagaacaacaagcgctacacctgcatcgagaaccagaactgccagattgacaagacccagaggaagcgctgcccctactgccgcttccagaagtgcctgtctgtgggcatgaagctggaggccgtgcgggctgacaggatgagaggaggaagaaacaagtttggccccatgtacaagagggaccgggccctgaagcagcagaagaaggccctgatccgggccaacggcctgaagctggaggccatgagccaggtgatccaggccatgcccagcgacctgaccatcagcagcgccatccagaacatccacagcgccagcaagggcctgcccctgaaccacgccgccctgcccccaacagattatgacaggagcccctttgtgaccagccccatctccatgaccatgccaccccacggcagcctgcagggctaccagacctacggccacttccccagccgggccatcaagtctgagtacccagacccctacaccagcagccctgagagcatcatgggctacagctacatggacagctaccagaccagcagccctgccagcatcccccacctgatcctggagctgctgaagtgtgagccagatgagccccaggtgcaggccaagatcatggcctacctgcagcaggagcaggccaacagaagcaagcatgagaagctgagcaccttcggcctgatgtgcaagatggctgaccagaccctcttcagcatcgtggagtgggcccggagcagcatcttcttccgggagctgaagggcctgaccctgagccccagcctggagtgcagcggctcctggctgatggccaccagcaccagctgcatccaggtgatccggctgccccagcccccagagtag

SEQ ID NO: 162384 - DNA, 1488 bp, Artificial Sequence
  Description of Artificial Sequence: Synthetic coding sequence
atgagcagcaacagcgacacaggagacctgcaggagagcctgaagcacggcctgacccccatcgtgtcccagttcaagatggtgaactacagctatgatgaggacctggaggagctgtgccctgtgtgtggggacaaggtgtctggctaccactacggcctgctgacctgtgagagctgcaagggcttcttcaagaggacagtgcagaacaacaagcgctacacctgcatcgagaaccagaactgccagattgacaagacccagaggaagcgctgcccctactgccgcttccagaagtgcctgtctgtgggcatgaagctggaggccgtgcgggctgacaggatgagaggaggaagaaacaagtttggccccatgtacaagagggaccgggccctgaagcagcagaagaaggccctgatccgggccaacggcctgaagctggaggccatgagccaggtgatccaggccatgcccagcgacctgaccatcagcagcgccatccagaacatccacagcgccagcaagggcctgcccctgaaccacgccgccctgcccccaacagattatgacaggagcccctttgtgaccagccccatctccatgaccatgccaccccacggcagcctgcagggctaccagacctacggccacttccccagccgggccatcaagtctgagtacccagacccctacaccagcagccctgagagcatcatgggctacagctacatggacagctaccagaccagcagccctgccagcatcccccacctgatcctggagctgctgaagtgtgagccagatgagccccaggtgcaggccaagatcatggcctacctgcagcaggagcaggccaacagaagcaagcatgagaagctgagcaccttcggcctgatgtgcaagatggctgaccagaccctcttcagcatcgtggagtgggcccggagcagcatcttcttccgggagctgaaggtggatgaccagatgaagctgctgcagaactgctggagcgagctgctgatcctggaccacatctaccggcaggtggtgcacggcaaggagggcagcatcttcctggtgacaggccagcaggtggactacagcatcatcgccagccaggccggggccaccctgaacaacctgatgagccacgcccaggagctggtggccaagctgcggagcctgcagtttgaccagcgggagtttgtgtgcctgaagttcctggtgctcttcagcctggatgtgaagaacctggagaacttccagctggtggagggcgtgcaggagcaggtgaatgctgccctgctggactacaccatgtgcaactacccccagcagacagagaagtttggccagctgctgctgcggctgcctgagatccgggccatctccatgcaggccgaggagtacctgtactacaagcacctgaatggagatgtgccctacaacaacctgctgattgagatgctgcacgccaagagggcctag

SEQ ID NO: 162385 - DNA, 1134 bp, Artificial Sequence
  Description of Artificial Sequence: Synthetic coding sequence
tgagacctggaggagctgtgccctgtgtgtggggacaaggtgtctggctaccactacggcctgctgacctgtgagagctgcaagggcttcttcaagaggacagtgcagaacaacaagcgctacacctgcatcgagaaccagaactgccagattgacaagacccagaggaagcgctgcccctactgccgcttccagaagtgcctgtctgtgggcatgaagctggaggccgtgcgggctgacaggatgaggggcggcaggaacaagtttggccccatgtacaagagggaccgggccctgaagcagcagaagaaggccctgatccgggccaacggcctgaagctggaggccatgagccaggtgatccaggccatgcccagcgacctgaccatcagcagcgccatccagaacatccacagcgccagcaagggcctgcccctgaaccacgccgccctgcccccaacagattatgacaggagcccctttgtgaccagccccatctccatgaccatgcctcctcatggcagcctgcagggctaccagacctacggccacttccccagccgggccatcaagtctgagtacccagacccctacaccagcagccctgagagcatcatgggctacagctacatggacagctaccagaccagcagccctgccagcatcccccacctgatcctggagctgctgaagtgtgagccagatgagccccaggtgcaggccaagatcatggcctacctgcagcaggagcaggccaacagaagcaagcatgagaagctgagcaccttcggcctgatgtgcaagatggctgaccagaccctcttcagcatcgtggagtgggcccggagcagcatcttcttccgggagctgaagggcctgaccctgagccccagcctggagtgcagcggcaccatcctggcccacggcaacctgcacctgctgcacagcagtgacagccctgccagcgccagccgggtggccggcatcaccggggtgcaccacaacacccacctgatctttgtgttcctggtggagatgggcttctgccacgtgggccaggccggcctgaagaccccagacctgcgggtcatctgcctgcccaggcctcccaaggtgctgggcctgtgggcctag

SEQ ID NO: 162386 - DNA, 1626 bp, Artificial Sequence
  Description of Artificial Sequence: Synthetic coding sequence
atgagcagcaacagcgacacaggagacctgcaggagagcctgaagcacggcctgacccccatcggggccggcctgcctgacagacatggcagccccatcccagcccggggccgcctggtgatgctgcccaaggtggagacagaggccctgggcctggcccggagccacggggagcagggccagatgcctgagaacatgcaggtgtcccagttcaagatggtgaactacagctatgatgaggacctggaggagctgtgccctgtgtgtggggacaaggtgtctggctaccactacggcctgctgacctgtgagagctgcaagggcttcttcaagaggacagtgcagaacaacaagcgctacacctgcatcgagaaccagaactgccagattgacaagacccagaggaagcgctgcccctactgccgcttccagaagtgcctgtctgtgggcatgaagctggaggccgtgcgggctgacaggatgagaggaggaagaaacaagtttggccccatgtacaagagggaccgggccctgaagcagcagaagaaggccctgatccgggccaacggcctgaagctggaggccatgagccaggtgatccaggccatgcccagcgacctgaccatcagcagcgccatccagaacatccacagcgccagcaagggcctgcccctgaaccacgccgccctgcccccaacagattatgacaggagcccctttgtgaccagccccatctccatgaccatgccaccccacggcagcctgcagggctaccagacctacggccacttccccagccgggccatcaagtctgagtacccagacccctacaccagcagccctgagagcatcatgggctacagctacatggacagctaccagaccagcagccctgccagcatcccccacctgatcctggagctgctgaagtgtgagccagatgagccccaggtgcaggccaagatcatggcctacctgcagcaggagcaggccaacagaagcaagcatgagaagctgagcaccttcggcctgatgtgcaagatggctgaccagaccctcttcagcatcgtggagtgggcccggagcagcatcttcttccgggagctgaaggtggatgaccagatgaagctgctgcagaactgctggagcgagctgctgatcctggaccacatctaccggcaggtggtgcacggcaaggagggcagcatcttcctggtgacaggccagcaggtggactacagcatcatcgccagccaggccggggccaccctgaacaacctgatgagccacgcccaggagctggtggccaagctgcggagcctgcagtttgaccagcgggagtttgtgtgcctgaagttcctggtgctcttcagcctggatgtgaagaacctggagaacttccagctggtggagggcgtgcaggagcaggtgaatgctgccctgctggactacaccatgtgcaactacccccagcagacagagaagtttggccagctgctgctgcggctgcctgagatccgggccatctccatgcaggccgaggagtacctgtactacaagcacctgaatggagatgtgccctacaacaacctgctgattgagatgctgcacgccaagagggcctag

SEQ ID NO: 162387 - DNA, 216 bp, Artificial Sequence
  Description of Artificial Sequence: Synthetic coding sequence
tgaagcctgaagcacggcctgacccccatcgaccggggcaactgccgcagcggctgcttctcctttgctgccaccctgcggcagaggagcctgctgaccagctgtgccggcctgcctgacagacatggcagccccatcccagcccggggccgcctggtgatgctgcccaaggtggagacagaggccctgggcctggcccggagccatggagagtag

SEQ ID NO: 162388 - DNA, 66 bp, Artificial Sequence
  Description of Artificial Sequence: Synthetic coding sequence
atgagcagcaacagcgacacaggagacctgcaggagagcctgaagcacggcctgacccccatctag

SEQ ID NO: 162389 - DNA, 249 bp, Artificial Sequence
  Description of Artificial Sequence: Synthetic coding sequence
atgagcagcaacagcgacacaggagacctgcaggagagcctgaagcacggcctgacccccatcgaccggggcaactgccgcagcggctgcttctcctttgctgccaccctgcggcagaggagcctgctgaccagctgtgccggcctgcctgacagacatggcagccccatcccagcccggggccgcctggtgatgctgcccaaggtggagacagaggccctgggcctggcccggagccacggggagtag

SEQ ID NO: 162390 - DNA, 1410 bp, Artificial Sequence
  Description of Artificial Sequence: Synthetic coding sequence
atggtgaactacagctatgatgaggacctggaggagctgtgccctgtgtgtggggacaaggtgtctggctaccactacggcctgctgacctgtgagagctgcaagggcttcttcaagaggacagtgcagaacaacaagcgctacacctgcatcgagaaccagaactgccagattgacaagacccagaggaagcgctgcccctactgccgcttccagaagtgcctgtctgtgggcatgaagctggaggccgtgcgggctgacaggatgagaggaggaagaaacaagtttggccccatgtacaagagggaccgggccctgaagcagcagaagaaggccctgatccgggccaacggcctgaagctggaggccatgagccaggtgatccaggccatgcccagcgacctgaccatcagcagcgccatccagaacatccacagcgccagcaagggcctgcccctgaaccacgccgccctgcccccaacagattatgacaggagcccctttgtgaccagccccatctccatgaccatgccaccccacggcagcctgcagggctaccagacctacggccacttccccagccgggccatcaagtctgagtacccagacccctacaccagcagccctgagagcatcatgggctacagctacatggacagctaccagaccagcagccctgccagcatcccccacctgatcctggagctgctgaagtgtgagccagatgagccccaggtgcaggccaagatcatggcctacctgcagcaggagcaggccaacagaagcaagcatgagaagctgagcaccttcggcctgatgtgcaagatggctgaccagaccctcttcagcatcgtggagtgggcccggagcagcatcttcttccgggagctgaaggtggatgaccagatgaagctgctgcagaactgctggagcgagctgctgatcctggaccacatctaccggcaggtggtgcacggcaaggagggcagcatcttcctggtgacaggccagcaggtggactacagcatcatcgccagccaggccggggccaccctgaacaacctgatgagccacgcccaggagctggtggccaagctgcggagcctgcagtttgaccagcgggagtttgtgtgcctgaagttcctggtgctcttcagcctggatgtgaagaacctggagaacttccagctggtggagggcgtgcaggagcaggtgaatgctgccctgctggactacaccatgtgcaactacccccagcagacagagaagtttggccagctgctgctgcggctgcctgagatccgggccatctccatgcaggccgaggagtacctgtactacaagcacctgaatggagatgtgccctacaacaacctgctgattgagatgctgcacgccaagagggcctag

SEQ ID NO: 162391 - DNA, 681 bp, Artificial Sequence
  Description of Artificial Sequence: Synthetic coding sequence
atgctgctgcggctggtgagcaacagctggccccaggtgatcctgccccccaggcctcccaaggtgctgggcctgcaggccccccggcgggccaggaagagagctgagggcacagccagcagcaatgtgttctccatgtttgaccagagccagatccaggagttcaaggagagcctggccctgagcccccggctggagagaaatggcatgatcagcgcccactgcaacctgtgcctgaccggcagcagcaacagccctgccagcgccagccaggccttcaccatcatggaccagaacagagatggcttcatcgacaaggaggacctgcgggacacctttgctgccctgggccgcatcaacgtgaagaatgaggagctggaggccatggtgaaggaggcccctggccccatcaacttcaccgtcttcctgaccatgtttggagagaagctgaagggcacagatcctgaggagaccatcctgcacgccttcaaggtgtttgacacagagggcaaaggatttgtgaaggcagatgtgatcaaggagaagctgatgacccaggccgaccgcttcagcgaggaggaggtgaagcagatgtttgctgccttccccccagatgtgtgtggcaacctggactacagaaacctgtgctacgtgatcacccatggagaggagaaggactag

SEQ ID NO: 162392 - DNA, 1569 bp, Artificial Sequence
  Description of Artificial Sequence: Synthetic coding sequence
atggaggagcacggcgtgacccagacagagcacatggccaccatcgaggcccatgctgtggcccagcaggtgcagcaggtgcacgtggccacctacacagagcacagcatgctgtctgcagatgaggacagccccagcagccctgaggacaccagctatgatgacagcgacatcctgaacagcacagctgctgatgaggtgacagcccacctggccgccgccggccctgtgggcatggctgctgctgctgctgtggccaccgggaagaagaggaagaggcctcatgtgtttgagagcaaccccagcatcaggaagaggcagcagacccggctgctgaggaagctgcgggccaccctggatgagtacaccaccagggtgggccagcaggccatcgtgctgtgcatcagccccagcaagcccaaccctgtgttcaaggtgtttggagctgcccccctggagaatgtggtgaggaagtacaagtccatgatcctggaggacctggagagcgccctggccgagcacgccccagccccccaggaggtgaacagcgagctgccccccctgaccattgatggcatccctgtgtctgtggacaagatgacccaggcccagctgcgggccttcatccctgagatgctgaagtacagcacaggccggggcaagccaggctggggcaaggagagctgcaagcccatctggtggccagaggacatcccctgggccaacgtgcggagtgatgtgaggacagaggagcagaagcagagggtgtcctggacccaggccctgcggaccatcgtgaagaactgctacaagcagcacggccgggaggacctgctgtatgcctttgaggaccagcagacccagacccaggccacagccacccacagcatcgcccacctggtgcccagccagacagtggtgcagaccttcagcaacccagatggcaccgtgtccctcatccaggtgggcaccggggccaccgtggccaccctggctgatgccagcgagctgcccaccaccgtgacagtggcccaggtgaactacagcgctgtggctgatggagaggtggagcagaactgggccaccctgcagggcggggagatgaccatccagaccacccaggccagcgaggccacccaggccgtggccagcctggccgaggccgctgtggccgccagccaggagatgcagcagggcgccaccgtgaccatggccctgaacagcgaggccgccgcccatgctgtggccaccctggccgaggccaccctgcagggcggcggccagatcgtgctgagcggggagacagctgctgctgtgggcgccctgactggagtgcaggatgccaacggcctcttcatggctgacagagctggcaggaagtggatcctgacagacaaggccaccggcctggtgcagatccctgtgtccatgtaccagacagtggtgaccagcctggcccagggcaatggacctgtgcaggtggccatggcccctgtgaccacccgcatcagtgacagcgctgtgaccatggatggccaggccgtggaggtggtgaccctggagcagtag

SEQ ID NO: 162393 - DNA, 1314 bp, Artificial Sequence
  Description of Artificial Sequence: Synthetic coding sequence
atggaggagcacggcgtgacccagacagagcacatggccaccatcgaggcccatgctgtggcccagcaggtgcagcaggtgcacgtggccacctacacagagcacagcatgctgtctgcagatgaggacagccccagcagccctgaggacaccagctatgatgacagcgacatcctgaacagcacagctgctgatgaggtgacagcccacctggccgccgccggccctgtgggcatggctgctgctgctgctgtggccaccgggaagaagaggaagaggcctcatgtgtttgagagcaaccccagcatcaggaagaggcagcagacccggctgctgaggaagctgcgggccaccctggatgagtacaccaccagggtgggccagcaggccatcgtgctgtgcatcagccccagcaagcccaaccctgtgttcaaggtgtttggagctgcccccctggagaatgtggtgaggaagtacaagtccatgatcctggaggacctggagagcgccctggccgagcacgccccagccccccaggaggtgaacagcgagctgccccccctgaccattgatggcatccctgtgtctgtggacaagatgacccaggcccagctgcgggccttcatccctgagatgctgaagtacagcacaggccggggcaagccaggctggggcaaggagagctgcaagcccatctggtggccagaggacatcccctgggccaacgtgcggagtgatgtgaggacagaggagcagaagcagagggtgggcaccggggccaccgtggccaccctggctgatgccagcgagctgcccaccaccgtgacagtggcccaggtgaactacagcgctgtggctgatggagaggtggagcagaactgggccaccctgcagggcggggagatgaccatccagaccacccaggccagcgaggccacccaggccgtggccagcctggccgaggccgctgtggccgccagccaggagatgcagcagggcgccaccgtgaccatggccctgaacagcgaggccgccgcccatgctgtggccaccctggccgaggccaccctgcagggcggcggccagatcgtgctgagcggggagacagctgctgctgtgggcgccctgactggagtgcaggatgccaacggcctggtgcagatccctgtgtccatgtaccagacagtggtgaccagcctggcccagggcaatggacctgtgcaggtggccatggcccctgtgaccacccgcatcagtgacagcgctgtgaccatggatggccaggccgtggaggtggtgaccctggagcagtag

SEQ ID NO: 162394 - DNA, 1512 bp, Artificial Sequence; identical to SEQ ID NO: 147082
  Description of Artificial Sequence: Synthetic coding sequence

SEQ ID NO: 162395 - DNA, 1569 bp, Artificial Sequence; identical to SEQ ID NO: 162392
  Description of Artificial Sequence: Synthetic coding sequence

SEQ ID NO: 162396 - DNA, 1512 bp, Artificial Sequence; identical to SEQ ID NO: 147082
  Description of Artificial Sequence: Synthetic coding sequence

SEQ ID NO: 162397 - DNA, 633 bp, Artificial Sequence
  Description of Artificial Sequence: Synthetic coding sequence
atggaggagcacggcgtgacccagacagagcacatggccaccatcgaggcccatgctgtggcccagcaggtgcagcaggtgcacgtggccacctacacagagcacagcatgctgtctgcagatgaggacagccccagcagccctgaggacaccagctatgatgacagcgacatcctgaacagcacagctgctgatgaggtgacagcccacctggccgccgccggccctgtgggcatggctgctgctgctgctgtggccaccgggaagaagaggaagaggcctcatgtgtttgagagcaaccccagcatcaggaagaggcagcagacccggctgctgaggaagctgcgggccaccctggatgagtacaccaccagggtgggccagcaggccatcgtgctgtgcatcagccccagcaagcccaaccctgtgttcaaggtgtttggagctgcccccctggagaatgtggtgaggaagtacaagtccatgatcctggaggacctggagagcgccctggccgagcacgccccagccccccaggaggtgaacagcgagctgccccccctgaccattgatggcatccctgtgtctgtggacaagatgacccaggcccagctgcgggccttcatcccctag

SEQ ID NO: 162398 - DNA, 1029 bp, Artificial Sequence
  Description of Artificial Sequence: Synthetic coding sequence
atgatcctggaggacctggagagcgccctggccgagcacgccccagccccccaggaggtgaacagcgagctgccccccctgaccattgatggcatccctgtgtctgtggacaagatgacccaggcccagctgcgggccttcatccctgagatgctgaagtacagcacaggccggggcaagccaggctggggcaaggagagctgcaagcccatctggtggccagaggacatcccctgggccaacgtgcggagtgatgtgaggacagaggagcagaagcagagggtgtcctggacccaggccctgcggaccatcgtgaagaactgctacaagcagcacggccgggaggacctgctgtatgcctttgaggaccagcagacccagacccaggccacagccacccacagcatcgcccacctggtgcccagccagacagtggtgcagaccttcagcaacccagatggcaccgtgtccctcatccaggtgggcactggagccaccgtggccaccctggctgatgccagcgagctgcccaccaccgtgacagtggcccaggtgaactacagcgctgtggctgatggagaggtggagcagaactgggccaccctgcagggcggggagatgaccatccagaccacccaggccagcgaggccacccaggccgtggccagcctggccgaggccgctgtggccgccagccaggagatgcagcagggcgccaccgtgaccatggccctgaacagcgaggccgccgcccatgctgtggccaccctggccgaggccaccctgcagggcggcggccagatcgtgctgtctggagaaacagctgctgctgtgggcgccctgactggagtgcaggatgccaacggcctggtgcagatccctgtgtccatgtaccagacagtggtgaccagcctggcccagggcaatggacctgtgcaggtggccatggcccctgtgaccacccgcatcagtgacagcgctgtgaccatggatggccaggccgtggaggtggtgaccctggagcagtag

SEQ ID NO: 162399 - DNA, 1860 bp, Artificial Sequence
  Description of Artificial Sequence: Synthetic coding sequence
atggctgatgagggcaagagctacagcgagcatgatgatgagcgggtgaacttcccccagaggaagaagaagggccggggccccttccgctggaagtatggagagggcaacagaagaagtggccggggcggcagcggcatccgcagcagccggctggaggaggatgatggagatgtggccatgtctgatgcccaggacggcccccgggtgcgctacaacccctacaccacccggcccaacagaagaggagacacctggcatgaccgggaccgcatccacgtgacagtgagaagagaccgggcccctcctgagcggggcggggccggcaccagccaggacggcaccagcaagaactggttcaagatcaccatcccctacggcaggaaatatgacaaggcctggctgctgtccatgatccagagcaagtgcagcgtgcccttcacccccatcgagttccactatgagaacacccgggcccagttctttgtggaggatgccagcacagccagcgccctgaaggctgtgaactacaagatcctggacagagaaaatcgccgcatcagcatcatcatcaacagcagcgccccaccccacaccatcctgaatgagctgaagccagagcaggtggagcagctgaagctgatcatgagcaagagatatgatggcagccagcaggccctggacctgaagggcctgcggagtgaccctgacctggtggcccagaacattgatgtggtgctgaacagaagaagctgcatggccgccaccctgcgcatcatcgaggagaacatccctgagctgctgagcctgaacctgagcaacaacagactctaccgcctggatgacatgagcagcatcgtgcagaaggcccccaacctgaagatcctgaacctgtctggaaatgagctgaagtctgagcgggagctggacaagatcaagggcctgaagctggaggagctgtggctggatggcaacagcctgtgtgacaccttccgggaccagagcacctacatcagcgccatccgggagcgcttccccaagctgctgcggctggatggccacgagctgcccccacccatcgcctttgatgtggaggcccccaccaccctgcccccctgcaagggcagctacttcggcacagagaacctgaagagcctggtgctgcacttcctgcagcagtactatgccatctatgacagcggggaccggcagggcctgctggatgcctaccatgatggagcctgctgcagcctgagcatccccttcatcccccagaacccagcccggagcagcctggccgagtacttcaaggacagcagaaatgtgaagaagctgaaggaccccaccctgcgcttccggctgctgaagcacacccggctgaatgtggtggccttcctgaatgagctgcccaagacccagcatgatgtgaacagctttgtggtggacatcagcgcccagaccagcaccctgctgtgcttctctgtgaatggagtcttcaaggaggtggatggcaagagccgggacagcctgcgggccttcaccaggaccttcatcgctgtgcctgccagcaacagcggcctgtgcatcgtgaatgatgagctgtttgtgagaaatgccagcagcgaggagatccagagggcctttgccatgcctgcccccacccccagcagcagccctgtgcccaccctgagccctgagcagcaggagatgctgcaggccttcagcacccagagcggcatgaacctggagtggagccagaagtgcctgcaggacaacaactgggactacaccaggtctgcccaggccttcacccacctgaaggccaagggggagatccctgaggtggccttcatgaagtag

SEQ ID NO: 162400 - DNA, 1071 bp, Artificial Sequence
  Description of Artificial Sequence: Synthetic coding sequence
atggctgatgagggcaagagctacagcgagcatgatgatgagcgggtgaacttcccccagaggaagaagaagggccggggccccttccgctggaagtatggagagggcaacagaagaagtggccggggcggcagcggcatccgcagcagccggctggaggaggatgatggagatgtggccatgtctgatgcccaggacggcccccgggtgcgctacaacccctacaccacccggcccaacagaagaggagacacctggcatgaccgggaccgcatccacgtgacagtgagaagagaccgggcccctcctgagcggggcggggccggcaccagccaggacggcaccagcaagaactggttcaagatcaccatcccctacggcaggaaatatgacaaggcctggctgctgtccatgatccagagcaagtgcagcgtgcccttcacccccatcgagttccactatgagaacacccgggcccagttctttgtggaggatgccagcacagccagcgccctgaaggctgtgaactacaagatcctggacagagaaaatcgccgcatcagcatcatcatcaacagcagcgccccaccccacaccatcctgaatgagctgaagccagagcaggtggagcagctgaagctgatcatgagcaagagatatgatggcagccagcaggccctggacctgaagggcctgcggagtgaccctgacctggtggcccagaacattgatgtggtgctgaacagaagaagctgcatggccgccaccctgcgcatcatcgaggagaacatccctgagctgctgagcctgaacctgagcaacaacagactctaccgcctggatgacatgagcagcatcgtgcagaaggcccccaacctgaagatcctgaacctgtctggaaatgagctgaagtctgagcgggagctggacaagatcaagggcctgaagctggaggagctgtggctggatggcaacagcctgtgtgacaccttccgggaccagagcacctacatccgctctgtggtggcctgtgtgtccccacctggggacctgcaccccctgggcggctag

SEQ ID NO: 162401 - DNA, 1071 bp, Artificial Sequence; identical to SEQ ID NO: 162400
  Description of Artificial Sequence: Synthetic coding sequence

SEQ ID NO: 162402 - DNA, 1860 bp, Artificial Sequence; identical to SEQ ID NO: 162399
  Description of Artificial Sequence: Synthetic coding sequence

SEQ ID NO: 162403 - DNA, 1881 bp, Artificial Sequence
  Description of Artificial Sequence: Synthetic coding sequence
atgtgcagcaccctgaagaagtgtggcacctacagaacagaggtggctgaatgtcatgaccacggcagcaccttccagggcaggaagaagggcggcagcagcttccgggacaactttgacaagaggagctgccactatgagcacggcggctatgagcggccccccagccactgccaggagaatgatggctctgtggagatgagagatgtgcacaaggaccagcagctgcggcacaccccctacagcatccgctgtgaaagaaggatgaagtggcacagtgaagatgagatccgcatcaccacctggaggaacaggaagcccccagagaggaagatgagccagaacacccaggacggctacaccaggaactggttcaaggtgaccatcccctacggcatcaagtatgacaaggcctggctgatgaacagcatccagagccactgcagcgaccgcttcacccctgtggacttccactacgtgaggaacagagcctgcttctttgtgcaggatgccagcgctgccagcgccctgaaggatgtgtcctacaagatctatgatgatgagaaccagaagatctgcatctttgtgaaccacagcacagccccctacagcgtgaagaacaagctgaagccaggccagatggagatgctgaagctgaccatgaacaagcgctacaacgtgtcccagcaggccctggacctgcagaacctgcgctttgatcctgacctgatgggccgggacatcgacatcatcctgaacagaagaaactgcatggccgccaccctgaagatcattgaaagaaacttccctgagctgctgagcctgaacctgtgcaacaacaagctgtaccagctggatggcctgagtgacatcacagagaaggcccccaaggtgaagaccctgaacctgagcaagaacaagctggagagcgcctgggagctgggcaaggtgaagggcctgaagctggaggagctgtggctggagggcaaccccctgtgcagcaccttcagtgaccagagcgcctacgtgtctgccatccgggactgcttccccaagctgctgcggctggatggccgggagctgagcgcccctgtgattgtggacatcgacagcagcgagaccatgaagccctgcaaggagaacttcaccggcagcgagaccctgaagcacctggtgctgcagttcctgcagcagtactacagcatctatgattctggggaccggcagggcctgctgggcgcctaccatgatgaggcctgcttcagcctggccatcccctttgaccccaaggacagcgcccccagcagcctgtgcaagtactttgaggacagcaggaacatgaagaccctgaaggacccctacctgaagggggagctgctgcggaggaccaagagggacatcgtggacagcctgagcgccctgcccaagacccagcacgacctgagcagcatcctggtggatgtgtggtgccagacagagaggatgctgtgcttctctgtgaatggagtcttcaaggaggtggagggccagagccagggctctgtgctggccttcaccaggaccttcatcgccaccccaggcagcagcagcagcctgtgcatcgtgaatgatgagctgtttgtgagagatgccagcccccaggagacccagagcgccttcagcatccctgtgtccaccctgagcagcagcagcgagcccagcctgagccaggagcagcaggagatggtgcaggccttcagcgcccagagcggcatgaagctggagtggagccagaagtgcctgcaggacaatgagtggaactacacccgggccggccaggccttcaccatgctgcagacagagggcaagatcccagctgaggccttcaagcagatctcctag

SEQ ID NO: 162404 - DNA, 1881 bp, Artificial Sequence; identical to SEQ ID NO: 162403
  Description of Artificial Sequence: Synthetic coding sequence

SEQ ID NO: 162405 - DNA, 1881 bp, Artificial Sequence; identical to SEQ ID NO: 162403
  Description of Artificial Sequence: Synthetic coding sequence

SEQ ID NO: 162406 - DNA, 1230 bp, Artificial Sequence
  Description of Artificial Sequence: Synthetic coding sequence
atgaagtggcacagtgaagatgagatccgcatcaccacctggaggaacaggaagcccccagagaggaagatgagccagaacacccaggacggctacaccaggaactggttcaaggtgaccatcccctacggcatcaagtatgacaaggcctggctgatgaacagcatccagagccactgcagcgaccgcttcacccctgtggacttccactacgtgaggaacagagcctgcttctttgtgcaggatgccagcgctgccagcgccctgaaggatgtgtcctacaagatctatgatgatgagaaccagaagatctgcatctttgtgaaccacagcacagccccctacagcgtgaagaacaagctgaagccaggccagatggagatgctgaagctgaccatgaacaagcgctacaacgtgtcccagcaggccctggacctgcagaacctgcgctttgatcctgacctgatgggccgggacatcgacatcatcctgaacagaagaaactgcatggccgccaccctgaagatcattgaaagaaacttccctgagctgctgagcctgaacctgtgcaacaacaagctgtaccagctggatggcctgagtgacatcacagagaaggcccccaaggtgaagaccctgaacctgagcaagaacaagctggagagcgcctgggagctgggcaaggtgaagggcctgaagctggaggagctgtggctggagggcaaccccctgtgcagcaccttcagtgaccagagcgcctacgtgtctgccatccgggactgcttccccaagctgctgcggctggatggccgggagctgagcgcccctgtgattgtggacatcgacagcagcgagaccatgaagccctgcaaggagaacttcaccggcagcgagaccctgaagcacctggtgctgcagttcctgcagcagtactacagcatctatgattctggggaccggcagggcctgctgggcgcctaccatgatgaggcctgcttcagcctggccatcccctttgaccccaaggacagcgcccccagcagcctgtgcaagtactttgaggacagcaggaacatgaagaccctgaaggacccctacctgaagggggagctgctgcggaggaccaagagggacatcgtggacagcctgagcgccctgcccaagacccagcacgacctgagcagcatcctggtggatgtgtggtgccagacagtgcccagcggccagtag

SEQ ID NO: 162407 - DNA, 1881 bp, Artificial Sequence; identical to SEQ ID NO: 162403
  Description of Artificial Sequence: Synthetic coding sequence

SEQ ID NO: 162408 - DNA, 1596 bp, Artificial Sequence
  Description of Artificial Sequence: Synthetic coding sequence
atgagcctgcccagcggccacaccaccggccacacagaccaggtggtgcagaggcgggcccgctgctgggacatctaccagaggcgcttcagcagccgctctgagcctgtgaaccctggcatgcacagcagcagccaccagcagcaggatggagatgctgccatgcacggggcccacatggacagccctgtgcgctacaccccctacaccatcagcccctacaacaggaagggcagcttcaggaagcaggaccagacccacgtgaacatggagcgggagcagaagcccccagagaggaggatggagggcaacatgccagatggcaccctgggctcctggttcaagatcaccgtgcccttcggcatcaagtacaatgagaagtggctgctgaacctgatccagaatgaatgttctgtgccctttgtgcctgtggagttccactatgagaacatgcacgccagcttctttgtggagaatgccagcatcgcctatgccctgaagaatgtgtctgggaagatctgggatgaggacaatgagaagatcagcatctttgtgaacccagctggcatcccccactttgtgcaccgggagctgaagtctgagaaggtggagcagatcaagctggccatgaaccagcagtgtgatgtgtcccaggaggccctggacatccagaggctgcccttctacccagacatggtgaacagagacaccaagatggccagcaaccccaggaagtgcatggccgccagcctggatgtgcatgaggagaacatccccaccgtgatgtctgctggggagatggacaagtggaagggcatcgagcctggagagaagtgtgccgacaggagccctgtgtgcaccaccttcagtgacaccagcagcaacatcaacagcatcctggagctgttccccaagctgctgtgcctggatggccagcagagcccccgggccaccctgtgtggcacagaggcccacaagaggctgcccacctgcaagggcagcttcttcggcagcgagatgctgaagaacctggtgctgcagttcctgcagcagtactacctgatctatgacagcggggaccggcagggcctgctgagcgcctaccatgatgaggcctgcttcagcctgagcatccccttcaacccagaagattctgcccccagcagcttctgcaagttcttcaaggacagcaggaacatcaagatcctgaaggacccctacctgcggggggagctgctgaagcacaccaagctggacatcgtggacagcctgagcgccctgcccaagacccagcacgacctgagcagcttcctggtggacatgtggtaccagacagagtggatgctgtgcttctctgtgaatggagtcttcaaggaggtggagggccagagccagggctctgtgctggccttcaccaggaccttcatcgccaccccaggcagcagcagcagcctgtgcatcgtgaatgacaagctgtttgtgcgggacaccagccaccagggcacccagagcgccctcttcaccctggtgcccacagccttcagcagctctgtgcctgccttcagccaggagcagcagaagatgctgcccagctag

SEQ ID NO: 162409 - DNA, 702 bp, Artificial Sequence
  Description of Artificial Sequence: Synthetic coding sequence
atggagcgggagcagaagcccccagagaggaggatggagggcaacatgccagatggcaccctgggctcctggttcaagatcaccgtgcccttcggcatcaagtacaatgagaagtggctgctgaacctgatccagaatgaatgttctgtgccctttgtgcctgtggagttccactatgagaacatgcacgccagcttctttgtggagaatgccagcatcgcctatgccctgaagaatgtgtctgggaagatctgggatgaagataatgagaagatcagcatctttgtgaacccagctggcatcccccactttgtgcaccgggagctgaagtctgagaaggtggagcagatcaagctggccatgaaccagcagtgtgatgtgtcccaggaggccctggacatccagaggctgcccttctacccagacatggtgaacagagacaccaagatggccagcaaccccaggaagtgcatggccgccagcctggatgtgcatgaggagaacatccccaccgtgatgtctgctggggagatggacaagtggaagggcatcgagcccggggagaagtgtgccgacaggagccctgtgtgcaccaccttcagtgacaccagcagcaacatcaagtctgtggtgcccagcgtgaccacctgggaccctgacctgtgcctgattgcccccttctgcagaagacggcagcactag

SEQ ID NO: 162410 - DNA, 612 bp, Artificial Sequence
  Description of Artificial Sequence: Synthetic coding sequence
atggccagcagccaccctgagcagctgtatgtggtgctgaagcccacccggggctaccagcctgtgcgctactacctgatctatgacagcggggaccggcagggcctgctgagcgcctaccatgatgaggcctgcttcagcctgagcatccccttcaacccagaagattctgcccccagcagcttctgcaagttcttcaaggacagcaggaacatcaagatcctgaaggacccctacctgcggggggagctgctgaagcacaccaagctggacatcgtggacagcctgagcgccctgcccaagacccagcacgacctgagcagcttcctggtggacatgtggtaccagacagagtggatgctgtgcttctctgtgaatggagtcttcaaggaggtggagggccagagccagggctctgtgctggccttcaccaggaccttcatcgccaccccaggcagcagcagcagcctgtgcatcgtgaatgacaagctgtttgtgcgggacaccagccaccagggcacccagagcgccctcttcaccctggtgcccacagccttcagcagctctgtgcctgccttcagccaggagcagcagaagatgctgcccagctag

SEQ ID NO: 162411 - DNA, 1086 bp, Artificial Sequence
  Description of Artificial Sequence: Synthetic coding sequence
tgaaatgagaagtggctgctgaacctgatccagaatgaatgttctgtgccctttgtgcctgtggagttccactatgagaacatgcacgccagcttctttgtggagaatgccagcatcgcctatgccctgaagaatgtgtctgggaagatctgggatgaagataatgagaagatcagcatctttgtgaacccagctggcatcccccactttgtgcaccgggagctgaagtctgagaaggtggagcagatcaagctggccatgaaccagcagtgtgatgtgtcccaggaggccctggacatccagaggctgcccttctacccagacatggtgaacagagacaccaagatggccagcaaccccaggaagtgcatggccgccagcctggatgtgcatgaggagaacatccccaccgtgatgtctgctggggagatggacaagtggaagggcatcgagcccggggagaagtgtgccgacaggagccctgtgtgcaccaccttcagtgacaccagcagcaacatcaacagcatcctggagctgttccccaagctgctgtgcctggatggccagcagagcccccgggccaccctgtgtggcacagaggcccacaagaggctgcccacctgcaagggcagcttctttggaagtgagatgctgaagaacctggtgctgcagttcctgcagcagtactacctgatctatgattctggggaccggcagggcctgctgagcgcctaccatgatgaggcctgcttcagcctgagcatccccttcaaccctgaggacagcgcccccagcagcttctgcaagttcttcaaggacagcaggaacatcaagatcctgaaggacccctacctgcggggggagctgctgaagcacaccaagctggacatcgtggacagcctgagcgccctgcccaagacccagcacgacctgagcagcttcctggtggacatgtggtaccagacagagtggatgctgtgcttctctgtgaatggagtcttcaaggaggtgtctggcttctgcagccggctgcacccagacctgcactgctacccctggcagcagttccagagcgtgcacaggtag

SEQ ID NO: 162412 - DNA, 1194 bp, Artificial Sequence
  Description of Artificial Sequence: Synthetic coding sequence
atgagaagaaacacccaggatgagaacatgaggaagtggttcaaggtgaccatcccctacggcatcaagtatgacaaggcctggctgatgaacagcatccagagcaactgcagcgtgcccttcacccctgtggacttccactacatccggaacagagcctgcttctttgtgcaggtggccagcgctgccagcgccctgaaggatgtgtcctacaagatctatgatgatgagaaccagaagatctgcatctttgtgagccacttcaccgccccctacagcgtgaagaacaagctgaagccaggccagatggagatgctgaagctgaccatgaacaagcgctacaacgtgtcccagcaggccctggacctgcagaacctgcgctttgatcctgacctgatgggccgggacatcgacatcatcctgaacagaagaaactgcatggccgccaccctgaagatcacagagaggaacttccctgagctgctgagcctgaacctgtgcaacaacaagctgtaccagctggatggcctgagtgacatcacagagaaggcccccaaggtgaagaccctgaacctgagcaagaacaagctggagagcgcctgggagctgggcaaggtgaagggcctgaagctggaggagctgtggctggagggcaaccccctgtgcagcaccttcagtgaccagagcgcctacgtgtctgccatccgggactgcttccccaagctgctgcggctggatggccgggagctgagcgcccctgtgattgtggacatcgacagcagcgagaccatgaagccctgcaaggagaacttcaccggcagcgagaccctgaagcacctggtgctgcagttcctgcagcagagcaacctgtgcaagtacttcaaggacagcaggaacatcaagatcctgaaggacccctacctgcagaggaagctgctgaagcacaccaagtgccccagaaatgtggacagcctgagcgccctgcctgagacccagcacgacttcaccagcatcctggtggacatgtggtaccagacagtgaacacctgcttcctgcccagggctggccctgagagccagcgctggtggtgcctgctgagcctgaagtggaaggatggcctgcgggtgctgatcctgcccagctgtggccccagcagcctgcccctggccgccatccctgtgtgtgccagctag

SEQ ID NO: 162413 - DNA, 1194 bp, Artificial Sequence; identical to SEQ ID NO: 162412
  Description of Artificial Sequence: Synthetic coding sequence

SEQ ID NO: 162414 - DNA, 1098 bp, Artificial Sequence
  Description of Artificial Sequence: Synthetic coding sequence
atgagaagaaacacccaggatgagaacatgaggaagtggttcaaggtgaccatcccctacggcatcaagtatgacaaggcctggctgatgaacagcatccagagcaactgcagcgtgcccttcacccctgtggacttccactacatccggaacagagcctgcttctttgtgcaggtggccagcgctgccagcgccctgaaggatgtgtcctacaagatctatgatgatgagaaccagaagatctgcatctttgtgagccacttcaccgccccctacagcgtgaagaacaagctgaagccaggccagatggagatgctgaagctgaccatgaacaagcgctacaacgtgtcccagcaggccctggacctgcagaacctgcgctttgatcctgacctgatgggccgggacatcgacatcatcctgaacagaagaaactgcatggccgccaccctgaagatcacagagaggaacttccctgagctgctgagcctgaacctgtgcaacaacaagctgtaccagctggatggcctgagtgacatcacagagaaggcccccaaggtgaagaccctgaacctgagcaagaacaagctggagagcgcctgggagctgggcaaggtgaagggcctgaagctggaggagctgtggctggagggcaaccccctgtgcagcaccttcagtgaccagagcgcctacgtgtctgccatccgggactgcttccccaagctgctgcggctggatggccgggagctgagcgcccctgtgattgtggacatcgacagcagcgagaccatgaagccctgcaaggagaacttcaccggcagcgagaccctgaagcacctggtgctgcagttcctgcagcagagcaacctgtgcaagtacttcaaggacagcaggaacatcaagatcctgaaggacccctacctgcagaggaagctgctgaagcacaccaagtgccccagaaatgtggacagcctgagcgccctgcctgagacccagcacgacttcaccagcatcctggtggacatgtggtaccagacagtgaacacctgcttcctgcccagggctggccctgagagccagagcctgcggcccctgtag

SEQ ID NO: 162415 - DNA, 1098 bp, Artificial Sequence; identical to SEQ ID NO: 162414
  Description of Artificial Sequence: Synthetic coding sequence

SEQ ID NO: 162416 - DNA, 1044 bp, Artificial Sequence
  Description of Artificial Sequence: Synthetic coding sequence
atggagcagtacacagccaacagcaacagcagcacagagcagatcgtggtgcaggccggccagatccagcagcagcagcagggcggcgtgacagctgtgcagctgcagacagaggcccaggtggccagcgccagcggccagcaggtgcagaccctgcaggtggtgcagggccagcccctgatggtgcaggtgtctgggggccagctgatcaccagcacaggccagcccatcatggtgcaggccgtgcctgggggccagggccagaccatcatgcaggtgcctgtgtctggcacccagggcctgcagcagatccagctggtgcccccaggccagatccagatccagggcggccaggccgtgcaggtgcagggccagcagggccagacccagcagatcatcatccagcagccccagacagctgtgacagctggccagacccagacccagcagcagattgctgtgcagggccagcaggtggcccagacagctgagggccagaccatcgtgtaccagcctgtgaatgctgatggcaccatcctgcagcaggtgacagtgcctgtgtctggcatgatcaccatcccagctgccagcctggccggggcccagatcgtgcagacaggagccaacaccaacaccaccagcagcggccagggcaccgtgacagtgaccctgcctgtggccggaaatgtggtgaacagcggcggcatggtgatgatggtgcctggagctggctctgtgcctgccatccagaggatccccctgcctggagctgagatgctggaggaggagcccctgtatgtgaatgccaagcagtaccaccgcatcctgaagaggcggcaggcccgggccaagctggaggccgagggcaagatccccaaggagaggaggaagtacctgcacgagagccgccacagacatgccatggccaggaagagaggagagggcggccgcttcttcagccccaaggagaaggacagcccccacatgcaggaccccaaccaggctgatgaggaggccatgacccagatcatccgggtgtcctag

SEQ ID NO: 162417 - DNA, 957 bp, Artificial Sequence
  Description of Artificial Sequence: Synthetic coding sequence
atggagcagtacacagccaacagcaacagcagcacagagcagatcgtggtgcaggccggccagatccagcagcaggtgcagggccagcccctgatggtgcaggtgtctgggggccagctgatcaccagcacaggccagcccatcatggtgcaggccgtgcctgggggccagggccagaccatcatgcaggtgcctgtgtctggcacccagggcctgcagcagatccagctggtgcccccaggccagatccagatccagggcggccaggccgtgcaggtgcagggccagcagggccagacccagcagatcatcatccagcagccccagacagctgtgacagctggccagacccagacccagcagcagattgctgtgcagggccagcaggtggcccagacagctgagggccagaccatcgtgtaccagcctgtgaatgctgatggcaccatcctgcagcaggtgacagtgcctgtgtctggcatgatcaccatcccagctgccagcctggccggggcccagatcgtgcagacaggagccaacaccaacaccaccagcagcggccagggcaccgtgacagtgaccctgcctgtggccggaaatgtggtgaacagcggcggcatggtgatgatggtgcctggggccggctctgtgcctgccatccagaggatccccctgcccggggctgagatgctggaggaggagcccctgtatgtgaatgccaagcagtaccaccgcatcctgaagaggcggcaggcccgggccaagctggaggccgagggcaagatccccaaggagaggaggaagtacctgcacgagagccgccacagacatgccatggccaggaagagaggagagggcggccgcttcttcagccccaaggagaaggacagcccccacatgcaggaccccaaccaggctgatgaggaggccatgacccagatcatccgggtgtcctag

SEQ ID NO: 162418 - DNA, 624 bp, Artificial Sequence
  Description of Artificial Sequence: Synthetic coding sequence
atgaccatggatggagacagcagcaccacagatgccagccagctgggcatctctgctgactacatcggcggcagccactacgtgatccagccccatgatgacacagaggacagcatgaatgaccacgaggacaccaacggcagcaaggagagcttccgggagcaggacatctacctgcccatcgccaacgtggcccgcatcatgaagaatgccatcccccagacaggcaagatcgccaaggatgccaaggaatgtgtgcaggagtgtgtgtctgagttcatctccttcatcaccagcgaggccagcgagcgctgccaccaggagaagaggaagaccatcaacggggaggacatcctgtttgccatgagcaccctgggctttgacagctatgtggagcccctgaagctgtacctgcagaagttccgggaggccatgaagggggagaagggcattggaggagctgtgacagccacagatggcctgtctgaggagctgacagaggaggccttcaccaaccagctgcctgctggcctcatcaccacagatggccagcagcagaatgtgatggtgtacaccaccagctaccagcagatctctggagtgcagcagatccagttctcctag

SEQ ID NO: 162419 - DNA, 624 bp, Artificial Sequence; identical to SEQ ID NO: 162418
  Description of Artificial Sequence: Synthetic coding sequence

SEQ ID NO: 162420 - DNA, 1377 bp, Artificial Sequence
  Description of Artificial Sequence: Synthetic coding sequence
atgagcacagaaggaggctttggaggcaccagcagcagtgatgcccagcagagcctgcagagcttctggccccgggtgatggaggagatccggaacctgactgtgaaggacttccgggtgcaggagctgcccctggcccgcatcaagaagatcatgaagctggatgaagatgtgaagatgatctctgctgaggcccctgtgctgtttgccaaggccgcccagatcttcatcacagagctgaccctgcgggcctggatccacacagaggacaacaagaggaggaccctgcagagaaatgacatcgccatggccatcaccaagtttgaccagtttgacttcctgattgatattgtgcccagagatgagctgaagccacccaagaggcaggaggaggtgcggcagagcgtgaccccagctgagcctgtgcagtactacttcaccctggcccagcagcccacagctgtgcaggtgcagggccagcagcagggccagcagaccaccagcagcaccaccaccatccagcccggccagatcatcatcgcccagccccagcagggccagaccacccctgtgaccatgcaggtgggggagggccagcaggtgcagatcgtgcaggcccagccccagggccaggcccagcaggcccagagcggcaccggccagaccatgcaggtgatgcagcagatcatcaccaacacaggagagatccagcagatccctgtgcagctgaatgccggccagctgcagtacatccggctggcccagcctgtgtctggcacccaggtggtgcagggccagatccagaccctggccaccaatgcccagcagggccagagaaatgccagccagggcaagccccggcgctgcctgaaggagaccctgcagatcacccagacagaggtgcagcagggccagcagcagttcagccagttcacagatggccagaggaacagcgtgcagcaggcccgggtgtctgagctgaccggggaggccgagccccgggaggtgaaggccactggaaacagcaccccctgcaccagcagcctgcccaccacccacccccccagccacagagctggggccagctgtgtgtgctgcagccagccccagcagagcagcaccagccccccacccagtgatgccctgcagtgggtggtggtggaggtgtctggcacccccaaccagctggagacccaccgggagctgcacgcccccctgcccggcatgaccagcctgagccccctgcaccccagccagcagctgtaccagatccagcaggtgaccatgcctgctggccaggacctggcccagcccatgttcatccagagcgccaaccagcccagtgatggccaggccccccaggtgactggagactag

SEQ ID NO: 162421 - DNA, 1008 bp, Artificial Sequence
  Description of Artificial Sequence: Synthetic coding sequence
atgagcacagaaggaggctttggaggcaccagcagcagtgatgcccagcagagcctgcagagcttctggccccgggtgatggaggagatccggaacctgactgtgaaggacttccgggtgcaggagctgcccctggcccgcatcaagaagatcatgaagctggatgaagatgtgaagatgatctctgctgaggcccctgtgctgtttgccaaggccgcccagatcttcatcacagagctgaccctgcgggcctggatccacacagaggacaacaagaggaggaccctgcagagaaatgacatcgccatggccatcaccaagtttgaccagtttgacttcctgattgatattgtgcccagagatgagctgaagccacccaagaggcaggaggaggtgcggcagagcgtgaccccagctgagcctgtgcagtactacttcaccctggcccagcagcccacagctgtgcaggtgcagggccagcagcagggccagcagaccaccagcagcaccaccaccatccagcccggccagatcatcatcgcccagccccagcagggccagaccacccctgtgaccatgcaggtgggggagggccagcaggtgcagatcgtgcaggcccagccccagggccaggcccagcaggcccagagcggcaccggccagaccatgcaggtgatgcagcagatcatcaccaacacaggagagatccagcagatccctgtgcagctgaatgccggccagctgcagtacatccggctggcccagcctgtgtctggcacccaggtggtgcagggccagatccagaccctggccaccaatgcccagcagatcacccagacagaggtgcagcagggccagcagcagttcagccagttcacagatggccagcagctgtaccagatccagcaggtgaccatgcctgctggccaggacctggcccagcccatgttcatccagagcgccaaccagcccagtgatggccaggccccccaggtgactggagactag

SEQ ID NO: 162422 - DNA, 1320 bp, Artificial Sequence
  Description of Artificial Sequence: Synthetic coding sequence
atgagcacagaaggaggctttggaggcaccagcagcagtgatgcccagcagagcctgcagagcttctggccccgggtgatggaggagatccggaacctgactgtgaaggacttccgggtgcaggagctgcccctggcccgcatcaagaagatcatgaagctggatgaagatgtgaagatgatctctgctgaggcccctgtgctgtttgccaaggccgcccagatcttcatcacagagctgaccctgcgggcctggatccacacagaggacaacaagaggaggaccctgcagagaaatgacatcgccatggccatcaccaagtttgaccagtttgacttcctgattgatattgtgcccagagatgagctgaagccacccaagaggcaggaggaggtgcggcagagcgtgaccccagctgagcctgtgcagtactacttcaccctggcccagcagcccacagctgtgcaggtgcagggccagcagcagggccagcagaccaccagcagcaccaccaccatccagcccggccagatcatcatcgcccagccccagcagggccagaccacccctgtgaccatgcaggtgggggagggccagcaggtgcagatcgtgcaggcccagccccagggccaggcccagcaggcccagagcggcaccggccagaccatgcaggtgatgcagcagatcatcaccaacacaggagagatccagcagatccctgtgcagctgaatgccggccagctgcagtacatccggctggcccagcctgtgtctggcacccaggtggtgcagggccagatccagaccctggccaccaatgcccagcagatcacccagacagaggtgcagcagggccagcagcagttcagccagttcacagatggccagagaaattctgtgcagcaggcccgggtgtctgagctgactggagaggccgagccccgggaggtgaaggccaccggcaacagcaccccctgcaccagcagcctgcccaccacccacccccccagccaccgggccggggccagctgtgtgtgctgcagccagccccagcagagcagcaccagccccccacccagtgatgccctgcagtgggtggtggtggaggtgtctggcacccccaaccagctggagacccaccgggagctgcacgcccccctgcccggcatgaccagcctgagccccctgcaccccagccagcagctgtaccagatccagcaggtgaccatgcctgctggccaggacctggcccagcccatgttcatccagagcgccaaccagcccagtgatggccaggccccccaggtgactggagactag

SEQ ID NO: 162423 - DNA, 906 bp, Artificial Sequence
  Description of Artificial Sequence: Synthetic coding sequence
atgagcacagaaggaggctttggaggcaccagcagcagtgatgcccagcagagcctgcagagcttctggccccgggtgatggaggagatccggaacctgactgtgaaggacttccgggtgcaggagctgcccctggcccgcatcaagaagatcatgaagctggatgaagatgtgaagatgatctctgctgaggcccctgtgctgtttgccaaggccgcccagatcttcatcacagagctgaccctgcgggcctggatccacacagaggacaacaagaggaggaccctgcagagaaatgacatcgccatggccatcaccaagtttgaccagtttgacttcctgattgatattgtgcccagagatgagctgaagccacccaagaggcaggaggaggtgcggcagagcgtgaccccagctgagcctgtgcagtactacttcaccctggcccagcagcccacagctgtgcaggtgcagggccagcagcagggccagcagaccaccagcagcaccaccaccatccagcccggccagatcatcatcgcccagccccagcagggccagaccatgcaggtgatgcagcagatcatcaccaacacaggagagatccagcagatccctgtgcagctgaatgccggccagctgcagtacatccggctggcccagcctgtgtctggcacccaggtggtgcagggccagatccagaccctggccaccaatgcccagcagatcacccagacagaggtgcagcagggccagcagcagttcagccagttcacagatggccagcagctgtaccagatccagcaggtgaccatgcctgctggccaggacctggcccagcccatgttcatccagagcgccaaccagcccagtgatggccaggccccccaggtgactggagactag

SEQ ID NO: 162424 - DNA, 1008 bp, Artificial Sequence; identical to SEQ ID NO: 162421
  Description of Artificial Sequence: Synthetic coding sequence

SEQ ID NO: 162425 - DNA, 702 bp, Artificial Sequence
  Description of Artificial Sequence: Synthetic coding sequence
atggccatcaccaagtttgaccagtttgacttcctgattgatattgtgcccagagatgagctgaagccacccaagaggcaggaggaggtgcggcagagcgtgaccccagctgagcctgtgcagtactacttcaccctggcccagcagcccacagctgtgcaggtgcagggccagcagcagggccagcagaccaccagcagcaccaccaccatccagcccggccagatcatcatcgcccagccccagcagggccagaccacccctgtgaccatgcaggtgggggagggccagcaggtgcagatcgtgcaggcccagccccagggccaggcccagcaggcccagagcggcaccggccagaccatgcaggtgatgcagcagatcatcaccaacacaggagagatccagcagatccctgtgcagctgaatgccggccagctgcagtacatccggctggcccagcctgtgtctggcacccaggtggtgcagggccagatccagaccctggccaccaatgcccagcagatcacccagacagaggtgcagcagggccagcagcagttcagccagttcacagatggccagcagctgtaccagatccagcaggtgaccatgagggcccggaccagccccagcccctgcagcagcagccagcccaccagccccccaactggacctcctggggaccggcggctgcgggcctag

SEQ ID NO: 162426 - DNA, 606 bp, Artificial Sequence
  Description of Artificial Sequence: Synthetic coding sequence
atggccatcaccaagtttgaccagtttgacttcctgattgatattgtgcccagagatgagctgaagccacccaagaggcaggaggaggtgcggcagagcgtgaccccagctgagcctgtgcagtactacttcaccctggcccagcagcccacagctgtgcaggtgcagggccagcagcagggccagcagaccaccagcagcaccaccaccatccagcccggccagatcatcatcgcccagccccagcagggccagaccacccctgtgaccatgcaggtgggggagggccagcaggtgcagatcgtgcaggcccagccccagggccaggcccagcaggcccagagcggcaccggccagaccatgcaggtgatgcagcagatcatcaccaacacaggagagatccagcagatccctgtgcagctgaatgccggccagctgcagtacatccggctggcccagcctgtgtctggcacccaggtggtgcagggccagatccagacccaggccatggagaccttctttgccttcaagaggcagatctacagcctgtggagggtgggcggcttcatcgccaccctcttcagcccccgggaccccggcaactag

SEQ ID NO: 162427 - DNA, 942 bp, Artificial Sequence
  Description of Artificial Sequence: Synthetic coding sequence
atgagcacagaaggaggctttggaggcaccagcagcagtgatgcccagcagagcctgcagagcttctggccccgggtgatggaggagatccggaacctgactgtgaaggacttccgggtgcaggagctgcccctggcccgcatcaagaagatcatgaagctggatgaagatgtgaagatgatctctgctgaggcccctgtgctgtttgccaaggccgcccagatcttcatcacagagctgaccctgcgggcctggatccacacagaggacaacaagaggaggaccctgcagagaaatgacatcgccatggccatcaccaagtttgaccagtttgacttcctgattgatattgtgcccagagatgagctgaagccacccaagaggcaggaggaggtgcggcagagcgtgaccccagctgagcctgtgcagtactacttcaccctggcccagcagcccacagctgtgcaggtgcagggccagcagcagggccagcagaccaccagcagcaccaccaccatccagcccggccagatcatcatcgcccagccccagcagggccagaccacccctgtgaccatgcaggtgggggagggccagcaggtgcagatcgtgcaggcccagccccagggccaggcccagcaggcccagagcggcaccggccagaccatgcaggtgatgcagcagatcatcaccaacacaggagagatccagcagatccctgagaccggcctggccgtgtccctgcggctgatgaagtgcagcggcctcatcagcgcccactgcagcttccggctgcccggcagcagtgacagccctgccagcgccagccgggtggccggcatcatcggggctgctgagtgcaggcctgctgctgtgtaccccctgagccctgcctgcatccgccacagcagctgtgccggcacagatcctgacacctgctag

SEQ ID NO: 162428 - DNA, 543 bp, Artificial Sequence
  Description of Artificial Sequence: Synthetic coding sequence
atgagcacagaaggaggctttggaggcaccagcagcagtgatgcccagcagagcctgcagagcttctggccccgggtgatggaggagatccggaacctgactgtgaaggacttccgggtgcaggagctgcccctggcccgcatcaagaagatcatgaagctggatgaagatgtgaagatgatctctgctgaggcccctgtgctgtttgccaaggccgcccagatcttcatcacagagctgaccctgcgggcctggatccacacagaggacaacaagaggaggaccctgcaggaggaggtgcggcagagcgtgaccccagctgagcctgtgcagtactacttcaccctggcccagcagcccacagctgtgcaggtgcagggccagcagcagggccagcagaccaccagcagcaccaccaccatccagcccggccagatcatcatcgcccagccccagcagggccagaccacccctgtgaccatgcaggtgggggagggccagcaggtgcagatcgtgcaggcccagccccagggccaggcctag

SEQ ID NO: 162429 - DNA, 1065 bp, Artificial Sequence
  Description of Artificial Sequence: Synthetic coding sequence
atgagcacagaaggaggctttggaggcaccagcagcagtgatgcccagcagagcctgcagagcttctggccccgggtgatggaggagatccggaacctgactgtgaaggacttccgggtgcaggagctgcccctggcccgcatcaagaagatcatgaagctggatgaagatgtgaagatgatctctgctgaggcccctgtgctgtttgccaaggccgcccagatcttcatcacagagctgaccctgcgggcctggatccacacagaggacaacaagaggaggaccctgcagagaaatgacatcgccatggccatcaccaagtttgaccagtttgacttcctgattgatattgtgcccagagatgagctgaagccacccaagaggcaggaggaggtgcggcagagcgtgaccccagctgagcctgtgcagtactacttcaccctggcccagcagcccacagctgtgcaggtgcagggccagcagcagggccagcagaccaccagcagcaccaccaccatccagcccggccagatcatcatcgcccagccccagcagggccagaccacccctgtgaccatgcaggtgggggagggccagcaggtgcagatcgtgcaggcccagccccagggccaggcccagcaggcccagagcggcaccggccagaccatgcaggtgatgcagcagatcatcaccaacacaggagagatccagcagatccctgtgcagctgaatgccggccagctgcagtacatccggctggcccagcctgtgtctggcacccaggtggtgcagggccagatccagaccctggccaccaatgcccagcagggccagagaaatgccagccagggcaagccccggcgctgcctgaaggagaccctgcagatcacccagacagaggtgcagcagggccagcagcagttcagccagttcacagatggccagcagctgtaccagatccagcaggtgaccatgcctgctggccaggacctggcccagcccatgttcatccagagcgccaaccagcccagtgatggccaggccccccaggtgactggagactag

SEQ ID NO: 162430 - DNA, 894 bp, Artificial Sequence
  Description of Artificial Sequence: Synthetic coding sequence
atgagcacagaaggaggctttggaggcaccagcagcagtgatgcccagcagagcctgcagagcttctggccccgggtgatggaggagatccggaacctgactgtgaaggacttccgggtgcaggagctgcccctggcccgcatcaagaagatcatgaagctggatgaagatgtgaagagaaatgacatcgccatggccatcaccaagtttgaccagtttgacttcctgattgatattgtgcccagagatgagctgaagccacccaagaggcaggaggaggtgcggcagagcgtgaccccagctgagcctgtgcagtactacttcaccctggcccagcagcccacagctgtgcaggtgcagggccagcagcagggccagcagaccaccagcagcaccaccaccatccagcccggccagatcatcatcgcccagccccagcagggccagaccacccctgtgaccatgcaggtgggggagggccagcaggtgcagatcgtgcaggcccagccccagggccaggcccagcaggcccagagcggcaccggccagaccatgcaggtgatgcagcagatcatcaccaacacaggagagatccagcagatccctgtgcagctgaatgccggccagctgcagtacatccggctggcccagcctgtgtctggcacccaggtggtgcagggccagatccagaccctggccaccaatgcccagcagatcacccagacagaggtgcagcagggccagcagcagttcagccagttcacagatggccagcagctgtaccagatccagcaggtgaccatgcctgctggccaggacctggcccagcccatgttcatccagagcgccaaccagcccagtgatggccaggccccccaggtgactggagactag

SEQ ID NO: 162431 - DNA, 1008 bp, Artificial Sequence; identical to SEQ ID NO: 162421
  Description of Artificial Sequence: Synthetic coding sequence

SEQ ID NO: 162432 - DNA, 1008 bp, Artificial Sequence; identical to SEQ ID NO: 162421
  Description of Artificial Sequence: Synthetic coding sequence

SEQ ID NO: 162433 - DNA, 390 bp, Artificial Sequence
  Description of Artificial Sequence: Synthetic coding sequence
atgagcacagaaggaggctttggaggcaccagcagcagtgatgcccagcagagcctgcagagcttctggccccgggtgatggaggagatccggaacctgactgtgaaggacttccgggtgcaggagctgcccctggcccgcatcaagaagatcatgaagctggatgaagatgtgaagatgatctctgctgaggcccctgtgctgtttgccaaggccgcccagatcttcatcacagagctgaccctgcgggcctggatccacacagaggacaacaagaggaggaccctgcagagaaatgacatcgccatggccatcaccaagtttgaccagtttgacttcctgattgatattgtgcccagagatgagctgaagccacccaagaggcagtag

SEQ ID NO: 162434 - DNA, 1005 bp, Artificial Sequence
  Description of Artificial Sequence: Synthetic coding sequence
atgagcacagaaggaggctttggaggcaccagcagcagtgatgcccagcagagcctgcagagcttctggccccgggtgatggaggagatccggaacctgactgtgaaggacttccgggtgcaggagctgcccctggcccgcatcaagaagatcatgaagctggatgaagatgtgaagatgatctctgctgaggcccctgtgctgtttgccaaggccgcccagatcttcatcacagagctgaccctgcgggcctggatccacacagaggacaacaagaggaggaccctgcagagaaatgacatcgccatggccatcaccaagtttgaccagtttgacttcctgattgatattgtgcccagagatgagctgaagccacccaagaggcaggaggaggtgcggcagagcgtgaccccagctgagcctgtgcagtactacttcaccctggcccagcagcccacagctgtgcaggtgcagggccagcagcagggccagcagaccaccagcagcaccaccaccatccagcccggccagatcatcatcgcccagccccagcagggccagaccacccctgtgaccatgcaggtgggggagggccagcaggtgcagatcgtgcaggcccagccccagggccaggcccagcaggcccagagcggcaccggccagaccatgcaggtgatgcagcagatcatcaccaacacaggagagatccagcagatccctgtgcagctgaatgccggccagctgcagtacatccggctggcccagcctgtgtctggcacccaggtggtgcagggccagatccagaccctggccaccaatgcccagcagatcacccagacagaggtgcagcagggccagcagcagttcagccagttcacagatggccagctgtaccagatccagcaggtgaccatgcctgctggccaggacctggcccagcccatgttcatccagagcgccaaccagcccagtgatggccaggccccccaggtgactggagactag

SEQ ID NO: 162435 - DNA, 426 bp, Artificial Sequence
  Description of Artificial Sequence: Synthetic coding sequence
atgagcacagaaggaggctttggaggcaccagcagcagtgatgcccagcagagcctgcagagcttctggccccgggtgatggaggagatccggaacctgactgtgaaggacttccgggtgcaggagctgcccctggcccgcatcaagaagatcatgaagctggatgaagatgtgaagatgatctctgctgaggcccctgtgctgtttgccaaggccgcccagatcttcatcacagagctgaccctgcgggcctggatccacacagaggacaacaagaggaggaccctgcagagaaatgacatcgccatggccatcaccaagtttgaccagtttgacttcctgattgatattgtgcccagagatgagctgaagccacccaagaggcaggaggtgcggcagagcgtgaccccagctgagcctgtgtag

SEQ ID NO: 162436 - DNA, 288 bp, Artificial Sequence
  Description of Artificial Sequence: Synthetic coding sequence
atgagcacagaaggaggctttggaggcaccagcagcagtgatgcccagcagagcctgcagagcttctggccccgggtgatggaggagatccggaacctgactgtgatgatctctgctgaggcccctgtgctgtttgccaaggccgcccagatcttcatcacagagctgaccctgcgggcctggatccacacagaggacaacaagaggaggaccctgcagagaaatgacatcgccatggccatcaccaagtttgaccagtttgacttcctgattgatattgtgccctag

SEQ ID NO: 162437 - DNA, 183 bp, Artificial Sequence
  Description of Artificial Sequence: Synthetic coding sequence
atgagcacagaaggaggctttggaggcaccagcagcagtgatgcccagcagagcctgcagagcttctggccccgggtgatggaggagatccggaacctgactgtgaaggacttccgggtgcaggagctgcccctggcccgcatcaagaagatcatgaagctggatgaagatgtgaagatgtag

SEQ ID NO: 162438 - DNA, 159 bp, Artificial Sequence
  Description of Artificial Sequence: Synthetic coding sequence
atgagcacagaaggaggctttggaggcaccagcagcagtgatgcccagcagagcctgcagagcttctggccccgggtgatggaggagatccggaacctgactgtgaaggacttccgggtgcaggagctgcccctggcccgcatcaagaagatcatgtag

SEQ ID NO: 162439 - DNA, 555 bp, Artificial Sequence
  Description of Artificial Sequence: Synthetic coding sequence
atggcccggagcctggtgcatgacacagtgttctactgcctgtctgtgtaccaggtgaagatcagccccaccccccagctgggcgccgccagcagcgctgagggccacgtgggccagggcgcccctggcctgatgggcaacatgaaccctgagggcggcgtgaaccatgaaaatggcatgaacagagatggcggcatgatccctgagggcggcggcggcaaccaggagccccggcagcagccccagcccccacctgaggagcccgcccaggccgccatggagggcccccagcctgagaacatgcagcccaggaccaggaggaccaagttcaccctgctgcaggtggaggagctggagagcgtcttccgccacacccagtacccagatgtgcccacccggcgggagctggccgagaacctgggcgtgacagaggacaaggtgcgggtgtggttcaagaacaagagggcccgctgcagaagacaccagcgggagctgatgctggccaatgagctgcgggctgaccctgatgactgtgtgtacatcgtggtggactag

SEQ ID NO: 162440 - DNA, 345 bp, Artificial Sequence
  Description of Artificial Sequence: Synthetic coding sequence
atggacaagagaagaagagccctgacccggctgtacctggacaaggccaccctcatctggaatggaaatgctgtgtctggcctggatgccctgaacaacttctttgacaccctgcccagcagcgagttccaggtgaacatgctggactgccagcctgtgcatgagcaggccacccagagccagaccaccgtgctggtggtgaccagcggcaccgtgaagtttgatggcaacaagcagcacttcttcaaccagaacttcctgctgacagcccagagcacccccaacaacacagtgtggaagatcgccagtgactgcttccgcttccaggactggagcagcagctag

SEQ ID NO: 162441 - DNA, 429 bp, Artificial Sequence
  Description of Artificial Sequence: Synthetic coding sequence
atggccaccagcctggacttcaagacctacgtggaccaggcctgcagagctgctgaggagtttgtgaacatctactatgagaccatggacaagagaagaagagccctgacccggctgtacctggacaaggccaccctcatctggaatggaaatgctgtgtctggcctggatgccctgaacaacttctttgacaccctgcccagcagcgagttccaggtgaacatgctggactgccagcctgtgcatgagcaggccacccagagccagaccaccgtgctggtggtgaccagcggcaccgtgaagtttgatggcaacaagcagcacttcttcaaccagaacttcctgctgacagcccagagcacccccaacaacacagtgtggaagatcgccagtgactgcttccgcttccaggactggagcagcagctag

SEQ ID NO: 162442 - DNA, 345 bp, Artificial Sequence; identical to SEQ ID NO: 162440
  Description of Artificial Sequence: Synthetic coding sequence

SEQ ID NO: 162443 - DNA, 882 bp, Artificial Sequence
  Description of Artificial Sequence: Synthetic coding sequence
atgacaggcctgtatgagctggtgtggagggtgctgcacgccctgctgtgcctgcacaggaccctgacctcctggctgcgggtgcgcttcggcacctggaactggatctggaggcgctgctgcagagctgccagcgctgctgtgctggcccccctgggcttcaccctgaggaagcccccagctgtgggcaggaacagaagacaccaccgccacccccggggcggcagctgcctggccgccgcccaccacaggatgcgctggagggcagatggccgcagcctggagaagctgcctgtgcacatgggcctggtgatcacagaggtggagcaggagcccagcttcagtgacatcgccagcctggtggtgtggtgcatggctgtgggcatctcctacatctctgtgtatgaccaccagggcatcttcaagaggaacaacagccggctgatggatgagatcctgaagcagcagcaggagctgctgggcctggactgcagcaagtacagccctgagtttgccaacagcaatgacaaggatgaccaggtgctgaactgccacctggccgtgaaggtgctgagcccagaagatggcaaggctgacatcgtgcgggccgcccaggacttctgccagctggtggcccagaagcagaagaggcccacagacctggatgtggacaccctggccagcctgctgagcagcaatggctgcccagaccctgacctggtgctgaagtttggacctgtggacagcaccctgggcttcctgccctggcacatccggctgacagaaattgtgtccctgcccagccacctgaacatctcctatgaggacttcttcagcgccctgcggcagtatgctgcctgtgagcagaggctgggcaagtag

SEQ ID NO: 162444 - DNA, 2571 bp, Artificial Sequence
  Description of Artificial Sequence: Synthetic coding sequence
atgaagcccaggcctgctggctttgtggacaacaagctgaagcagagggtcatccagtacctgaccagcaacaagtgtgggaagtatgtggacatcggcgtgctggccagtgacctgcagagggtgtacagcattgattatggaagaaggaagagaaatgccttccgcatccaggtggagaaggtgttcagcatcatcagcagcgagaaggagctgaagaacctgacagagctggaggatgagcacctggccaagagggcccggcagggcgaggaggacaatgagtacacagagagctacagtgatgatgacagctccatggaggactacccagacccccagagcgccaaccacatgaacagcagcctgctgagcctgtacagaaaaggaaatccagacagcgtgagcaacaccccagagatggagcagcgggagaccaccagcagcaccccccgcatcagcagcaagacaggcagcatccccctgaagaccccagccaaggacagcgagggcggctggttcatcgacaagacccccagcgtgaagaaggacagcttcttcctggacctgagctgtgagaagagcaaccccaagaagcccatcacagagatccaggacagcaaggacagcagcctgctggagagtgacatgaagaggaagggcaagctgaagaacaagggcagcaagaggaagaaggaggacctgcaggaggtggatggagaaattgaggccgtgctgcagaagaaggccaaggcccggggcctggagttccagatcagcaatgtgaagtttgaagatgtgggcggcaatgacatgaccctgaaggaggtgtgcaagatgctgatccacatgaggcaccctgaggtgtaccaccacctgggcgtggtgcccccccggggcgtgctgctgcacggccccccaggctgcggcaagaccctgctggcccacgccatcgccggggagctggacctgcccatcctgaaggtggccgcccctgagatcgtgtctggagtgtctggagagagcgagcagaagctgcgggagctgtttgagcaggccgtgtccaatgccccctgcatcatcttcattgatgaaattgatgccatcacccccaagcgggaggtggccagcaaggacatggagcggcgcatcgtggcccagctgctgacctgcatggatgacctgaacaacgtggccgccacagcccgggtgctggtgattggagccaccaacagaccagacagcctggaccctgccctgcggcgggccggccgctttgaccgggagatctgcctgggcatcccagatgaggccagccgggagcgcatcctgcagaccctgtgcaggaagctgcggctgccccaggcctttgacttctgccacctggcccacctgaccccaggctttgtgggcgctgacctgatggccctgtgccgggaggccgccatgtgtgctgtgaacagagtgctgatgaagctgcaggagcagcagaagaagaaccctgagatggaggacctgcccagcaaaggagtgcaggaggagcggctgggcacagagcccaccagcgagacccaggatgagctgcagaggctgctgggcctgctgcgggaccaggaccccctgtctgaggagcagatgcagggcctgtgcatcgagctgaatgacttcatcgtggccctgagctctgtgcagcccagcgccaagcgggagggctttgtgacagtgcccaacgtgacctgggccgacattggagccctggaggacatccgggaggagctgaccatggccatcctggcccctgtgaggaacccagaccagttcaaggccctgggcctggtgaccccagctggggtgctgctggccggccccccaggctgtgggaagaccctgctggccaaggctgtggccaatgaaagtggcctgaacttcatctctgtgaagggccctgagctgctgaacatgtatgtgggggagagcgagagagctgtgcggcaggtgttccagagggccaagaacagcgccccctgcgtcatcttctttgatgaggtggatgccctgtgccccaggagaagtgaccgggagactggagcctctgtgcgggtggtgaaccagctgctgacagagatggatggcctggaggcccggcagcaggtgttcatcatggccgccaccaacagaccagacatcatcgaccctgccatcctgcggcccggccgcctggacaagaccctgtttgtgggcctgcccccacctgctgaccggctggccatcctgaagaccatcaccaagaatggcaccaagccacccctggatgctgatgtgaacctggaggccatcgccggggacctgcgctgtgactgctacacaggagctgacctgagcgccctggtgcgggaggccagcatctgtgccctgcggcaggagatggcccggcagaagtctggaaatgagaagggggagctgaaggtgagccacaagcactttgaggaggccttcaagaaggtgcgcagcagcatcagcaagaaggaccagatcatgtatgagcggctgcaggagagcctgagcaggtag

SEQ ID NO: 162445 - DNA, 2004 bp, Artificial Sequence
  Description of Artificial Sequence: Synthetic coding sequence
atgaagaggaagggcaagctgaagaacaagggcagcaagaggaagaaggaggacctgcaggaggtggatggagaaattgaggccgtgctgcagaagaaggccaaggcccggggcctggagttccagatcagcaatgtgaagtttgaagatgtgggcggcaatgacatgaccctgaaggaggtgtgcaagatgctgatccacatgaggcaccctgaggtgtaccaccacctgggcgtggtgcccccccggggcgtgctgctgcacggccccccaggctgcggcaagaccctgctggcccacgccatcgccggggctgagtgcagcggcatgatcacagcccactgcagctttgacttcagcggcagcaatgaccccccagccagcgccagccaggagctggacctgcccatcctgaaggtggccgcccctgagatcgtgtctggagtgtctggagagagcgagcagaagctgcgggagctgtttgagcaggccgtgtccaatgccccctgcatcatcttcattgatgaaattgatgccatcacccccaagcgggaggtggccagcaaggacatggagaggagaattgtggcccagctgctgacctgcatggatgacctgaacaacgtggccgccacagcccgggtgctggtgattggagccaccaacagaccagacagcctggaccctgccctgcggcgggccggccgctttgaccgggagatctgcctgggcatcccagatgaggccagccgggagcgcatcctgcagaccctgtgcaggaagctgcggctgccccaggcctttgacttctgccacctggcccacctgaccccaggctttgtgggcgctgacctgatggccctgtgccgggaggccgccatgtgtgctgtgaacagagtgctgatgaagctgcaggagcagcagaagaagaaccctgagatggaggacctgcccagcaagggcgtgcaggaggagcggctgggcacagagcccaccagcgagacccaggatgagctgcagaggctgctgggcctgctgcgggaccaggaccccctgtctgaggagcagatgcagggcctgtgcatcgagctgaatgacttcatcgtggccctgagctctgtgcagcccagcgccaagcgggagggctttgtgacagtgcccaacgtgacctgggccgacatcggggccctggaggacatccgggaggagctgaccatggccatcctggcccctgtgagaaatccagaccagttcaaggccctgggcctggtgaccccagctggggtgctgctggccggccccccaggctgcggcaagaccctgctggccaaggctgtggccaatgaaagtggcctgaacttcatctctgtgaagggccctgagctgctgaacatgtatgtgggggagagcgagagagctgtgcggcaggtgttccagagggccaagaacagcgccccctgtgtgatcttctttgatgaggtggatgccctgtgcccccggcggagtgaccgggagaccggggcctctgtgcgggtggtgaaccagctgctgacagagatggatggcctggaggcccggcagcaggtgttcatcatggccgccaccaacagaccagacatcattgatcctgccatcctgcggcccggccgcctggacaagaccctgtttgtgggcctgcccccacctgctgaccggctggccatcctgaagaccatcaccaagaatggcaccaagccacccctggatgctgatgtgaacctggaggccatcgccggggacctgcgctgtgactgctacaccggggctgacctgagcgccctggtgcgggaggccagcatctgtgccctgcggcaggagatggcccggcagaagtctggaaatgaaaaaggagagctgaaggtgagccacaagcactttgaggaggccttcaagaaggtgcgcagcagcatcagcaagaaggaccagatcatgtatgaaaggctgcaggagagcctgagcaggtag

SEQ ID NO: 162446 - DNA, 1770 bp, Artificial Sequence
  Description of Artificial Sequence: Synthetic coding sequence
atggaggactacccagacccccagagcgccaaccacatgaacagcagcctgctgagcctgtacagaaaaggaaatccagacagcgtgagcaacaccccagagatggagcagcgggagaccaccagcagcaccccccgcatcagcagcaagacaggcagcatccccctgaagaccccagccaaggacagcgagggcggctggttcatcgacaagacccccagcgtgaagaaggacagcttcttcctggacctgagctgtgagaagagcaaccccaagaagcccatcacagagatccaggacagcaaggacagcagcctgctggagagtgacatgaagaggaagggcaagctgaagaacaagggcagcaagaggaagaaggaggacctgcaggaggtggatggagaaattgaggccgtgctgcagaagaaggccaaggcccggggcctggagttccagatcagcaatgtgaagtttgaagatgtgggcggcaatgacatgaccctgaaggaggtgtgcaagatgctgatccacatgaggcaccctgaggtgtaccaccacctgggcgtggtgcccccccggggcgtgctgctgcacggccccccaggctgcggcaagaccctgctggcccacgccatcgccggggagctggacctgcccatcctgaaggtggccgcccctgagatcgtgtctggagtgtctggagagagcgagcagaagctgcgggagctgtttgagcaggccgtgtccaatgccccctgcatcatcttcattgatgaaattgatgccatcacccccaagcgggaggtggccagcaaggacatggagcggcgcatcgtggcccagctgctgacctgcatggatgacctgaacaacgtggccgccacagcccgggtgctggtgattggagccaccaacagaccagacagcctggaccctgccctgcggcgggccggccgctttgaccgggagatctgcctgggcatcccagatgaggccagccgggagcgcatcctgcagaccctgtgcaggaagctgcggctgccccaggcctttgacttctgccacctggcccacctgaccccaggctttgtgggcgctgacctgatggccctgtgccgggaggccgccatgtgtgctgtgaacagagtgctgatgaagctgcaggagcagcagaagaagaaccctgagatggaggacctgcccagcaaaggagtgcaggaggagcggctgggcacagagcccaccagcgagacccaggatgagctgcagaggctgctgggcctgctgcgggaccaggaccccctgtctgaggagcagatgcagggcctgtgcatcgagctgaatgacttcatcgtggccctgagctctgtgcagcccagcgccaagcgggagggctttgtgacagtgcccaacgtgacctgggccgacattggagccctggaggacatccgggaggagctgaccatggccatcctggcccctgtgaggaacccagaccagttcaaggccctgggcctggtgaccccagctggggtgctgctggccggccccccaggctgtgggaagaccctgctggccaaggctgtggccaatgaaagtggcctgaacttcatctctgtgaagggccctgagctgctgaacatgtatgtgggggagagcgagagagctgtgcggcaggtgttccagagggccaagaacagcgccccctgcgtcatcttctttgatgaggtggatgccctgtgccccaggagaagtgaccgggagatctag

SEQ ID NO: 162447 - DNA, 2253 bp, Artificial Sequence
  Description of Artificial Sequence: Synthetic coding sequence
atggaggactacccagacccccagagcgccaaccacatgaacagcagcctgctgagcctgtacagaaaaggaaatccagacagcgtgagcaacaccccagagatggagcagcgggagaccaccagcagcaccccccgcatcagcagcaagacaggcagcatccccctgaagaccccagccaaggacagcgagggcggctggttcatcgacaagacccccagcgtgaagaaggacagcttcttcctggacctgagctgtgagaagagcaaccccaagaagcccatcacagagatccaggacagcaaggacagcagcctgctggagagtgacatgaagaggaagggcaagctgaagaacaagggcagcaagaggaagaaggaggacctgcaggaggtggatggagaaattgaggccgtgctgcagaagaaggccaaggcccggggcctggagttccagatcagcaatgtgaagtttgaagatgtgggcggcaatgacatgaccctgaaggaggtgtgcaagatgctgatccacatgaggcaccctgaggtgtaccaccacctgggcgtggtgcccccccggggcgtgctgctgcacggccccccaggctgcggcaagaccctgctggcccacgccatcgccggggagctggacctgcccatcctgaaggtggccgcccctgagatcgtgtctggagtgtctggagagagcgagcagaagctgcgggagctgtttgagcaggccgtgtccaatgccccctgcatcatcttcattgatgaaattgatgccatcacccccaagcgggaggtggccagcaaggacatggagcggcgcatcgtggcccagctgctgacctgcatggatgacctgaacaacgtggccgccacagcccgggtgctggtgattggagccaccaacagaccagacagcctggaccctgccctgcggcgggccggccgctttgaccgggagatctgcctgggcatcccagatgaggccagccgggagcgcatcctgcagaccctgtgcaggaagctgcggctgccccaggcctttgacttctgccacctggcccacctgaccccaggctttgtgggcgctgacctgatggccctgtgccgggaggccgccatgtgtgctgtgaacagagtgctgatgaagctgcaggagcagcagaagaagaaccctgagatggaggacctgcccagcaaaggagtgcaggaggagcggctgggcacagagcccaccagcgagacccaggatgagctgcagaggctgctgggcctgctgcgggaccaggaccccctgtctgaggagcagatgcagggcctgtgcatcgagctgaatgacttcatcgtggccctgagctctgtgcagcccagcgccaagcgggagggctttgtgacagtgcccaacgtgacctgggccgacattggagccctggaggacatccgggaggagctgaccatggccatcctggcccctgtgaggaacccagaccagttcaaggccctgggcctggtgaccccagctggggtgctgctggccggccccccaggctgtgggaagaccctgctggccaaggctgtggccaatgaaagtggcctgaacttcatctctgtgaagggccctgagctgctgaacatgtatgtgggggagagcgagagagctgtgcggcaggtgttccagagggccaagaacagcgccccctgcgtcatcttctttgatgaggtggatgccctgtgccccaggagaagtgaccgggagactggagcctctgtgcgggtggtgaaccagctgctgacagagatggatggcctggaggcccggcagcaggtgttcatcatggccgccaccaacagaccagacatcatcgaccctgccatcctgcggcccggccgcctggacaagaccctgtttgtgggcctgcccccacctgctgaccggctggccatcctgaagaccatcaccaagaatggcaccaagccacccctggatgctgatgtgaacctggaggccatcgccggggacctgcgctgtgactgctacacaggagctgacctgagcgccctggtgcgggaggccagcatctgtgccctgcggcaggagatggcccggcagaagtctggaaatgagaagggggagctgaaggtgagccacaagcactttgaggaggccttcaagaaggtgcgcagcagcatcagcaagaaggaccagatcatgtatgagcggctgcaggagagcctgagcaggtag

SEQ ID NO: 162448 - DNA, 2298 bp, Artificial Sequence
  Description of Artificial Sequence: Synthetic coding sequence
atgaagcccaggcctgctggctttgtggacaacaagctgaagcagagggtcatccagtacctgaccagcaacaagtgtgggaagtatgtggacatcggcgtgctggccagtgacctgcagagggtgtacagcattgattatggaagaaggaagagaaatgccttccgcatccaggtggagaaggtgttcagcatcatcagcagcgagaaggagctgaagaacctgacagagctggaggatgagcacctggccaagagggcccggcagggcgaggaggacaatgagtacacagagagctacagtgatgatgacagctccatggaggactacccagacccccaggacagcaaggacagcagcctgctggagagtgacatgaagaggaagggcaagctgaagaacaagggcagcaagaggaagaaggaggacctgcaggaggtggatggagaaattgaagctgtgctgcagaagaaggccaaggcccggggcctggagttccagatcagcaatgtgaagtttgaagatgtgggcggcaatgacatgaccctgaaggaggtgtgcaagatgctgatccacatgaggcaccctgaggtgtaccaccacctgggcgtggtgcccccccggggcgtgctgctgcacggccccccaggctgtgggaagaccctgctggcccacgccatcgccggggagctggacctgcccatcctgaaggtggccgcccctgagatcgtgtctggagtgtctggagagagcgagcagaagctgcgggagctgtttgagcaggccgtgtccaatgccccctgcatcatcttcattgatgaaattgatgccatcacccccaagcgggaggtggccagcaaggacatggagaggagaattgtggcccagctgctgacctgcatggatgacctgaacaacgtggccgccacagcccgggtgctggtgattggagccaccaacagaccagacagcctggaccctgccctgcggcgggccggccgctttgaccgggagatctgcctgggcatcccagatgaggccagccgggagcgcatcctgcagaccctgtgcaggaagctgcggctgccccaggcctttgacttctgccacctggcccacctgaccccaggctttgtgggcgctgacctgatggccctgtgccgggaggccgccatgtgtgctgtgaacagagtgctgatgaagctgcaggagcagcagaagaagaaccctgagatggaggacctgcccagcaagggcgtgcaggaggagcggctgggcacagagcccaccagcgagacccaggatgagctgcagaggctgctgggcctgctgcgggaccaggaccccctgtctgaggagcagatgcagggcctgtgcatcgagctgaatgacttcatcgtggccctgagctctgtgcagcccagcgccaagcgggagggctttgtgacagtgcccaacgtgacctgggccgacatcggggccctggaggacatccgggaggagctgaccatggccatcctggcccctgtgagaaatccagaccagttcaaggccctgggcctggtgaccccagctggggtgctgctggccggccccccaggctgcggcaagaccctgctggccaaggctgtggccaatgaaagtggcctgaacttcatctctgtgaagggccctgagctgctgaacatgtatgtgggggagagcgagagagctgtgcggcaggtgttccagagggccaagaacagcgccccctgtgtgatcttctttgatgaggtggatgccctgtgcccccggcggagtgaccgggagaccggggcctctgtgcgggtggtgaaccagctgctgacagagatggatggcctggaggcccggcagcaggtgttcatcatggccgccaccaacagaccagacatcattgatcctgccatcctgcggcccggccgcctggacaagaccctgtttgtgggcctgcccccacctgctgaccggctggccatcctgaagaccatcaccaagaatggcaccaagccacccctggatgctgatgtgaacctggaggccatcgccggggacctgcgctgtgactgctacaccggggctgacctgagcgccctggtgcgggaggccagcatctgtgccctgcggcaggagatggcccggcagaagtctggaaatgaaaaaggagagctgaaggtgagccacaagcactttgaggaggccttcaagaaggtgcgcagcagcatcagcaagaaggaccagatcatgtatgaaaggctgcaggagagcctgagcaggtag

SEQ ID NO: 162449 - DNA, 1386 bp, Artificial Sequence
  Description of Artificial Sequence: Synthetic coding sequence
atgccacccagcggcccccggggcaccctgctgctgctgcccctgctgctgctgctgctgctgcgggctgtgctggccgtgcccctggagcggggggcccccaacaaggaggagaccccagccacagagagcccagacaccggcctgtactaccaccgctacctgcaggaggtgattgatgtgctggagacagatggccacttccgggagaagctgcaggccgccaatgctgaggacatcaagagcggcaagctgagccgggagctggactttgtgagccaccacgtgaggaccaagctggatgagctgaagaggcaggaggtgtcccggctgaggatgctgctgaaggccaagatggatgctgagcaggaccccaacgtgcaggtggaccacctgaacctgctgaagcagtttgagcacctggacccccagaaccagcacacctttgaggcccgggacctggagctgctgatccagacagccacccgggacctggcccagtatgatgctgcccaccacgaggagttcaagagatatgagatgctgaaggagcatgaaagaagacgctacctggagagcctgggggaggagcagaggaaggaggccgagaggaagctggaggagcagcagaggaggcaccgggagcaccccaaggtgaatgtgcccggcagccaggcccagctgaaggaggtgtgggaggagctggatggcctggaccccaaccgcttcaaccccaagaccttcttcatcctgcatgacatcaacagtgatggagtgctggatgagcaggagctggaggccctcttcaccaaggagctggagaaggtgtatgaccccaagaatgaagaagatgacatgagggagatggaggaggagcggctgaggatgagggagcacgtgatgaagaatgtggacaccaaccaggaccggctggtgaccctggaggagttcctggccagcacccagaggaaggagtttggagacacaggagagggctgggagaccgtggagatgcacccagcctacacagaggaggagctgcggagatttgaggaggagctggccgcccgggaggccgagctgaatgccaaggcccagaggctgagccaggagacagaggccctgggccgcagccagggccgcctggaggcccagaagcgggagctgcagcaggccgtgctgcacatggagcagaggaagcagcagcagcagcagcagcagggccacaaggccccagctgcccaccctgagggccagctgaagttccacccagacacagatgatgtgcctgtgcctgccccagctggggaccagaaggaggtggacaccagcgagaagaagctgctggagcggctgcctgaggtggaggtgccccagcacctgtag

SEQ ID NO: 162450 - DNA, 1386 bp, Artificial Sequence; identical to SEQ ID NO: 162449
  Description of Artificial Sequence: Synthetic coding sequence

SEQ ID NO: 162451 - DNA, 1386 bp, Artificial Sequence; identical to SEQ ID NO: 162449
  Description of Artificial Sequence: Synthetic coding sequence

SEQ ID NO: 162452 - DNA, 375 bp, Artificial Sequence
  Description of Artificial Sequence: Synthetic coding sequence
atgccacccagcggcccccggggcaccctgctgctgctgcccctgctgctgctgctgctgctgcgggctgtgctggccgtgcccctggagcggggggcccccaacaaggaggagaccccagccacagagagcccagacaccggcctgtactaccaccgctacctgcaggaggtgattgatgtgctggagacagatggccacttccgggagaagctgcaggccgccaatgctgaggacatcaagagcggcaagctgagccgggagctggactttgtgagccaccacgtgaggaccaagctggatgagctgaagaggcaggaggtgtcccggctgaggatgctgctgaaggccaagatggatgctgagcaggactag

SEQ ID NO: 162453 - DNA, 336 bp, Artificial Sequence
  Description of Artificial Sequence: Synthetic coding sequence
atgccacccagcggcccccggggcaccctgctgctgctgcccctgctgctgctgctgctgctgcgggctgtgctggccgtgcccctggagcggggggcccccaacaaggaggagaccccagccacagagagcccagacaccggcctgtactaccaccgctacctgcaggaggtgattgatgtgctggagacagatggccacttccgggagaagctgcaggccgccaatgctgaggacatcaagagcggcaagctgagccgggagctggactttgtgagccaccacgtgaggaccaagctggatgagctgaagaggcaggaggtgtcccggctgtag

SEQ ID NO: 162454 - DNA, 1263 bp, Artificial Sequence
  Description of Artificial Sequence: Synthetic coding sequence
atgcgctggaggaccatcctgctgcagtactgcttcctgctgatcacctgcctgctgacagccctggaggccgtgcccattgatattgacaagaccaaggtgcagaacatccaccctgtggagagcgccaagattgagcccccagacaccggcctgtactatgatgagtacctgaagcaggtgattgatgtgctggagacagacaagcacttccgggagaagctgcagaaggctgacatcgaggagatcaagagcggccgcctgagcaaggagctggacctggtgagccaccacgtgaggaccaagctggatgagctgaagaggcaggaggtgggccgcctgaggatgctgatcaaggccaagctggacagcctgcaggacatcggcatggaccaccaggccctgctgaagcagtttgaccacctgaaccacctgaacccagacaagtttgagagcacagacctggacatgctgatcaaggccgccaccagtgacctggagcactatgacaagaccaggcatgaggagttcaagaagtatgagatgatgaaggagcacgagcggcgggagtacctgaagaccctgaatgaggagaagaggaaggaggaggagagcaagtttgaggagatgaagaagaagcatgagaaccaccccaaggtgaaccaccctggcagcaaggaccagctgaaggaggtgtgggaggagacagatggcctggaccccaatgactttgaccccaagaccttcttcaagctgcatgatgtgaacagtgatggcttcctggatgagcaggagctggaggccctcttcaccaaggagctggagaaggtgtatgaccccaagaatgaggaggatgacatggtggagatggaggaggagcggctgaggatgagggagcacgtgatgtctgaggtggacaccaacaaggaccggctggtgaccctggaggagttcctgaaggccacagagaagaaggagttcctggagccagacagctgggagaccctggaccagcagcagttcttcacagaggaggagctgaaggagtatgagaacatcatcgccctgcaggagaatgagctgaagaagaaggcagatgagctgcagaagcagaaggaggagctgcagaggcagcacgaccagctggaggcccagaagctggagtaccaccaggtgatccagcagatggagcagaagaagctgcagcagggcatcccccccagcggccctgctggggagctgaagtttgagccccgggtgtag

SEQ ID NO: 162455 - DNA, 1173 bp, Artificial Sequence
  Description of Artificial Sequence: Synthetic coding sequence
atgcgctggaggaccatcctgctgcagtactgcttcctgctgatcacctgcctgctgacagccctggaggccgtgcccattgatattgacaagaccaaggtgcagaacatccaccctgtggagagcgccaagattgagcccccagacaccggcctgtactatgatgagtacctgaagcaggtgattgatgtgctggagacagacaagcacttccgggagaagctgcagaaggctgacatcgaggagatcaagagcggccgcctgagcaaggagctggacctggtgagccaccacgtgaggaccaagctggatgagctgaagaggcaggaggtgggccgcctgaggatgctgatcaaggccaagctggacagcctgcaggacatcggcatggaccaccaggccctgctgaagcagtttgaccacctgaaccacctgaacccagacaagtttgagagcacagacctggacatgctgatcaaggccgccaccagtgacctggagcactatgacaagaccaggcatgaggagttcaagaagtatgagatgatgaaggagcacgagcggcgggagtacctgaagaccctgaatgaggagaagaggaaggaggaggagagcaagtttgaggagatgaagaagaagcatgagaaccaccccaaggtgaaccaccctggcagcaaggaccagctgaaggaggtgtgggaggagacagatggcctggaccccaatgactttgaccccaagaccttcttcaagctgcatgatgtgaacagtgatggcttcctggatgagcaggagctggaggccctcttcaccaaggagctggagaaggtgtatgaccccaagaatgaggaggatgacatggtggagatggaggaggagcggctgaggatgagggagcacgtgatgtctgagaccctggaccagcagcagttcttcacagaggaggagctgaaggagtatgagaacatcatcgccctgcaggagaatgagctgaagaagaaggcagatgagctgcagaagcagaaggaggagctgcagaggcagcacgaccagctggaggcccagaagctggagtaccaccaggtgatccagcagatggagcagaagaagctgcagcagggcatcccccccagcggccctgctggggagctgaagtttgagccccacatctag

SEQ ID NO: 162456 - DNA, 210 bp, Artificial Sequence
  Description of Artificial Sequence: Synthetic coding sequence
atgcgctggaggaccatcctgctgcagtactgcttcctgctgatcacctgcctgctgacagccctggaggccgtgcccattgatattgacaagaccaaggtgcagaacatccaccctgtggagagcgccaagattgagcccccagacaccggcctgtactatgatgagtacctgaagcaggtgattgatgtgctggagacagacaagtag

SEQ ID NO: 162457 - DNA, 105 bp, Artificial Sequence
  Description of Artificial Sequence: Synthetic coding sequence
atgcgctggaggaccatcctgctgcagtactgcttcctgctgatcacctgcctgctgacagccctggaggccgtgcccattgatattgacaagaccaaggtgtag

SEQ ID NO: 162458 - DNA, 1263 bp, Artificial Sequence
  Description of Artificial Sequence: Synthetic coding sequence
atgcgctggaggaccatcctgctgcagtactgcttcctgctgatcacctgcctgctgacagccctggaggccgtgcccattgatattgacaagaccaaggtgcagaacatccaccctgtggagagcgccaagattgagcccccagacaccggcctgtactatgatgagtacctgaagcaggtgattgatgtgctggagacagacaagcacttccgggagaagctgcagaaggctgacatcgaggagatcaagagcggccgcctgagcaaggagctggacctggtgagccaccacgtgaggaccaagctggatgagctgaagaggcaggaggtgggccgcctgaggatgctgatcaaggccaagctggacagcctgcaggacatcggcatggaccaccaggccctgctgaagcagtttgaccacctgaaccacctgaacccagacaagtttgagagcacagacctggacatgctgatcaaggccgccaccagtgacctggagcactatgacaagaccaggcatgaggagttcaagaagtatgagatgatgaaggagcacgagcggcgggagtacctgaagaccctgaatgaggagaagaggaaggaggaggagagcaagtttgaggagatgaagaagaagcatgagaaccaccccaaggtgaaccaccctggcagcaaggaccagctgaaggaggtgtgggaggagacagatggcctggaccccaatgactttgaccccaagaccttcttcaagctgcatgatgtgaacagtgatggcttcctggatgagcaggagctggaggccctcttcaccaaggagctggagaaggtgtatgaccccaagaatgaggaggatgacatggtggagatggaggaggagcggctgaggatgagggagcacgtgatgtctgaggtggacaccaacaaggaccggctggtgaccctggaggagttcctgaaggccacagagaagaaggagttcctggagccagacagctgggagaccctggaccagcagcagttcttcacagaggaggagctgaaggagtatgagaacatcatcgccctgcaggagaatgagctgaagaagaaggcagatgagctgcagaagcagaaggaggagctgcagaggcagcacgaccagctggaggcccagaagctggagtaccaccaggtgatccagcagatggagcagaagaagctgcagcagggcatcccccccagcggccctgctggggagctgaagtttgagccccacatctag

SEQ ID NO: 162459 - DNA, 588 bp, Artificial Sequence
  Description of Artificial Sequence: Synthetic coding sequence
atgcgctggaggaccatcctgctgcagtactgcttcctgctgatcacctgcctgctgacagccctggaggccgtgcccattgatattgacaagaccaaggtgcagaacatccaccctgtggagagcgccaagattgagcccccagacaccggcctgtactatgatgagtacctgaagcaggtgattgatgtgctggagacagacaagcacttccgggagaagctgcagaaggctgacatcgaggagatcaagagcggccgcctgagcaaggagctggacctggtgagccaccacgtgaggaccaagctggatgagctgaagaggcaggaggtgggccgcctgaggatgctgatcaaggccaagctggacagcctgcaggacatcggcatggaccaccaggccctgctgaagcagtttgaccacctgaaccacctgaacccagacaagtttgagagcacagacctggacatgctgatcaaggccgccaccagtgacctggagcactatgacaagaccaggcatgaggagttcaagaagtatgagatgatgaaggagcacgagcggcgggagtacctgaagaccctgtag

SEQ ID NO: 162460 - DNA, 597 bp, Artificial Sequence
  Description of Artificial Sequence: Synthetic coding sequence
atgcgctggaggaccatcctgctgcagtactgcttcctgctgatcacctgcctgctgacagccctggaggccgtgcccattgatattgacaagaccaaggtgcagaacatccaccctgtggagagcgccaagattgagcccccagacaccggcctgtactatgatgagtacctgaagcaggtgattgatgtgctggagacagacaagcacttccgggagaagctgcagaaggctgacatcgaggagatcaagagcggccgcctgagcaaggagctggacctggtgagccaccacgtgaggaccaagctggatgagctgaagaggcaggaggtgggccgcctgaggatgctgatcaaggccaagctggacagcctgcaggacatcggcatggaccaccaggccctgctgaagcagtttgaccacctgaaccacctgaacccagacaagtttgagagcacagacctggacatgctgatcaaggccgccaccagtgacctggagcactatgacaagaccaggcatgaggagttcaagaagtatgagatgatgaaggagcacgagcggcgggagtacctgaagaccctgaatgaggagtag

SEQ ID NO: 162461 - DNA, 105 bp, Artificial Sequence; identical to SEQ ID NO: 162457
  Description of Artificial Sequence: Synthetic coding sequence

SEQ ID NO: 162462 - DNA, 120 bp, Artificial Sequence
  Description of Artificial Sequence: Synthetic coding sequence
atgcgctggaggaccatcctgctgcagtactgcttcctgctgatcacctgcctgctgacagccctggaggccgtgcccattgatattgacaagaccaaggtgcagaacatccacccctag

SEQ ID NO: 162463 - DNA, 210 bp, Artificial Sequence; identical to SEQ ID NO: 162456
  Description of Artificial Sequence: Synthetic coding sequence

SEQ ID NO: 162464 - DNA, 273 bp, Artificial Sequence
  Description of Artificial Sequence: Synthetic coding sequence
atgcgctggaggaccatcctgctgcagtactgcttcctgctgatcacctgcctgctgacagccctggaggccgtgcccattgatattgacaagaccaaggtgcagaacatccaccctgtggagagcgccaagattgagcccccagacaccggcctgtactatgatgagtacctgaagcaggtgattgatgtgctggagacagacaagcacttccgggagaagctgcagaaggctgacatcgaggagatcaagagcggccgcctgagcaagtag

SEQ ID NO: 162465 - DNA, 1323 bp, Artificial Sequence
  Description of Artificial Sequence: Synthetic coding sequence
atgatcatccccagcctggaggagctggacagcctgaagtacagcgacctgcagaacctggccaagagcctgggcctgcgggccaacctgcgggccaccaagctgctgaaggccctgaagggctacatcaagcatgaggccaggaaaggaaatgaaaaccaggatgagagccagaccagcgccagcagctgtgatgaaacagagatccagatcagcaaccaggaggaggccgagcggcagcccctgggccacgtgaccaagacccggcggcgctgcaagacagtgcgggtggaccctgacagccagcagaaccacagcgagatcaagatcagcaaccccacagagttccagaaccacgagaagcaggagagccaggacctgcgggccacagccaaggtgcccagccccccagatgagcaccaggaggccgagaatgctgtgagcagcggcaacagagacagcaaggtgcccagcgagggcaagaagagcctgtacacagatgagagcagcaagccaggcaagaacaagaggacagccatcaccacccccaacttcaagaagctgcacgaggcccacttcaaggagatggagagcattgaccagtacattgaaaggaagaagaagcactttgaggagcacaacagcatgaatgagctgaagcagcccatcaacaagggcggcgtgaggacccctgtgcccccccggggccgcctgtctgtggccagcacccccatcagccagaggaggagccagggccgcagctgtggccctgccagccagagcaccctgggcctgaagggcagcctgaagaggtctgccatctctgctgccaagacaggagtgcgcttctctgctgccaccaaggacaatgagcacaagaggagcctgaccaagaccccagccaggaagagcgcccacgtgacagtgtctgggggcacccccaagggggaggccgtgctgggcacccacaagctgaagaccatcactggaaacagcgctgctgtgatcacccccttcaagctgaccacagaggccacccagacccctgtgagcaacaagaagcctgtgtttgacctgaaggccagcctgagccggcccctgaactatgagccccacaagggcaagctgaagccctggggccagagcaaggagaacaactacctgaaccagcacgtgaaccgcatcaacttctacaagaagacctacaagcagccccacctgcagaccaaggaggagcagaggaagaagcgggagcaggagaggaaggagaagaaggccaaggtgctgggcatgaggcggggcctcatcctggctgaagattag

SEQ ID NO: 162466 - DNA, 1209 bp, Artificial Sequence
  Description of Artificial Sequence: Synthetic coding sequence
atgatcatccccagcctggaggagctggacagcctgaagtacagcgacctgcagaacctggccaagagcctgggcctgcgggccaacctgcgggccaccaagctgctgaaggccctgaagggctacatcaagcatgaggccaggaaaggaaatgaaaaccaggatgagagccagaccagcgccagcagctgtgatgaaacagagatccagatcagcaaccaggaggaggccgagcggcagcccctgggccacgtgaccaagacccggcggcgctgcaagacagtgcgggtggaccctgacagccagcagaaccacagcgagatcaagatcagcaaccccacagagttccagaaccacgagaagcaggagagccaggacctgcgggccacagccaaggtgcccagccccccagatgagcaccaggaggccgagaatgctgtgagcagcggcaacagagacagcaaggtgcccagcgagggcaagaagagcctgtacacagatgagagcagcaagccaggcaagaacaagaggacagccatcaccacccccaacttcaagaagctgcacgaggcccacttcaaggagatggagagcattgaccagtacattgaaaggaagaagaagcactttgaggagcacaacagcatgaatgagctgaagcagcagcccatcaacaagggcggcgtgaggacccctgtgcccccccggggccgcctgtctgtggccagcacccccatcagccagaggaggagccagggccgcagctgtggccctgccagccagagcaccctgggcctgaagggcagcctgaagaggtctgccatctctgctgccaagacaggagtgcgcttctctgctgccaccaaggacaatgagcacaagaggagcctgaccaagaccccagccaggaagagcgcccacgtgacagtgtctgggggcacccccaagggggaggccgtgctgggcacccacaagctgaagaccatcaccggcaacagcgctgctgggaagctgaagccctggggccagagcaaggagaacaactacctgaaccagcacgtgaaccgcatcaacttctacaagaagacctacaagcagccccacctgcagaccaaggaggagcagaggaagaagcgggagcaggagaggaaggagaagaaggccaaggtgctgggcatgaggcggggcctcatcctggctgaagattag

SEQ ID NO: 162467 - DNA, 1326 bp, Artificial Sequence
  Description of Artificial Sequence: Synthetic coding sequence
atgatcatccccagcctggaggagctggacagcctgaagtacagcgacctgcagaacctggccaagagcctgggcctgcgggccaacctgcgggccaccaagctgctgaaggccctgaagggctacatcaagcatgaggccaggaaaggaaatgaaaaccaggatgagagccagaccagcgccagcagctgtgatgaaacagagatccagatcagcaaccaggaggaggccgagcggcagcccctgggccacgtgaccaagacccggcggcgctgcaagacagtgcgggtggaccctgacagccagcagaaccacagcgagatcaagatcagcaaccccacagagttccagaaccacgagaagcaggagagccaggacctgcgggccacagccaaggtgcccagccccccagatgagcaccaggaggccgagaatgctgtgagcagcggcaacagagacagcaaggtgcccagcgagggcaagaagagcctgtacacagatgagagcagcaagccaggcaagaacaagaggacagccatcaccacccccaacttcaagaagctgcacgaggcccacttcaaggagatggagagcattgaccagtacattgaaaggaagaagaagcactttgaggagcacaacagcatgaatgagctgaagcagcagcccatcaacaagggcggcgtgaggacccctgtgcccccccggggccgcctgtctgtggccagcacccccatcagccagaggaggagccagggccgcagctgtggccctgccagccagagcaccctgggcctgaagggcagcctgaagaggtctgccatctctgctgccaagacaggagtgcgcttctctgctgccaccaaggacaatgagcacaagaggagcctgaccaagaccccagccaggaagagcgcccacgtgacagtgtctgggggcacccccaagggggaggccgtgctgggcacccacaagctgaagaccatcaccggcaacagcgctgctgtgatcacccccttcaagctgaccacagaggccacccagacccctgtgagcaacaagaagcctgtgtttgacctgaaggccagcctgagccggcccctgaactatgagccccacaagggcaagctgaagccctggggccagagcaaagaaaacaactacctgaaccagcacgtgaaccgcatcaacttctacaagaagacctacaagcagccccacctgcagaccaaggaggagcagaggaagaagcgggagcaggagaggaaggagaagaaggccaaggtgctgggcatgagaagaggcctcatcctggccgaggactag

SEQ ID NO: 162468 - DNA, 1323 bp, Artificial Sequence
  Description of Artificial Sequence: Synthetic coding sequence
atgatcatccccagcctggaggagctggacagcctgaagtacagcgacctgcagaacctggccaagagcctgggcctgcgggccaacctgcgggccaccaagctgctgaaggccctgaagggctacatcaagcatgaggccaggaaaggaaatgaaaaccaggatgagagccagaccagcgccagcagctgtgatgaaacagagatccagatcagcaaccaggaggaggccgagcggcagcccctgggccacgtgaccaagacccggcggcgctgcaagacagtgcgggtggaccctgacagccagaaccacagcgagatcaagatcagcaaccccacagagttccagaaccacgagaagcaggagagccaggacctgcgggccacagccaaggtgcccagccccccagatgagcaccaggaggctgaaaatgctgtgagcagcggcaacagagacagcaaggtgcccagcgagggcaagaagagcctgtacacagatgagagcagcaagccaggcaagaacaagaggacagccatcaccacccccaacttcaagaagctgcacgaggcccacttcaaggagatggagagcattgaccagtacatcgagaggaagaagaagcactttgaggagcacaacagcatgaatgagctgaagcagcagcccatcaacaagggcggcgtgaggacccctgtgcccccccggggccgcctgtctgtggccagcacccccatcagccagaggaggagccagggccgcagctgtggccctgccagccagagcaccctgggcctgaagggcagcctgaagaggtctgccatctctgctgccaagacaggagtgcgcttctctgctgccaccaaggacaatgagcacaagaggagcctgaccaagaccccagccaggaagagcgcccacgtgacagtgtctgggggcacccccaagggggaggccgtgctgggcacccacaagctgaagaccatcactggaaacagcgctgctgtgatcacccccttcaagctgaccacagaggccacccagacccctgtgagcaacaagaagcctgtgtttgacctgaaggccagcctgagccggcccctgaactatgagccccacaagggcaagctgaagccctggggccagagcaaggagaacaactacctgaaccagcacgtgaaccgcatcaacttctacaagaagacctacaagcagccccacctgcagaccaaggaggagcagaggaagaagcgggagcaggagaggaaggagaagaaggccaaggtgctgggcatgaggcggggcctcatcctggctgaagattag

SEQ ID NO: 162469 - DNA, 1320 bp, Artificial Sequence
  Description of Artificial Sequence: Synthetic coding sequence
atgatcatccccagcctggaggagctggacagcctgaagtacagcgacctgcagaacctggccaagagcctgggcctgcgggccaacctgcgggccaccaagctgctgaaggccctgaagggctacatcaagcatgaggccaggaaaggaaatgaaaaccaggatgagagccagaccagcgccagcagctgtgatgaaacagagatccagatcagcaaccaggaggaggccgagcggcagcccctgggccacgtgaccaagacccggcggcgctgcaagacagtgcgggtggaccctgacagccagaaccacagcgagatcaagatcagcaaccccacagagttccagaaccacgagaagcaggagagccaggacctgcgggccacagccaaggtgcccagccccccagatgagcaccaggaggctgaaaatgctgtgagcagcggcaacagagacagcaaggtgcccagcgagggcaagaagagcctgtacacagatgagagcagcaagccaggcaagaacaagaggacagccatcaccacccccaacttcaagaagctgcacgaggcccacttcaaggagatggagagcattgaccagtacatcgagaggaagaagaagcactttgaggagcacaacagcatgaatgagctgaagcagcccatcaacaagggcggcgtgaggacccctgtgcccccccggggccgcctgtctgtggccagcacccccatcagccagaggaggagccagggccgcagctgtggccctgccagccagagcaccctgggcctgaagggcagcctgaagaggtctgccatctctgctgccaagacaggagtgcgcttctctgctgccaccaaggacaatgagcacaagaggagcctgaccaagaccccagccaggaagagcgcccacgtgacagtgtctgggggcacccccaagggggaggccgtgctgggcacccacaagctgaagaccatcaccggcaacagcgctgctgtgatcacccccttcaagctgaccacagaggccacccagacccctgtgagcaacaagaagcctgtgtttgacctgaaggccagcctgagccggcccctgaactatgagccccacaagggcaagctgaagccctggggccagagcaaagaaaacaactacctgaaccagcacgtgaaccgcatcaacttctacaagaagacctacaagcagccccacctgcagaccaaggaggagcagaggaagaagcgggagcaggagaggaaggagaagaaggccaaggtgctgggcatgagaagaggcctcatcctggccgaggactag

SEQ ID NO: 162470 - DNA, 1281 bp, Artificial Sequence
  Description of Artificial Sequence: Synthetic coding sequence
atgatcatccccagcctggaggagctggacagcctgaagtacagcgacctgcagaacctggccaagagcctgggcctgcgggccaacctgcgggccaccaagctgctgaaggccctgaagggctacatcaagcatgaggccaggaaaggaaatgaaaaccaggatgagagccagaccagcgccagcagctgtgatgaaacagagatccagatcagcaaccaggaggaggccgagcggcagcccctgggccacgtgaccaagacccggcggcgctgcaagacagtgcgggtggaccctgacagccagaaccacgagaagcaggagagccaggacctgcgggccacagccaaggtgcccagccccccagatgagcaccaggaggctgaaaatgctgtgagcagcggcaacagagacagcaaggtgcccagcgagggcaagaagagcctgtacacagatgagagcagcaagccaggcaagaacaagaggacagccatcaccacccccaacttcaagaagctgcacgaggcccacttcaaggagatggagagcattgaccagtacatcgagaggaagaagaagcactttgaggagcacaacagcatgaatgagctgaagcagcagcccatcaacaagggcggcgtgaggacccctgtgcccccccggggccgcctgtctgtggccagcacccccatcagccagaggaggagccagggccgcagctgtggccctgccagccagagcaccctgggcctgaagggcagcctgaagaggtctgccatctctgctgccaagacaggagtgcgcttctctgctgccaccaaggacaatgagcacaagaggagcctgaccaagaccccagccaggaagagcgcccacgtgacagtgtctgggggcacccccaagggggaggccgtgctgggcacccacaagctgaagaccatcactggaaacagcgctgctgtgatcacccccttcaagctgaccacagaggccacccagacccctgtgagcaacaagaagcctgtgtttgacctgaaggccagcctgagccggcccctgaactatgagccccacaagggcaagctgaagccctggggccagagcaaggagaacaactacctgaaccagcacgtgaaccgcatcaacttctacaagaagacctacaagcagccccacctgcagaccaaggaggagcagaggaagaagcgggagcaggagaggaaggagaagaaggccaaggtgctgggcatgaggcggggcctcatcctggctgaagattag

SEQ ID NO: 162471 - DNA, 2250 bp, Artificial Sequence
  Description of Artificial Sequence: Synthetic coding sequence
atggctgctgctggcagcaggaagaggcggctggccgagctgactgtggatgagttcctggccagcggctttgacagcgagagcgagagcgagagcgagaacagcccccaggccgagacccgggaggcccgggaggccgcccggagcccagacaagccaggcggcagccccagcgccagcaggaggaagggccgggccagcgagcacaaggaccagctgagccggctgaaggaccgggaccctgagttctacaagttcctgcaggagaatgaccagagcctgctgaacttcagtgacagcgacagcagcgaggaggaggagggccccttccacagcctgcctgatgtgctggaggaggccagcgaggaggaggatggagctgaggagggagaagatggagacagagtgccccggggcctgaagggcaagaagaacagcgtgcctgtgacagtggccatggtggagcgctggaagcaggccgccaagcagaggctgacccccaagctgttccacgaggtggtgcaggccttccgggctgctgtggccaccaccaggggggaccaggagagcgctgaggccaacaagttccaggtgacagattctgctgccttcaatgccctggtgaccttctgcatccgggacctgattggctgcctgcagaagctgctgtttgggaaggtggccaaggacagcagcaggatgctgcagcccagcagcagccccctgtggggcaagctgcgggtggacatcaaggcctacctgggcagcgccatccagctggtgtcctgcctgtctgagaccaccgtgctggccgctgtgctgcggcacatctctgtgctggtgccctgcttcctgaccttccccaagcagtgcaggatgctgctgaagaggatggtgattgtgtggagcactggagaggagagcctgcgggtgctggccttcctggtgctgagccgggtgtgccgccacaagaaggacaccttcctgggccctgtgctgaagcagatgtacatcacctacgtgaggaactgcaagttcaccagccctggggccctgcccttcatctccttcatgcagtggaccctgacagagctgctggccctggagcccggggtggcctaccagcacgccttcctgtacatccggcagctggccatccacctgagaaatgccatgaccaccaggaagaaggagacctaccagagcgtgtacaactggcagtatgtgcactgcctcttcctgtggtgccgggtgctgagcacagctggccccagcgaggccctgcagcccctggtgtaccccctggcccaggtgatcatcggctgcatcaagctgatccccacagcccgcttctaccccctgaggatgcactgcatccgggccctgaccctgctgagcggcagcagcggggccttcatccctgtgctgcccttcatcctggagatgttccagcaggtggacttcaacaggaagccaggccgcatgagcagcaagcccatcaacttcagcgtcatcctgaagctgagcaatgtgaacctgcaggagaaggcctacagagatggcctggtggagcagctgtatgacctgaccctggagtacctgcacagccaggcccactgcatcggcttccctgagctggtgctgcctgtggtgctgcagctgaagagcttcctgcgggagtgcaaggtggccaactactgccggcaggtgcagcagctgctgggcaaggtgcaggagaacagcgcctacatctgcagccggcggcagagggtgtcctttggagtgtctgagcagcaggccgtggaggcctgggagaagctgacccgggaggagggcacccccctgaccctgtactacagccactggaggaagctgcgggaccgggagatccagctggagatcagcggcaaggagcggctggaggacctgaacttccctgagatcaagaggaggaagatggctgacaggaaggatgaggacaggaagcagttcaaggacctgtttgacctgaacagcagtgaagaagatgacacagagggcttcagcgagcggggcatcctgcggcccctgagcaccaggcatggagtggaggatgatgaagaagatgaggaggagggggaggaggacagcagcaacagtgaagatggagaccctgatgctgaggccggcctggcccctggagagctgcagcagctggcccagggcccagaagatgagctggaggacctgcagctgtctgaagatgactag

SEQ ID NO: 162472 - DNA, 2403 bp, Artificial Sequence
  Description of Artificial Sequence: Synthetic coding sequence
atgaagttcagaagaaacaagaagcagatccccagcttcaggaagctgatcaagaccagcaaggtgaagctggagaacaagctgaagaacaagcagttcaagcagcagagcaccctgaagaagtacaggaaggagcagaggaagctgcggcaggccgtgaaggatgctgtgtccaagaagcccatccccctggagaaccccaaggagaagaggcctgggaagagaattgaaagagaggaggaggaggaggaggaggccctgcccctggacatgatggatgaagatgacctgcagctgatgaaggacctgggccagagggtgtccttcctgacccgggacctgagcagcagcgagcctgtgcacgccaagaagaggaagcatgagcgcatcatcgacaagtatgagaagatccccaggaccctgcagacagcccctgagaaggagctgatccacctgctgcccatcaaggacaagagcggcatcatcccccagacccgggagaagcctgtgacagacagcaacaaggatgaggaggaccaggaggaggagcgggagctggaggaggagatcatcgaggaccccatccaggagctgaccatcgaggagcacctgattgaaaggaagaagaagctgcaggagaagaagatgcacatcgccgccctggccagcgccatcctgagtgaccctgagaacaacatcaagaagctgaaggagctgcgctccatgctgatggagcaggaccctgatgtggccgtgacagtgaggaagctggtgattgtgtccctgatggagctgttcaaggacatcacccccagctacaagatccggcccctgacagaagctgagaagagcaccaagaccaggaaggagacccagaagctgcgggagtttgaggagggcctggtgtcccagtacaagttctacctggagaacctggagcagatggtgaaggactggaagcagaggaagctgaagaagagcaatgtggtgtccctgaaggcctacaagggcctggccgaggtggccgtgaagagcctgtgtgagctgctggtggccctgccccacttcaacttccacaacaacatcatcgtgctgattgtgcccctgatgaatgacatgagcaagctgatcagcgagatgtgctgtgaggccgtgaagaagctgttcaagcaggacaagctgggccaggccagcctgggcgtcatcaaggtgatcagcggctttgtgaagggcaggaactatgaggtgcggcctgagatgctgaagaccttcctgtgcctgcgcatcaaggaggtggaggtgaagaaggacacagaggacatcaacaagcccaagaagttcatgaccttcaaggagaagaggaagagcctgagcaggatgcagaggaagtggaagaaggccgaggagaagctggagcgggagctgcgggaggccgaggccagcgagagcacagagaagaagctgaagctgcacacagagaccctgaacatcgtgtttgtgacctacttccgcatcctgaagaaggcccagaggagccccctgctgcctgctgtgctggagggcctggccaagtttgcccacctgatcaacgtggagttctttgatgacctgctggtggtgctgcacaccctgattgaaagtggggacctgagctaccaggagagcctgcactgtgtgcagacagccttccacatcctgagcggccagggagatgtgctgaacatcgaccccctgaagttctacacccacctgtacaagaccctcttcaagctgcatgctggggccaccaatgaaggagtggagatcgtgctgcagtgcctggatgtgatgctgaccaagaggaggaagcaggtgtcccagcagagggccctggccttcatcaagaggctgtgcaccctggccctgcacgtgctgcccaacagcagcatcggcatcctggccaccacccgcatcctgatgcacaccttccccaagacagacctgctgctggacagcgagagccagggcagcggggtcttcctgcctgagctggatgagcctgagtactgcaatgcccagaacacagccctgtgggagctgcacgccctgcggcggcactaccaccccatcgtgcagagatttgctgcccacctgattgctggggcccccagcgagggcagcggggccctgaagccagagctgagcagaagaagtgccacagagctgtttgaggcctacagcatggccgagatgaccttcaacccccctgtggagagcagcaaccccaagatcaagggcaagttcctgcagggcgacagcttcctgaatgaagacctgaaccagctgatcaagcgctacagcagcgaggtggccacagagagccccctggacttcaccaagtacctgaagaccagcctgcactag

SEQ ID NO: 162473 - DNA, 2403 bp, Artificial Sequence
  Description of Artificial Sequence: Synthetic coding sequence
atgaaggcccggaggaacaagaagcagatccccagcttcaggaagctgatcaagaccagcaaggtgaagctggagaacaagctgaagaacaagcagttcaagcagcagagcaccctgaagaagtacaggaaggagcagaggaagctgcggcaggccgtgaaggatgctgtgtccaagaagcccatccccctggagaaccccaaggagaagaggcctgggaagagaattgaaagagaggaggaggaggaggaggaggccctgcccctggacatgatggatgaagatgacctgcagctgatgaaggacctgggccagagggtgtccttcctgacccgggacctgagcagcagcgagcctgtgcacgccaagaagaggaagcatgagcgcatcatcgacaagtatgagaagatccccaggaccctgcagacagcccctgagaaggagctgatccacctgctgcccatcaaggacaagagcggcatcatcccccagacccgggagaagcctgtgacagacagcaacaaggatgaggaggaccaggaggaggagcgggagctggaggaggagatcatcgaggaccccatccaggagctgaccatcgaggagcacctgattgaaaggaagaagaagctgcaggagaagaagatgcacatcgccgccctggccagcgccatcctgagtgaccctgagaacaacatcaagaagctgaaggagctgcgctccatgctgatggagcaggaccctgatgtggccgtgacagtgaggaagctggtgattgtgtccctgatggagctgttcaaggacatcacccccagctacaagatccggcccctgacagaagctgagaagagcaccaagaccaggaaggagacccagaagctgcgggagtttgaggagggcctggtgtcccagtacaagttctacctggagaacctggagcagatggtgaaggactggaagcagaggaagctgaagaagagcaatgtggtgtccctgaaggcctacaagggcctggccgaggtggccgtgaagagcctgtgtgagctgctggtggccctgccccacttcaacttccacaacaacatcatcgtgctgattgtgcccctgatgaatgacatgagcaagctgatcagcgagatgtgctgtgaggccgtgaagaagctgttcaagcaggacaagctgggccaggccagcctgggcgtcatcaaggtgatcagcggctttgtgaagggcaggaactatgaggtgcggcctgagatgctgaagaccttcctgtgcctgcgcatcaaggaggtggaggtgaagaaggacacagaggacatcaacaagcccaagaagttcatgaccttcaaggagaagaggaagagcctgagcaggatgcagaggaagtggaagaaggccgaggagaagctggagcgggagctgcgggaggccgaggccagcgagagcacagagaagaagctgaagctgcacacagagaccctgaacatcgtgtttgtgacctacttccgcatcctgaagaaggcccagaggagccccctgctgcctgctgtgctggagggcctggccaagtttgcccacctgatcaacgtggagttctttgatgacctgctggtggtgctgcacaccctgattgaaagtggggacctgagctaccaggagagcctgcactgtgtgcagacagccttccacatcctgagcggccagggagatgtgctgaacatcgaccccctgaagttctacacccacctgtacaagaccctcttcaagctgcatgctggggccaccaatgaaggagtggagatcgtgctgcagtgcctggatgtgatgctgaccaagaggaggaagcaggtgtcccagcagagggccctggccttcatcaagaggctgtgcaccctggccctgcacgtgctgcccaacagcagcatcggcatcctggccaccacccgcatcctgatgcacaccttccccaagacagacctgctgctggacagcgagagccagggcagcggggtcttcctgcctgagctggatgagcctgagtactgcaatgcccagaacacagccctgtgggagctgcacgccctgcggcggcactaccaccccatcgtgcagagatttgctgcccacctgattgctggggcccccagcgagggcagcggggccctgaagccagagctgagcagaagaagtgccacagagctgtttgaggcctacagcatggccgagatgaccttcaacccccctgtggagagcagcaaccccaagatcaagggcaagttcctgcagggcgacagcttcctgaatgaagacctgaaccagctgatcaagcgctacagcagcgaggtggccacagagagccccctggacttcaccaagtacctgaagaccagcctgcactag

SEQ ID NO: 162474 - DNA, 1506 bp, Artificial Sequence
  Description of Artificial Sequence: Synthetic coding sequence
atggagctgttcaaggacatcacccccagctacaagatccggcccctgacagaagctgagaagagcaccaagaccaggaaggagacccagaagctgcgggagtttgaggagggcctggtgtcccagtacaagttctacctggagaacctggagcagatggtgaaggactggaagcagaggaagctgaagaagagcaatgtggtgtccctgaaggcctacaagggcctggccgaggtggccgtgaagagcctgtgtgagctgctggtggccctgccccacttcaacttccacaacaacatcatcgtgctgattgtgcccctgatgaatgacatgagcaagctgatcagcgagatgtgctgtgaggccgtgaagaagctgttcaagcaggacaagctgggccaggccagcctgggcgtcatcaaggtgatcagcggctttgtgaagggcaggaactatgaggtgcggcctgagatgctgaagaccttcctgtgcctgcgcatcaaggaggtggaggtgaagaaggacacagaggacatcaacaagcccaagaagttcatgaccttcaaggagaagaggaagagcctgagcaggatgcagaggaagtggaagaaggccgaggagaagctggagcgggagctgcgggaggccgaggccagcgagagcacagagaagaagctgaagctgcacacagagaccctgaacatcgtgtttgtgacctacttccgcatcctgaagaaggcccagaggagccccctgctgcctgctgtgctggagggcctggccaagtttgcccacctgatcaacgtggagttctttgatgacctgctggtggtgctgcacaccctgattgaaagtggggacctgagctaccaggagagcctgcactgtgtgcagacagccttccacatcctgagcggccagggagatgtgctgaacatcgaccccctgaagttctacacccacctgtacaagaccctcttcaagctgcatgctggggccaccaatgaaggagtggagatcgtgctgcagtgcctggatgtgatgctgaccaagaggaggaagcaggtgtcccagcagagggccctggccttcatcaagaggctgtgcaccctggccctgcacgtgctgcccaacagcagcatcggcatcctggccaccacccgcatcctgatgcacaccttccccaagacagacctgctgctggacagcgagagccagggcagcggggtcttcctgcctgagctggatgagcctgagtactgcaatgcccagaacacagccctgtgggagctgcacgccctgcggcggcactaccaccccatcgtgcagagatttgctgcccacctgattgctggggcccccagcgagggcagcggggccctgaagccagagctgagcagaagaagtgccacagagctgtttgaggcctacagcatggccgagatgaccttcaacccccctgtggagagcagcaaccccaagatcaaggtgaccaccaagggctag

SEQ ID NO: 162475 - DNA, 1551 bp, Artificial Sequence
  Description of Artificial Sequence: Synthetic coding sequence
atggagcgggagcctggagctgctggggtgagaagagccctgggccggcggctggaggccgtgctggccagccgctctgaggccaatgctgtgtttgacatcctggccgtgctgcagagcgaggaccaggaggagatccaggaggccgtgaggacctgcagccggctgtttggagccctgctggagcggggggagctgtttgtgggccagctgcccagcgaggagatggtgatgacaggcagccagggcgccaccaggaagtacaaggtgtggatgaggcaccgctaccacagctgctgcaaccggctgggggagctgctgggccaccccagcttccaggtgaaggagctggccctgagcgccctgctgaagtttgtgcagctggagggcgcccaccccctggagaagagcaagtgggagggcaactacctgttcccccgggagctgttcaagctggtggtgggcggcctgctgagccctgaggaggaccagagcctgctgctgagccagttccgggagtacctggactatgatgacacccgctaccacaccatgcaggccgctgtggatgctgtggcccgggtgacaggccagcaccctgaggtgcccccagccttctggaacaatgccttcaccctgctgtctgctgtgtccctgccccggcgggagcccaccgtgagcagcttctacgtgaagagagctgagctgtgggacacctggaaggtggcccacctgaaggagcacagaagagtcttccaggccatgtggctgtccttcctgaagcacaagctgcccctgagcctgtacaagaaggtgctgctgattgtgcatgatgccatcctgccccagctggcccagcccaccctgatgattgacttcctgacccgggcctgtgacctgggcggggccctgagcctgctggccctgaatggcctcttcatcctgatccacaagcacaacctggagtacccagacttctacaggaagctgtatggcctgctggaccccagcgtcttccacgtgaagtaccgggcccgcttcttccacctggccgacctcttcctgagcagcagccacctgcctgcctacctggtggccgcctttgccaagaggctggcccggctggccctgacagcccctcctgaggccctgctgatggtgctgcccttcatctgcaacctgctgcggcggcacccagcctgccgggtgctggtgcaccggccccacggccctgagctggatgctgacccctatgaccccggggaggaggaccctgcccagagccgggccctggagagcagcctgtgggagctgcaggccctgcagaggcactaccaccctgaggtgtccaaggccgccagcgtcatcaaccaggccctgtccatgcctgaggtgtccatcgcccccctgctggagctgacagcctatgagatctttgagcgggacctgaagaagaagggccctgagcctgtgcccctggagttcatcccagcccagggcctgctgggccggcctggagagctgtgtgcccagcacttcaccctgtcctag

SEQ ID NO: 162476 - DNA, 252 bp, Artificial Sequence
  Description of Artificial Sequence: Synthetic coding sequence
tgaccagaggagctgacctttgccagcgcccaggccgaggcccgggaggaggagaggagagtgcgggagaccgtgcggcgggacaagaccctgctgaaggagaagaggaagaggcgggaggagctgttcatcgagcagaagaagaggaagctgctgcctgacaccatcctggagaagctgaccacagccagccagaccaacatcaagaagagccctgggaaggtgaaggagggcatgaccatcctgatctag

SEQ ID NO: 162477 - DNA, 774 bp, Artificial Sequence
  Description of Artificial Sequence: Synthetic coding sequence
atggtgcagctgcggccccgggccagccgggccccagccagcgctgaggccatggtggatgagggccagctggccagcgaggaggaggaggccgagcacggcctgctgctgggccagcccagcagcggggctgctgctgagcccctggaggaggatgaggagggagatgatgaatttgatgatgaggcccctgaggagctgacctttgccagcgcccaggccgaggcccgggaggaggagaggagagtgcgggagaccgtgcggcgggacaagaccctgctgaaggagaagaggaagaggcgggaggagctgttcatcgagcagaagaagaggaagctgctgcctgacaccatcctggagaagctgaccacagccagccagaccaacatcaagaagagccctgggaaggtgaaggaggtgaacctgcagaagaagaatgaagactgtgagaagggaaatgacagcaagaaggtgaaggtgcagaaggtgcagagcgtgtcccagaacaagagctacctggccgtgcggctgaaggaccaggacctgcgggacagccggcagcaggccgcccaggccttcatccacaacagcctgtatggccctggcaccaacagaaccaccgtgaacaagttcctgagcctggccaacaagaggctgcctgtgaagagagctgctgtgcagttcctgaacaatgcctggggcatccagaagaagcagaatgccaagcgcttcaagaggcgctggatggtgaggaagatgaagaccaagaagtag

SEQ ID NO: 162478 - DNA, 3300 bp, Artificial Sequence
  Description of Artificial Sequence: Synthetic coding sequence
atgtctgtgctgaacaagaccaagtggaagggcggcaccctgcagatccagctggccaaggagagcttcctgcaccggctggcccaggagcgggaggccgccaaggccaagaaggaggagagcaccactggaaatgccaacctgctggagaagacaggaggagtggacttccacatgaaggctgtgcctggaacagaggtgcccggccacaagaactgggtggtgtccaagtttggccgggtgctgcctgtgctgcacctgaagaaccagcacaagaggaagatcatcaagtatgaccccagcaagtactgccacaacctgaagaagatcggggaggacttcagcaacaccatccccatcagcagcctgacctgggagctggagggcggcaatgaccccatgagcaagaagagaagaggagagttcagtgacttccacggcccccccaagaagatcatcaaggtgcagaaggatgagagcagcacaggcagcctggccatgagcacccggccccggcgggtgattgagcggccccccctgacccagcagcaggccgcccagaagaggacctgtgacagcatcacccccagcaagagcagccctgtgcctgtgtctgacacccagaagctgaagaacctgcccttcaagaccagcggcctggagacagccaagaagaggaacagcatcagtgatgatgacacagacagtgaagatgagctgaggatgatgattgccaaggaggagaacctgcagaggaccacccagcccagcatcaatgaaagtgaaagtgacccctttgaggtggtgagagatgacttcaagtctggagtgcacaagctgcacagcctcatcggcctgggcatcaagaacagagtgtcctgccacgacagtgatgatgacatcatgagaaatgaccgggagtatgacagcggggacacagatgagatcatcgccatgaagaagaatgtggccaaggtgaagaacagcacagagttcagccagatggagaagagcaccaagaagaccagcttcaagaaccgggagaactgtgagctgagtgaccactgcatcaagctgcagaagaggaagagcaatgtggagagcgccctgagccacggcctgaagagcctgaacaggaagagccccagccacagcagcagcagtgaagatgctgacagcgccagcgagctggccgacagcgagggcggggaggagtacaatgccatgatgaagaactgcctgcgggtgaacctgaccctggccgacctggagcagctggccggcagtgacctgaaggtgcccaatgaagacaccaagagtgatggccctgagaccaccacccagtgcaagtttgaccggggcagcaagagccccaagacccccaccggcctgcggcggggccggcagtgcatccggcctgctgagatcgtggccagcctgctggagggggaggagaacacctgtgggaagcagaagcccaaggagaacaacctgaagcccaagttccaggccttcaagggcgtgggctgcctgtatgagaaggagagcatgaagaagagcctgaaggacagcgtggccagcaacaacaaggaccagaacagcatgaagcatgaggaccccagcatcatctccatggaggatggcagcccctacgtgaatggcagcctgggggaggtgaccccctgccagcacgccaagaaggccaacggccccaactacatccagccccagaagaggcagaccacctttgagagccaggacaggaaggctgtgagccccagcagcagcgagaagaggagcaagaaccccatcagccggcccctggagggcaagaagagcctgagcctgagcgccaagacccacaacattggatttgacaaggacagctgccacagcaccaccaagacagaggccagccaggaggagaggagtgacagcagcggcctgaccagcctgaagaagagccccaaggtgagcagcaaggacacccgggagatcaagacagacttcagcctgagcatcagcaacagcagtgatgtgtctgccaaggacaagcatgctgaggacaatgagaagaggctggccgccctggaggcccggcagaaggccaaggaggtgcagaagaagctggtgcacaatgccctggccaacctggatggccaccctgaggacaagcccacccacatcatctttggaagtgacagtgaatgtgaaacagaggagaccagcacccaggagcagagccaccctggagaggagtgggtgaaggagagcatgggcaagaccagcggcaagctgtttgacagcagtgatgatgatgaaagtgacagtgaagatgacagcaaccgcttcaagatcaagccccagtttgagggccgggccggccagaagctgatggacctgcagagccactttggaacagatgaccgcttcaggatggacagccgcttcctggagacagacagcgaggaggagcaggaggaggtgaatgagaagaagacagctgaggaggaggagctggccgaggagaagaagaaggccctgaatgtggtgcagagcgtgctgcagatcaacctgagcaacagcaccaacagaggctctgtggccgccaagaagttcaaggacatcatccactatgaccccaccaagcaggaccacgccacctatgaaaggaagagagatgacaagcccaaggagagcaaggccaagaggaagaagaagcgggaggaggccgagaagctgcctgaggtgtccaaggagatgtactacaacatcgccatggacctgaaggagatcttccagaccaccaagtacaccagcgagaaggaggagggcaccccctggaatgaagactgtgggaaggagaagccagaggagatccaggaccctgctgccctgaccagtgatgctgagcagcccagcggcttcaccttctccttctttgacagcgacaccaaggacatcaaggaggagacctacagagtggagaccgtgaagccaggcaagatcgtgtggcaggaggacccccggctgcaggacagcagcagcgaggaggaggatgtgacagaggagacagaccacaggaacagcagccctggagaggccagcctgctggagaaggagaccacccgcttcttcttcttcagcaagaatgatgagcggctgcagggcagtgacctcttctggaggggcgtgggcagcaacatgagcagaaattcctgggaggcccggaccaccaacctgaggatggactgcaggaagaagcacaaggatgccaagaggaagatgaagcccaagtag

SEQ ID NO: 162479 - DNA, 3396 bp, Artificial Sequence
  Description of Artificial Sequence: Synthetic coding sequence
atgaaggtgaaccgggagaccaagaggctgtatgtgggcggcctgagccaggacatcagcgaggccgacctgcagaaccagttcagcagatttggagaggtgtctgatgtggagatcatcaccaggaaggatgaccagggcaacccccagaaggtgtttgcctacatcaacatctctgtggccgaggccgacctgaagaagtgcatgtctgtgctgaacaagaccaagtggaagggcggcaccctgcagatccagctggccaaggagagcttcctgcaccggctggcccaggagcgggaggccgccaaggccaagaaggaggagagcaccactggaaatgccaacctgctggagaagacaggaggagtggacttccacatgaaggctgtgcctggaacagaggtgcccggccacaagaactgggtggtgtccaagtttggccgggtgctgcctgtgctgcacctgaagaaccagcacaagcacctgaggaacatcatcaagtatgaccccagcaagtactgccacaacctgaagaagatcggggaggacttcagcaacaccatccccatcagcagcctgacctgggagctggagggcggcaatgaccccatgagcaagaagagaagaggagagttcagtgacttccacggcccccccaagaagatcatcaaggtgcagaaggatgagagcagcacaggcagcctggccatgagcacccggccccggcgggtgattgagcggccccccctgacccagcagcaggccgcccagaagaggacctgtgacagcatcacccccagcaagagcagccctgtgcctgtgtctgacacccagaagctgaagaacctgcccttcaagaccagcggcctggagacagccaagaagaggaacagcatcagtgatgatgacacagacagtgaagatgagctgaggatgatgattgccaaggaggagaacctgcagaggaccacccagcccagcatcaatgaaagtgaaagtgacccctttgaggtggtgagagatgacttcaagtctggagtgcacaagctgcacagcctcatcggcctgggcatcaagaacagagtgtcctgccacgacagtgatgatgacatcatgagaaatgaccgggagtatgacagcggggacacagatgagatcatcgccatgaagaagaatgtggccaaggtgaagaacagcacagagttcagccagatggagaagagcaccaagaagaccagcttcaagaaccgggagaactgtgagctgagtgaccactgcatcaagctgcagaagaggaagagcaatgtggagagcgccctgagccacggcctgaagagcctgaacaggaagagccccagccacagcagcagcagtgaagatgctgacagcgccagcgagctggccgacagcgagggcggggaggagtacaatgccatgatgaagaactgcctgcgggtgaacctgaccctggccgacctggagcagctggccggcagtgacctgaaggtgcccaatgaagacaccaagagtgatggccctgagaccaccacccagtgcaagtttgaccggggcagcaagagccccaagacccccaccggcctgcggcggggccggcagtgcatccggcctgctgagatcgtggccagcctgctggagggggaggagaacacctgtgggaagcagaagcccaaggagaacaacctgaagcccaagttccaggccttcaagggcgtgggctgcctgtatgagaaggagagcatgaagaagagcctgaaggacagcgtggccagcaacaacaaggaccagaacagcatgaagcatgaggaccccagcatcatctccatggaggatggcagcccctacgtgaatggcagcctgggggaggtgaccccctgccagcacgccaagaaggccaacggccccaactacatccagccccagaagaggcagaccacctttgagagccaggacaggaaggctgtgagccccagcagcagcgagaagaggagcaagaaccccatcagccggcccctggagggcaagaagagcctgagcctgagcgccaagacccacaacattggatttgacaaggacagctgccacagcaccaccaagacagaggccagccaggaggagaggagtgacagcagcggcctgaccagcctgaagaagagccccaaggtgagcagcaaggacacccgggagatcaagacagacttcagcctgagcatcagcaacagcagtgatgtgtctgccaaggacaagcatgctgaggacaatgagaagaggctggccgccctggaggcccggcagaaggccaaggaggtgcagaagaagctggtgcacaatgccctggccaacctggagagcatgggcaagaccagcggcaagctgtttgacagcagtgatgatgatgaaagtgacagtgaagatgacagcaaccgcttcaagatcaagccccagtttgagggccgggccggccagaagctgatggacctgcagagccactttggaacagatgaccgcttcaggatggacagccgcttcctggagacagacagcgaggaggagcaggaggaggtgaatgagaagaagacagctgaggaggaggagctggccgaggagaagaagaaggccctgaatgtggtgcagagcgtgctgcagatcaacctgagcaacagcaccaacagaggctctgtggccgccaagaagttcaaggacatcatccactatgaccccaccaagcaggaccacgccacctatgaaaggaagagagatgacaagcccaaggagagcaaggccaagaggaagaagaagcgggaggaggccgagaagctgcctgaggtgtccaaggagatgtactacaacatcgccatggacctgaaggagatcttccagaccaccaagtacaccagcgagaaggaggagggcaccccctggaatgaagactgtgggaaggagaagccagaggagatccaggaccctgctgccctgaccagtgatgctgagcagcccagcggcttcaccttctccttctttgacagcgacaccaaggacatcaaggaggagacctacagagtggagaccgtgaagccaggcaagatcgtgtggcaggaggacccccggctgcaggacagcagcagcgaggaggaggatgtgacagaggagacagaccacaggaacagcagccctggagaggccagcctgctggagaaggagaccacccgcttcttcttcttcagcaagaatgatgagcggctgcagggcagtgacctcttctggaggggcgtgggcagcaacatgagcagaaattcctgggaggcccggaccaccaacctgaggatggactgcaggaagaagcacaaggatgccaagaggaagatgaagcccaagtag

SEQ ID NO: 162480 - DNA, 777 bp, Artificial Sequence
  Description of Artificial Sequence: Synthetic coding sequence
atgaaggtgaaccgggagaccaagaggctgtatgtgggcggcctgagccaggacatcagcgaggccgacctgcagaaccagttcagcagatttggagaggtgtctgatgtggagatcatcaccaggaaggatgaccagggcaacccccagaaggtgtttgcctacatcaacatctctgtggccgaggccgacctgaagaagtgcatgtctgtgctgaacaagaccaagtggaagggcggcaccctgcagatccagctggccaaggagagcttcctgcaccggctggcccaggagcgggaggccgccaaggccaagaaggaggagagcaccactggaaatgccaacctgctggagaagacaggaggagtggacttccacatgaaggctgtgcctggaacagaggtgcccggccacaagaactgggtggtgtccaagtttggccgggtgctgcctgtgctgcacctgaagaaccagcacaagaggaagatcatcaagtatgaccccagcaagtactgccacaacctgaagaagatcggggaggacttcagcaacaccatccccatcagcagcctgacctgggagctggagggcggcaatgaccccatgagcaagaagagaagaggagagttcagtgacttccacggcccccccaagaagatcatcaaggtgcagaaggatgagagcagcacaggcagcctggccatgagcacccggccccggcgggtgattgagcggccccccctgacccagcagcaggccgcccagaagaggacatag

SEQ ID NO: 162481 - DNA, 2913 bp, Artificial Sequence
  Description of Artificial Sequence: Synthetic coding sequence
atgaaggtgaaccgggagaccaagaggctgtatgtgggcggcctgagccaggacatcagcgaggccgacctgcagaaccagttcagcagatttggagaggtgtctgatgtggagatcatcaccaggaaggatgaccagggcaacccccagaaggtgtttgcctacatcaacatctctgtggccgaggccgacctgaagaagtgcatgtctgtgctgaacaagaccaagtggaagggcggcaccctgcagatccagctggccaaggagagcttcctgcaccggctggcccaggagcgggaggccgccaaggccaagaaggaggagagcaccactggaaatgccaacctgctggagaagacaggaggagtggacttccacatgaaggctgtgcctggaacagaggtgcccggccacaagaactgggtggtgtccaagtttggccgggtgctgcctgtgctgcacctgaagaaccagcacaagaggaagatcatcaagtatgaccccagcaagtactgccacaacctgaagaagatcggggaggacttcagcaacaccatccccatcagcagcctgacctgggagctggagggcggcaatgaccccatgagcaagaagagaagaggagagttcagtgacttccacggcccccccaagaagatcatcaaggtgcagaaggatgagagcagcacaggcagcctggccatgagcacccggccccggcgggtgattgagcggccccccctgacccagcagcaggccgcccagaagaggacctgtgacagcatcacccccagcaagagcagccctgtgcctgtgtctgacacccagaagctgaagaacctgcccttcaagaccagcggcctggagacagccaagaagaggaacagcatcagtgatgatgacacagacagtgaagatgagctgaggatgatgattgccaaggaggagaacctgcagaggaccacccagcccagcatcaatgaaagtgaaagtgacccctttgaggtggtgagagatgacttcaagtctggagtgcacaagctgcacagcctcatcggcctgggcatcaagaacagagtgtcctgccacgacagtgatgatgacatcatgagaaatgaccgggagtatgacagcggggacacagatgagatcatcgccatgaagaagaatgtggccaaggtgaagaacagcacagagttcagccagatggagaagagcaccaagaagaccagcttcaagaaccgggagaactgtgagctgagtgaccactgcatcaagctgcagaagaggaagagcaatgtggagagcgccctgagccacggcctgaagagcctgaacaggaagagccccagccacagcagcagcagtgaagatgctgacagcgccagcgagctggccgacagcgagggcggggaggagtacaatgccatgatgaagaactgcctgcgggtgaacctgaccctggccgacctggagcagctggccggcagtgacctgaaggtgcccaatgaagacaccaagagtgatggccctgagaccaccacccagtgcaagtttgaccggggcagcaagagccccaagacccccaccggcctgcggcggggccggcagtgcatccggcctgctgagatcgtggccagcctgctggagggggaggagaacacctgtgggaagcagaagcccaaggagaacaacctgaagcccaagttccaggccttcaagggcgtgggctgcctgtatgagaaggagagcatgaagaagagcctgaaggacagcgtggccagcaacaacaaggaccagaacagcatgaagcatgaggaccccagcatcatctccatggaggatggcagcccctacgtgaatggcagcctgggggaggtgaccccctgccagcacgccaagaaggccaacggccccaactacatccagccccagaagaggcagaccacctttgagagccaggacaggaaggctgtgagccccagcagcagcgagaagaggagcaagaaccccatcagccggcccctggagggcaagaagagcctgagcctgagcgccaagacccacaacattggatttgacaaggacagctgccacagcaccaccaagacagaggccagccaggaggagaggagtgacagcagcggcctgaccagcctgaagaagagccccaaggtgagcagcaaggacacccgggagatcaagacagacttcagcctgagcatcagcaacagcagtgatgtgtctgccaaggacaagcatgctgaggacaatgagaagaggctggccgccctggaggcccggcagaaggccaaggaggtgcagaagaagctggtgcacaatgccctggccaacctggatggccaccctgaggacaagcccacccacatcatctttggaagtgacagtgaatgtgaaacagaggagaccagcacccaggagcagagccaccctggagaggagtgggtgaaggagagcatgggcaagaccagcggcaagctgtttgacagcagtgatgatgatgaaagtgacagtgaagatgacagcaaccgcttcaagatcaagccccagtttgagggccgggccggccagaagctgatggacctgcagagccactttggaacagatgaccgcttcaggatggacagccgcttcctggagacagacagcgaggaggagcaggaggaggtgaatgagaagaagacagctgaggaggaggagctggccgaggagaagaagaaggccctgaatgtggtgcagagcgtgctgcagatcaacctgagcaacagcaccaacagaggctctgtggccgccaagaagttcaaggacatcatccactatgaccccaccaagcaggaccacgccacctatgaaaggaagagagatgacaagcccaaggagagcaaggcctag

SEQ ID NO: 162482 - DNA, 1242 bp, Artificial Sequence
  Description of Artificial Sequence: Synthetic coding sequence
atgaaggtgaaccgggagaccaagaggctgtatgtgggcggcctgagccaggacatcagcgaggccgacctgcagaaccagttcagcagatttggagaggtgtctgatgtggagatcatcaccaggaaggatgaccagggcaacccccagaaggtgtttgcctacatcaacatctctgtggccgaggccgacctgaagaagtgcatgtctgtgctgaacaagaccaagtggaagggcggcaccctgcagatccagctggccaaggagagcttcctgcaccggctggcccaggagcgggaggccgccaaggccaagaaggaggagagcaccactggaaatgccaacctgctggagaagacaggaggagtggacttccacatgaaggctgtgcctggaacagaggtgcccggccacaagaactgggtggtgtccaagtttggccgggtgctgcctgtgctgcacctgaagaaccagcacaagaggaagatcatcaagtatgaccccagcaagtactgccacaacctgaagaagatcggggaggacttcagcaacaccatccccatcagcagcctgacctgggagctggagggcggcaatgaccccatgagcaagaagagaagaggagagttcagtgacttccacggcccccccaagaagatcatcaaggtgcagaaggatgagagcagcacaggcagcctggccatgagcacccggccccggcgggtgattgagcggccccccctgacccagcagcaggccgcccagaagaggacctgtgacagcatcacccccagcaagagcagccctgtgcctgtgtctgacacccagaagctgaagaacctgcccttcaagaccagcggcctggagacagccaagaagaggaacagcatcagtgatgatgacacagacagtgaagatgagctgaggatgatgattgccaaggaggagaacctgcagaggaccacccagcccagcatcaatgaaagtgaaagtgacccctttgaggtggtgagagatgacttcaagtctggagtgcacaagctgcacagcctcatcggcctgggcatcaagaacagagtgtcctgccacgacagtgatgatgacatcatgagaaatgaccgggagtatgacagcggggacacagatgagatcatcgccatgaagaagaatgtggccaaggtgaagaacagcacagagttcagccagatggagaagagcaccaagaagaccagcttcaagtag

SEQ ID NO: 162483 - DNA, 3504 bp, Artificial Sequence
  Description of Artificial Sequence: Synthetic coding sequence
atgaaggtgaaccgggagaccaagaggctgtatgtgggcggcctgagccaggacatcagcgaggccgacctgcagaaccagttcagcagatttggagaggtgtctgatgtggagatcatcaccaggaaggatgaccagggcaacccccagaaggtgtttgcctacatcaacatctctgtggccgaggccgacctgaagaagtgcatgtctgtgctgaacaagaccaagtggaagggcggcaccctgcagatccagctggccaaggagagcttcctgcaccggctggcccaggagcgggaggccgccaaggccaagaaggaggagagcaccactggaaatgccaacctgctggagaagacaggaggagtggacttccacatgaaggctgtgcctggaacagaggtgcccggccacaagaactgggtggtgtccaagtttggccgggtgctgcctgtgctgcacctgaagaaccagcacaagaggaagatcatcaagtatgaccccagcaagtactgccacaacctgaagaagatcggggaggacttcagcaacaccatccccatcagcagcctgacctgggagctggagggcggcaatgaccccatgagcaagaagagaagaggagagttcagtgacttccacggcccccccaagaagatcatcaaggtgcagaaggatgagagcagcacaggcagcctggccatgagcacccggccccggcgggtgattgagcggccccccctgacccagcagcaggccgcccagaagaggacctgtgacagcatcacccccagcaagagcagccctgtgcctgtgtctgacacccagaagctgaagaacctgcccttcaagaccagcggcctggagacagccaagaagaggaacagcatcagtgatgatgacacagacagtgaagatgagctgaggatgatgattgccaaggaggagaacctgcagaggaccacccagcccagcatcaatgaaagtgaaagtgacccctttgaggtggtgagagatgacttcaagtctggagtgcacaagctgcacagcctcatcggcctgggcatcaagaacagagtgtcctgccacgacagtgatgatgacatcatgagaaatgaccgggagtatgacagcggggacacagatgagatcatcgccatgaagaagaatgtggccaaggtgaagaacagcacagagttcagccagatggagaagagcaccaagaagaccagcttcaagaaccgggagaactgtgagctgagtgaccactgcatcaagctgcagaagaggaagagcaatgtggagagcgccctgagccacggcctgaagagcctgaacaggaagagccccagccacagcagcagcagtgaagatgctgacagcgccagcgagctggccgacagcgagggcggggaggagtacaatgccatgatgaagaactgcctgcgggtgaacctgaccctggccgacctggagcagctggccggcagtgacctgaaggtgcccaatgaagacaccaagagtgatggccctgagaccaccacccagtgcaagtttgaccggggcagcaagagccccaagacccccaccggcctgcggcggggccggcagtgcatccggcctgctgagatcgtggccagcctgctggagggggaggagaacacctgtgggaagcagaagcccaaggagaacaacctgaagcccaagttccaggccttcaagggcgtgggctgcctgtatgagaaggagagcatgaagaagagcctgaaggacagcgtggccagcaacaacaaggaccagaacagcatgaagcatgaggaccccagcatcatctccatggaggatggcagcccctacgtgaatggcagcctgggggaggtgaccccctgccagcacgccaagaaggccaacggccccaactacatccagccccagaagaggcagaccacctttgagagccaggacaggaaggctgtgagccccagcagcagcgagaagaggagcaagaaccccatcagccggcccctggagggcaagaagagcctgagcctgagcgccaagacccacaacattggatttgacaaggacagctgccacagcaccaccaagacagaggccagccaggaggagaggagtgacagcagcggcctgaccagcctgaagaagagccccaaggtgagcagcaaggacacccgggagatcaagacagacttcagcctgagcatcagcaacagcagtgatgtgtctgccaaggacaagcatgctgaggacaatgagaagaggctggccgccctggaggcccggcagaaggccaaggaggtgcagaagaagctggtgcacaatgccctggccaacctggatggccaccctgaggacaagcccacccacatcatctttggaagtgacagtgaatgtgaaacagaggagaccagcacccaggagcagagccaccctggagaggagtgggtgaaggagagcatgggcaagaccagcggcaagctgtttgacagcagtgatgatgatgaaagtgacagtgaagatgacagcaaccgcttcaagatcaagccccagtttgagggccgggccggccagaagctgatggacctgcagagccactttggaacagatgaccgcttcaggatggacagccgcttcctggagacagacagcgaggaggagcaggaggaggtgaatgagaagaagacagctgaggaggaggagctggccgaggagaagaagaaggccctgaatgtggtgcagagcgtgctgcagatcaacctgagcaacagcaccaacagaggctctgtggccgccaagaagttcaaggacatcatccactatgaccccaccaagcaggaccacgccacctatgaaaggaagagagatgacaagcccaaggagagcaaggccaagaggaagaagaagcgggaggaggccgagaagctgcctgaggtgtccaaggagatgtactacaacatcgccatggacctgaaggagatcttccagaccaccaagtacaccagcgagaaggaggagggcaccccctggaatgaagactgtgggaaggagaagccagaggagatccaggaccctgctgccctgaccagtgatgctgagcagcccagcggcttcaccttctccttctttgacagcgacaccaaggacatcaaggaggagacctacagagtggagaccgtgaagccaggcaagatcgtgtggcaggaggacccccggctgcaggacagcagcagcgaggaggaggatgtgacagaggagacagaccacaggaacagcagccctggagaggccagcctgctggagaaggagaccacccgcttcttcttcttcagcaagaatgatgagcggctgcagggcagtgacctcttctggaggggcgtgggcagcaacatgagcagaaattcctgggaggcccggaccaccaacctgaggatggactgcaggaagaagcacaaggatgccaagaggaagatgaagcccaagtag

SEQ ID NO: 162484 - DNA, 438 bp, Artificial Sequence
  Description of Artificial Sequence: Synthetic coding sequence
atgaaggtgaaccgggagaccaagaggctgtatgtgggcggcctgagccaggacatcagcgaggccgacctgcagaaccagttcagcagatttggagaggtgtctgatgtggagatcatcaccaggaaggatgaccagggcaacccccagaaggtgtttgcctacatcaacatctctgtggccgaggccgacctgaagaagtgcatgtctgtgctgaacaagaccaagtggaagggcggcaccctgcagatccagctggccaaggagagcttcctgcaccggctggcccaggagcgggaggccgccaaggccaagaaggaggagagcaccactggaaatgccaacctgctggagaagacaggaggagtggacttccacatgaaggctgtgcctggaacagaggtgcccggccacaagaactgggtggtgtccaagtag

SEQ ID NO: 162485 - DNA, 3504 bp, Artificial Sequence; identical to SEQ ID NO: 162483
  Description of Artificial Sequence: Synthetic coding sequence

SEQ ID NO: 162486 - DNA, 261 bp, Artificial Sequence
  Description of Artificial Sequence: Synthetic coding sequence
atgaaggtgaaccgggagaccaagaggctgtatgtgggcggcctgagccaggacatcagcgaggccgacctgcagaaccagttcagcagatttggagaggtgtctgatgtggagatcatcaccaggaaggatgaccagggcaacccccagaaggtgtttgcctacatcaacatctctgtggccgaggccgacctgaagaagagcatcttccacgtgatccagagggacagcagtgatgaggagaacagcagcatcgtgtag

SEQ ID NO: 162487 - DNA, 3441 bp, Artificial Sequence
  Description of Artificial Sequence: Synthetic coding sequence
atgggccctgccccagctggggagcagctgcggggggccaccggggagcctgaggtgatggagcccgccctggagggcaccgggaaggagggcaagaaggccagcagcaggaagaggaccctggccgagcccccagccaagggcctgctgcagcctgtgaagctgagcagagctgagctgtacaaggagcccaccaatgaggagctgaaccggctgcgggagacagagatcctcttccacagcagcctgctgcggctgcaggtggaggagctgctgaaggaggtgcggctgtctgagaagaagaaggacagaattgatgccttcctgcgggaggtgaaccagagggtggtgcgggtgcccagcgtgcctgagacagagctgacagaccaggcctggctgcctgctggggtgcgggtgcccctgcaccaggtgccctatgctgtgaagggctgcttccgcttcctgcccccagcccaggtgacagtggtgggcagctacctgctgggcacctgcatccggccagacatcaacgtggatgtggccctgaccatgccccgggagatcctgcaggacaaggatggcctgaaccagcgctacttcaggaagagggccctgtacctggcccacctggcccaccacctggcccaggaccccctgtttggatctgtgtgcttctcctacaccaacggctgccacctgaagcccagcctgctgctgcggccccggggcaaggatgagcggctggtgacagtgcggctgcacccctgccccccaccagacttcttccggccctgccgcctgctgcccaccaagaacaacgtgcgcagcgcctggtaccggggccagagccctgctggagatggcagccctgagccccccaccccccgctacaacacctgggtgctgcaggacacagtgctggagagccacctgcagctgctgagcaccatcctgagcagcgcccagggcctgaaggatggagtggccctgctgaaggtgtggctgcggcagcgggagctggacaagggccagggcggcttcaccggcttcctggtgtccatgctggtggtgttcctggtgtccaccaggaagatccacaccaccatgagcggctaccaggtgctgcggtctgtgctgcagttcctggccaccacagacctgactgtgaatggcatcagcctgtgcctgagcagtgaccccagcctgcctgccctggccgacttccaccaggccttctctgtggtgttcctggacagcagcggccacctgaacctgtgtgctgatgtgacagccagcacctaccaccaggtgcagcacgaggcccggctgtccatgatgctgctggacagcagagcagatgatggcttccacctgctgctgatgacccccaagcccatgatccgggcctttgaccacgtgctgcacctgcggcccctgagccggctgcaggccgcctgccaccggctgaagctgtggccagagctgcaggacaatggaggagactatgtgtctgctgccctgggccccctgaccaccctgctggagcagggcctgggcgcccggctgaacctgctggcccacagccggccccctgtgcctgagtgggacatcagccaggacccccccaagcacaaggacagcggcaccctgaccctgggcctgctgctgcggcctgagggcctgacctctgtgctggagctgggccctgaggccgaccagcctgaggccgccaagttccggcagttctggggcagccgctctgagctgcggcgcttccaggatggagccatccgggaggccgtggtgtgggaggccgcctccatgagccagaagaggctcatcccccaccaggtggtgacccacctgctggccctgcatgctgacatccctgagacctgtgtgcactacgtgggcggccccctggatgccctgatccagggcctgaaggagaccagcagcactggagaggaggccctggtggccgctgtgcgctgctatgatgacctgagccggctgctgtggggcctggagggcctgcccctgactgtgtctgctgtgcagggcgcccaccctgtgctgcgctacacagaggtgttcccccccacccctgtgcggcctgccttctccttctatgagaccctgcgggagaggagcagcctgctgccccggctggacaagccctgcccagcctacgtggagcccatgacagtggtgtgccacctggagggcagcggccagtggccccaggatgctgaggccgtgcagagggtgcgggccgccttccagctgcggctggccgagctgctgacccagcagcacggcctgcagtgccgggccacagccacccacacagatgtgctgaaggatggctttgtgttccgcatccgggtggcctaccagcgggagccccagatcctgaaggaggtgcagagccctgagggcatgatcagcctgcgggacacagctgccagcctgcggctggagcgggacacccggcagctgcccctgctgaccagcgccctgcacggcctgcagcagcagcacccagccttcagcggcgtggcccggctggccaagcgctgggtgcgggcccagctgctgggggagggctttgctgatgagagcctggacctggtggccgccgccctcttcctgcaccctgagcccttcaccccacccagcagcccccaggtgggcttcctgcgcttcctgttcctggtgtccacctttgactggaagaacaaccccctgtttgtgaacctgaacaatgagctgactgtggaggagcaggtggagatccgcagcggcttcctggccgcccgggcccagctgcctgtgatggtgattgtgaccccccaggacaggaagaacagcgtgtggacccaggacggccccagcgcccagatcctgcagcagctggtggtgctggccgctgaggccctgcccatgctggagaagcagctgatggacccccggggccctggggacatcagaacagtgttccggccccccctggacatctatgatgtgctgatccggctgagccccaggcacatccccaggcaccggcaggccgtggacagccctgctgccagcttctgccggggcctgctgagccagcccggccccagcagcctgatgcctgtgctgggctatgaccccccccagctgtacctgacccagctgcgggaggccttcggggacctggccctcttcttctatgaccagcacggcggggaggtgattggagtgctgtggaagcccaccagcttccagccccagcccttcaaggccagcagcaccaagggccgcatggtgatgagccggggcggggagctggtgatggtgcccaacgtggaggccatcctggaggactttgctgtgctgggggagggcctggtgcagacagtggaggcccggtctgagcgctggacagtgtag

SEQ ID NO: 162488 - DNA, 3024 bp, Artificial Sequence
  Description of Artificial Sequence: Synthetic coding sequence
atgggccctgccccagctggggagcagctgcggggggccaccggggagcctgaggtgatggagcccgccctggagggcaccgggaaggagggcaagaaggccagcagcaggaagaggaccctggccgagcccccagccaagggcctgctgcagcctgtgaagctgagcagagctgagctgtacaaggagcccaccaatgaggagctgaaccggctgcgggagacagagatcctcttccacagcagcctgctgcggctgcaggtggaggagctgctgaaggaggtgcggctgtctgagaagaagaaggacagaattgatgccttcctgcgggaggtgaaccagagggtggtgcgggtgcccagcgtgcctgagacagagctgacagaccaggcctggctgcctgctggggtgcgggtgcccctgcaccaggtgccctatgctgtgaagggctgcttccgcttcctgcccccagcccaggtgacagtggtgggcagctacctgctgggcacctgcatccggccagacatcaacgtggatgtggccctgaccatgccccgggagatcctgcaggacaaggatggcctgaaccagcgctacttcaggaagagggccctgtacctggcccacctggcccaccacctggcccaggaccccctgtttggatctgtgtgcttctcctacaccaacggctgccacctgaagcccagcctgctgctgcggccccggggcaaggatgagcggctggtgacagtgcggctgcacccctgccccccaccagacttcttccggccctgccgcctgctgcccaccaagaacaacgtgcgcagcgcctggtaccggggccagagccctgctggagatggcagccctgagccccccaccccccgctacaacacctgggtgctgcaggacacagtgctggagagccacctgcagctgctgagcaccatcctgagcagcgcccagggcctgaaggatggagtggccctgctgaaggtgtggctgcggcagcgggagctggacaagggccagggcggcttcaccggcttcctggtgtccatgctggtggtgttcctggtgtccaccaggaagatccacaccaccatgagcggctaccaggtgctgcggtctgtgctgcagttcctggccaccacagacctgactgtgaatggcatcagcctgtgcctgagcagtgaccccagcctgcctgccctggccgacttccaccaggccttctctgtggtgttcctggacagcagcggccacctgaacctgtgtgctgatgtgacagccagcacctaccaccaggtgcagcacgaggcccggctgtccatgatgctgctggacagcagagcagatgatggcttccacctgctgctgatgacccccaagcccatgatccgggcctttgaccacgtgctgcacctgcggcccctgagccggctgcaggccgcctgccaccggctgaagctgtggccagagctgcaggacaatggaggagactatgtgtctgctgccctgggccccctgaccaccctgctggagcagggcctgggcgcccggctgaacctgctggcccacagccggccccctgtgcctgagtgggacatcagccaggacccccccaagcacaaggacagcggcaccctgaccctgggcctgctgctgcggcctgagggcctgacctctgtgctggagctgggccctgaggccgaccagcctgaggccgccaagttccggcagttctggggcagccgctctgagctgcggcgcttccaggatggagccatccgggaggccgtggtgtgggaggccgcctccatgagccagaagaggctcatcccccaccaggtggtgacccacctgctggccctgcatgctgacatccctgagacctgtgtgcactacgtgggcggccccctggatgccctgatccagggcctgaaggagaccagcagcactggagaggaggccctggtggccgctgtgcgctgctatgatgacctgagccggctgctgtggggcctggagggcctgcccctgactgtgtctgctgtgcagggcgcccaccctgtgctgcgctacacagaggtgttcccccccacccctgtgcggcctgccttctccttctatgagaccctgcgggagaggagcagcctgctgccccggctggacaagccctgcccagcctacgtggagcccatgacagtggtgtgccacctggagggcagcggccagtggccccaggatgctgaggccgtgcagagggtgcgggccgccttccagctgcggctggccgagctgctgacccagcagcacggcctgcagtgccgggccacagccacccacacagatgtgctgaaggatggctttgtgttccgcatccgggtggcctaccagcgggagccccagatcctgaaggaggtgcagagccctgagggcatgatcagcctgcgggacacagctgccagcctgcggctggagcgggacacccggcagctgcccctgctgaccagcgccctgcacggcctgcagcagcagcacccagccttcagcggcgtggcccggctggccaagcgctgggtgcgggcccagctgctgggggagggctttgctgatgagagcctggacctggtggccgccgccctcttcctgcaccctgagcccttcaccccacccagcagcccccaggtgggcttcctgcgcttcctgttcctggtgtccacctttgactggaagaacaaccccctgtttgtgaacctgaacaatgagctgactgtggaggagcaggtggagatccgcagcggcttcctggccgcccgggcccagctgcctgtgatggtgattgtgaccccccaggacaggaagaacagcgtgtggacccaggacggccccagcgcccagatcctgcagcagctggtggtgctggccgctgaggccctgcccatgctggagaagcagctgatggacccccggggccctggggacatccgctgggaccctgccaagatgtggcccttctag

SEQ ID NO: 162489 - DNA, 2100 bp, Artificial Sequence
  Description of Artificial Sequence: Synthetic coding sequence
atgggccctgccccagctggggagcagctgcggggggccaccggggagcctgaggtgatggagcccgccctggagggcaccgggaaggagggcaagaaggccagcagcaggaagaggaccctggccgagcccccagccaagggcctgctgcagcctgtgaagctgagcagagctgagctgtacaaggagcccaccaatgaggagctgaaccggctgcgggagacagagatcctcttccacagcagcctgctgcggctgcaggtggaggagctgctgaaggaggtgcggctgtctgagaagaagaaggacagaattgatgccttcctgcgggaggtgaaccagagggtggtgcgggtgcccagcgtgcctgagacagagctgacagaccaggcctggctgcctgctggggtgcgggtgcccctgcaccaggtgccctatgctgtgaagggctgcttccgcttcctgcccccagcccaggtgacagtggtgggcagctacctgctgggcacctgcatccggccagacatcaacgtggatgtggccctgaccatgccccgggagatcctgcaggacaaggatggcctgaaccagcgctacttcaggaagagggccctgtacctggcccacctggcccaccacctggcccaggaccccctgtttggatctgtgtgcttctcctacaccaacggctgccacctgaagcccagcctgctgctgcggccccggggcaaggatgagcggctggtgacagtgcggctgcacccctgccccccaccagacttcttccggccctgccgcctgctgcccaccaagaacaacgtgcgcagcgcctggtaccggggccagagccctgctggagatggcagccctgagccccccaccccccgctacaacacctgggtgctgcaggacacagtgctggagagccacctgcagctgctgagcaccatcctgagcagcgcccagggcctgaaggatggagtggccctgctgaaggtgtggctgcggcagcgggagctggacaagggccagggcggcttcaccggcttcctggtgtccatgctggtggtgttcctggtgtccaccaggaagatccacaccaccatgagcggctaccaggtgctgcggtctgtgctgcagttcctggccaccacagacctgactgtgaatggcatcagcctgtgcctgagcagtgaccccagcctgcctgccctggccgacttccaccaggccttctctgtggtgttcctggacagcagcggccacctgaacctgtgtgctgatgtgacagccagcacctaccaccaggtgcagcacgaggcccggctgtccatgatgctgctggacagcagagcagatgatggcttccacctgctgctgatgacccccaagcccatgatccgggcctttgaccacgtgctgcacctgcggcccctgagccggctgcaggccgcctgccaccggctgaagctgtggccagagctgcaggacaatggaggagactatgtgtctgctgccctgggccccctgaccaccctgctggagcagggcctgggcgcccggctgaacctgctggcccacagccggccccctgtgcctgagtgggacatcagccaggacccccccaagcacaaggacagcggcaccctgaccctgggcctgctgctgcggcctgagggcctgacctctgtgctggagctgggccctgaggccgaccagcctgaggccgccaagttccggcagttctggggcagccgctctgagctgcggcgcttccaggatggagccatccgggaggccgtggtgtgggaggccgcctccatgagccagaagaggctcatcccccaccaggtggtgacccacctgctggccctgcatgctgacatccctgagacctgtgtgcactacgtgggcggccccctggatgccctgatccagggcctgaaggaggccagcagcaccaagggccgcatggtgatgagcagaggaggagagctggtgatggtgcccaacgtggaggccatcctggaggactttgctgtgctgggggagggcctggtgcagacagtggaggcccggtctgagcgctggacagtgtag

SEQ ID NO: 162490 - DNA, 603 bp, Artificial Sequence
  Description of Artificial Sequence: Synthetic coding sequence
atggtgattgtgaccccccaggacaggaagaacagcgtgtggacccaggacggccccagcgcccagatcctgcagcagctggtggtgctggccgctgaggccctgcccatgctggagaagcagctgatggacccccggggccctggggacatcagaacagtgttccggccccccctggacatctatgatgtgctgatccggctgagccccaggcacatccccaggcaccggcaggccgtggacagccctgctgccagcttctgccggggcctgctgagccagcccggccccagcagcctgatgcctgtgctgggctatgaccccccccagctgtacctgacccagctgcgggaggccttcggggacctggccctcttcttctatgaccagcacggcggggaggtgattggagtgctgtggaagcccaccagcttccagccccagcccttcaaggccagcagcaccaagggccgcatggtgatgagccggggcggggagctggtgatggtgcccaacgtggaggccatcctggaggactttgctgtgctgggggagggcctggtgcagacagtggaggcccggtctgagcgctggacagtgtag

SEQ ID NO: 162491 - DNA, 3072 bp, Artificial Sequence
  Description of Artificial Sequence: Synthetic coding sequence
atgggccctgccccagctggggagcagctgcggggggccaccggggagcctgaggtgatggagcccgccctggagggcaccgggaaggagggcaagaaggccagcagcaggaagaggaccctggccgagcccccagccaagggcctgctgcagcctgtgaagctgagcagagctgagctgtacaaggagcccaccaatgaggagctgaaccggctgcgggagacagagatcctcttccacagcagcctgctgcggctgcaggtggaggagctgctgaaggaggtgcggctgtctgagaagaagaaggacagaattgatgccttcctgcgggaggtgaaccagagggtggtgcgggtgcccagcgtgcctgagacagagctgacagaccaggcctggctgcctgctggggtgcgggtgcccctgcaccaggtgccctatgctgtgaagggctgcttccgcttcctgcccccagcccaggtgacagtggtgggcagctacctgctgggcacctgcatccggccagacatcaacgtggatgtggccctgaccatgccccgggagatcctgcaggacaaggatggcctgaaccagcgctacttcaggaagagggccctgtacctggcccacctggcccaccacctggcccaggaccccctgtttggatctgtgtgcttctcctacaccaacggctgccacctgaagcccagcctgctgctgcggccccggggcaaggatgagcggctggtgacagtgcggctgcacccctgccccccaccagacttcttccggccctgccgcctgctgcccaccaagaacaacgtgcgcagcgcctggtaccggggccagagccctgctggagatggcagccctgagccccccaccccccgctacaacacctgggtgctgcaggacacagtgctggagagccacctgcagctgctgagcaccatcctgagcagcgcccagggcctgaaggatggagtggccctgctgaaggtgtggctgcggcagcgggagctggacaagggccagggcggcttcaccggcttcctggtgtccatgctggtggtgttcctggtgtccaccaggaagatccacaccaccatgagcggctaccaggtgctgcggtctgtgctgcagttcctggccaccacagacctgactgtgaatggcatcagcctgtgcctgagcagtgaccccagcctgcctgccctggccgacttccaccaggccttctctgtggtgttcctggacagcagcggccacctgaacctgtgtgctgatgtgacagccagcacctaccaccaggtgcagcacgaggcccggctgtccatgatgctgctggacagcagagcagatgatggcttccacctgctgctgatgacccccaagcccatgatccgggcctttgaccacgtgctgcacctgcggcccctgagccggctgcaggccgcctgccaccggctgaagctgtggccagagctgcaggacaatggaggagactatgtgtctgctgccctgggccccctgaccaccctgctggagcagggcctgggcgcccggctgaacctgctggcccacagccggccccctgtgcctgagtgggacatcagccaggacccccccaagcacaaggacagcggcaccctgaccctgggcctgctgctgcggcctgagggcctgacctctgtgctggagctgggccctgaggccgaccagcctgaggccgccaagttccggcagttctggggcagccgctctgagctgcggcgcttccaggatggagccatccgggaggccgtggtgtgggaggccgcctccatgagccagaagaggctcatcccccaccaggtggtgacccacctgctggccctgcatgctgacatccctgagacctgtgtgcactacgtgggcggccccctggatgccctgatccagggcctgaaggagaccagcagcactggagaggaggccctggtggccgctgtgcgctgctatgatgacctgagccggctgctgtggggcctggagggcctgcccctgactgtgtctgctgtgcagggcgcccaccctgtgctgcgctacacagaggtgttcccccccacccctgtgcggcctgccttctccttctatgagaccctgcgggagaggagcagcctgctgccccggctggacaagccctgcccagcctacgtggagcccatgacagtggtgtgccacctggagggcagcggccagtggccccaggatgctgaggccgtgcagagggtgcgggccgccttccagctgcggctggccgagctgctgacccagcagcacggcctgcagtgccgggccacagccacccacacagatgtgctgaaggatggctttgtgttccgcatccgggtggcctaccagcgggagccccagatcctgaaggaggtgcagagccctgagggcatgatcagcctgcgggacacagctgccagcctgcggctggagcgggacacccggcagctgcccctgctgaccagcgccctgcacggcctgcagcagcagcacccagccttcagcggcgtggcccggctggccaagcgctgggtgcgggcccagctgctgggggagggctttgctgatgagagcctggacctggtggccgccgccctcttcctgcaccctgagcccttcaccccacccagcagcccccaggtgggcttcctgcgcttcctgttcctggtgtccacctttgactggaagaacaaccccctgtttgtgaacctgaacaatgagctgactgtggaggagcaggtggagatccgcagcggcttcctggccgcccgggcccagctgcctgtgatggtgattgtgaccccccaggacaggaagaacagcgtgtggacccaggacggccccagcgcccagatcctgcagcagctggtggtgctggccgctgaggccctgcccatgctggagaagcagctgatggacccccggggccctggggacatccgcatgggccccagtgaaaatgtggccctgctgagccacatcacagacacagagcagtggaagggggccatctgtgtgtag

SEQ ID NO: 162492 - DNA, 3285 bp, Artificial Sequence
  Description of Artificial Sequence: Synthetic coding sequence
atgggccctgccccagctggggagcagctgcggggggccaccggggagcctgaggtgatggagcccgccctggagggcaccgggaaggagggcaagaaggccagcagcaggaagaggaccctggccgagcccccagccaagggcctgctgcagcctgtgaagctgagcagagctgagctgtacaaggagcccaccaatgaggagctgaaccggctgcgggagacagagatcctcttccacagcagcctgctgcggctgcaggtggaggagctgctgaaggaggtgcggctgtctgagaagaagaaggacagaattgatgccttcctgcgggaggtgaaccagagggtggtgcgggtgcccagcgtgcctgagacagaggagatcctgcaggacaaggatggcctgaaccagcgctacttcaggaagagggccctgtacctggcccacctggcccaccacctggcccaggaccccctgtttggatctgtgtgcttctcctacaccaacggctgccacctgaagcccagcctgctgctgcggccccggggcaaggatgagcggctggtgacagtgcggctgcacccctgccccccaccagacttcttccggccctgccgcctgctgcccaccaagaacaacgtgcgcagcgcctggtaccggggccagagccctgctggagatggcagccctgagccccccaccccccgctacaacacctgggtgctgcaggacacagtgctggagagccacctgcagctgctgagcaccatcctgagcagcgcccagggcctgaaggatggagtggccctgctgaaggtgtggctgcggcagcgggagctggacaagggccagggcggcttcaccggcttcctggtgtccatgctggtggtgttcctggtgtccaccaggaagatccacaccaccatgagcggctaccaggtgctgcggtctgtgctgcagttcctggccaccacagacctgactgtgaatggcatcagcctgtgcctgagcagtgaccccagcctgcctgccctggccgacttccaccaggccttctctgtggtgttcctggacagcagcggccacctgaacctgtgtgctgatgtgacagccagcacctaccaccagggctggagcctgctgtggctgcaggtgcagcacgaggcccggctgtccatgatgctgctggacagcagagcagatgatggcttccacctgctgctgatgacccccaagcccatgatccgggcctttgaccacgtgctgcacctgcggcccctgagccggctgcaggccgcctgccaccggctgaagctgtggccagagctgcaggacaatggaggagactatgtgtctgctgccctgggccccctgaccaccctgctggagcagggcctgggcgcccggctgaacctgctggcccacagccggccccctgtgcctgagtgggacatcagccaggacccccccaagcacaaggacagcggcaccctgaccctgggcctgctgctgcggcctgagggcctgacctctgtgctggagctgggccctgaggccgaccagcctgaggccgccaagttccggcagttctggggcagccgctctgagctgcggcgcttccaggatggagccatccgggaggccgtggtgtgggaggccgcctccatgagccagaagaggctcatcccccaccaggtggtgacccacctgctggccctgcatgctgacatccctgagacctgtgtgcactacgtgggcggccccctggatgccctgatccagggcctgaaggagaccagcagcactggagaggaggccctggtggccgctgtgcgctgctatgatgacctgagccggctgctgtggggcctggagggcctgcccctgactgtgtctgctgtgcagggcgcccaccctgtgctgcgctacacagaggtgttcccccccacccctgtgcggcctgccttctccttctatgagaccctgcgggagaggagcagcctgctgccccggctggacaagccctgcccagcctacgtggagcccatgacagtggtgtgccacctggagggcagcggccagtggccccaggatgctgaggccgtgcagagggtgcgggccgccttccagctgcggctggccgagctgctgacccagcagcacggcctgcagtgccgggccacagccacccacacagatgtgctgaaggatggctttgtgttccgcatccgggtggcctaccagcgggagccccagatcctgaaggaggtgcagagccctgagggcatgatcagcctgcgggacacagctgccagcctgcggctggagcgggacacccggcagctgcccctgctgaccagcgccctgcacggcctgcagcagcagcacccagccttcagcggcgtggcccggctggccaagcgctgggtgcgggcccagctgctgggggagggctttgctgatgagagcctggacctggtggccgccgccctcttcctgcaccctgagcccttcaccccacccagcagcccccaggtgggcttcctgcgcttcctgttcctggtgtccacctttgactggaagaacaaccccctgtttgtgaacctgaacaatgagctgactgtggaggagcaggtggagatccgcagcggcttcctggccgcccgggcccagctgcctgtgatggtgattgtgaccccccaggacaggaagaacagcgtgtggacccaggacggccccagcgcccagatcctgcagcagctggtggtgctggccgctgaggccctgcccatgctggagaagcagctgatggacccccggggccctggggacatcagaacagtgttccggccccccctggacatctatgatgtgctgatccggctgagccccaggcacatccccaggcaccggcaggccgtggacagccctgctgccagcttctgccggggcctgctgagccagcccggccccagcagcctgatgcctgtgctgggctatgaccccccccagctgtacctgacccagctgcgggaggccttcggggacctggccctcttcttctatgaccagcacggcggggaggtgattggagtgctgtggaagcccaccagcttccagccccagcccttcaaggccagcagcaccaagggccgcatggtgatgagccggggcggggagctggtgatggtgcccaacgtggaggccatcctggaggactttgctgtgctgggggagggcctggtgcagacagtggaggcccggtctgagcgctggacagtgtag

SEQ ID NO: 162493 - DNA, 2109 bp, Artificial Sequence
  Description of Artificial Sequence: Synthetic coding sequence
atgatgctgctggacagcagagcagatgatggcttccacctgctgctgatgacccccaagcccatgatccgggcctttgaccacgtgctgcacctgcggcccctgagccggctgcaggccgcctgccaccggctgaagctgtggccagagctgcaggacaatggaggagactatgtgtctgctgccctgggccccctgaccaccctgctggagcagggcctgggcgcccggctgaacctgctggcccacagccggccccctgtgcctgagtgggacatcagccaggacccccccaagcacaaggacagcggcaccctgaccctgggcctgctgctgcggcctgagggcctgacctctgtgctggagctgggccctgaggccgaccagcctgaggccgccaagttccggcagttctggggcagccgctctgagctgcggcgcttccaggatggagccatccgggaggccgtggtgtgggaggccgcctccatgagccagaagaggctcatcccccaccaggtggtgacccacctgctggccctgcatgctgacatccctgagacctgtgtgcactacgtgggcggccccctggatgccctgatccagggcctgaaggagaccagcagcactggagaggaggccctggtggccgctgtgcgctgctatgatgacctgagccggctgctgtggggcctggagggcctgcccctgactgtgtctgctgtgcagggcgcccaccctgtgctgcgctacacagaggtgttcccccccacccctgtgcggcctgccttctccttctatgagaccctgcgggagaggagcagcctgctgccccggctggacaagccctgcccagcctacgtggagcccatgacagtggtgtgccacctggagggcagcggccagtggccccaggatgctgaggccgtgcagagggtgcgggccgccttccagctgcggctggccgagctgctgacccagcagcacggcctgcagtgccgggccacagccacccacacagatgtgctgaaggatggctttgtgttccgcatccgggtggcctaccagcgggagccccagatcctgaaggaggtgcagagccctgagggcatgatcagcctgcgggacacagctgccagcctgcggctggagcgggacacccggcagctgcccctgctgaccagcgccctgcacggcctgcagcagcagcacccagccttcagcggcgtggcccggctggccaagcgctgggtgcgggcccagctgctgggggagggctttgctgatgagagcctggacctggtggccgccgccctcttcctgcaccctgagcccttcaccccacccagcagcccccaggtgggcttcctgcgcttcctgttcctggtgtccacctttgactggaagaacaaccccctgtttgtgaacctgaacaatgagctgactgtggaggagcaggtggagatccgcagcggcttcctggccgcccgggcccagctgcctgtgatggtgattgtgaccccccaggacaggaagaacagcgtgtggacccaggacggccccagcgcccagatcctgcagcagctggtggtgctggccgctgaggccctgcccatgctggagaagcagctgatggacccccggggccctggggacatcagaacagtgttccggccccccctggacatctatgatgtgctgatccggctgagccccaggcacatccccaggcaccggcaggccgtggacagccctgctgccagcttctgccggggcctgctgagccagcccggccccagcagcctgatgcctgtgctgggctatgaccccccccagctgtacctgacccagctgcgggaggccttcggggacctggccctcttcttctatgaccagcacggcggggaggtgattggagtgctgtggaagcccaccagcttccagccccagcccttcaaggccagcagcaccaagggccgcatggtgatgagccggggcggggagctggtgatggtgcccaacgtggaggccatcctggaggactttgctgtgctgggggagggcctggtgcagacagtggaggcccggtctgagcgctggacagtgtag

SEQ ID NO: 162494 - DNA, 645 bp, Artificial Sequence
  Description of Artificial Sequence: Synthetic coding sequence
atgaacctgagcagcgccagcagcacagaggagaaggctgtgaccaccgtgctgtggggctgtgagctgagccaggagaggaggacctggaccttccggccccagctggagggcaagcagagctgccgcctgctgctgcacaccatctgcctgggggagaaggccaaggaggagatgcaccgggtggagatcctgcccccagccaaccaggaggacaagaagatgcagcctgtgaccatcgccagcctgcaggcctctgtgctgcccatggtgtccatggtgggcgtgcagctgagcccccctgtgaccttccagctgcgggccggcagcggccctgtgttcctgagcggccaggagagatatgaggccagtgacctgacctgggaggaggaggaggaggaggagggggaggaggaggaggaggaggaggaggatgatgaagatgaagatgctgacatcagcctggaggagcagagccctgtgaagcaggtgaagaggctggtgccccagaagcaggcctctgtggccaagaagaagaagctggagaaggaggaggaggagatccgggcctctgtgcgggacaagagccctgtgaagaaggccaaggccacagcccgggccaagaagccaggcttcaagaagtag

SEQ ID NO: 162495 - DNA, 411 bp, Artificial Sequence
  Description of Artificial Sequence: Synthetic coding sequence
atgaacctgagcagcgccagcagcacagaggagaaggctgtgaccaccgtgctgtggggctgtgagctgagccaggagaggaggacctggaccttccggccccagctggagggcaagcagagctgccgcctgctgctgcacaccatctgcctgggggagaaggccaaggaggagatgcaccgggtggagatcctgcccccagccaaccaggaggacaagaagatgcagcctgtgaccatcgccagcctgcaggcctctgtgctgcccatggtgtccatggtgggcgtgcagctgagcccccctgtgaccttccagctgcgggccggcagcggccctgtgttcctgagcggccaggagagatatgagaagaaggccggcaagagaagaagaggcaacaagagccagaggtag

SEQ ID NO: 162496 - DNA, 645 bp, Artificial Sequence; identical to SEQ ID NO: 162494
  Description of Artificial Sequence: Synthetic coding sequence

SEQ ID NO: 162497 - DNA, 645 bp, Artificial Sequence; identical to SEQ ID NO: 162494
  Description of Artificial Sequence: Synthetic coding sequence

SEQ ID NO: 162498 - DNA, 645 bp, Artificial Sequence; identical to SEQ ID NO: 162494
  Description of Artificial Sequence: Synthetic coding sequence

SEQ ID NO: 162499 - DNA, 537 bp, Artificial Sequence
  Description of Artificial Sequence: Synthetic coding sequence
atggctgctggaacagctgctgccctggccttcctgagccaggagagcaggacccgggccggcggcgtgggcggcctgcgggtgcctgcccctgtgaccatggacagcttcttcttcggctgtgagctgagcggccacaccaggagcttcaccttcaaggtggaggaggaggatgatgctgagcacgtgctggccctgaccatgctgtgcctgacagagggcgccaaggatgagtgcaatgtggtggaggtggtggccagaaatcatgaccaccaggagattgctgtgcctgtggccaacctgaagctgagctgccagcccatgctgagcctggatgacttccagctgcagccccctgtgaccttccggctgaagagcggcagcggccctgtgcgcatcaccggccgccaccagatcgtgaccatgagcaatgatgtgtctgaggaggagagcgaggaggaggaggaggacagtgatgaggaggaggtggagctgtgccccatcctgcctgccaagaagcagggcggccggccctag

SEQ ID NO: 162500 - DNA, 501 bp, Artificial Sequence
  Description of Artificial Sequence: Synthetic coding sequence
atgaagtacaccagctacatcctggccttccagctgtgcatcgtgctgggcagcctgggctgctactgccaggacccctacgtgaaggaggccgagaacctgaagaagtacttcaatgccggccacagtgatgtggccgacaatggcaccctcttcctgggcatcctgaagaactggaaggaggagagtgacaggaagatcatgcagagccagatcgtgtccttctacttcaagctgttcaagaacttcaaggatgaccagagcatccagaagtctgtggagaccatcaaggaggacatgaatgtgaagttcttcaacagcaacaagaagaagagagatgactttgagaagctgaccaactacagcgtgacagacctgaatgtgcagaggaaggccatccacgagctgatccaggtgatggccgagctgagccctgctgccaagacaggcaagaggaagaggagccagatgctgttccggggccggcgggccagccagtag

SEQ ID NO: 162501 - DNA, 2061 bp, Artificial Sequence
  Description of Artificial Sequence: Synthetic coding sequence
atgtccatgttcagtgacttcctgcagagcttcctgaagcacagcagcagcacagtgtttgacctggtggaggagtatgagaacatctgtggcagccaggtgaacatcctgagcaagatcgtgtcccgggccaccccaggcctgcagaagttcagcaagacagcctccatgctgtggctgctgcagcaggagatggtgacctggaggctgctggccagcctgtacagagaccgcatccagagcgccctggaggaggagagcgtgtttgctgtgacagctgtgaatgccagcgagaagacagtggtggaggccctcttccagagggacagcctggtgcggcagagccagctggtggtggactggctggagagcatcgccaaggatgagatcggggagttcagtgacaacatcgagttctacgccaagtctgtgtactgggagaacaccctgcacaccctgaagcagaggcagctgaccagctatgtgggctctgtgcggcccctggtgacagagctggaccctgatgcccccatccggcagaagatgcccctggatgacctggaccgggaggatgaggtgcggctgctgaagtacctgttcaccctcatccgggccggcatgacagaggaggcccagaggctgtgcaagagatgtggccaggcctggagggctgccaccctggagggctggaagctgtaccatgaccccaacgtgaatggaggaacagagctggagcctgtggagggcaacccctaccgccgcatctggaagatcagctgctggaggatggctgaagatgagctgttcaacagatatgaaagagccatctatgctgccctgagcggcaacctgaagcagctgctgcctgtgtgtgacacctgggaggacacagtgtgggcctacttccgggtgatggtggacagcctggtggagcaggagatccagacctctgtggccaccctggatgaaacagaggagctgccccgggagtacctgggcgccaactggaccctggagaaggtgtttgaggagctgcaggccacagacaagaagagggtgctggaggagaaccaggagcactaccacatcgtgcagaagttcctgatcctgggggacattgatggcctgatggatgagttcagcaagtggctgagcaagagcaggaacaacctgcccggccacctgctgcgcttcatgacccacctgatcctcttcttccgcaccctgggcctgcagaccaaggaggaggtgtccattgaggtgctgaagacctacatccaggaggaccggctgaagattgatgtgattgactggctggtgtttgatcctgcccagagagctgaggccctgaagcagggcaatgccatcatgaggaagttcctggccagcaagaagcatgaggccgccaaggaggtgtttgtgaagatcccccaggacagcattgctgagatctacaaccagtgtgaggagcagggcatggagagccccctgcctgcagaagatgacaatgccatccgggagcacctgtgcatccgggcctacctggaggcccacgagaccttcaatgagtggttcaagcacatgaacagcgtgccccagaagccagccctgatcccccagcccaccttcacagagaaggtggcccacgagcacaaggagaagaagtatgagatggactttggcatctggaagggccacctggatgccctgacagcagatgtgaaggagaagatgtacaacgtgctgctgtttgtggatggcggctggatggtggatgtgagagaagatgccaaggaggaccacgagaggacccaccagatggtgctgctgaggaagctgtgcctgcccatgctgtgcttcctgctgcacaccatcctgcacagcacaggccagtaccaggagtgcctgcagctggccgacatggtgagcagcgagcggcacaagctgtacctggtgttcagcaaggaggagctgaggaagctgctgcagaagctgcgggagagcagcctgatgctgctggaccagggcctggaccccctgggctatgagatccagctgtag

SEQ ID NO: 162502 - DNA, 2691 bp, Artificial Sequence
  Description of Artificial Sequence: Synthetic coding sequence
atgaagatcctggtgatcctgcaccaggagacccggctgagcctggagctgctggcccactttgacagcctggtgctgagcaccaacctgctcttcatcgtgacccccaccagccgcagcctgctgcggcagcctgacatcagctgcatcctgggcactggaggcaagagcccccggctgacccagagcagcggcttctttggaaacctgtccatggtgaccaacctggatgacagcaactgggccgccgccttcagcagccagaggagcggcctcttcaccaacacagagccccacagcatcacagaagatgtgaccatctctgctgtgatgctgcgggaggatgatcctggagaggccgcctccatgtccatgttcagtgacttcctgcagagcttcctgaagcacagcagcagcacagtgtttgacctggtggaggagtatgagaacatctgtggcagccaggtgaacatcctgagcaagatcgtgtcccgggccaccccaggcctgcagaagttcagcaagacagcctccatgctgtggctgctgcagcaggagatggtgacctggaggctgctggccagcctgtacagagaccgcatccagagcgccctggaggaggagagcgtgtttgctgtgacagctgtgaatgccagcgagaagacagtggtggaggccctcttccagagggacagcctggtgcggcagagccagctggtggtggactggctggagagcatcgccaaggatgagatcggggagttcagtgacaacatcgagttctacgccaagtctgtgtactgggagaacaccctgcacaccctgaagcagaggcagctgaccagctatgtgggctctgtgcggcccctggtgacagagctggaccctgatgcccccatccggcagaagatgcccctggatgacctggaccgggaggatgaggtgcggctgctgaagtacctgttcaccctcatccgggccggcatgacagaggaggcccagaggctgtgcaagagatgtggccaggcctggagggctgccaccctggagggctggaagctgtaccatgaccccaacgtgaatggaggaacagagctggagcctgtggagggcaacccctaccgccgcatctggaagatcagctgctggaggatggctgaagatgagctgttcaacagatatgaaagagccatctatgctgccctgagcggcaacctgaagcagctgctgcctgtgtgtgacacctgggaggacacagtgtgggcctacttccgggtgatggtggacagcctggtggagcaggagatccagacctctgtggccaccctggatgaaacagaggagctgccccgggagtacctgggcgccaactggaccctggagaaggtgtttgaggagctgcaggccacagacaagaagagggtgctggaggagaaccaggagcactaccacatcgtgcagaagttcctgatcctgggggacattgatggcctgatggatgagttcagcaagtggctgagcaagagcaggaacaacctgcccggccacctgctgcgcttcatgacccacctgatcctcttcttccgcaccctgggcctgcagaccaaggaggaggtgtccattgaggtgctgaagacctacatccagctgctgatccgggagaagcacaccaacctgattgccttctacacctgccacctgccccaggacctggccgtggcccagtatgccctcttcctggagagcgtgacagaatttgagcagaggcaccactgcctggagctggccaaggaggccgacctggatgtggccaccatcaccaagacagtggtggagaacatcaggaagaaggacaatggagagttcagccaccacgacctggccccagccctggacaccggcaccacagaggaggaccggctgaagattgatgtgattgactggctggtgtttgatcctgcccagagagctgaggccctgaagcagggcaatgccatcatgaggaagttcctggccagcaagaagcatgaggccgccaaggaggtgtttgtgaagatcccccaggacagcattgctgagatctacaaccagtgtgaggagcagggcatggagagccccctgcctgcagaagatgacaatgccatccgggagcacctgtgcatccgggcctacctggaggcccacgagaccttcaatgagtggttcaagcacatgaacagcgtgccccagaagccagccctgatcccccagcccaccttcacagagaaggtggcccacgagcacaaggagaagaagtatgagatggactttggcatctggaagggccacctggatgccctgacagcagatgtgaaggagaagatgtacaacgtgctgctgtttgtggatggcggctggatggtggatgtgagagaagatgccaaggaggaccacgagaggacccaccagatggtgctgctgaggaagctgtgcctgcccatgctgtgcttcctgctgcacaccatcctgcacagcacaggccagtaccaggagtgcctgcagctggccgacatggtgagcagcgagcggcacaagctgtacctggtgttcagcaaggaggagctgaggaagctgctgcagaagctgcgggagagcagcctgatgctgctggaccagggcctggaccccctgggctatgagatccagctgtag

SEQ ID NO: 162503 - DNA, 3471 bp, Artificial Sequence
  Description of Artificial Sequence: Synthetic coding sequence
atgtttcctgctgcccccagccccaggaccccaggcaccggcagccggcggggccccctggccggcctgggccctggcagcacccccaggacagccagcaggaagggcctgcccctgggcagcgctgtgagcagccctgtgctcttcagccctgtgggccgccgcagcagcctgagcagccggggcacccccaccaggatgttcccccaccacagcatcacagagagcgtgaactatgatgtgaagaccttcggcagcagcctgcctgtgaaggtgatggaggccctgaccctggccgaggtggatgaccagctgaccatcaacattgatgagggcggctgggcctgcctggtgtgcaaggagaagctgatcatctggaagatcgccctgagccccatcaccaagctgtctgtgtgcaaggagctgcagctgcccccaagtgacttccactggagcgctgacctggtggccctgagctacagcagccccagcggggaggcccacagcacccaggccgtggccgtgatggtggccacccgggagggcagcatccgctactggcccagcctggccggggaggacacctacacagaggcctttgtggacagcggcggggacaagacctacagcttcctgacagctgtgcagggcggcagcttcatcctgagcagcagcggcagccagctgatccgcctcatccctgagagcagcggcaagatccaccagcacatcctgccccagggccagggcatgctgtctggaattggaaggaaggtgagcagcctgtttggcatcctgagccccagcagtgacctgaccctgagctctgtgctgtgggaccgggagaggagcagcttctacagcctgaccagcagcaacatcagcaagtgggagctggatgacagcagcgagaagcacgcctacagctgggacatcaacagagccctgaaggagaacatcacagatgccatctggggcagcgagagcaactatgaggccatcaaggagggcgtgaacatccgctacctggacctgaagcagaactgtgatggcctggtgatcctggccgccgcctggcacagcgctgacaacccctgcctgatctactacagcctcatcaccatcgaggacaatggctgccagatgtctgatgctgtgacagtggaggtgacccagtacaacccccccttccagagcgaggacctgatcctgtgccagctgactgtgcccaacttcagcaaccagacagcctacctgtacaatgaatctgctgtgtatgtgtgcagcacaggcaccgggaagttcagcctgccccaggagaagatcgtgttcaatgcccagggcgacagcgtgctgggcgctggggcctgtggcggcgtgcccatcatcttcagcaggaacagcggcctggtgtccatcaccagcagagaaaatgtgtccatcctggccgaggacctggagggcagcctggccagctctgtggccggccccaacagcgagagcatgatctttgagaccaccaccaagaatgagaccatcgcccaggaggacaagatcaagctgctgaaggccgccttcctgcagtactgcaggaaggacctgggccacgcccagatggtggtggatgagctgttcagcagccacagcgacctggacagcgacagcgagctggacagagctgtgacccagatctctgtggacctgatggatgactacccagccagtgacccccgctgggccgagagcgtgcctgaggaggcccctggcttcagcaacaccagcctcatcatcctgcaccagctggaggacaagatgaaggcccacagcttcctgatggacttcatccaccaggtgggcctgtttggccgcctgggcagcttccctgtgcggggcacccccatggccacccggctgctgctgtgtgaacatgctgagaagctgtctgctgccatcgtgctgaagaaccaccacagccggctgagtgacctggtgaacacagccatcctgattgccctgaacaagcgggagtatgagatccccagcaacctgaccccagcagatgtgttcttccgggaggtgtcccaggtggacaccatctgtgaatgtctgctggagcacgaggagcaggtgctgagagatgcccccatggacagcattgagtgggccgaggtggtgatcaacgtgaacaacatcctgaaggacatgctgcaggccgccagccactaccggcagaacagaaacagcctgtacagaagagaggagagcctggagaaggagccagaatatgtgccctggacagccaccagcggccctgggggcatccgcaccgtcatcatccggcagcacgagatcgtgctgaaggtggcctacccccaggccgacagcaacctgaggaacatcgtgacagagcagctggtggccctgattgactgcttcctggatggctacgtgtcccagctgaagtctgtggacaagagcagcaaccgggagagatatgacaacctggagatggagtacctgcagaagagaagtgacctgctgagccccctgctgagcctgggccagtacctgtgggccgccagcctggccgagaagtactgtgactttgacatcctggtgcagatgtgtgagcagacagacaaccagagccggctgcagcgctacatgacccagtttgctgaccagaacttcagtgacttcctgttccgctggtacctggagaagggcaagaggggcaagctgctgagccagcccatcagccagcacggccagctggccaacttcctgcaggcccacgagcacctgtcctggctgcacgagatcaacagccaggagctggagaaggcccacgccaccctgctgggcctggccaacatggagacccgctactttgccaagaagaagaccctgctgggcctgagcaagctggccgccctggccagtgacttcagcgaggacatgctgcaggagaagattgaggagatggccgagcaggagcgcttcctgctgcaccaggagaccctgcctgagcagctgctggccgagaagcagctgaacctgagcgccatgcctgtgctgacagccccccagctgattggcctgtacatctgtgaagaaaatagaagagccaatgaatatgacttcaagaaggccctggacctgctggagtacattgatgaggaggaggacatcaacatcaatgacctgaagctggagatcctgtgcaaggccctgcagagggacaactggagcagcagtgatggcaaggatgaccccatcgaggtgtccaaggacagcatctttgtgaagatcctgcagaagctgctgaaggatggcatccagctgtctgagtacctgcctgaggtgaaggacctgctgcaggccgaccagctgggcagcctgaagagcaacccctactttgaatttgtgctgaaggccaactatgagtactacgtgcagggccagatctag

SEQ ID NO: 162504 - DNA, 675 bp, Artificial Sequence
  Description of Artificial Sequence: Synthetic coding sequence
atgtttcctgctgcccccagccccaggaccccaggcaccggcagccggcggggccccctggccggcctgggccctggcagcacccccaggacagccagcaggaagggcctgcccctgggcagcgctgtgagcagccctgtgctcttcagccctgtgggccgccgcagcagcctgagcagccggggcacccccaccaggatgttcccccaccacagcatcacagagagcgtgaactatgatgtgaagaccttcggcagcagcctgcctgtgaaggtgatggaggccctgaccctggccgaggtggatgaccagctgaccatcaacattgatgagggcggctgggcctgcctggtgtgcaaggagaagctgatcatctggaagatcgccctgagccccatcaccaagctgtctgtgtgcaaggagctgcagctgcccccaagtgacttccactggagcgctgacctggtggccctgagctacagcagccccagcggggaggcccacagcacccaggccgtggccgtgatggtggccacccgggagggcagcatccgctactggcccagcctggccggggaggacacctacacagaggcctttgtggacagcggcggggacaagacctacagcttcctgacagctgtgcaggtgcacaaggagaccaagtctggatag

SEQ ID NO: 162505 - DNA, 3207 bp, Artificial Sequence
  Description of Artificial Sequence: Synthetic coding sequence
atgtttcctgctgcccccagccccaggaccccaggcaccggcagccggcggggccccctggccggcctgggccctggcagcacccccaggacagccagcaggaagggcctgcccctgggcagcgctgtgagcagccctgtgctcttcagccctgtgggccgccgcagcagcctgagcagccggggcacccccaccaggatgttcccccaccacagcatcacagagagcgtgaactatgatgtgaagaccttcggcagcagcctgcctgtgaaggtgatggaggccctgaccctggccgaggtggatgaccagctgaccatcaacattgatgagggcggctgggcctgcctggtgtgcaaggagaagctgatcatctggaagatcgccctgagccccatcaccaagctgtctgtgtgcaaggagctgcagctgcccccaagtgacttccactggagcgctgacctggtggccctgagctacagcagccccagcggggaggcccacagcacccaggccgtggccgtgatggtggccacccgggagggcagcatccgctactggcccagcctggccggggaggacacctacacagaggcctttgtggacagcggcggggacaagacctacagcttcctgacagctgtgcagggcggcagcttcatcctgagcagcagcggcagccagctgatccgcctcatccctgagagcagcggcaagatccaccagcacatcctgccccagggccagggcatgctgtctggaattggaaggaaggtgagcagcctgtttggcatcctgagccccagcagtgacctgaccctgagctctgtgctgtgggaccgggagaggagcagcttctacagcctgaccagcagcaacatcagcaagtgggagctggatgacagcagcgagaagcacgcctacagctgggacatcaacagagccctgaaggagaacatcacagatgccatctggggcagcgagagcaactatgaggccatcaaggagggcgtgaacatccgctacctggacctgaagcagaactgtgatggcctggtgatcctggccgccgcctggcacagcgctgacaacccctgcctgatctactacagcctcatcaccatcgaggacaatggctgccagatgtctgatgctgtgacagtggaggtgacccagtacaacccccccttccagagcgaggacctgatcctgtgccagctgactgtgcccaacttcagcaaccagacagcctacctgtacaatgaatctgctgtgtatgtgtgcagcacaggcaccgggaagttcagcctgccccaggagaagatcgtgttcaatgcccagggcgacagcgtgctgggcgctggggcctgtggcggcgtgcccatcatcttcagcaggaacagcggcctggtgtccatcaccagcagagaaaatgtgtccatcctggccgaggacctggagggcagcctggccagctctgtggccggccccaacagcgagagcatgatctttgagaccaccaccaagaatgagaccatcgcccaggaggacaagatcaagctgctgaaggccgccttcctgcagtactgcaggaaggacctgggccacgcccagatggtggtggatgagctgttcagcagccacagcgacctggacagcgacagcgagctggacagagctgtgacccagatctctgtggacctgatggatgactacccagccagtgacccccgctgggccgagagcgtgcctgaggaggcccctggcttcagcaacaccagcctcatcatcctgcaccagctggaggacaagatgaaggcccacagcttcctgatggacttcatccaccaggtgggcctgtttggccgcctgggcagcttccctgtgcggggcacccccatggccacccggctgctgctgtgtgaacatgctgagaagctgtctgctgccatcgtgctgaagaaccaccacagccggctgagtgacctggtgaacacagccatcctgattgccctgaacaagcgggagtatgagatccccagcaacctgaccccagcagatgtgttcttccgggaggtgtcccaggtggacaccatctgtgaatgtctgctggagcacgaggagcaggtgctgagagatgcccccatggacagcattgagtgggccgaggtggtgatcaacgtgaacaacatcctgaaggacatgctgcaggccgccagccactaccggcagaacagaaacagcctgtacagaagagaggagagcctggagaaggagccagaatatgtgccctggacagccaccagcggccctgggggcatccgcaccgtcatcatccggcagcacgagatcgtgctgaaggtggcctacccccaggccgacagcaacctgaggaacatcgtgacagagcagctggtggccctgattgactgcttcctggatggctacgtgtcccagctgaagtctgtggacaagagcagcaaccgggagagatatgacaacctggagaagggcaagaggggcaagctgctgagccagcccatcagccagcacggccagctggccaacttcctgcaggcccacgagcacctgtcctggctgcacgagatcaacagccaggagctggagaaggcccacgccaccctgctgggcctggccaacatggagacccgctactttgccaagaagaagaccctgctgggcctgagcaagctggccgccctggccagtgacttcagcgaggacatgctgcaggagaagattgaggagatggccgagcaggagcgcttcctgctgcaccaggagaccctgcctgagcagctgctggccgagaagcagctgaacctgagcgccatgcctgtgctgacagccccccagctgattggcctgtacatctgtgaggagaacagaagagccaatgaatatgacttcaagaaggccctggacctgctggagtacattgatgaggaggaggacatcaacatcaatgacctgaagctggagatcctgtgcaaggccctgcagagggacaactggagcagcagtgatggcaaggatgaccccatcgaggtgtccaaggacagcatctttgtgaagatcctgcagaagctgctgaaggatggcatccagctgtctgagtacctgcctgaggtgaaggacctgctgcaggccgaccagctgggcagcatcaacgtgaacttctgctag

SEQ ID NO: 162506 - DNA, 3258 bp, Artificial Sequence
  Description of Artificial Sequence: Synthetic coding sequence
atgtttcctgctgcccccagccccaggaccccaggcaccggcagccggcggggccccctggccggcctgggccctggcagcacccccaggacagccagcaggaagggcctgcccctgggcagcgctgtgagcagccctgtgctcttcagccctgtgggccgccgcagcagcctgagcagccggggcacccccaccaggatgttcccccaccacagcatcacagagagcgtgaactatgatgtgaagaccttcggcagcagcctgcctgtgaaggtgatggaggccctgaccctggccgaggtggatgaccagctgaccatcaacattgatgagggcggctgggcctgcctggtgtgcaaggagaagctgatcatctggaagatcgccctgagccccatcaccaagctgtctgtgtgcaaggagctgcagctgcccccaagtgacttccactggagcgctgacctggtggccctgagctacagcagccccagcggggaggcccacagcacccaggccgtggccgtgatggtggccacccgggagggcagcatccgctactggcccagcctggccggggaggacacctacacagaggcctttgtggacagcggcggggacaagacctacagcttcctgacagctgtgcagggcggcagcttcatcctgagcagcagcggcagccagctgatccgcctcatccctgagagcagcggcaagatccaccagcacatcctgccccagggccagggcatgctgtctggaattggaaggaaggtgagcagcctgtttggcatcctgagccccagcagtgacctgaccctgagctctgtgctgtgggaccgggagaggagcagcttctacagcctgaccagcagcaacatcagcaagtgggagctggatgacagcagcgagaagcacgcctacagctgggacatcaacagagccctgaaggagaacatcacagatgccatctggggcagcgagagcaactatgaggccatcaaggagggcgtgaacatccgctacctggacctgaagcagaactgtgatggcctggtgatcctggccgccgcctggcacagcgctgacaacccctgcctgatctactacagcctcatcaccatcgaggacaatggctgccagatgtctgatgctgtgacagtggaggtgacccagtacaacccccccttccagagcgaggacctgatcctgtgccagctgactgtgcccaacttcagcaaccagacagcctacctgtacaatgaatctgctgtgtatgtgtgcagcacaggcaccgggaagttcagcctgccccaggagaagatcgtgttcaatgcccagggcgacagcgtgctgggcgctggggcctgtggcggcgtgcccatcatcttcagcaggaacagcggcctggtgtccatcaccagcagagaaaatgtgtccatcctggccgaggacctggagggcagcctggccagctctgtggccggccccaacagcgagagcatgatctttgagaccaccaccaagaatgagaccatcgcccaggaggacaagatcaagctgctgaaggccgccttcctgcagtactgcaggaaggacctgggccacgcccagatggtggtggatgagctgttcagcagccacagcgacctggacagcgacagcgagctggacagagctgtgacccagatctctgtggacctgatggatgactacccagccagtgacccccgctgggccgagagcgtgcctgaggaggcccctggcttcagcaacaccagcctcatcatcctgcaccagctggaggacaagatgaaggcccacagcttcctgatggacttcatccaccaggtgggcctgtttggccgcctgggcagcttccctgtgcggggcacccccatggccacccggctgctgctgtgtgaacatgctgagaagctgtctgctgccatcgtgctgaagaaccaccacagccggctgagtgacctggtgaacacagccatcctgattgccctgaacaagcgggagtatgagatccccagcaacctgaccccagcagatgtgttcttccgggaggtgtcccaggtggacaccatctgtgaatgtctgctggagcacgaggagcaggtgctgagagatgcccccatggacagcattgagtgggccgaggtggtgatcaacgtgaacaacatcctgaaggacatgctgcaggccgccagccactaccggcagaacagaaacagcctgtacagaagagaggagagcctggagaaggagccagaatatgtgccctggacagccaccagcggccctgggggcatccgcaccgtcatcatccggcagcacgagatcgtgctgaaggtggcctacccccaggccgacagcaacctgaggaacatcgtgacagagcagctggtggccctgattgactgcttcctggatggctacgtgtcccagctgaagtctgtggacaagagcagcaaccgggagagatatgacaacctggagaagggcaagaggggcaagctgctgagccagcccatcagccagcacggccagctggccaacttcctgcaggcccacgagcacctgtcctggctgcacgagatcaacagccaggagctggagaaggcccacgccaccctgctgggcctggccaacatggagacccgctactttgccaagaagaagaccctgctgggcctgagcaagctggccgccctggccagtgacttcagcgaggacatgctgcaggagaagattgaggagatggccgagcaggagcgcttcctgctgcaccaggagaccctgcctgagcagctgctggccgagaagcagctgaacctgagcgccatgcctgtgctgacagccccccagctgattggcctgtacatctgtgaggagaacagaagagccaatgaatatgacttcaagaaggccctggacctgctggagtacattgatgaggaggaggacatcaacatcaatgacctgaagctggagatcctgtgcaaggccctgcagagggacaactggagcagcagtgatggcaaggatgaccccatcgaggtgtccaaggacagcatctttgtgaagatcctgcagaagctgctgaaggatggcatccagctgtctgagtacctgcctgaggtgaaggacctgctgcaggccgaccagctgggcagcctgaagagcaacccctactttgaatttgtgctgaaggccaactatgagtactacgtgcagggccagatctag

SEQ ID NO: 162507 - DNA, 3423 bp, Artificial Sequence
  Description of Artificial Sequence: Synthetic coding sequence
atgggccccctggccggcctgggccctggcagcacccccaggacagccagcaggaagggcctgcccctgggcagcgctgtgagcagccctgtgctcttcagccctgtgggccgccgcagcagcctgagcagccggggcacccccaccaggatgttcccccaccacagcatcacagagagcgtgaactatgatgtgaagaccttcggcagcagcctgcctgtgaaggtgatggaggccctgaccctggccgaggtggatgaccagctgaccatcaacattgatgagggcggctgggcctgcctggtgtgcaaggagaagctgatcatctggaagatcgccctgagccccatcaccaagctgtctgtgtgcaaggagctgcagctgcccccaagtgacttccactggagcgctgacctggtggccctgagctacagcagccccagcggggaggcccacagcacccaggccgtggccgtgatggtggccacccgggagggcagcatccgctactggcccagcctggccggggaggacacctacacagaggcctttgtggacagcggcggggacaagacctacagcttcctgacagctgtgcagggcggcagcttcatcctgagcagcagcggcagccagctgatccgcctcatccctgagagcagcggcaagatccaccagcacatcctgccccagggccagggcatgctgtctggaattggaaggaaggtgagcagcctgtttggcatcctgagccccagcagtgacctgaccctgagctctgtgctgtgggaccgggagaggagcagcttctacagcctgaccagcagcaacatcagcaagtgggagctggatgacagcagcgagaagcacgcctacagctgggacatcaacagagccctgaaggagaacatcacagatgccatctggggcagcgagagcaactatgaggccatcaaggagggcgtgaacatccgctacctggacctgaagcagaactgtgatggcctggtgatcctggccgccgcctggcacagcgctgacaacccctgcctgatctactacagcctcatcaccatcgaggacaatggctgccagatgtctgatgctgtgacagtggaggtgacccagtacaacccccccttccagagcgaggacctgatcctgtgccagctgactgtgcccaacttcagcaaccagacagcctacctgtacaatgaatctgctgtgtatgtgtgcagcacaggcaccgggaagttcagcctgccccaggagaagatcgtgttcaatgcccagggcgacagcgtgctgggcgctggggcctgtggcggcgtgcccatcatcttcagcaggaacagcggcctggtgtccatcaccagcagagaaaatgtgtccatcctggccgaggacctggagggcagcctggccagctctgtggccggccccaacagcgagagcatgatctttgagaccaccaccaagaatgagaccatcgcccaggaggacaagatcaagctgctgaaggccgccttcctgcagtactgcaggaaggacctgggccacgcccagatggtggtggatgagctgttcagcagccacagcgacctggacagcgacagcgagctggacagagctgtgacccagatctctgtggacctgatggatgactacccagccagtgacccccgctgggccgagagcgtgcctgaggaggcccctggcttcagcaacaccagcctcatcatcctgcaccagctggaggacaagatgaaggcccacagcttcctgatggacttcatccaccaggtgggcctgtttggccgcctgggcagcttccctgtgcggggcacccccatggccacccggctgctgctgtgtgaacatgctgagaagctgtctgctgccatcgtgctgaagaaccaccacagccggctgagtgacctggtgaacacagccatcctgattgccctgaacaagcgggagtatgagatccccagcaacctgaccccagcagatgtgttcttccgggaggtgtcccaggtggacaccatctgtgaatgtctgctggagcacgaggagcaggtgctgagagatgcccccatggacagcattgagtgggccgaggtggtgatcaacgtgaacaacatcctgaaggacatgctgcaggccgccagccactaccggcagaacagaaacagcctgtacagaagagaggagagcctggagaaggagccagaatatgtgccctggacagccaccagcggccctgggggcatccgcaccgtcatcatccggcagcacgagatcgtgctgaaggtggcctacccccaggccgacagcaacctgaggaacatcgtgacagagcagctggtggccctgattgactgcttcctggatggctacgtgtcccagctgaagtctgtggacaagagcagcaaccgggagagatatgacaacctggagatggagtacctgcagaagagaagtgacctgctgagccccctgctgagcctgggccagtacctgtgggccgccagcctggccgagaagtactgtgactttgacatcctggtgcagatgtgtgagcagacagacaaccagagccggctgcagcgctacatgacccagtttgctgaccagaacttcagtgacttcctgttccgctggtacctggagaagggcaagaggggcaagctgctgagccagcccatcagccagcacggccagctggccaacttcctgcaggcccacgagcacctgtcctggctgcacgagatcaacagccaggagctggagaaggcccacgccaccctgctgggcctggccaacatggagacccgctactttgccaagaagaagaccctgctgggcctgagcaagctggccgccctggccagtgacttcagcgaggacatgctgcaggagaagattgaggagatggccgagcaggagcgcttcctgctgcaccaggagaccctgcctgagcagctgctggccgagaagcagctgaacctgagcgccatgcctgtgctgacagccccccagctgattggcctgtacatctgtgaagaaaatagaagagccaatgaatatgacttcaagaaggccctggacctgctggagtacattgatgaggaggaggacatcaacatcaatgacctgaagctggagatcctgtgcaaggccctgcagagggacaactggagcagcagtgatggcaaggatgaccccatcgaggtgtccaaggacagcatctttgtgaagatcctgcagaagctgctgaaggatggcatccagctgtctgagtacctgcctgaggtgaaggacctgctgcaggccgaccagctgggcagcctgaagagcaacccctactttgaatttgtgctgaaggccaactatgagtactacgtgcagggccagatctag

SEQ ID NO: 162508 - DNA, 4428 bp, Artificial Sequence
  Description of Artificial Sequence: Synthetic coding sequence
atggccagcggggccggcggcgtgggcggcggcggcggcggcaagatccgcacccggcgctgccaccagggccccatcaagccctaccagcagggccggcagcagcaccagggcatcctgagccgggtgacagagagcgtgaagaacatcgtgcccggctggctgcagcgctacttcaacaagaatgaagatgtgtgcagctgcagcacagacaccagcgaggtgccccgctggccagagaacaaggaggaccacctggtgtatgcagatgaggagagcagcaacatcacagatggccgcatcaccccagagcctgctgtgagcaacacagaggagcccagcaccaccagcacagccagcaactacccagatgtgctgacccggcccagcctgcacaggagccacctgaacttctccatgctggagagccctgccctgcactgccagcccagcaccagcagcgccttccccatcggcagcagcggcttcagcctggtgaaggagatcaaggacagcaccagccagcatgatgatgacaacatcagcaccaccagcggcttcagcagccgggccagtgacaaggacatcaccgtgtccaagaacaccagcctgccccccctgtggagccctgaggccgagaggagccacagcctgagccagcacacagccaccagcagcaagaagccagccttcaacctgagcgccttcggcaccctgagccccagcctgggcaacagcagcatcctgaagaccagccagctgggggacagccccttctacccaggcaagaccacctacggcggcgctgctgctgctgtgcggcagagcaagctgaggaacaccccctaccaggcccctgtgcggcggcagatgaaggccaagcagctgagcgcccagagctatggagtgaccagcagcacagcccggcgcatcctgcagagcctggagaagatgagcagccccctggctgatgccaagaggatccccagcatcgtgagcagccccctgaacagccccctggacagaagtggcatcgacatcacagacttccaggccaagcgggagaaggtggacagccagtacccacctgtgcagaggctgatgacccccaagcctgtgtccatcgccaccaacagatctgtgtacttcaagcccagcctgacccccagcggggagttcaggaagaccaaccagagaattgacaacaagtgcagcacaggctatgagaagaacatgaccccaggccagaaccgggagcagcgggagagcggcttctcctaccccaacttcagcctgcctgctgccaacggcctgagcagcggcgtgggcggcggcggcggcaagatgaggcgggagaggaccaggtttgtggccagcaagcccctggaggaggaggagatggaggtgcctgtgctgcccaagatcagcctgcccatcaccagcagcagcctgcccaccttcaacttcagcagccctgagatcaccaccagcagccccagccccatcaacagcagccaggccctgaccaacaaggtgcagatgaccagccccagcagcacaggcagccccatgttcaagttcagcagccccatcgtgaagagcacagaggccaacgtgctgccccccagcagcatcggcttcaccttctctgtgcctgtggccaagacagctgagctgagcggcagcagcagcaccctggagcccatcatcagcagcagcgcccaccacgtgaccaccgtgaacagcaccaactgcaagaagaccccacctgaggactgtgagggccccttccggcctgctgagatcctgaaggagggctctgtgctggacatcctgaagagccctggctttgccagccccaagattgacagcgtggccgcccagcccacagccaccagccctgtggtgtacaccaggcctgccatcagcagcttcagcagcagcggcatcggctttggagagagcctgaaggccggcagctcctggcagtgtgacacctgcctgctgcagaacaaggtgacagacaacaagtgcatcgcctgccaggccgccaagctgagcccccgggacacagccaagcagacaggaattgagacccccaacaagagcggcaagaccaccctgagcgccagcggcactggatttggagacaagttcaagcctgtgattggcacctgggactgtgacacctgcctggtgcagaacaagccagaggccatcaagtgtgtggcctgtgagacccccaagccaggcacctgtgtgaagagggccctgaccctgactgtggtgtctgagagcgctgagaccatgacagccagcagcagcagctgcaccgtgaccaccggcaccctgggctttggagacaagttcaagaggcccatcggctcctgggagtgcagcgtgtgctgcgtgagcaacaatgctgaggacaacaagtgtgtgtcctgcatgtctgagaagccaggcagctctgtgcctgccagcagcagcagcacagtgcctgtgtccctgcccagcggcggcagcctgggcctggagaagttcaagaagccagagggctcctgggactgtgagctgtgcctggtgcagaacaaggctgacagcaccaagtgcctggcctgtgagagcgccaagccaggcaccaagagcggcttcaagggctttgacaccagcagcagcagcagcaacagcgctgccagcagcagcttcaagtttggagtgagcagcagcagcagcggccccagccagaccctgaccagcactggaaacttcaagtttggagaccagggcggcttcaagattggagtgtccagtgacagcggcagcatcaaccccatgtctgagggcttcaagttcagcaagcccatcggggacttcaagtttggagtgtcctctgagagcaagccagaggaggtgaagaaggacagcaagaatgacaacttcaagtttggcctgagcagcggcctgagcaaccctgtgtccctgacccccttccagtttggagtgagcaacctgggccaggaggagaagaaggaggagctgcccaagagcagcagcgctggcttctcctttggcaccggggtcatcaacagcaccccagccccagccaacaccatcgtgaccagcgagaacaagagcagcttcaacctgggcaccatcgagaccaagagcgcctctgtggcccccttcacctgcaagaccagcgaggccaagaaggaggagatgcctgccaccaagggcggcttctcctttggaaatgtggagcccgccagcctgcccagcgcctctgtgtttgtgctgggccgcacagaggagaagcagcaggagcctgtgaccagcaccagcctggtgtttgggaagaaggctgacaatgaggagcccaagtgccagcctgtgttctcctttggaaacagcgagcagaccaaggatgagaacagcagcaagagcaccttctccttctccatgaccaagcccagcgagaaggagagcgagcagcctgccaaggccacctttgcctttggagcccagaccagcaccacagctgaccagggcgccgccaagcctgtgttctccttcctgaacaacagcagcagcagcagcagcaccccagccaccagcgctgggggcggcatcttcggcagcagcaccagcagcagcaacccccctgtggccacctttgtgtttggccagagcagcaaccctgtgagcagcagcgccttcggcaacacagctgagagcagcaccagccagagcctgctcttcagccaggacagcaagctggccaccaccagcagcactggaacagctgtgaccccatttgtgtttggacctggggccagcagcaacaacaccaccaccagcggctttggatttggagccaccaccaccagcagcagcgctggcagcagctttgtgtttggcaccggccccagcgcccccagcgccagccctgcctttggagccaaccagacccccaccttcggccagagccagggcgccagccagcccaaccccccaggcttcggcagcatcagcagcagcacagccctcttccccaccggcagccagcctgccccacccaccttcggcaccgtgagcagcagcagccagccccctgtgtttggccagcagcccagccagagcgcctttggaagtggcaccacccccaacagcagcagcgccttccagtttggcagcagcaccaccaacttcaacttcaccaacaacagccccagcggggtcttcacctttggagccaacagcagcaccccagctgccagcgcccagcccagcggcagcggcggcttccccttcaaccagagccctgctgccttcaccgtgggcagcaatggcaagaatgtgttcagcagcagcggcaccagcttcagcggcaggaagatcaagacagctgtgagaagaaggaagtag

SEQ ID NO: 162509 - DNA, 4368 bp, Artificial Sequence
  Description of Artificial Sequence: Synthetic coding sequence
ggcctgcggctgtgcctgagccggcccctgaccaggcctggagctggcagcggcggcggcagcgccatggccagcggggccggcggcgtgggcggcggcggcggcggcaagatccgcacccggcgctgccaccagggccccatcaagccctaccagcagggccggcagcagcaccagggcatcctgagccgggtgacagagagcgtgaagaacatcgtgcccggctggctgcagcgctacttcaacaagaatgaagatgtgtgcagctgcagcacagacaccagcgaggtgccccgctggccagagaacaaggaggaccacctggtgtatgcagatgaggagagcagcaacatcacagatggccgcatcaccccagagcctgctgtgagcaacacagaggagcccagcaccaccagcacagccagcaactacccagatgtgctgacccggcccagcctgcacaggagccacctgaacttctccatgctggagagccctgccctgcactgccagcccagcaccagcagcgccttccccatcggcagcagcggcttcagcctggtgaaggagatcaaggacagcaccagccagcatgatgatgacaacatcagcaccaccagcggcttcagcagccgggccagtgacaaggacatcaccgtgtccaagaacaccagcctgccccccctgtggagccctgaggccgagaggagccacagcctgagccagcacacagccaccagcagcaagaagccagccttcaacctgagcgccttcggcaccctgagccccagcctgggcaacagcagcatcctgaagaccagccagctgggggacagccccttctacccaggcaagaccacctacggcggcgctgctgctgctgtgcggcagagcaagctgaggaacaccccctaccaggcccctgtgcggcggcagatgaaggccaagcagctgagcgcccagagctatggagtgaccagcagcacagcccggcgcatcctgcagagcctggagaagatgagcagccccctggctgatgccaagaggatccccagcatcgtgagcagccccctgaacagccccctggacagaagtggcatcgacatcacagacttccaggccaagcgggagaaggtggacagccagtacccacctgtgcagaggctgatgacccccaagcctgtgtccatcgccaccaacagatctgtgtacttcaagcccagcctgacccccagcggggagttcaggaagaccaaccagagaattgacaacaagtgcagcacaggctatgagaagaacatgaccccaggccagaaccgggagcagcgggagagcggcttctcctaccccaacttcagcctgcctgctgccaacggcctgagcagcggcgtgggcggcggcggcggcaagatgaggcgggagaggaccaggtttgtggccagcaagcccctggaggaggaggagatggaggtgcctgtgctgcccaagatcagcctgcccatcaccagcagcagcctgcccaccttcaacttcagcagccctgagatcaccaccagcagccccagccccatcaacagcagccaggccctgaccaacaaggtgcagatgaccagccccagcagcacaggcagccccatgttcaagttcagcagccccatcgtgaagagcacagaggccaacgtgctgccccccagcagcatcggcttcaccttctctgtgcctgtggccaagacagctgagctgagcggcagcagcagcaccctggagcccatcatcagcagcagcggctttgccagccccaagattgacagcgtggccgcccagcccacagccaccagccctgtggtgtacaccaggcctgccatcagcagcttcagcagcagcggcatcggctttggagagagcctgaaggccggcagctcctggcagtgtgacacctgcctgctgcagaacaaggtgacagacaacaagtgcatcgcctgccaggccgccaagctgagcccccgggacacagccaagcagacaggaattgagacccccaacaagagcggcaagaccaccctgagcgccagcggcactggatttggagacaagttcaagcctgtgattggcacctgggactgtgacacctgcctggtgcagaacaagccagaggccatcaagtgtgtggcctgtgagacccccaagccaggcacctgtgtgaagagggccctgaccctgactgtggtgtctgagagcgctgagaccatgacagccagcagcagcagctgcaccgtgaccaccggcaccctgggctttggagacaagttcaagaggcccatcggctcctgggagtgcagcgtgtgctgcgtgagcaacaatgctgaggacaacaagtgtgtgtcctgcatgtctgagaagccaggcagctctgtgcctgccagcagcagcagcacagtgcctgtgtccctgcccagcggcggcagcctgggcctggagaagttcaagaagccagagggctcctgggactgtgagctgtgcctggtgcagaacaaggctgacagcaccaagtgcctggcctgtgagagcgccaagccaggcaccaagagcggcttcaagggctttgacaccagcagcagcagcagcaacagcgctgccagcagcagcttcaagtttggagtgagcagcagcagcagcggccccagccagaccctgaccagcactggaaacttcaagtttggagaccagggcggcttcaagattggagtgtccagtgacagcggcagcatcaaccccatgtctgagggcttcaagttcagcaagcccatcggggacttcaagtttggagtgtcctctgagagcaagccagaggaggtgaagaaggacagcaagaatgacaacttcaagtttggcctgagcagcggcctgagcaaccctgtgtccctgacccccttccagtttggagtgagcaacctgggccaggaggagaagaaggaggagctgcccaagagcagcagcgctggcttctcctttggcaccggggtcatcaacagcaccccagccccagccaacaccatcgtgaccagcgagaacaagagcagcttcaacctgggcaccatcgagaccaagagcgcctctgtggcccccttcacctgcaagaccagcgaggccaagaaggaggagatgcctgccaccaagggcggcttctcctttggaaatgtggagcccgccagcctgcccagcgcctctgtgtttgtgctgggccgcacagaggagaagcagcaggagcctgtgaccagcaccagcctggtgtttgggaagaaggctgacaatgaggagcccaagtgccagcctgtgttctcctttggaaacagcgagcagaccaaggatgagaacagcagcaagagcaccttctccttctccatgaccaagcccagcgagaaggagagcgagcagcctgccaaggccacctttgcctttggagcccagaccagcaccacagctgaccagggcgccgccaagcctgtgttctccttcctgaacaacagcagcagcagcagcagcaccccagccaccagcgctgggggcggcatcttcggcagcagcaccagcagcagcaacccccctgtggccacctttgtgtttggccagagcagcaaccctgtgagcagcagcgccttcggcaacacagctgagagcagcaccagccagagcctgctcttcagccaggacagcaagctggccaccaccagcagcactggaacagctgtgaccccatttgtgtttggacctggggccagcagcaacaacaccaccaccagcggctttggatttggagccaccaccaccagcagcagcgctggcagcagctttgtgtttggcaccggccccagcgcccccagcgccagccctgcctttggagccaaccagacccccaccttcggccagagccagggcgccagccagcccaaccccccaggcttcggcagcatcagcagcagcacagccctcttccccaccggcagccagcctgccccacccaccttcggcaccgtgagcagcagcagccagccccctgtgtttggccagcagcccagccagagcgcctttggaagtggcaccacccccaacagcagcagcgccttccagtttggcagcagcaccaccaacttcaacttcaccaacaacagccccagcggggtcttcacctttggagccaacagcagcaccccagctgccagcgcccagcccagcggcagcggcggcttccccttcaaccagagccctgctgccttcaccgtgggcagcaatggcaagaatgtgttcagcagcagcggcaccagcttcagcggcaggaagatcaagacagctgtgagaagaaggaagtag

SEQ ID NO: 162510 - DNA, 4521 bp, Artificial Sequence
  Description of Artificial Sequence: Synthetic coding sequence
atggccagcggggccggcggcgtgggcggcggcggcggcggcaagatccgcacccggcgctgccaccagggccccatcaagccctaccagcagggccggcagcagcaccagggcatcctgagccgggtgacagagagcgtgaagaacatcgtgcccggctggctgcagcgctacttcaacaagaatgaagatgtgtgcagctgcagcacagacaccagcgaggtgccccgctggccagagaacaaggaggaccacctggtgtatgcagatgaggagagcagcaacatcacagatggccgcatcaccccagagcctgctgtgagcaacacagaggagcccagcaccaccagcacagccagcaactacccagatgtgctgacccggcccagcctgcacaggagccacctgaacttctccatgctggagagccctgccctgcactgccagcccagcaccagcagcgccttccccatcggcagcagcggcttcagcctggtgaaggagatcaaggacagcaccagccagcatgatgatgacaacatcagcaccaccagcggcttcagcagccgggccagtgacaaggacatcaccgtgtccaagaacaccagcctgccccccctgtggagccctgaggccgagaggagccacagcctgagccagcacacagccaccagcagcaagaagccagccttcaacctgagcgccttcggcaccctgagccccagcctgggcaacagcagcatcctgaagaccagccagctgggggacagccccttctacccaggcaagaccacctacggcggcgctgctgctgctgtgcggcagagcaagctgaggaacaccccctaccaggcccctgtgcggcggcagatgaaggccaagcagctgagcgcccagagctatggagtgaccagcagcacagcccggcgcatcctgcagagcctggagaagatgagcagccccctggctgatgccaagaggatccccagcatcgtgagcagccccctgaacagccccctggacagaagtggcatcgacatcacagacttccaggccaagcgggagaaggtggacagccagtacccacctgtgcagaggctgatgacccccaagcctgtgtccatcgccaccaacagatctgtgtacttcaagcccagcctgacccccagcggggagttcaggaagaccaaccagagaattgacaacaagtgcagcacaggctatgagaagaacatgaccccaggccagaaccgggagcagcgggagagcggcttctcctaccccaacttcagcctgcctgctgccaacggcctgagcagcggcgtgggcggcggcggcggcaagatgaggcgggagaggaccaggtttgtggccagcaagcccctggaggaggagcggcagggcctgactgtgctgcccaagctgatcagcagcagctgtgcccaggccatcatccccagctggcccctgaaggtgctgcggctgcaggagatggaggtgcctgtgctgcccaagatcagcctgcccatcaccagcagcagcctgcccaccttcaacttcagcagccctgagatcaccaccagcagccccagccccatcaacagcagccaggccctgaccaacaaggtgcagatgaccagccccagcagcacaggcagccccatgttcaagttcagcagccccatcgtgaagagcacagaggccaacgtgctgccccccagcagcatcggcttcaccttctctgtgcctgtggccaagacagctgagctgagcggcagcagcagcaccctggagcccatcatcagcagcagcgcccaccacgtgaccaccgtgaacagcaccaactgcaagaagaccccacctgaggactgtgagggccccttccggcctgctgagatcctgaaggagggctctgtgctggacatcctgaagagccctggctttgccagccccaagattgattctgtggccgcccagcccacagccaccagccctgtggtgtacaccaggcctgccatcagcagcttcagcagcagcggcattggatttggagagagcctgaaggccggcagctcctggcagtgtgacacctgcctgctgcagaacaaggtgacagacaacaagtgcatcgcctgccaggccgccaagctgagcccccgggacacagccaagcagacaggcatcgagacccccaacaagagcggcaagaccaccctgagcgccagcggcaccggctttggagacaagttcaagcctgtgattggcacctgggactgtgacacctgcctggtgcagaacaagccagaggccatcaagtgtgtggcctgtgagacccccaagccaggcacctgtgtgaagagggccctgaccctgactgtggtgtctgagagcgctgagaccatgacagccagcagcagcagctgcaccgtgaccaccggcaccctgggctttggagacaagttcaagaggcccatcggctcctgggagtgcagcgtgtgctgcgtgagcaacaatgctgaggacaacaagtgtgtgtcctgcatgtctgagaagccaggcagctctgtgcctgccagcagcagcagcacagtgcctgtgtccctgcccagcggcggcagcctgggcctggagaagttcaagaagccagagggctcctgggactgtgagctgtgcctggtgcagaacaaggctgacagcaccaagtgcctggcctgtgagagcgccaagccaggcaccaagagcggcttcaagggctttgacaccagcagcagcagcagcaacagcgctgccagcagcagcttcaagtttggagtgagcagcagcagcagcggccccagccagaccctgaccagcacaggcaacttcaagtttggagaccagggcggcttcaagattggagtgtccagtgacagcggcagcatcaaccccatgtctgagggcttcaagttcagcaagcccatcggggacttcaagtttggagtgagcagcgagagcaagccagaggaggtgaagaaggacagcaagaatgacaacttcaagtttggcctgagcagcggcctgagcaaccctgtgtccctgacccccttccagtttggagtgagcaacctgggccaggaggagaagaaggaggagctgcccaagagcagcagcgctggcttctcctttggaactggagtcatcaacagcaccccagccccagccaacaccatcgtgaccagcgagaacaagagcagcttcaacctgggcaccatcgagaccaagagcgcctctgtggcccccttcacctgcaagaccagcgaggccaagaaggaggagatgcctgccaccaagggcggcttctcctttggaaatgtggagcccgccagcctgcccagcgcctctgtgtttgtgctgggccgcacagaggagaagcagcaggagcctgtgaccagcaccagcctggtgtttgggaagaaggctgacaatgaggagcccaagtgccagcccgtcttctcctttggaaattctgagcagaccaaggatgagaacagcagcaagagcaccttctccttctccatgaccaagcccagcgagaaggagagcgagcagcctgccaaggccacctttgccttcggggcccagaccagcaccacagctgaccagggcgccgccaagcctgtgttctccttcctgaacaacagcagcagcagcagcagcaccccagccaccagcgctgggggcggcatcttcggcagcagcaccagcagcagcaacccccctgtggccacctttgtgtttggccagagcagcaaccctgtgagcagcagcgcctttggaaacacagctgagagcagcaccagccagagcctgctcttcagccaggacagcaagctggccaccaccagcagcactggaacagctgtgaccccatttgtgtttggacctggggccagcagcaacaacaccaccaccagcggcttcggctttggagccaccaccaccagcagcagcgctggcagcagctttgtgtttggaacaggccccagcgcccccagcgccagccctgccttcggggccaaccagacccccaccttcggccagagccagggcgccagccagcccaaccccccaggcttcggcagcatcagcagcagcacagccctcttccccaccggcagccagcctgccccacccacctttggaacagtgagcagcagcagccagccccctgtgtttggccagcagcccagccagagcgccttcggcagcggcaccacccccaacagcagcagcgccttccagtttggcagcagcaccaccaacttcaacttcaccaacaacagccccagcggggtcttcaccttcggggccaacagcagcaccccagctgccagcgcccagcccagcggcagcggcggcttccccttcaaccagagccctgctgccttcaccgtgggcagcaatggcaagaatgtgttcagcagcagcggcaccagcttcagcggcaggaagatcaagacagctgtgagaagaaggaagtag

SEQ ID NO: 162511 - DNA, 3555 bp, Artificial Sequence
  Description of Artificial Sequence: Synthetic coding sequence
atgatgcagctgctgcagctgctgctgggcctgctgggccctgggggctacctgttcctgctgggggactgccaggaggtgaccaccctgactgtgaagtaccaggtgtctgaggaggtgcccagcggcaccgtcatcggcaagctgagccaggagctgggccgggaggagcggcggcggcaggccggggccgccttccaggtgctgcagctgccccaggccctgcccatccaggtggacagcgaggagggcctgctgagcacaggccggcggctggaccgggagcagctgtgccggcagtgggacccctgcctggtgtcctttgatgtgctggccactggagacctggccctgatccacgtggagatccaggtgctggacatcaatgaccaccagccccgcttccccaagggggagcaggagctggagatcagcgagagcgccagcctgcggacccgcatccccctggaccgggccctggaccctgacaccggccccaacaccctgcacacctacaccctgagccccagcgagcactttgccctggatgtgattgtgggcccagatgagaccaagcacgccgagctgattgtggtgaaggagctggaccgggagatccacagcttctttgacctggtgctgacagcctatgacaatggaaacccccccaagagcggcaccagcctggtgaaggtgaatgtgctggacagcaatgacaacagccctgcctttgctgagagcagcctggccctggagatccaggaggatgctgcccctggcaccctgctgatcaagctgacagccacagatcctgaccagggccccaacggggaggtggagttcttcctgagcaagcacatgcctcctgaggtgctggacaccttcagcattgatgccaagacaggccaggtgatcctgcggcggcccctggactatgagaagaacccagcctatgaggtggatgtgcaggcccgggacctgggccccaaccccatcccagcccactgcaaggtgctgatcaaggtgctggatgtgaatgacaacatccccagcatccacgtgacctgggccagccagcccagcctggtgtctgaggccctgcccaaggacagcttcatcgccctggtgatggctgatgacctggacagcggccacaacggcctggtgcactgctggctgagccaggagctgggccacttccggctgaagaggaccaacggcaacacctacatgctgctgaccaatgccaccctggaccgggagcagtggcccaagtacaccctgaccctgctggcccaggaccagggcctgcagcccctgagcgccaagaagcagctgagcatccagatcagtgacatcaatgacaatgcccctgtgtttgagaagagccgctatgaggtgtccacccgggagaacaacctgcccagcctgcacctgatcaccatcaaggcccatgatgctgacctgggcatcaacgggaaggtgtcctaccgcatccaggacagccctgtggcccacctggtggccatcgacagcaacacaggagaggtgacagcccagaggagcctgaactatgaggagatggccggctttgagttccaggtgattgctgaggacagcggccagcccatgctggccagctctgtgtctgtgtgggtgtccctgctggatgccaatgacaatgcccctgaggtggtgcagcctgtgctgagtgatggcaaggccagcctgtctgtgctggtgaatgccagcacaggccacctgctggtgcccatcgagacccccaacggcctgggccctgctggaacagacaccccacccctggccacccacagcagccggcccttcctgctgaccaccatcgtggccagagatgctgacagcggggccaatggagagcccctgtacagcatccgctctggaaatgaggcccacctgttcatcctgaacccccacacaggccagctgtttgtgaatgtgaccaatgccagcagcctgattggcagcgagtgggagctggagatcgtggtggaggaccagggcagcccccccctgcagacccgggccctgctgcgggtgatgtttgtgacctctgtggaccacctgcgggacagcgccaggaagccaggggccctgtccatgtccatgctgaccgtcatctgcctggccgtgctgctgggcatcttcggcctcatcctggccctcttcatgagcatctgcaggacagagaagaaggacaacagagcctacaactgccgggaggccgagagcacctaccggcagcagcccaagaggccccagaagcacatccagaaggctgacatccacctggtgcctgtgctgcggggccaggccggggagccctgtgaggtgggccagagccacaaggatgtggacaaggaggccatgatggaggccggctgggacccctgcctgcaggcccccttccacctgacccccaccctgtaccgcaccctgaggaaccagggcaaccagggcgccccagctgagagccgggaggtgctgcaggacacagtgaacctgctcttcaaccacccccggcagagaaatgccagccgggagaacctgaacctgcctgagccccagcctgccaccggccagcccaggagccggcccctgaaggtggccggcagccccaccggccgcctggccggggaccagggcagcgaggaggccccccagaggcccccagccagcagcgccaccctgcggcggcagaggcacctgaatggcaaggtgtccccagagaaggagagcggcccccggcagatcctgcggagcctggtgcggctgtctgtggccgcctttgctgagaggaaccctgtggaggagctgactgtggacagcccccctgtgcagcagatcagccagctgctgagcctgctgcaccagggccagttccagcccaagcccaaccaccggggcaacaagtacctggccaagccaggcggcagccgcagcgccatcccagacacagatggccccagcgcccgggccggcggccagacagatcctgagcaggaggagggccccctggaccctgaggaggacctgtctgtgaagcagctgctggaggaggagctgagcagcctgctggaccccagcacaggcctggccctggaccggctgagcgccccagaccctgcctggatggcccggctgagcctgcccctgaccaccaactacagagacaacgtcatcagcccagatgctgctgccacagaggagcccaggaccttccagaccttcggcaaggccgaggcccctgagctgagccccaccggcacccggctggccagcacctttgtgtctgagatgagcagcctgctggagatgctgctggagcagaggagctccatgcctgtggaggccgccagcgaggccctgcggcggctgtctgtgtgtggccgcaccctgagcctggacctggccaccagcgctgccagcggcatgaaggtgcagggcgaccccggcggcaagacaggaacagagggcaagagccggggcagcagcagcagcagccgctgcctgtag

SEQ ID NO: 162512 - DNA, 3999 bp, Artificial Sequence
  Description of Artificial Sequence: Synthetic coding sequence
atgtctgacatggactaccccctgcagggccctggcctgctgtctgtgcccaacctgcctgagatcagcagcatccggcgggtgcccctgcccccagagctggtggagcagtttggccacatgcagtgcaactgcatgatgggcgtcttcccccccatcagccgggcctggctgaccatcgacagcgacatcttcatgtggaactatgaagatggaggagacctggcctactttgatggcctgtctgagaccatcctggccgtgggcctggtgaagcccaaggccggcatcttccagccccacgtgcgccacctgctggtgctggccacccctgtggacatcgtcatcctgggcctgtcctatgccaacctgcagacaggcagcggcgtgctgaatgacagcctgagcggcggcatgcagctgctgcctgaccccctgtacagcctgcccacagacaacacctacctgctgaccatcaccagcacagacaatggccgcatcttcctggccggcaaggatggctgcctgtatgaggtggcctaccaggccgaggccggctggttcagccagcgctgcaggaagatcaaccacagcaagagcagcctgtccttcctggtgcccagcctgctgcagttcaccttctctgaagatgaccccatcctgcagatcgccatcgacaacagcaggaacatcctgtacaccaggtctgagaagggcgtcatccaggtgtatgacctgggccaggacggccagggcatgagccgggtggcctctgtgtcccagaatgccatcgtgtctgctgctggcaacatcgcccggaccatcgacaggagcgtcttcaagcccatcgtgcagattgctgtgattgagaacagcgagagcctggactgccagctgctggccgtgacccatgctggggtgcggctgtacttcagcacctgccccttccggcagcccctggcccggcccaacaccctgaccctggtgcacgtgcggctgcccccaggcttcagcgccagcagcacagtggagaagcccagcaaggtgcaccgggccctgtacagcaagggcatcctgctgatggccgcctctgaaaatgaagataatgacatcctgtggtgtgtgaaccacgacaccttccccttccagaagcccatgatggagacccagatgacagctggggtggatggccacagctgggccctgagcgccattgatgagctgaaggtggacaagatcatcacccccctgaacaaggaccacatccccatcacagacagccctgtggtggtgcagcagcacatgctgccccccaagaagtttgtgctgctgagcgcccagggcagcctgatgttccacaagctgcggcctgtggaccagctgcggcacctgctggtgtccaatgtgggcggagatggagaggagattgagcgcttcttcaagctgcaccaggaggaccaggcctgtgccacctgcctgatcctggcctgcagcacagctgcctgtgaccgggaggtgtctgcctgggccacccgggccttcttccgctatggaggagaggcccagatgaggttccccaccaccctgcccccacccagcaatgtgggccccatcctgggcagccctgtgtacagcagcagccctgtgcccagcggcagcccctaccccaaccccagcttcctgggcacccccagccacggcatccagcccccagccatgagcacccctgtgtgtgccctgggcaacccagccacccaggccaccaacatgagctgtgtgacaggccctgagatcgtgtacagcggcaagcacaacggcatctgcatctacttcagccgcatcatgggcaacatctgggatgccagcctggtggtggagcgcatcttcaagagcggcaaccgggagatcacagccatcgagagctctgtgccctgccagctgctggagagcgtgctgcaggagctgaagggcctgcaggagttcctggacaggaacagccagtttgctgggggccccctgggcaaccccaacaccacagccaaggtgcagcagaggctgattggcttcatgaggccagaaaatggaaacccccagcagatgcagcaggagctgcagaggaagttccacgaggcccagctgtctgagaagatcagcctgcaggccatccagcagctggtgaggaagagctaccaggccctggccctgtggaagctgctgtgtgagcaccagttcaccatcatcgtggccgagctgcagaaggagctgcaggagcagctgaagatcaccaccttcaaggacctggtgatccgggacaaggagctgactggagccctgattgccagcctcatcaactgctacatccgggacaatgctgctgtggatggcatcagcctgcacctgcaggacatctgccccctgctgtacagcacagatgatgccatctgcagcaaggccaatgagctgctgcagaggagccggcaggtgcagaacaagacagagaaggagaggatgctgcgggagagcctgaaggagtaccagaagatcagcaaccaggtggacctgagcaatgtgtgtgcccagtaccggcaggtgcgcttctatgaaggagtggtggagctgagcctgacagctgctgagaagaaggacccccagggcctgggcctgcacttctacaagcatggagagcctgaggaggacatcgtgggcctgcaggccttccaggagcggctgaacagctacaagtgcatcacagacaccctgcaggagctggtgaaccagagcaaggccgccccccagagccccagcgtgcccaagaagccaggcccccctgtgctgagcagtgaccccaacatgctgagcaatgaggaggccggccaccactttgagcagatgctgaagctgagccagaggagcaaggatgagctgttcagcatcgccctgtacaactggctgatccaggtggacctggccgacaagctgctgcaggtggccagccccttcctggagccccacctggtgaggatggccaaggtggaccagaacagagtgcgctacatggacctgctgtggagatactatgagaagaacagaagcttcagcaatgctgcccgggtgctgagccggctggccgacatgcacagcacagagatcagcctgcagcagaggctggagtacatcgcccgggccatcctgagcgccaagagcagcacagccatcagcagcattgctgctgatggagagttcctgcacgagctggaggagaagatggaggtggcccgcatccagctgcagatccaggagaccctgcagaggcagtacagccaccacagctctgtgcaggatgctgtgtcccagctggacagcgagctgatggacatcaccaagctgtatggagaatttgctgaccccttcaagctggccgagtgcaagctggccatcatccactgtgccggctacagcgaccccatcctggtgcagaccctgtggcaggacatcatcgagaaggagctgagtgacagcgtgaccctgagcagcagtgacaggatgcacgccctgagcctgaagatcgtgctgctgggcaagatctatgccggcaccccccgcttcttccccctggacttcatcgtgcagttcctggagcagcaggtgtgcaccctgaactgggatgtgggctttgtgatccagaccatgaatgaaattggagtgcccctgccccggctgctggaggtgtatgaccagctgttcaagagccgggaccccttctggaacaggatgaagaagcccctgcacctgctggactgcatccacgtgctgctgatccgctacgtggagaaccccagccaggtgctgaactgtgaaagaagacgcttcaccaacctgtgcctggatgctgtgtgtggctacctggtggagctgcagagcatgagcagctctgtggccgtgcaggccatcaccggcaacttcaagagcctgcaggccaagctggagcggctgcactag

SEQ ID NO: 162513 - DNA, 4062 bp, Artificial Sequence
  Description of Artificial Sequence: Synthetic coding sequence
atgtacccagacctgtctgagctgctgatggtgtctgcccccaacaaccccaccgtgtctggcatgtctgacatggactaccccctgcagggccctggcctgctgtctgtgcccaacctgcctgagatcagcagcatcagaagagtgcccctgcccccagagctggtggagcagtttggccacatgcagtgcaactgcatgatgggcgtcttcccccccatcagccgggcctggctgaccatcgacagcgacatcttcatgtggaactatgaagatggaggagacctggcctactttgatggcctgtctgagaccatcctggccgtgggcctggtgaagcccaaggccggcatcttccagccccacgtgcgccacctgctggtgctggccacccctgtggacatcgtcatcctgggcctgtcctatgccaacctgcagacaggcagcggcgtgctgaatgacagcctgagcggcggcatgcagctgctgcctgaccccctgtacagcctgcccacagacaacacctacctgctgaccatcaccagcacagacaatggccgcatcttcctggccggcaaggatggctgcctgtatgaggtggcctaccaggccgaggccggctggttcagccagcgctgcaggaagatcaaccacagcaagagcagcctgtccttcctggtgcccagcctgctgcagttcaccttctctgaagatgaccccatcctgcagatcgccatcgacaacagcaggaacatcctgtacaccaggtctgagaagggcgtcatccaggtgtatgacctgggccaggacggccagggcatgagccgggtggcctctgtgtcccagaatgccatcgtgtctgctgctggcaacatcgcccggaccatcgacagatctgtgttcaagcccatcgtgcagattgctgtgattgaaaattctgagagcctggactgccagctgctggccgtgacccacgccggcgtgcggctgtacttcagcacctgccccttccggcagcccctggcccggcccaacaccctgaccctggtgcacgtgcggctgcccccaggcttcagcgccagcagcacagtggagaagcccagcaaggtgcaccgggccctgtacagcaagggcatcctgctgatggccgcctctgaaaatgaagataatgacatcctgtggtgtgtgaaccacgacaccttccccttccagaagcccatgatggagacccagatgacagctggggtggatggccacagctgggccctgagcgccattgatgagctgaaggtggacaagatcatcacccccctgaacaaggaccacatccccatcacagacagccctgtggtggtgcagcagcacatgctgccccccaagaagtttgtgctgctgagcgcccagggcagcctgatgttccacaagctgcggcctgtggaccagctgcggcacctgctggtgtccaatgtgggcggagatggagaggagattgagcgcttcttcaagctgcaccaggaggaccaggcctgtgccacctgcctgatcctggcctgcagcacagctgcctgtgaccgggaggtgtctgcctgggccacccgggccttcttccgctatggaggagaggcccagatgaggttccccaccaccctgcccccacccagcaatgtgggccccatcctgggcagccctgtgtacagcagcagccctgtgcccagcggcagcccctaccccaaccccagcttcctgggcacccccagccacggcatccagcccccagccatgagcacccctgtgtgtgccctgggcaacccagccacccaggccaccaacatgagctgtgtgactggacctgagatcgtgtacagcggcaagcacaacggcatctgcatctacttcagccgcatcatgggcaacatctgggatgccagcctggtggtggagcgcatcttcaagagcggcaaccgggagatcacagccatcgagagctctgtgccctgccagctgctggagagcgtgctgcaggagctgaagggcctgcaggagttcctggacaggaacagccagtttgctgggggccccctgggcaaccccaacaccacagccaaggtgcagcagaggctcatcggcttcatgaggccagaaaatggaaacccccagcagatgcagcaggagctgcagaggaagttccacgaggcccagctgtctgagaagatcagcctgcaggccatccagcagctggtgaggaagagctaccaggccctggccctgtggaagctgctgtgtgagcaccagttcaccatcatcgtggccgagctgcagaaggagctgcaggagcagctgaagatcaccaccttcaaggacctggtgatccgggacaaggagctgaccggggccctgattgccagcctcatcaactgctacatccgggacaatgctgctgtggatggcatcagcctgcacctgcaggacatctgccccctgctgtacagcacagatgatgccatctgcagcaaggccaatgagctgctgcagaggagccggcaggtgcagaacaagacagagaaggagaggatgctgcgggagagcctgaaggagtaccagaagatcagcaaccaggtggacctgagcaatgtgtgtgcccagtaccggcaggtgcgcttctatgagggcgtggtggagctgagcctgacagctgctgagaagaaggacccccagggcctgggcctgcacttctacaagcacggggagccagaagaagatattgtgggcctgcaggccttccaggagcggctgaacagctacaagtgcatcacagacaccctgcaggagctggtgaaccagagcaaggccgccccccagagccccagcgtgcccaagaagccaggcccccctgtgctgagcagtgaccccaacatgctgagcaatgaggaggccggccaccactttgagcagatgctgaagctgagccagaggagcaaggatgagctgttcagcatcgccctgtacaactggctgatccaggtggacctggccgacaagctgctgcaggtggccagccccttcctggagccccacctggtgaggatggccaaggtggaccagaacagagtgcgctacatggacctgctgtggagatactatgagaagaacagaagcttcagcaatgctgcccgggtgctgagccggctggccgacatgcacagcacagagatcagcctgcagcagaggctggagtacatcgcccgggccatcctgagcgccaagagcagcacagccatcagcagcattgctgctgatggagagttcctgcacgagctggaggagaagatggaggtggcccgcatccagctgcagatccaggagaccctgcagaggcagtacagccaccacagctctgtgcaggatgctgtgtcccagctggacagcgagctgatggacatcaccaagctgtatggagaatttgctgaccccttcaagctggccgagtgcaagctggccatcatccactgtgccggctacagcgaccccatcctggtgcagaccctgtggcaggacatcatcgagaaggagctgagtgacagcgtgaccctgagcagcagtgacaggatgcacgccctgagcctgaagatcgtgctgctgggcaagatctatgccggcaccccccgcttcttccccctggacttcatcgtgcagttcctggagcagcaggtgtgcaccctgaactgggatgtgggcttcgtcatccagaccatgaatgaaattggagtgcccctgccccggctgctggaggtgtatgaccagctgttcaagagccgggaccccttctggaacaggatgaagaagcccctgcacctgctggactgcatccacgtgctgctgatccgctacgtggagaaccccagccaggtgctgaactgtgagcggcggcgcttcaccaacctgtgcctggatgctgtgtgtggctacctggtggagctgcagagcatgagcagctctgtggccgtgcaggccatcactggaaacttcaagagcctgcaggccaagctggagcggctgcactag

SEQ ID NO: 162514 - DNA, 3984 bp, Artificial Sequence
  Description of Artificial Sequence: Synthetic coding sequence
atgcccagcagcctgctgggcgccgccatgcctgccagcaccagcgctgctgccctgcaggaggccctggagaatgccggccgcctgattgaccggcagctgcaggaggacaggatgtacccagacctgtctgagctgctgatggtgtctgcccccaacaaccccaccgtgtctggcatgtctgacatggactaccccctgcagggccctggcctgctgtctgtgcccaacctgcctgagatcagcagcatcagaagagtgcccctgcccccagagctggtggagcagtttggccacatgcagtgcaactgcatgatgggcgtcttcccccccatcagccgggcctggctgaccatcgacagcgacatcttcatgtggaactatgaagatggaggagacctggcctactttgatggcctgtctgagaccatcctggccgtgggcctggtgaagcccaaggccggcatcttccagccccacgtgcgccacctgctggtgctggccacccctgtggacatcgtcatcctgggcctgtcctatgccaacctgcagacaggcagcggcgtgctgaatgacagcctgagcggcggcatgcagctgctgcctgaccccctgtacagcctgcccacagacaacacctacctgctgaccatcaccagcacagacaatggccgcatcttcctggccggcaaggatggctgcctgtatgaggtggcctaccaggccgaggccggctggttcagccagcgctgcaggaagatcaaccacagcaagagcagcctgtccttcctggtgcccagcctgctgcagttcaccttctctgaagatgaccccatcctgcagatcgccatcgacaacagcaggaacatcctgtacaccaggtctgagaagggcgtcatccaggtgtatgacctgggccaggacggccagggcatgagccgggtggcctctgtgtcccagaatgccatcgtgtctgctgctggcaacatcgcccggaccatcgacagatctgtgttcaagcccatcgtgcagattgctgtgattgaaaattctgagagcctggactgccagctgctggccgtgacccacgccggcgtgcggctgtacttcagcacctgccccttccggcagcccctggcccggcccaacaccctgaccctggtgcacgtgcggctgcccccaggcttcagcgccagcagcacagtggagaagcccagcaaggtgcaccgggccctgtacagcaagggcatcctgctgatggccgcctctgaaaatgaagataatgacatcctgtggtgtgtgaaccacgacaccttccccttccagaagcccatgatggagacccagatgacagctggggtggatggccacagctgggccctgagcgccattgatgagctgaaggtggacaagatcatcacccccctgaacaaggaccacatccccatcacagacagccctgtggtggtgcagcagcacatgctgccccccaagaagtttgtgctgctgagcgcccagggcagcctgatgttccacaagctgcggcctgtggaccagctgcggcacctgctggtgtccaatgtgggcggagatggagaggagattgagcgcttcttcaagctgcaccaggaggaccaggcctgtgccacctgcctgatcctggcctgcagcacagctgcctgtgaccgggaggtgtctgcctgggccacccgggccttcttccgctatggaggagaggcccagatgaggttccccaccaccctgcccccacccagcaatgtgggccccatcctgggcagccctgtgtacagcagcagccctgtgcccagcggcagcccctaccccaaccccagcttcctgggcacccccagccacggcatccagcccccagccatgagcacccctgtgtgtgccctgggcaacccagccacccaggccaccaacatgagctgtgtgactggacctgagatcgtgtacagcggcaagcacaacggcatctgcatctacttcagccgcatcatgggcaacatctgggatgccagcctggtggtggagcgcatcttcaagagcggcaaccgggagatcacagccatcgagagctctgtgccctgccagctgctggagagcgtgctgcaggagctgaagggcctgcaggagttcctggacaggaacagccagtttgctgggggccccctgggcaaccccaacaccacagccaaggtgcagcagaggctcatcggcttcatgaggccagaaaatggaaacccccagcagatgcagcaggagctgcagaggaagttccacgaggcccagctgtctgagaagatcagcctgcaggccatccagcagctggtgaggaagagctaccaggccctggccctgtggaagctgctgtgtgagcaccagttcaccatcatcgtggccgagctgcagaaggccaatgagctgctgcagaggagccggcaggtgcagaacaagacagagaaggagaggatgctgcgggagagcctgaaggagtaccagaagatcagcaaccaggtggacctgagcaatgtgtgtgcccagtaccggcaggtgcgcttctatgagggcgtggtggagctgagcctgacagctgctgagaagaaggacccccagggcctgggcctgcacttctacaagcacggggagccagaagaagatattgtgggcctgcaggccttccaggagcggctgaacagctacaagtgcatcacagacaccctgcaggagctggtgaaccagagcaaggccgccccccagagccccagcgtgcccaagaagccaggcccccctgtgctgagcagtgaccccaacatgctgagcaatgaggaggccggccaccactttgagcagatgctgaagctgagccagaggagcaaggatgagctgttcagcatcgccctgtacaactggctgatccaggtggacctggccgacaagctgctgcaggtggccagccccttcctggagccccacctggtgaggatggccaaggtggaccagaacagagtgcgctacatggacctgctgtggagatactatgagaagaacagaagcttcagcaatgctgcccgggtgctgagccggctggccgacatgcacagcacagagatcagcctgcagcagaggctggagtacatcgcccgggccatcctgagcgccaagagcagcacagccatcagcagcattgctgctgatggagagttcctgcacgagctggaggagaagatggaggtggcccgcatccagctgcagatccaggagaccctgcagaggcagtacagccaccacagctctgtgcaggatgctgtgtcccagctggacagcgagctgatggacatcaccaagctgtatggagaatttgctgaccccttcaagctggccgagtgcaagctggccatcatccactgtgccggctacagcgaccccatcctggtgcagaccctgtggcaggacatcatcgagaaggagctgagtgacagcgtgaccctgagcagcagtgacaggatgcacgccctgagcctgaagatcgtgctgctgggcaagatctatgccggcaccccccgcttcttccccctggacttcatcgtgcagttcctggagcagcaggtgtgcaccctgaactgggatgtgggcttcgtcatccagaccatgaatgaaattggagtgcccctgccccggctgctggaggtgtatgaccagctgttcaagagccgggaccccttctggaacaggatgaagaagcccctgcacctgctggactgcatccacgtgctgctgatccgctacgtggagaaccccagccaggtgctgaactgtgagcggcggcgcttcaccaacctgtgcctggatgctgtgtgtggctacctggtggagctgcagagcatgagcagctctgtggccgtgcaggccatcactggaaacttcaagagcctgcaggccaagctggagcggctgcactag

SEQ ID NO: 162515 - DNA, 4311 bp, Artificial Sequence
  Description of Artificial Sequence: Synthetic coding sequence
atgctgcacctgtctgctgcccccccagcccctcctcctgaggtgacagccacagcccggccctgcctgtgcagcgtgggcagaagaggagatggcggcaagatggctgctgctggggccctggagaggagctttgtggagctgtctggagctgagcgggagcggcccaggcacttccgggagttcaccgtgtgcagcattggaacagccaatgctgtggccggggctgtgaagtacagcgagagcgctgggggcttctactacgtggagagcggcaagctgttctctgtgaccaggaaccgcttcatccactggaagaccagcggggacaccctggagctgatggaggagagcctggacatcaacctgctgaacaatgccatccggctgaagttccagaactgcagcgtgctgcctggaggagtgtatgtgtctgagacccagaacagagtcatcatcctgatgctgaccaaccagacagtgcaccggctgctgctgccccaccccagcaggatgtacagaagtgagctggtggtggacagccagatgcagagcatcttcacagacatcggcaaggtggacttcacagacccctgcaactaccagctgatcccagctgtgcccggcatcagccccaacagcacagccagcacagcctggctgagcagtgatggagaggccctgtttgccctgccctgtgccagcggcggcatctttgtgctgaagctgcccccctatgacatccctggcatggtgtctgtggtggagctgaagcagagctctgtgatgcagaggctgctgaccggctggatgcccacagccatccggggggaccagagccccagcgaccggcccctgagcctggccgtgcactgtgtggagcatgatgccttcatctttgccctgtgccaggaccacaagctgaggatgtggagctacaaggagcagatgtgcctgatggtggccgacatgctggagtatgtgcctgtgaagaaggacctgcggctgacagctggcaccggccacaagctgcggctggcctacagccccaccatgggcctgtacctgggcatctacatgcacgcccccaagaggggccagttctgcatcttccagctggtgtccacagagagcaaccgctacagcctggaccacatcagcagcctcttcaccagccaggagaccctgattgactttgccctgaccagcacagacatctgggccctgtggcatgatgctgagaaccagacagtggtgaagtacatcaactttgagcacaacgtggccggccagtggaaccctgtgttcatgcagcccctgcctgaggaggagatcgtcatcagagatgaccaggacccccgggagatgtacctgcagagcctcttcaccccaggccagttcaccaatgaggccctgtgcaaggccctgcagatcttctgccggggcacagaaagaaacctggacctgtcctggagcgagctgaagaaggaggtgaccctggccgtggagaatgagctgcagggctctgtgacagaatatgagttcagccaggaggagttcaggaacctgcagcaggagttctggtgcaagttctacgcctgctgcctgcagtaccaggaggccctgagccaccccctggccctgcacctgaacccccacaccaacatggtgtgcctgctgaagaagggctacctgtccttcctgatccccagcagcctggtggaccacctgtacctgctgccctatgagaacctgctgacagaagatgagaccaccatcagtgatgatgtggacatcgccagagatgtgatctgcctgatcaagtgcctgcggctgattgaggagagcgtgacagtggacatgtctgtcatcatggagatgagctgctacaacctgcagagccctgagaaggctgctgagcagatcctggaggacatgatcaccattgatgtggagaatgtgatggaggacatctgcagcaagctgcaggagatccggaaccccatccacgccatcggcctgctgatccgggagatggactatgaaacagaggtggagatggagaagggcttcaacccagcccagcccctgaacatccgcatgaacctgacccagctgtatggcagcaacacagctggctacatcgtgtgccggggcgtgcacaagatcgccagcacccgcttcctgatctgccgggacctgctgatcctgcagcagctgctgatgaggctgggagatgctgtgatctggggcaccggccagctgttccaggcccagcaggacctgctgcacaggacagcccccctgctgctgagctactacctgatcaagtggggctctgaatgtctggccacagatgtgcccctggacaccctggagagcaacctgcagcacctgtctgtgctggagctgacagattctggggccctgatggccaacagatttgtgagcagcccccagaccatcgtggagctgttcttccaggaggtggccaggaagcacatcatcagccacctgttcagccagcccaaggcccccctgagccagacaggcctgaactggccagagatgatcacagccatcaccagctacctgctgcagctgctgtggcccagcaaccctggctgcctcttcctggagtgcctgatgggcaactgccagtatgtgcagctgcaggactacatccagctgctgcacccctggtgccaggtgaatgtgggcagctgccgcttcatgctgggccgctgctacctggtgactggagagggccagaaggccctggagtgcttctgccaggccgccagcgaggtgggcaaggaggagttcctggacaggctcatccgctcagaagatggagagatcgtgtccaccccccggctgcagtactatgacaaggtgctgcggctgctggatgtgattggcctgcctgagctggtgatccagctggccaccagcgccatcacagaggccggagatgactggaagagccaggccaccctgcggacctgcatcttcaagcaccacctggacctgggccacaacagccaggcctatgaggccctgacccagatcccagacagcagccggcagctggactgcctgcggcagctggtggtggtgctgtgtgagaggagccagctgcaggacctggtggagttcccctacgtgaacctgcacaatgaggtggtgggcatcatcgagagccgggcccgggctgtggacctgatgacccacaactactatgagctgctgtatgccttccacatctaccgccacaactacaggaaggccggcaccgtgatgtttgaatatggcatgaggctgggccgggaggtgaggaccctgcggggcctggagaagcagggcaactgctacctggccgccctgaactgcctgcggctcatccggccagaatatgcctggatcgtgcagcctgtgtctggagctgtgtatgacaggcctggggccagccccaagaggaaccatgatggagaatgtacagctgcccccaccaaccggcagatcgagatcctggagctggaggacctggagaaggagtgcagcctggcccgcatccggctgaccctggcccagcacgaccccagcgctgtggccgtggccggcagcagcagcgctgaggagatggtgaccctgctggtgcaggccggcctgtttgacacagccatcagcctgtgccagaccttcaagctgcccctgacccctgtgtttgagggcctggccttcaagtgcatcaagctgcagtttggaggagaggccgcccaggccgaggcctgggcctggctggccgccaaccagctgagcagcgtcatcaccaccaaggagagcagcgccacagatgaggcctggaggctgctgagcacctacctggagcgctacaaggtgcagaacaacctgtaccaccactgtgtgatcaacaagctgctgagccatggagtgcccctgcccaactggctgatcaacagctacaagaaggtggatgctgctgagctgctgcggctgtacctgaactatgacctgctggaggaggccgtggacctggtgtctgaatatgtggatgctgtgctgggcaagggccaccagtactttggaattgagttccccctgagcgccacagcccccatggtgtggctgccctacagcagcattgaccagctgctgcaggccctgggggagaacagcgccaacagccacaacatcgccctgagccagaagatcctggacaagctggaggactaccagcagaaggtggacaaggccacccgggacctgctgtacagaaggaccctgtag

SEQ ID NO: 162516 - DNA, 1452 bp, Artificial Sequence
  Description of Artificial Sequence: Synthetic coding sequence
atggtgtctgtggtggagctgaagcagagctctgtgatgcagaggctgctgaccggctggatgcccacagccatccggggggaccagagccccagcgaccggcccctgagcctggccgtgcactgtgtggagcatgatgccttcatctttgccctgtgccaggaccacaagctgaggatgtggagctacaaggagcagatgtgcctgatggtggccgacatgctggagtatgtgcctgtgaagaaggacctgcggctgacagctggcaccggccacaagctgcggctggcctacagccccaccatgggcctgtacctgggcatctacatgcacgcccccaagaggggccagaggcggggctttgccatgctgcccggcctgaagctgctgagcagcagcagcccccccaccagcgccagccagtgtgccggcatcacctctgtgaaccacagcacccagcctgagttcttcttctgcatcttccagctggtgtccacagagagcaaccgctacagcctggaccacatcagcagcctcttcaccagccaggagaccctgattgactttgccctgaccagcacagacatctgggccctgtggcatgatgctgagaaccagacagtggtgaagtacatcaactttgagcacaacgtggccggccagtggaaccctgtgttcatgcagcccctgcctgaggaggagatcgtcatcagagatgaccaggacccccgggagatgtacctgcagagcctcttcaccccaggccagttcaccaatgaggccctgtgcaaggccctgcagatcttctgccggggcacagaaagaaacctggacctgtcctggagcgagctgaagaaggaggtgaccctggccgtggagaatgagctgcagggctctgtgacagaatatgagttcagccaggaggagttcaggaacctgcagcaggagttctggtgcaagttctacgcctgctgcctgcagtaccaggaggccctgagccaccccctggccctgcacctgaacccccacaccaacatggtgtgcctgctgaagaagggctacctgtccttcctgatccccagcagcctggtggaccacctgtacctgctgccctatgagaacctgctgacagaagatgagaccaccatcagtgatgatgtggacatcgccagagatgtgatctgcctgatcaagtgcctgcggctgattgaggagagcgtgacagtggacatgtctgtcatcatggagatgagctgctacaacctgcagagccctgagaaggctgctgagcagatcctggaggacatgatcaccattgatgtggagaatgtgatggaggacatctgcagcaagctgcaggagatccggaaccccatccacgccatcggcctgctgatccgggagatggactatgaaacagaggtggagatggagaagggcttcaacccctag

SEQ ID NO: 162517 - DNA, 675 bp, Artificial Sequence
  Description of Artificial Sequence: Synthetic coding sequence
atgctgcacctgtctgctgcccccccagcccctcctcctgaggtgacagccacagcccggccctgcctgtgcagcgtgggcagaagaggagatggcggcaagatggctgctgctggggccctggagaggagctttgtggagctgtctggagctgagcgggagcggcccaggcacttccgggagttcaccgtgtgcagcattggaacagccaatgctgtggccggggctgtgaagtacagcgagagcgctgggggcttctactacgtggagagcggcaagctgttctctgtgaccaggaaccgcttcatccactggaagaccagcggggacaccctggagctgatggaggagagcctggacatcaacctgctgaacaatgccatccggctgaagttccagaactgcagcgtgctgcctggaggagtgtatgtgtctgagacccagaacagagtcatcatcctgatgctgaccaaccagacagtgcaccggctgctgctgccccaccccagcaggatgtacagatctgtgtcctggctgagcgccatctccttcatcagccagatcaccctgggcgtgaccaacgtggtgctggagcgctgcctgctggagctgaaggagatctggatcctggtgatcccccaccaggcctactttgacagctaccgcctgaagtag

SEQ ID NO: 162518 - DNA, 6039 bp, Artificial Sequence
  Description of Artificial Sequence: Synthetic coding sequence
atggccacccccctggccgtgaacagcgctgccagcctgtggggcccctacaaggacatctggcacaaggtgggcaatgccctgtggaggcggcagcctgaggccgtgcacctgctggacaagatcctgaagaagcacaagccagacttcatcagcctcttcaagaacccccccaagaatgtgcagcagcacgagaaggtgcagaaggccagcacagagggcgtggccatccagggccagcagggcacccggctgctgcctgagcagctgatcaaggaggccttcatcctgagtgacctgtttgatattggagagctggccgctgtggagctgctgctggccggggagcaccagcagccccacttccctggcctgacccggggcctggtggccgtgctgctgtactgggatggcaagcgctgcatcgccaacagcctgaaggccctgatccagagcagaagaggcaagacctggaccctggagctgagccctgagctggcctccatgaccacccgcttcacagatgagctgatggagcagggcctgacctacaaggtgctgaccctggtgtcccagattgatgtgaacaatgaatttgagaagctgcagcgggagcggggcctgggcagcgagaagcacaggaaggaggtgtctgacctgatcaaggaatgtcggcagagcctggccgagagcctgtttgcctgggcctgccagagccccctgggcaaggaggacaccctgctgctgattggccacctggagcgggtgacagtggaggccaacggcagcctggatgctgtgaacctggccctgctgatggccctgctgtactgctttgacatctccttcatcgagcagagcacagaggagagagatgacatgatccaccagctgcccctgctgacagagaagcagtacatcgccaccatccacagccggctgcaggacagccagctgtggaagctgcccggcctgcaggccaccgtgcggctggcctgggccctggccctgcggggcatcagccagctgcctgatgtgacagccctggccgagttcacagaagcagatgaggccatggccgagctggccatcgctgacaacgtgttcctgttcctgatggagagcgtggtggtgtctgagtacttctaccaggaggagttctacatccggcgggtgcacaacctgatcacagacttcctggccctgatgcccatgaaggtgaagcagctgaggaacagagcagatgaagatgccaggatgatccacatgtccatgcagatgggaaatgaaccacccatcagcctgcggcgggacctggagcacctgatgctgctgattggagagctgtacaagaagaaccccttccacctggagctggccctggagtactggtgccccacagagcccctgcagacccccaccatcatgggcagctacctgggcgtggcccaccagaggcctccccagaggcaggtggtgctgagcaagtttgtgcggcagatgggagacctgctgccccccaccatctacatcccctacctgaagatgctgcagggcctggccaacggcccccagtgtgcccactactgcttcagcctgctgaaggtgaatggcagcagccacgtggagaacatccagggcgctgggggcagccctgtgtcctgggagcacttcttccacagcctgatgctgtaccacgagcacctgaggaaggacctgcccagcgctgacagcgtgcagtaccgccacctgcccagccggggcatcacccagaaggagcaggacggcctcatcgccttcctgcagctgaccagcaccatcatcacctggagcgaaaatgcccggctggccctgtgtgagcacccccagtggacccctgtggtggtgatcctgggcctgctgcagtgcagcatcccccctgtgctgaaggccgagctgctgaagaccctggccgccttcggcaagagccctgagattgctgccagcctgtggcagagcctggagtacacccagatcctgcagacagtgcgcatccccagccagaggcaggccatcggcatcgaggtggagctgaatgaaattgagagccgctgtgaggagtaccccctgacccgggccttctgccagctgatcagcaccctggtggagagcagcttccccagcaacctgggcgccggcctgcggcccccaggctttgacccctacctgcagttcctgcgggacagcgtcttcctgcgcttccgcacccgggcctacagaagagctgctgagaagtgggaggtggccgaggtggtgctggaggtgttctacaagctgctgcgggactatgagccccagctggaggactttgtggaccagtttgtggagctgcagggcgaggagatcatcgcctacaagcccccaggcttcagcctgatgtaccacctgctgaatgaaagccccatgctggagctggccctgagcctgctggaggagggcgtgaagcagctggacacctacgcccccttccctgggaagaagcacctggagaaggctgtgcagcactgcctggccctgctgaacctgaccctgcagaaggagaacctcttcatggacctgctgcgggagagccagctggccctgattgtgtgccccctggagcagctgctgcagggcatcaaccccaggaccaagaaggctgacaacgtggtgaacatcgcccgctacctgtaccacggcaacaccaaccctgagctggcctttgagagcgccaagatcctgtgctgcatcagctgcaacagcaacatccagatcaagctggtgggggacttcacccatgaccagagcatcagccagaagctgatggccggctttgtggagtgcctggactgtgaagatgctgaggagtttgtgcggctggaggagggcagcgagctggagaagaagctggtggccatcagacatgagacccgcatccacatcctgaacctgctgatcaccagcctggagtgcaacccccccaacctggccctgtacctgctgggctttgagctgaagaagcctgtgtccaccaccaacctgcaggaccccggggtgctgggctgccccaggacctgcctgcacgccatcctgaacatcctggagaagggcacagagggccgcacaggccctgtggccgtgcgggagagcccccagctggccgagctgtgctaccaggtgatctaccagctgtgtgcctgcagcgacaccagcggccccaccatgagatacctgcggaccagccaggacttcctgttcagccagctgcagtacctgcccttcagcaacaaggagtatgagatctccatgctgaaccagatgtcctggctgatgaagacagccagcattgagctgcgggtgaccagcctgaaccggcagaggagccacacccagaggctgctgcacctgctgctggatgacatgcctgtgaagccctacagtgatggagagggcggcattgaagatgagaacagatctgtgtctggcttcctgcactttgacacagccaccaaggtgcggaggaagatcctgaacatcctggacagcattgacttcagccaggagatccctgagcccctgcagctggacttctttgaccgggcccagatcgagcaggtgattgccaactgtgagcacaagaacctgcggggccagacagtgtgcaatgtgaagctgctgcaccgggtgctggtggccgaggtgaatgccctgcagggcatggccgccatcggccagaggcccctgctgatggaggagatcagcacagtgctgcagtatgtggtgggcaggaacaagctgctgcagtgcctgcacgccaagagacatgccctggagagctggaggcagctggtggagatcatcctgacagcctgcccccaggacctgatccaggctgaagatcggcagctgatcatccgggacatcctgcaggatgtgcatgacaagatcctggatgatgaagctgcccaggagctgatgcctgtggtggccggggctgtgttcaccctgacagcccacctgagccaggccgtgctgacagagcagaaggagacctctgtgctgggccctgctgaggcccactacgccttcatgctggacagctgcttcaccagccccccacctgaggagaaccccctggtgggctttgccagcattggagacagcagcctgtacatcatcctgaagaagctgctggacttcatcctgaagacaggaggcggcttccagagggtgaggacccacctgtatggcagcctgctgtactacctgcagatcgcccagaggccagatgagccagacaccctggaggccgccaagaagaccatgtgggagcggctgacagccccagaagatgtgttcagcaagctgcagagagaaaatattgccatcatcgagagctatggagctgccctgatggaggtggtgtgcagagatgcctgtgatggccatgaaattggaaggatgctggccctggccctgctggacagaattgtgtctgtggacaagcagcagcagtggctgctgtacctgagcaacagcggctacctgaaggtgctggtggacagcctggtggaggatgacaggaccctgcagagcctgctgaccccccagccccccctgctgaaggccctgtacacctatgagagcaagatggccttcctgaccagggtggccaagatccagcagggcgccctggagctgctgcggtctggagtgattgtgcggctggcccagtgccaggtgtatgacatgaggcctgagacagacccccagagcatgtttggcatgagggacccccccatgttcatccccacccctgtggaccgctaccggcagatcctgctgcctgccctgcagctgtgccaggtgatcctgaccagctccatggcccagcacctgcaggccgccggccaggtgctgcagttcctgatcagccacagcgacaccatccaggccatcctgcgctgccaggatgtgtctgctggcagcctgcaggagctggccctgctgaccggcatcatcagcaaggccgccctgcccggcatcctgtctgagctggatgtggatgtgaatgaaggcagcctgatggagctgcagggccacatcggccgcttccagaggcagtgcctgggcctgctgagcagatttggaggcagtgaccggctgcggcagttcaagttccaggatgacaacgtggagggggacaaggtgtccaagaaggatgaaattgagctggccatgcagcagatctgtgccaacgtgatggagtactgccagagcctgatgctgcagagcagccccaccttccagcacgctgtgtgcctcttcacccccagcctgtctgaaacagtgaacagagatggcccccggcaggacacccaggcccctgtggtgccctactggaggctgcccggcctgggcatcatcatctacctgctgaagcagagcgccaatgacttcttctcctactatgacagccaccggcagagcgtgtccaagctgcagaatgtggagcagctgcccccagatgagatcaaggagctgtgccagagcgtgatgcctgctggggtggacaagatcagcacagcccagaagtatgtgctggcccggcggcggctggtgaaggtgatcaacaacagagccaagctgctgagcctgtgcagcttcatcatcgagacctgcctcttcatcctgtggaggcacctggagtactacctgctgcactgcatgcccacagacagccaggacagcctgtttgccagcaggaccctcttcaagagccggcggctgcaggacagctttgccagcgagaccaacctggacttccgcagcggcctggccatcgtgtcccagcacgacctggaccagctgcaggctgatgccatcaatgcctttggagagagcctgcagaagaagctgctggacatcgagggcctgtacagcaaggtgcgcagccgctacagcttcatccaggccctggtgcggcgcatccggggcctgctgcgcatcagcagaaattag

SEQ ID NO: 162519 - DNA, 750 bp, Artificial Sequence
  Description of Artificial Sequence: Synthetic coding sequence
atgagcctgaggaactacagcgagcgggaggtgtctgacctgatcaaggaatgtcggcagagcctggccgagagcctgtttgcctgggcctgccagagccccctgggcaaggaggacaccctgctgctgattggccacctggagcgggtgacagtggaggccaacggcagcctggatgctgtgaacctggccctgctgatggccctgctgtactgctttgacatctccttcatcgagcagagcacagaggagagagatgacatgatccaccagctgcccctgctgacagagaagcagtacatcgccaccatccacagccggctgcaggacagccagctgtggaagctgcccggcctgcaggccaccgtgcggctggcctgggccctggccctgcggggcatcagccagctgcctgatgtgacagccctggccgagttcacagaagcagatgaggccatggccgagctggccatcgctgacaacgtgttcctgttcctgatggagagcgtggtggtgtctgagtacttctaccaggaggagttctacatccggcgggtgcacaacctgatcacagacttcctggccctgatgcccatgaaggtgaagcagctgaggaacagagcagatgaagatgccaggatgatccacatgtccatgcagatgggaaatgaaccacccatcagcctgcggcgggacctggagcacctgatgctgctggtgtccaagctgctggtgctgcggctgaactag

SEQ ID NO: 162520 - DNA, 5664 bp, Artificial Sequence
  Description of Artificial Sequence: Synthetic coding sequence
atggccgcccggggccggggcctgctgctgctgaccctgtctgtgctgctggccgccggccccagcgctgctgctgccaagctgaacatccccaaggtgctgctgcccttcacccgggccaccagggtgaacttcaccctggaggccagcgagggctgctaccgctggctgagcaccaggcctgaggtggccagcattgagcccctgggcctggatgagcagcagtgcagccagaaggctgtggtgcaggcccggctgacccagcctgcccggctgaccagcatcatctttgctgaggacatcaccaccggccaggtgctgcgctgtgatgccatcgtggacctgattcatgacatccagatcgtgtccaccacccgggagctgtacctggaggacagccccctggagctgaagatccaggccctggacagcgagggcaacaccttcagcaccctggccggcctggtgtttgagtggaccatcgtgaaggacagcgaggccgaccgcttcagtgacagccacaatgccctgcgcatcctgaccttcctggagagcacctacatccccccatcctacatcagcgagatggagaaggccgccaagcagggcgacaccatcctggtgtctggcatgaagacaggcagcagcaagctgaaggcccgcatccaggaggccgtgtacaagaatgtgcggcctgctgaggtgcggctgctgatcctggagaacatcctgctgaacccagcctatgatgtgtacctgatggtgggcaccagcatccactacaaggtgcagaagatccggcagggcaagatcacagagctgtccatgcccagcgaccagtatgagctgcagctgcagaacagcatccctggccctgagggggaccctgcccggcctgtggccgtgctggcccaggacacctccatggtgacagccctgcagctgggccagagcagcctggtgctgggccacaggagcatccgcatgcagggcgccagccggctgcccaacagcaccatctacgtggtggagcccggctacctgggcttcaccgtgcaccctggggaccgctgggtgctggagaccggccgcctgtatgagatcaccatcgaggtgtttgacaagttcagcaacaaggtgtatgtgtctgacaacatccgcatcgagaccgtgctgcctgctgagttctttgaggtgctgagcagcagccagaatggcagctaccaccgcatccgggccctgaagaggggccagacagccattgatgctgccctgacctctgtggtggaccaggacggcggcgtgcacatcctgcaggtgcctgtgtggaaccagcaggaggtggagatccacatccccatcaccctgtaccccagcatcctgaccttcccctggcagcccaagacaggagcctaccagtacaccatccgggcccatggaggcagcggcaacttctcctggagcagcagcagccacctggtggccaccgtgacagtgaagggcgtgatgaccactggaagtgacatcggcttcagcgtcatccaggcccatgatgtgcagaaccccctgcactttggagagatgaaggtgtatgtgattgagccccacagcatggagtttgccccctgccaggtggaggcccgggtgggccaggccctggagctgcccctgcgcatcagcggcctgatgcctgggggcgccagcgaggtggtgaccctgagtgactgcagccactttgacctggccgtggaggtggagaaccagggcgtcttccagcccctgcccggccgcctgcccccaggcagcgagcactgcagcggcatccgggtgaaggccgaggcccagggcagcaccaccctgctggtgtcctaccgccacggccacgtgcacctgagcgccaagatcaccatcgccgcctacctgcccctgaaggctgtggaccccagctctgtggccctggtgaccctgggcagcagcaaggagatgctgtttgagggcggcccccggccctggatcctggagcccagcaagttcttccagaatgtgacagctgaggacacagacagcatcggcctggccctgtttgccccccacagcagcaggaactaccagcagcactggatcctggtgacctgccaggccctgggggagcaggtgattgccctgtctgtgggcaacaagcccagcctgaccaaccccttccctgctgtggagcctgctgtggtgaagtttgtgtgtgccccacccagccggctgaccctggcccctgtgtacaccagcccccagctggacatgagctgccccctgctgcagcagaacaagcaggtggtgcctgtgagcagccacaggaacccccggctggacctggccgcctatgaccaggagggcagaagatttgacaacttcagcagcctgagcatccagtgggagagcaccaggcctgtgctggccagcattgagcctgagctgcccatgcagctggtgtcccaggatgatgagagcggccagaagaagctgcacggcctgcaggccatcctggtgcatgaggccagcggcaccacagccatcacagccacagccaccggctaccaggagagccacctgagcagcgcccggaccaagcagccccatgaccccctggtgcccctgagcgccagcattgagctgatcctggtggaggatgtgcgggtgtccccagaggaggtgaccatctacaaccaccctggcatccaggccgagctgcgcatccgggagggcagcggctacttcttcctgaacaccagcacagcagatgtggtgaaggtggcctaccaggaggcccggggcgtggccatggtgcaccccctgctgcccggcagcagcaccatcatgattcatgacctgtgcctggtgtttcctgccccagccaaggctgtggtgtatgtgtctgacatccaggagctgtacatccgggtggtggacaaggtggagatcggcaagacagtgaaggcctacgtgcgggtgctggacctgcacaagaagcccttcctggccaagtacttccccttcatggacctgaagctgcgggccgccagccccatcatcaccctggtggccctggatgaggccctggacaactacaccatcaccttcctgatccggggcgtggccatcggccagaccagcctgacagcctctgtgaccaacaaggccggccagaggatcaacagcgccccccagcagatcgaggtgtttcctcccttccggctgatgcccaggaaggtgaccctgctgattggagccaccatgcaggtgaccagcgagggcggcccccagccccagagcaacatcctcttcagcatcagcaatgaatctgtggccctggtgtctgctgctggcctggtgcagggcctggccatcggaaatggaacagtgtctggcctggtgcaggccgtggatgctgagaccgggaaggtggtgatcatcagccaggacctggtgcaggtggaggtgctgctgctgcgggctgtgcgcatccgggcccccatcatgaggatgaggacaggcacccagatgcccatctacgtgacaggcatcaccaaccaccagaaccccttctcctttggaaatgctgtgcccggcctgaccttccactggagcgtgaccaagagagatgtgctggacctgcggggccgccaccacgaggccagcatccggctgcccagccagtacaactttgccatgaatgtgctgggccgggtgaagggccgcacaggcctgcgggtggtggtgaaggctgtggaccccaccagcggccagctgtatggcctggcccgggagctgagtgatgagatccaggtgcaggtgtttgagaagctgcagctgctgaaccctgagattgaagctgagcagatcctgatgagccccaacagctacatcaagctgcagaccaacagagatggagctgccagcctgagctacagagtgctggatggccctgagaaggtgcctgtggtgcacgtggatgagaagggcttcctggccagcggctccatgattggcaccagcaccattgaagtcatcgcccaggagccctttggagccaaccagaccatcatcgtggccgtgaaggtgtcccctgtgtcctacctgcgggtgtccatgagccctgtgctgcacacccagaacaaggaggccctggtggccgtgcccctgggcatgacagtgaccttcaccgtgcacttccatgacaacagcggagatgtgttccacgcccacagctctgtgctgaactttgccaccaacagagatgactttgtgcagatcggcaagggccccaccaacaacacctgtgtggtgaggacagtgtctgtgggcctgaccctgctgcgggtgtgggatgctgagcaccctggcctgagtgacttcatgcccctgcctgtgctgcaggccatcagccctgagctgagcggggccatggtggtgggagatgtgctgtgcctggccaccgtgctgaccagcctggagggcctgagcggcacctggagcagcagcgccaacagcatcctgcacatcgaccccaagacaggagtggccgtggcccgggctgtgggctctgtgacagtgtactatgaggtggccggccacctgcggacctacaaggaggtggtggtgtctgtgccccagaggatcatggcccggcacctgcaccccatccagaccagcttccaggaggccacagccagcaaggtgattgtggccgtgggggacaggagcagcaacctgcggggagaatgtacccccacccagcgggaggtgatccaggccctgcaccctgagaccctcatcagctgccagagccagttcaagccagctgtgtttgacttccccagccaggatgtgttcaccgtggagccccagtttgacacagccctgggccagtacttctgcagcatcaccatgcaccggctgacagacaagcagaggaagcacctgtccatgaagaagacagccctggtggtgtctgccagcctgagcagcagccacttcagcacagagcaggtgggcgctgaggtgcccttcagccctggcctgtttgctgaccaggccgagatcctgctgagcaaccactacaccagcagcgagatccgggtgtttggagcccctgaggtgctggagaacctggaggtgaagagcggcagccctgctgtgctggcctttgccaaggagaagagctttggctggcccagcttcatcacctacacagtgggcgtgctggaccctgctgctggcagccagggccccctgagcaccaccctgaccttcagcagccctgtgaccaaccaggccatcgccatccctgtgacagtggcctttgtggtggacagaagaggccctggcccctatggagccagcctcttccagcacttcctggacagctaccaggtgatgttcttcaccctgtttgccctgctggccggcacagctgtgatgatcatcgcctaccacacagtgtgcaccccccgggacctggccgtgcctgctgccctgaccccccgggccagccctggccacagcccccactactttgctgccagcagccccaccagccccaatgccctgcccccagccaggaaggccagccccccatctggcctgtggagccctgcctatgccagccactag

SEQ ID NO: 162521 - DNA, 6273 bp, Artificial Sequence
  Description of Artificial Sequence: Synthetic coding sequence
atgggagatgagatggatgccatgatccctgagcgggagatgaaggacttccagttccgggccctgaagaaggtgcgcatctttgacagccctgaggagctgcccaaggagaggagcagcctgctggccgtgagcaacaagtatggcctggtgtttgctggaggagccagcggcctgcagatcttccccaccaagaacctgctgatccagaacaagccaggagatgaccccaacaagatcgtggacaaggtgcagggcctgctggtgcccatgaagttccccatccaccacctggccctgagctgtgacaacctgaccctgagcgcctgcatgatgagcagtgaatatggcagcatcatcgccttctttgatgtgaggaccttcagcaatgaggccaagcagcagaagaggccctttgcctaccacaagctgctgaaggatgctgggggcatggtgattgacatgaagtggaaccccaccgtgcccagcatggtggccgtgtgcctggctgatggcagcattgctgtgctgcaggtgacagagaccgtgaaggtgtgtgccaccctgcccagcacagtggccgtgacctctgtgtgctggagccccaagggcaagcagctggccgtgggcaagcagaatggaacagtggtgcagtacctgcccaccctgcaggagaagaaggtgatcccctgcccccccttctatgaaagtgaccaccctgtgcgggtgctggatgtgctgtggattggcacctacgtgtttgccatcgtgtatgctgctgctgatggcaccctggagaccagcccagatgtggtgatggccctgctgcccaagaaggaggagaagcaccctgagatctttgtgaacttcatggagccctgctacggcagctgcacagagcggcagcaccactactacctgagctacatcgaggagtgggacctggtgctggccgccagcgctgccagcacagaggtgtccatcctggcccggcagagcgaccagatcaactgggagagctggctgctggaggacagcagcagagctgagctgcctgtgacagacaagagtgatgacagcctgcccatgggcgtggtggtggactacaccaaccaggtggagatcaccatcagtgatgagaagaccctgcccccagcccctgtgctgatgctgctgagcacagatggagtgctgtgccccttctacatgatcaaccagaaccctggggtgaagagcctcatcaagaccccagagcggctgagcctggagggggagcggcagcccaagagccctggcagcacccccaccacccccaccagcagccaggccccccagaagctggatgccagcgctgctgctgccccagccagcctgccccccagcagccctgctgcccccatcgccaccttcagcctgctgcctgctggaggagcccccaccgtcttctcctttggcagcagcagcctgaagagcagcgccaccgtgactggagagcccccatcctacagcagcggcagtgacagcagcaaggccgcccctggccctggccccagcaccttctcctttgtgccccccagcaaggccagcctggcccccaccccagctgccagccctgtggcccccagcgctgccagcttctcctttggcagcagcggcttcaagcccaccctggagagcacccctgtgcccagcgtgtctgcccccaacatcgccatgaagcccagcttcccccccagcaccagcgctgtgaaggtgaacctgtctgagaagttcaccgctgctgccaccagcacccctgtgagcagcagccagagcgccccacccatgagccccttcagcagcgccagcaagccagctgccagcggccccctgagccaccccacccccctgagcgccccacccagctctgtgcccctgaagagctctgtgctgcccagccccagcggccgcagcgcccagggcagcagcagccctgtgcccagcatggtgcagaagagcccccgcatcaccccacctgctgccaagccaggcagcccccaggccaagagcctgcagcctgctgtggccgagaagcagggccaccagtggaaggacagcgaccctgtgatggccggcatcggggaggagatcgcccacttccagaaggagctggaggagctgaaggcccggaccagcaaggcctgcttccaggtgggcaccagcgaggagatgaagatgctgaggacagaaagtgatgacctgcacaccttcctgctggagatcaaggagaccacagagagcctgcacggggacatcagcagcctgaagaccaccctgctggagggctttgctggggtggaggaggcccgggagcagaatgaaagaaacagagacagcggctacctgcacctgctgtacaagaggcccctggaccccaagtctgaggcccagctgcaggagatccggcggctgcaccagtatgtgaagtttgctgtgcaggatgtgaatgatgtgctggacctggagtgggaccagcacctggagcagaagaagaagcagaggcacctgctggtgcctgagcgggagaccctcttcaacaccctggccaacaaccgggagatcatcaaccagcagaggaagaggctgaaccacctggtggacagcctgcagcagctgcggctgtacaagcagaccagcctgtggagcctgagcagcgctgtgcccagccagagcagcatccacagctttgacagcgacctggagagcctgtgcaatgccctgctgaagaccaccatcgagagccacaccaagagcctgcccaaggtgcctgccaagctgagccccatgaagcaggcccagctgaggaacttcctggccaagaggaagaccccacctgtgcgcagcacagccccagccagcctgagccgcagcgccttcctgagccagcgctactatgaggacctggatgaggtgagcagcaccagctctgtgtcccagagcctggagagtgaagatgcccggaccagctgcaaggatgatgaggccgtggtgcaggcccccaggcatgcccctgtggtgaggacccccagcatccagcccagcctgctgccccacgccgccccctttgccaagagccacctggtgcacggcagcagccctggggtgatgggcacctctgtggccaccagcgccagcaagatcatcccccagggcgctgacagcaccatgctggccaccaagacagtgaagcatggagcccccagccccagccaccccatcagcgccccccaggccgctgctgctgctgccctgcggcggcagatggccagccaggccccagctgtgaacaccctgacagagagcaccctgaagaatgtgccccaggtggtgaatgtgcaggagctgaagaacaacccagccacccccagcacagccatgggcagctctgtgccctacagcacagccaagaccccccaccctgtgctgacccctgtggccgccaaccaggccaagcagggcagcctcatcaacagcctgaagcccagcggccccaccccagccagcggccagctgagcagcggggacaaggccagcggcacagccaagattgaaacagctgtgaccagcaccccatctgccagcggccagttcagcaagcccttctccttcagccccagcggcaccggcttcaactttggcatcatcacccccacccccagcagcaacttcaccgctgcccagggcgccacccccagcaccaaggagagcagccagccagatgccttcagcagcggcggcggcagcaagcccagctatgaggccatccctgagagcagccccccatctggcatcaccagcgccagcaacaccaccccaggagagcctgctgccagcagcagcaggcctgtggcccccagcggcacagccctgagcaccaccagcagcaagctggagaccccacccagcaagctgggggagctgctcttccccagcagcctggccggggagaccctgggcagcttcagcggcctgcgggtgggccaggctgatgacagcaccaagcccaccaacaaggccagcagcaccagcctgaccagcacccagcccaccaagaccagcggcgtgcccagcggcttcaacttcaccgcccctcctgtgctgggcaagcacacagagccccctgtgaccagcagcgccaccaccacctctgtggcccctcctgctgccaccagcaccagcagcacagctgtgtttggcagcctgcctgtgaccagcgctggcagcagcggggtcatcagctttggaggcaccagcctgtctgctgggaagaccagcttctcctttggcagccagcagaccaacagcacagtgcccccatctgcccccccacccaccacagctgccacccccctgcccaccagcttccccaccctgagctttggcagcctgctgagcagcgccaccacccccagcctgcccatgtctgctggccgcagcacagaggaggccaccagcagcgccctgcctgagaagccaggggacagcgaggtgtctgccagcgctgccagcctgctggaggagcagcagagcgcccagctgccccaggccccaccccagaccagtgacagcgtgaagaaggagcctgtgctggcccagcctgctgtgagcaacagcggcacagctgccagcagcaccagcctggtggccctgtctgctgaggccaccccagccaccaccggggtgcctgatgccaggacagaagctgtgcccccagccagcagcttctctgtgcccggccagacagctgtgacagctgctgccatcagcagcgctggccctgtggccgtggagaccagcagcacccccatcgccagcagcaccaccagcatcgtggcccctggccccagcgctgaggccgccgcctttggaacagtgaccagcggcagctctgtgtttgcccagcccccagctgccagcagcagcagcgccttcaaccagctgaccaacaacacagccacagcccccagcgccacccctgtgtttggccaggtggccgccagcacagcccccagcctgtttggccagcagacaggcagcacagccagcacagctgctgccaccccccaggtgagcagcagcggcttcagcagccctgccttcggcaccacagcccctggggtgtttggccagaccaccttcggccaggcctctgtgtttggccagagcgccagcagcgctgcctctgtgttctccttcagccagcccggcttcagctctgtgcctgccttcggccagcctgccagcagcacccccaccagcaccagcggctctgtgtttggagctgccagcagcaccagcagcagcagcagcttctcctttggccagagcagccccaacacaggaggcggcctgtttggccagagcaatgccccagccttcggccagagccctggcttcggccagggcggctctgtgtttggaggcaccagcgctgccaccaccacagctgccaccagcggcttctccttctgccaggccagcggcttcggcagcagcaacacaggctctgtgtttggccaggccgccagcactggaggcatcgtgtttggccagcagagcagcagcagcagcggctctgtgtttggcagcggcaacacaggccggggcggcggcttcttcagcggcctgggcggcaagcccagccaggatgctgccaacaagaaccccttcagcagcgccagcggcggcttcggcagcacagccaccagcaacaccagcaacctgtttggaaattctggggccaagaccttcggcggctttgccagcagcagctttggagagcagaagcccaccggcaccttcagcagcggcggcggctctgtggccagccagggcttcggcttcagcagccccaacaagacaggaggctttggagctgcccctgtgtttggcagcccccccaccttcggcggcagccctggctttggaggagtgcctgccttcggcagcgccccagccttcaccagccccctgggcagcactggaggcaaggtgtttggagagggcacagctgctgccagcgctgggggcttcggcttcggcagcagcagcaacaccaccagctttggcaccctggccagccagaatgcccccaccttcggcagcctgagccagcagaccagcggcttcggcacccagagcagcggcttcagcggcttcggcagcggcaccggcggcttctcctttggcagcaacaacagctctgtgcagggctttggaggctggaggagctag

SEQ ID NO: 162522 - DNA, 6243 bp, Artificial Sequence
  Description of Artificial Sequence: Synthetic coding sequence
atgggagatgagatggatgccatgatccctgagcgggagatgaaggacttccagttccgggccctgaagaaggtgcgcatctttgacagccctgaggagctgcccaaggagaggagcagcctgctggccgtgagcaacaagtatggcctggtgtttgctggaggagccagcggcctgcagatcttccccaccaagaacctgctgatccagaacaagccaggagatgaccccaacaagatcgtggacaaggtgcagggcctgctggtgcccatgaagttccccatccaccacctggccctgagctgtgacaacctgaccctgagcgcctgcatgatgagcagtgaatatggcagcatcatcgccttctttgatgtgaggaccttcagcaatgaggccaagcagcagaagaggccctttgcctaccacaagctgctgaaggatgctgggggcatggtgattgacatgaagtggaaccccaccgtgcccagcatggtggccgtgtgcctggctgatggcagcattgctgtgctgcaggtgacagagaccgtgaaggtgtgtgccaccctgcccagcacagtggccgtgacctctgtgtgctggagccccaagggcaagcagctggccgtgggcaagcagaatggaacagtggtgcagtacctgcccaccctgcaggagaagaaggtgatcccctgcccccccttctatgaaagtgaccaccctgtgcgggtgctggatgtgctgtggattggcacctacgtgtttgccatcgtgtatgctgctgctgatggcaccctggagaccagcccagatgtggtgatggccctgctgcccaagaaggaggagaagcaccctgagatctttgtgaacttcatggagccctgctacggcagctgcacagagcggcagcaccactactacctgagctacatcgaggagtgggacctggtgctggccgccagcgctgccagcacagaggtgtccatcctggcccggcagagcgaccagatcaactgggagagctggctgctggaggacagcagcagagctgagctgcctgtgacagacaagagtgatgacagcctgcccatgggcgtggtggtggactacaccaaccaggtggagatcaccatcagtgatgagaagaccctgcccccagcccctgtgctgatgctgctgagcacagatggagtgctgtgccccttctacatgatcaaccagaaccctggggtgaagagcctcatcaagaccccagagcggctgagcctggagggggagcggcagcccaagagccctggcagcacccccaccacccccaccagcagccaggccccccagaagctggatgccagcgctgctgctgccccagccagcctgccccccagcagccctgctgcccccatcgccaccttcagcctgctgcctgctggaggagcccccaccgtcttctcctttggcagcagcagcctgaagagcagcgccaccgtgactggagagcccccatcctacagcagcggcagtgacagcagcaaggccgcccctggccctggccccagcaccttctcctttgtgccccccagcaaggccagcctggcccccaccccagctgccagccctgtggcccccagcgctgccagcttctcctttggcagcagcggcttcaagcccaccctggagagcacccctgtgcccagcgtgtctgcccccaacatcgccatgaagcccagcttcccccccagcaccagcgctgtgaaggtgaacctgtctgagaacagcagccagagcgccccacccatgagccccttcagcagcgccagcaagccagctgccagcggccccctgagccaccccacccccctgagcgccccacccagctctgtgcccctgaagagctctgtgctgcccagccccagcgctggccgcagcgcccagggcagcagcagccctgtgcccagcatggtgcagaagagcccccgcatcaccccacctgctgccaagccaggcagcccccaggccaagagcctgcagcctgctgtggccgagaagcagggccaccagtggaaggacagcgaccctgtgatggccggcatcggggaggagatcgcccacttccagaaggagctggaggagctgaaggcccggaccagcaaggcctgcttccaggtgggcaccagcgaggagatgaagatgctgaggacagaaagtgatgacctgcacaccttcctgctggagatcaaggagaccacagagagcctgcacggggacatcagcagcctgaagaccaccctgctggagggctttgctggggtggaggaggcccgggagcagaatgaaagaaacagagacagcggctacctgcacctgctgtacaagaggcccctggaccccaagtctgaggcccagctgcaggagatccggcggctgcaccagtatgtgaagtttgctgtgcaggatgtgaatgatgtgctggacctggagtgggaccagcacctggagcagaagaagaagcagaggcacctgctggtgcctgagcgggagaccctcttcaacaccctggccaacaaccgggagatcatcaaccagcagaggaagaggctgaaccacctggtggacagcctgcagcagctgcggctgtacaagcagaccagcctgtggagcctgagcagcgctgtgcccagccagagcagcatccacagctttgacagcgacctggagagcctgtgcaatgccctgctgaagaccaccatcgagagccacaccaagagcctgcccaaggtgcctgccaagctgagccccatgaagcaggcccagctgaggaacttcctggccaagaggaagaccccacctgtgcgcagcacagccccagccagcctgagccgcagcgccttcctgagccagcgctactatgaggacctggatgaggtgagcagcaccagctctgtgtcccagagcctggagagtgaagatgcccggaccagctgcaaggatgatgaggccgtggtgcaggcccccaggcatgcccctgtggtgaggacccccagcatccagcccagcctgctgccccacgccgccccctttgccaagagccacctggtgcacggcagcagccctggggtgatgggcacctctgtggccaccagcgccagcaagatcatcccccagggcgctgacagcaccatgctggccaccaagacagtgaagcatggagcccccagccccagccaccccatcagcgccccccaggccgctgctgctgctgccctgcggcggcagatggccagccaggccccagctgtgaacaccctgacagagagcaccctgaagaatgtgccccaggtggtgaatgtgcaggagctgaagaacaacccagccacccccagcacagccatgggcagctctgtgccctacagcacagccaagaccccccaccctgtgctgacccctgtggccgccaaccaggccaagcagggcagcctcatcaacagcctgaagcccagcggccccaccccagccagcggccagctgagcagcggggacaaggccagcggcacagccaagattgaaacagctgtgaccagcaccccatctgccagcggccagttcagcaagcccttctccttcagccccagcggcaccggcttcaactttggcatcatcacccccacccccagcagcaacttcaccgctgcccagggcgccacccccagcaccaaggagagcagccagccagatgccttcagcagcggcggcggcagcaagcccagctatgaggccatccctgagagcagccccccatctggcatcaccagcgccagcaacaccaccccaggagagcctgctgccagcagcagcaggcctgtggcccccagcggcacagccctgagcaccaccagcagcaagctggagaccccacccagcaagctgggggagctgctcttccccagcagcctggccggggagaccctgggcagcttcagcggcctgcgggtgggccaggctgatgacagcaccaagcccaccaacaaggccagcagcaccagcctgaccagcacccagcccaccaagaccagcggcgtgcccagcggcttcaacttcaccgcccctcctgtgctgggcaagcacacagagccccctgtgaccagcagcgccaccaccacctctgtggcccctcctgctgccaccagcaccagcagcacagctgtgtttggcagcctgcctgtgaccagcgctggcagcagcggggtcatcagctttggaggcaccagcctgtctgctgggaagaccagcttctcctttggcagccagcagaccaacagcacagtgcccccatctgcccccccacccaccacagctgccacccccctgcccaccagcttccccaccctgagctttggcagcctgctgagcagcgccaccacccccagcctgcccatgtctgctggccgcagcacagaggaggccaccagcagcgccctgcctgagaagccaggggacagcgaggtgtctgccagcgctgccagcctgctggaggagcagcagagcgcccagctgccccaggccccaccccagaccagtgacagcgtgaagaaggagcctgtgctggcccagcctgctgtgagcaacagcggcacagctgccagcagcaccagcctggtggccctgtctgctgaggccaccccagccaccaccggggtgcctgatgccaggacagaagctgtgcccccagccagcagcttctctgtgcccggccagacagctgtgacagctgctgccatcagcagcgctggccctgtggccgtggagaccagcagcacccccatcgccagcagcaccaccagcatcgtggcccctggccccagcgctgaggccgccgcctttggaacagtgaccagcggcagctctgtgtttgcccagcccccagctgccagcagcagcagcgccttcaaccagctgaccaacaacacagccacagcccccagcgccacccctgtgtttggccaggtggccgccagcacagcccccagcctgtttggccagcagacaggcagcacagccagcacagctgctgccaccccccaggtgagcagcagcggcttcagcagccctgccttcggcaccacagcccctggggtgtttggccagaccaccttcggccaggcctctgtgtttggccagagcgccagcagcgctgcctctgtgttctccttcagccagcccggcttcagctctgtgcctgccttcggccagcctgccagcagcacccccaccagcaccagcggctctgtgtttggagctgccagcagcaccagcagcagcagcagcttctcctttggccagagcagccccaacacaggaggcggcctgtttggccagagcaatgccccagccttcggccagagccctggcttcggccagggcggctctgtgtttggaggcaccagcgctgccaccaccacagctgccaccagcggcttctccttctgccaggccagcggcttcggcagcagcaacacaggctctgtgtttggccaggccgccagcactggaggcatcgtgtttggccagcagagcagcagcagcagcggctctgtgtttggcagcggcaacacaggccggggcggcggcttcttcagcggcctgggcggcaagcccagccaggatgctgccaacaagaaccccttcagcagcgccagcggcggcttcggcagcacagccaccagcaacaccagcaacctgtttggaaattctggggccaagaccttcggcggctttgccagcagcagctttggagagcagaagcccaccggcaccttcagcagcggcggcggctctgtggccagccagggcttcggcttcagcagccccaacaagacaggaggctttggagctgcccctgtgtttggcagcccccccaccttcggcggcagccctggctttggaggagtgcctgccttcggcagcgccccagccttcaccagccccctgggcagcactggaggcaaggtgtttggagagggcacagctgctgccagcgctgggggcttcggcttcggcagcagcagcaacaccaccagctttggcaccctggccagccagaatgcccccaccttcggcagcctgagccagcagaccagcggcttcggcacccagagcagcggcttcagcggcttcggcagcggcaccggcggcttctcctttggcagcaacaacagctctgtgcagggctttggaggctggaggagctag

SEQ ID NO: 162523 - DNA, 4560 bp, Artificial Sequence
  Description of Artificial Sequence: Synthetic coding sequence
atgaagcccagcttcccccccagcaccagcgctgtgaaggtgaacctgtctgagaagttcaccgctgctgccaccagcacccctgtgagcagcagccagagcgccccacccatgagccccttcagcagcgccagcaagccagctgccagcggccccctgagccaccccacccccctgagcgccccacccagctctgtgcccctgaagagctctgtgctgcccagccccagcggccgcagcgcccagggcagcagcagccctgtgcccagcatggtgcagaagagcccccgcatcaccccacctgctgccaagccaggcagcccccaggccaagagcctgcagcctgctgtggccgagaagcagggccaccagtggaaggacagcgaccctgtgatggccggcattggagaggagatcgcccacttccagaaggagctggaggagctgaaggcccggaccagcaaggcctgcttccaggtgggcaccagcgaggagatgaagatgctgaggacagaaagtgatgacctgcacaccttcctgctggagatcaaggagaccacagagagcctgcatggagacatcagcagcctgaagaccaccctgctggagggctttgctggggtggaggaggcccgggagcagaatgaaagaaacagagattctggctacctgcacctgctgtacaagaggcccctggaccccaagtctgaggcccagctgcaggagatccggcggctgcaccagtatgtgaagtttgctgtgcaggatgtgaatgatgtgctggacctggagtgggaccagcacctggagcagaagaagaagcagaggcacctgctggtgcctgagcgggagaccctcttcaacaccctggccaacaaccgggagatcatcaaccagcagaggaagaggctgaaccacctggtggacagcctgcagcagctgcggctgtacaagcagaccagcctgtggagcctgagcagcgctgtgcccagccagagcagcatccacagctttgacagcgacctggagagcctgtgcaatgccctgctgaagaccaccatcgagagccacaccaagagcctgcccaaggtgcctgccaagctgagccccatgaagcaggcccagctgaggaacttcctggccaagaggaagaccccacctgtgcgcagcacagccccagccagcctgagccgcagcgccttcctgagccagcgctactatgaggacctggatgaggtgagcagcaccagctctgtgtcccagagcctggagagtgaagatgcccggaccagctgcaaggatgatgaagctgtggtgcaggcccccaggcatgcccctgtggtgaggacccccagcatccagcccagcctgctgccccatgctgccccctttgccaagagccacctggtgcacggcagcagccctggggtgatgggcacctctgtggccaccagcgccagcaagatcatcccccagggcgctgacagcaccatgctggccaccaagacagtgaagcacggggcccccagccccagccaccccatcagcgccccccaggccgctgctgctgctgccctgcggcggcagatggccagccaggccccagctgtgaacaccctgacagagagcaccctgaagaatgtgccccaggtggtgaatgtgcaggagctgaagaacaacccagccacccccagcacagccatgggcagctctgtgccctacagcacagccaagaccccccaccctgtgctgacccctgtggccgccaaccaggccaagcagggcagcctcatcaacagcctgaagcccagcggccccaccccagccagcggccagctgagcagcggggacaaggccagcggcacagccaagattgaaacagctgtgaccagcacccccagcgccagcggccagttcagcaagcccttctccttcagccccagcggcaccggcttcaactttggcatcatcacccccacccccagcagcaacttcaccgctgcccagggcgccacccccagcaccaaggagagcagccagccagatgccttcagcagcggcggcggcagcaagcccagctatgaggccatccctgagagcagcccccccagcggcatcaccagcgccagcaacaccaccccaggagagcctgctgccagcagcagcaggcctgtggcccccagcggcacagccctgagcaccaccagcagcaagctggagaccccacccagcaagctgggggagctgctcttccccagcagcctggccggggagaccctgggcagcttcagcggcctgcgggtgggccaggctgatgacagcaccaagcccaccaacaaggccagcagcaccagcctgaccagcacccagcccaccaagaccagcggcgtgcccagcggcttcaacttcaccgcccctcctgtgctgggcaagcacacagagccccctgtgaccagcagcgccaccaccacctctgtggcccccccagctgccaccagcaccagcagcacagctgtgtttggcagcctgcctgtgaccagcgctggcagcagtggagtcatcagctttggaggcaccagcctgtctgctgggaagaccagcttctcctttggcagccagcagaccaacagcacagtgccccccagcgcccccccacccaccacagctgccacccccctgcccaccagcttccccaccctgagctttggcagcctgctgagcagcgccaccacccccagcctgcccatgtctgctggccgcagcacagaggaggccaccagcagcgccctgcctgagaagccaggggacagcgaggtgtctgccagcgctgccagcctgctggaggagcagcagagcgcccagctgccccaggccccaccccagaccagtgacagcgtgaagaaggagcctgtgctggcccagcctgctgtgagcaacagcggcacagctgccagcagcaccagcctggtggccctgtctgctgaggccaccccagccaccactggagtgcctgatgccaggacagaggccgtgcccccagccagcagcttctctgtgcccggccagacagctgtgacagctgctgccatcagcagcgctggccctgtggccgtggagaccagcagcacccccatcgccagcagcaccaccagcatcgtggcccctggccccagcgctgaggccgccgccttcggcaccgtgaccagcggcagctctgtgtttgcccagcccccagctgccagcagcagcagcgccttcaaccagctgaccaacaacacagccacagcccccagcgccacccctgtgtttggccaggtggccgccagcacagcccccagcctgtttggccagcagacaggcagcacagccagcacagctgctgccaccccccaggtgagcagcagcggcttcagcagccctgccttcggcaccacagcccctggggtgtttggccagaccaccttcggccaggcctctgtgtttggccagagcgccagcagcgctgccagcgtcttctccttcagccagcccggcttcagctctgtgcctgccttcggccagcctgccagcagcacccccaccagcaccagcggctctgtgtttggagctgccagcagcaccagcagcagcagcagcttctcctttggccagagcagccccaacacaggaggcggcctgtttggccagagcaatgccccagccttcggccagagccctggcttcggccagggcggctctgtgtttggaggcaccagcgctgccaccaccacagctgccaccagcggcttctccttctgccaggccagcggcttcggcagcagcaacacaggctctgtgtttggccaggccgccagcactggaggcatcgtgtttggccagcagagcagcagcagcagcggctctgtgtttggaagtggcaacacaggccggggcggcggcttcttcagcggcctgggcggcaagcccagccaggatgctgccaacaagaaccccttcagcagcgccagcggcggcttcggcagcacagccaccagcaacaccagcaacctgtttggaaacagcggggccaagacctttggaggctttgccagcagcagctttggagagcagaagcccaccggcaccttcagcagcggcggcggctctgtggccagccagggcttcggcttcagcagccccaacaagacaggaggctttggagctgcccctgtgtttggcagcccccccacctttggaggcagccctggctttggaggagtgcctgcctttggaagtgccccagccttcaccagccccctgggcagcactggaggcaaggtgtttggagagggcacagctgctgccagcgctgggggctttggatttggcagcagcagcaacaccaccagctttggcaccctggccagccagaatgcccccaccttcggcagcctgagccagcagaccagcggcttcggcacccagagcagcggcttcagcggctttggaagtggcactggaggcttctcctttggcagcaacaacagctctgtgcagggctttggaggctggaggagctag

SEQ ID NO: 162524 - DNA, 6276 bp, Artificial Sequence
  Description of Artificial Sequence: Synthetic coding sequence
atgggagatgagatggatgccatgatccctgagcgggagatgaaggacttccagttccgggccctgaagaaggtgcgcatctttgacagccctgaggagctgcccaaggagaggagcagcctgctggccgtgagcaacaagtatggcctggtgtttgctggaggagccagcggcctgcagatcttccccaccaagaacctgctgatccagaacaagccaggagatgaccccaacaagatcgtggacaaggtgcagggcctgctggtgcccatgaagttccccatccaccacctggccctgagctgtgacaacctgaccctgagcgcctgcatgatgagcagtgaatatggcagcatcatcgccttctttgatgtgaggaccttcagcaatgaggccaagcagcagaagaggccctttgcctaccacaagctgctgaaggatgctgggggcatggtgattgacatgaagtggaaccccaccgtgcccagcatggtggccgtgtgcctggctgatggcagcattgctgtgctgcaggtgacagagaccgtgaaggtgtgtgccaccctgcccagcacagtggccgtgacctctgtgtgctggagccccaagggcaagcagctggccgtgggcaagcagaatggaacagtggtgcagtacctgcccaccctgcaggagaagaaggtgatcccctgcccccccttctatgaaagtgaccaccctgtgcgggtgctggatgtgctgtggattggcacctacgtgtttgccatcgtgtatgctgctgctgatggcaccctggagaccagcccagatgtggtgatggccctgctgcccaagaaggaggagaagcaccctgagatctttgtgaacttcatggagccctgctacggcagctgcacagagcggcagcaccactactacctgagctacatcgaggagtgggacctggtgctggccgccagcgctgccagcacagaggtgtccatcctggcccggcagagcgaccagatcaactgggagagctggctgctggaggacagcagcagagctgagctgcctgtgacagacaagagtgatgacagcctgcccatgggcgtggtggtggactacaccaaccaggtggagatcaccatcagtgatgagaagaccctgcccccagcccctgtgctgatgctgctgagcacagatggagtgctgtgccccttctacatgatcaaccagaaccctggggtgaagagcctcatcaagaccccagagcggctgagcctggagggggagcggcagcccaagagccctggcagcacccccaccacccccaccagcagccaggccccccagaagctggatgccagcgctgctgctgccccagccagcctgccccccagcagccctgctgcccccatcgccaccttcagcctgctgcctgctggaggagcccccaccgtcttctcctttggcagcagcagcctgaagagcagcgccaccgtgactggagagcccccatcctacagcagcggcagtgacagcagcaaggccgcccctggccctggccccagcaccttctcctttgtgccccccagcaaggccagcctggcccccaccccagctgccagccctgtggcccccagcgctgccagcttctcctttggcagcagcggcttcaagcccaccctggagagcacccctgtgcccagcgtgtctgcccccaacatcgccatgaagcccagcttcccccccagcaccagcgctgtgaaggtgaacctgtctgagaagttcaccgctgctgccaccagcacccctgtgagcagcagccagagcgccccacccatgagccccttcagcagcgccagcaagccagctgccagcggccccctgagccaccccacccccctgagcgccccacccagctctgtgcccctgaagagctctgtgctgcccagccccagcgctggccgcagcgcccagggcagcagcagccctgtgcccagcatggtgcagaagagcccccgcatcaccccacctgctgccaagccaggcagcccccaggccaagagcctgcagcctgctgtggccgagaagcagggccaccagtggaaggacagcgaccctgtgatggccggcattggagaggagatcgcccacttccagaaggagctggaggagctgaaggcccggaccagcaaggcctgcttccaggtgggcaccagcgaggagatgaagatgctgaggacagaaagtgatgacctgcacaccttcctgctggagatcaaggagaccacagagagcctgcatggagacatcagcagcctgaagaccaccctgctggagggctttgctggggtggaggaggcccgggagcagaatgaaagaaacagagattctggctacctgcacctgctgtacaagaggcccctggaccccaagtctgaggcccagctgcaggagatccggcggctgcaccagtatgtgaagtttgctgtgcaggatgtgaatgatgtgctggacctggagtgggaccagcacctggagcagaagaagaagcagaggcacctgctggtgcctgagcgggagaccctcttcaacaccctggccaacaaccgggagatcatcaaccagcagaggaagaggctgaaccacctggtggacagcctgcagcagctgcggctgtacaagcagaccagcctgtggagcctgagcagcgctgtgcccagccagagcagcatccacagctttgacagcgacctggagagcctgtgcaatgccctgctgaagaccaccatcgagagccacaccaagagcctgcccaaggtgcctgccaagctgagccccatgaagcaggcccagctgaggaacttcctggccaagaggaagaccccacctgtgcgcagcacagccccagccagcctgagccgcagcgccttcctgagccagcgctactatgaggacctggatgaggtgagcagcaccagctctgtgtcccagagcctggagagtgaagatgcccggaccagctgcaaggatgatgaagctgtggtgcaggcccccaggcatgcccctgtggtgaggacccccagcatccagcccagcctgctgccccatgctgccccctttgccaagagccacctggtgcacggcagcagccctggggtgatgggcacctctgtggccaccagcgccagcaagatcatcccccagggcgctgacagcaccatgctggccaccaagacagtgaagcacggggcccccagccccagccaccccatcagcgccccccaggccgctgctgctgctgccctgcggcggcagatggccagccaggccccagctgtgaacaccctgacagagagcaccctgaagaatgtgccccaggtggtgaatgtgcaggagctgaagaacaacccagccacccccagcacagccatgggcagctctgtgccctacagcacagccaagaccccccaccctgtgctgacccctgtggccgccaaccaggccaagcagggcagcctcatcaacagcctgaagcccagcggccccaccccagccagcggccagctgagcagcggggacaaggccagcggcacagccaagattgaaacagctgtgaccagcacccccagcgccagcggccagttcagcaagcccttctccttcagccccagcggcaccggcttcaactttggcatcatcacccccacccccagcagcaacttcaccgctgcccagggcgccacccccagcaccaaggagagcagccagccagatgccttcagcagcggcggcggcagcaagcccagctatgaggccatccctgagagcagcccccccagcggcatcaccagcgccagcaacaccaccccaggagagcctgctgccagcagcagcaggcctgtggcccccagcggcacagccctgagcaccaccagcagcaagctggagaccccacccagcaagctgggggagctgctcttccccagcagcctggccggggagaccctgggcagcttcagcggcctgcgggtgggccaggctgatgacagcaccaagcccaccaacaaggccagcagcaccagcctgaccagcacccagcccaccaagaccagcggcgtgcccagcggcttcaacttcaccgcccctcctgtgctgggcaagcacacagagccccctgtgaccagcagcgccaccaccacctctgtggcccccccagctgccaccagcaccagcagcacagctgtgtttggcagcctgcctgtgaccagcgctggcagcagtggagtcatcagctttggaggcaccagcctgtctgctgggaagaccagcttctcctttggcagccagcagaccaacagcacagtgccccccagcgcccccccacccaccacagctgccacccccctgcccaccagcttccccaccctgagctttggcagcctgctgagcagcgccaccacccccagcctgcccatgtctgctggccgcagcacagaggaggccaccagcagcgccctgcctgagaagccaggggacagcgaggtgtctgccagcgctgccagcctgctggaggagcagcagagcgcccagctgccccaggccccaccccagaccagtgacagcgtgaagaaggagcctgtgctggcccagcctgctgtgagcaacagcggcacagctgccagcagcaccagcctggtggccctgtctgctgaggccaccccagccaccactggagtgcctgatgccaggacagaggccgtgcccccagccagcagcttctctgtgcccggccagacagctgtgacagctgctgccatcagcagcgctggccctgtggccgtggagaccagcagcacccccatcgccagcagcaccaccagcatcgtggcccctggccccagcgctgaggccgccgccttcggcaccgtgaccagcggcagctctgtgtttgcccagcccccagctgccagcagcagcagcgccttcaaccagctgaccaacaacacagccacagcccccagcgccacccctgtgtttggccaggtggccgccagcacagcccccagcctgtttggccagcagacaggcagcacagccagcacagctgctgccaccccccaggtgagcagcagcggcttcagcagccctgccttcggcaccacagcccctggggtgtttggccagaccaccttcggccaggcctctgtgtttggccagagcgccagcagcgctgccagcgtcttctccttcagccagcccggcttcagctctgtgcctgccttcggccagcctgccagcagcacccccaccagcaccagcggctctgtgtttggagctgccagcagcaccagcagcagcagcagcttctcctttggccagagcagccccaacacaggaggcggcctgtttggccagagcaatgccccagccttcggccagagccctggcttcggccagggcggctctgtgtttggaggcaccagcgctgccaccaccacagctgccaccagcggcttctccttctgccaggccagcggcttcggcagcagcaacacaggctctgtgtttggccaggccgccagcactggaggcatcgtgtttggccagcagagcagcagcagcagcggctctgtgtttggaagtggcaacacaggccggggcggcggcttcttcagcggcctgggcggcaagcccagccaggatgctgccaacaagaaccccttcagcagcgccagcggcggcttcggcagcacagccaccagcaacaccagcaacctgtttggaaacagcggggccaagacctttggaggctttgccagcagcagctttggagagcagaagcccaccggcaccttcagcagcggcggcggctctgtggccagccagggcttcggcttcagcagccccaacaagacaggaggctttggagctgcccctgtgtttggcagcccccccacctttggaggcagccctggctttggaggagtgcctgcctttggaagtgccccagccttcaccagccccctgggcagcactggaggcaaggtgtttggagagggcacagctgctgccagcgctgggggctttggatttggcagcagcagcaacaccaccagctttggcaccctggccagccagaatgcccccaccttcggcagcctgagccagcagaccagcggcttcggcacccagagcagcggcttcagcggctttggaagtggcactggaggcttctcctttggcagcaacaacagctctgtgcagggctttggaggctggaggagctag

SEQ ID NO: 162525 - DNA, 237 bp, Artificial Sequence
  Description of Artificial Sequence: Synthetic coding sequence
ggggagggcacagctgctgccagcgctgggggcttcggcttcggcagcagcagcaacaccaccagctttggcaccctggccagccagaatgcccccaccttcggcagcctgagccagcagaccagcggcttcggcacccagagcagcggcttcagcggcttcggcagcggcaccggcggcttctcctttggcagcaacaacagctctgtgcagggctttggaggctggaggagctag

SEQ ID NO: 162526 - DNA, 5055 bp, Artificial Sequence
  Description of Artificial Sequence: Synthetic coding sequence
ggggctgagggcaggaagtttgctgtggagcggcccggcttccggggccagggccggggccggcagcgctggctgctgcggcacaccacccccaccagcagccaggccccccagaagctggatgccagcgctgctgctgccccagccagcctgccccccagcagccctgctgcccccatcgccaccttcagcctgctgcctgctgggggcgcccccaccgtcttctcctttggcagcagcagcctgaagagcagcgccaccgtgactggagagccccccagctacagcagcggcagtgacagcagcaaggccgcccctggccctggccccagcaccttctcctttgtgccccccagcaaggccagcctggcccccaccccagctgccagccctgtggcccccagcgctgccagcttctcctttggcagcagcggcttcaagcccaccctggagagcacccctgtgcccagcgtgtctgcccccaacatcgccatgaagcccagcttcccccccagcaccagcgctgtgaaggtgaacctgtctgagaagttcaccgctgctgccaccagcacccctgtgagcagcagccagagcgccccacccatgagccccttcagcagcgccagcaagccagctgccagcggccccctgagccaccccacccccctgagcgccccacccagctctgtgcccctgaagagctctgtgctgcccagccccagcgctggccgcagcgcccagggcagcagcagccctgtgcccagcatggtgcagaagagcccccgcatcaccccacctgctgccaagccaggcagcccccaggccaagagcctgcagcctgctgtggccgagaagcagggccaccagtggaaggacagcgaccctgtgatggccggcatcggggaggagatcgcccacttccagaaggagctggaggagctgaaggcccggaccagcaaggcctgcttccaggtgggcaccagcgaggagatgaagatgctgaggacagaaagtgatgacctgcacaccttcctgctggagatcaaggagaccacagagagcctgcacggggacatcagcagcctgaagaccaccctgctggagggctttgctggggtggaggaggcccgggagcagaatgaaagaaacagagacagcggctacctgcacctgctgtacaagaggcccctggaccccaagtctgaggcccagctgcaggagatccggcggctgcaccagtatgtgaagtttgctgtgcaggatgtgaatgatgtgctggacctggagtgggaccagcacctggagcagaagaagaagcagaggcacctgctggtgcctgagcgggagaccctcttcaacaccctggccaacaaccgggagatcatcaaccagcagaggaagaggctgaaccacctggtggacagcctgcagcagctgcggctgtacaagcagaccagcctgtggagcctgagcagcgctgtgcccagccagagcagcatccacagctttgacagcgacctggagagcctgtgcaatgccctgctgaagaccaccatcgagagccacaccaagagcctgcccaaggtgcctgccaagctgagccccatgaagcaggcccagctgaggaacttcctggccaagaggaagaccccacctgtgcgcagcacagccccagccagcctgagccgcagcgccttcctgagccagcgctactatgaggacctggatgaggtgagcagcaccagctctgtgtcccagagcctggagagtgaagatgcccggaccagctgcaaggatgatgaggccgtggtgcaggcccccaggcatgcccctgtggtgaggacccccagcatccagcccagcctgctgccccacgccgccccctttgccaagagccacctggtgcacggcagcagccctggggtgatgggcacctctgtggccaccagcgccagcaagatcatcccccagggcgctgacagcaccatgctggccaccaagacagtgaagcatggagcccccagccccagccaccccatcagcgccccccaggccgctgctgctgctgccctgcggcggcagatggccagccaggccccagctgtgaacaccctgacagagagcaccctgaagaatgtgccccaggtggtgaatgtgcaggagctgaagaacaacccagccacccccagcacagccatgggcagctctgtgccctacagcacagccaagaccccccaccctgtgctgacccctgtggccgccaaccaggccaagcagggcagcctcatcaacagcctgaagcccagcggccccaccccagccagcggccagctgagcagcggggacaaggccagcggcacagccaagattgaaacagctgtgaccagcaccccatctgccagcggccagttcagcaagcccttctccttcagccccagcggcaccggcttcaactttggcatcatcacccccacccccagcagcaacttcaccgctgcccagggcgccacccccagcaccaaggagagcagccagccagatgccttcagcagcggcggcggcagcaagcccagctatgaggccatccctgagagcagccccccatctggcatcaccagcgccagcaacaccaccccaggagagcctgctgccagcagcagcaggcctgtggcccccagcggcacagccctgagcaccaccagcagcaagctggagaccccacccagcaagctgggggagctgctcttccccagcagcctggccggggagaccctgggcagcttcagcggcctgcgggtgggccaggctgatgacagcaccaagcccaccaacaaggccagcagcaccagcctgaccagcacccagcccaccaagaccagcggcgtgcccagcggcttcaacttcaccgcccctcctgtgctgggcaagcacacagagccccctgtgaccagcagcgccaccaccacctctgtggcccctcctgctgccaccagcaccagcagcacagctgtgtttggcagcctgcctgtgaccagcgctggcagcagcggggtcatcagctttggaggcaccagcctgtctgctgggaagaccagcttctcctttggcagccagcagaccaacagcacagtgcccccatctgcccccccacccaccacagctgccacccccctgcccaccagcttccccaccctgagctttggcagcctgctgagcagcgccaccacccccagcctgcccatgtctgctggccgcagcacagaggaggccaccagcagcgccctgcctgagaagccaggggacagcgaggtgtctgccagcgctgccagcctgctggaggagcagcagagcgcccagctgccccaggccccaccccagaccagtgacagcgtgaagaaggagcctgtgctggcccagcctgctgtgagcaacagcggcacagctgccagcagcaccagcctggtggccctgtctgctgaggccaccccagccaccaccggggtgcctgatgccaggacagaagctgtgcccccagccagcagcttctctgtgcccggccagacagctgtgacagctgctgccatcagcagcgctggccctgtggccgtggagaccagcagcacccccatcgccagcagcaccaccagcatcgtggcccctggccccagcgctgaggccgccgcctttggaacagtgaccagcggcagctctgtgtttgcccagcccccagctgccagcagcagcagcgccttcaaccagctgaccaacaacacagccacagcccccagcgccacccctgtgtttggccaggtggccgccagcacagcccccagcctgtttggccagcagacaggcagcacagccagcacagctgctgccaccccccaggtgagcagcagcggcttcagcagccctgccttcggcaccacagcccctggggtgtttggccagaccaccttcggccaggcctctgtgtttggccagagcgccagcagcgctgcctctgtgttctccttcagccagcccggcttcagctctgtgcctgccttcggccagcctgccagcagcacccccaccagcaccagcggctctgtgtttggagctgccagcagcaccagcagcagcagcagcttctcctttggccagagcagccccaacacaggaggcggcctgtttggccagagcaatgccccagccttcggccagagccctggcttcggccagggcggctctgtgtttggaggcaccagcgctgccaccaccacagctgccaccagcggcttctccttctgccaggccagcggcttcggcagcagcaacacaggctctgtgtttggccaggccgccagcactggaggcatcgtgtttggccagcagagcagcagcagcagcggctctgtgtttggcagcggcaacacaggccggggcggcggcttcttcagcggcctgggcggcaagcccagccaggatgctgccaacaagaaccccttcagcagcgccagcggcggcttcggcagcacagccaccagcaacaccagcaacctgtttggaaattctggggccaagaccttcggcggctttgccagcagcagctttggagagcagaagcccaccggcaccttcagcagcggcggcggctctgtggccagccagggcttcggcttcagcagccccaacaagacaggaggctttggagctgcccctgtgtttggcagcccccccaccttcggcggcagccctggctttggaggagtgcctgccttcggcagcgccccagccttcaccagccccctgggcagcactggaggcaaggtgtttggagagggcacagctgctgccagcgctgggggcttcggcttcggcagcagcagcaacaccaccagctttggcaccctggccagccagaatgcccccaccttcggcagcctgagccagcagaccagcggcttcggcacccagagcagcggcttcagcggcttcggcagcggcaccggcggcttctcctttggcagcaacaacagctctgtgcagggctttggaggctggaggagctag

SEQ ID NO: 162527 - DNA, 6282 bp, Artificial Sequence
  Description of Artificial Sequence: Synthetic coding sequence
atgggagatgagatggatgccatgatccctgagcgggagatgaaggacttccagttccgggccctgaagaaggtgcgcatctttgacagccctgaggagctgcccaaggagaggagcagcctgctggccgtgagcaacaagtatggcctggtgtttgctggaggagccagcggcctgcagatcttccccaccaagaacctgctgatccagaacaagccaggagatgaccccaacaagatcgtggacaaggtgcagggcctgctggtgcccatgaagttccccatccaccacctggccctgagctgtgacaacctgaccctgagcgcctgcatgatgagcagtgaatatggcagcatcatcgccttctttgatgtgaggaccttcagcaatgaggccaagcagcagaagaggccctttgcctaccacaagctgctgaaggatgctgggggcatggtgattgacatgaagtggaaccccaccgtgcccagcatggtggccgtgtgcctggctgatggcagcattgctgtgctgcaggtgacagagaccgtgaaggtgtgtgccaccctgcccagcacagtggccgtgacctctgtgtgctggagccccaagggcaagcagctggccgtgggcaagcagaatggaacagtggtgcagtacctgcccaccctgcaggagaagaaggtgatcccctgcccccccttctatgaaagtgaccaccctgtgcgggtgctggatgtgctgtggattggcacctacgtgtttgccatcgtgtatgctgctgctgatggcaccctggagaccagcccagatgtggtgatggccctgctgcccaagaaggaggagaagcaccctgagatctttgtgaacttcatggagccctgctacggcagctgcacagagcggcagcaccactactacctgagctacatcgaggagtgggacctggtgctggccgccagcgctgccagcacagaggtgtccatcctggcccggcagagcgaccagatcaactgggagagctggctgctggaggacagcagcagagctgagctgcctgtgacagacaagagtgatgacagcctgcccatgggcgtggtggtggactacaccaaccaggtggagatcaccatcagtgatgagaagaccctgcccccagcccctgtgctgatgctgctgagcacagatggagtgctgtgccccttctacatgatcaaccagaaccctggggtgaagagcctcatcaagaccccagagcggctgagcctggagggggagcggcagcccaagagccctggcagcacccccaccacccccaccagcagccaggccccccagaagctggatgccagcgctgctgctgccccagccagcctgccccccagcagccctgctgcccccatcgccaccttcagcctgctgcctgctggaggagcccccaccgtcttctcctttggcagcagcagcctgaagagcagcgccaccgtgactggagagcccccatcctacagcagcggcagtgacagcagcaaggccgcccctggccctggccccagcaccttctcctttgtgccccccagcaaggccagcctggcccccaccccagctgccagccctgtggcccccagcgctgccagcttctcctttggcagcagcggcttcaagcccaccctggagagcacccctgtgcccagcgtgtctgcccccaacatcgccatgaagcccagcttcccccccagcaccagcgctgtgaaggtgaacctgtctgagaacagcagccagagcgccccacccatgagccccttcagcagcgccagcaagccagctgccagcggccccctgagccaccccacccccctgagcgccccacccagctctgtgcccctgaagagctctgtgctgcccagccccagcggccgcagcgcccagggcagcagcagccctgtgcccagcatggtgcagaagagcccccgcatcaccccacctgctgccaagccaggcagcccccaggccaagagcctgcagcctgctgtggccgagaagcagggccaccagtggaaggacagcgaccctgtgatggccggcattggagaggagatcgcccacttccagaaggagctggaggagctgaaggcccggaccagcaaggcctgcttccaggtgggcaccagcgaggagatgaagatgctgaggacagaaagtgatgacctgcacaccttcctgctggagatcaaggagaccacagagagcctgcatggagacatcagcagcctgaagaccaccctgctggagggctttgctggggtggaggaggcccgggagcagaatgaaagaaacagagattctggctacctgcacctgctgtacaagaggcccctggaccccaagtctgaggcccagctgcaggagatccggcggctgcaccagtatgtgaagtttgctgtgcaggatgtgaatgatgtgctggacctggagtgggaccagcacctggagcagaagaagaagcagaggcacctgctggtgcctgagcgggagaccctcttcaacaccctggccaacaaccgggagatcatcaaccagcagaggaagaggctgaaccacctggtggacagcctgcagcagctgcggctgtacaagcagaccagcctgtggagcctgagcagcgctgtgcccagccagagcagcatccacagctttgacagcgacctggagagcctgtgcaatgccctgctgaagaccaccatcgagagccacaccaagagcctgcccaaggtgcctgccaagctgagccccatgaagcaggcccagctgaggaacttcctggccaagaggaagaccccacctgtgcgcagcacagccccagccagcctgagccgcagcgccttcctgagccagcgctactatgaggacctggatgaggtgagcagcaccagctctgtgtcccagagcctggagagtgaagatgcccggaccagctgcaaggatgatgaagctgtggtgcaggcccccaggcatgcccctgtggtgaggacccccagcatccagcccagcctgctgccccatgctgccccctttgccaagagccacctggtgcacggcagcagccctggggtgatgggcacctctgtggccaccagcgccagcaagatcatcccccagggcgctgacagcaccatgctggccaccaagacagtgaagcacggggcccccagccccagccaccccatcagcgccccccaggccgctgctgctgctgccctgcggcggcagatggccagccaggccccagctgtgaacaccctgacagagagcaccctgaagaatgtgccccaggtggtgaatgtgcaggagctgaagaacaacccagccacccccagcacagccaagaccccccaccctgtgctgacccctgtggccgccaaccaggccaagcagggcagcctcatcaacagcctgaagcccagcggccccaccccagccagcggccagctgagcagcggggacaaggccagcggcacagccaagattgaaacagctgtgaccagcacccccagcgccagcggccagttcagcaagcccttctccttcagccccagcggcaccggcttcaactttggcatcatcacccccacccccagcagcaacttcaccgctgcccagggcgccacccccagcaccaaggagagcagccagccagatgccttcagcagcggcggcggcagcaagcccagctatgaggccatccctgagagcagcccccccagcggcatcaccagcgccagcaacaccaccccaggagagcctgctgccagcagcagcaggcctgtggcccccagcggcacagccctgagcaccaccagcagcaagctggagaccccacccagcaagctgggggagctgctcttccccagcagcctggccggggagaccctgggcagcttcagcggcctgcgggtgggccaggctgatgacagcaccaagcccaccaacaaggccagcagcaccagcctgaccagcacccagcccaccaagaccagcggcgtgcccagcggcttcaacttcaccgcccctcctgtgctgggcaagcacacagagccccctgtgaccagcagcgccaccaccacctctgtggcccccccagctgccaccagcaccagcagcacagctgtgtttggcagcctgcctgtgaccagcgctggcagcagtggagtcatcagctttggaggcaccagcctgtctgctgggaagaccagcttctcctttggcagccagcagaccaacagcacagtgccccccagcgcccccccacccaccacagctgccacccccctgcccaccagcttccccaccctgagctttggcagcctgctgagcagcgccaccacccccagcctgcccatgtctgctggccgcagcacagaggaggccaccagcagcgccctgcctgagaagccaggggacagcgaggtgtctgccagcgctgccagcctgctggaggagcagcagagcgcccagctgccccaggccccaccccagaccagtgacagcgtgaagaaggagcctgtgctggcccagcctgctgtgagcaacagcggcacagctgccagcagcaccagcctggtggccctgtctgctgaggccaccccagccaccactggagtgcctgatgccaggacagaggccgtgcccccagccagcagcttctctgtgcccggccagacagctgtgacagctgctgccatcagcagcgctggccctgtggccgtggagaccagcagcacccccatcgccagcagcaccaccagcatcgtggcccctggccccagcgctgaggccgccgccttcggcaccgtgaccagcggcagctctgtgtttgcccagcccccagctgccagcagcagcagcgccttcaaccagctgaccaacaacacagccacagcccccagcgccacccctgtgtttggccaggtggccgccagcacagcccccagcctgtttggccagcagacaggcagcacagccagcacagctgctgccaccccccaggtgagcagcagcggcttcagcagccctgccttcggcaccacagcccctggggtgtttggccagaccaccttcggccaggcctctgtgtttggccagagcgccagcagcgctgccagcgtcttctccttcagccagcccggcttcagctctgtgcctgccttcggccagcctgccagcagcacccccaccagcaccagcggctctgtgtttggagctgccagcagcaccagcagcagcagcagcttctcctttggccagagcagccccaacacaggaggcggcctgtttggccagagcaatgccccagccttcggccagagccctggcttcggccagggcggctctgtgtttggaggcaccagcgctgccaccaccacagctgccaccagcggcttctccttctgccaggccagcggcttcggcagcagcaacacaggctctgtgtttggccaggccgccagcactggaggcatcgtgtttggccagcagagcagcagcagcagcggctctgtgtttggaagtggcaacacaggccggggcggcggcttcttcagcggcctgggcggcaagcccagccaggatgctgccaacaagaaccccttcagcagcgccagcggcggcttcggcagcacagccaccagcaacaccagcaacctgtttggaaacagcggggccaagacctttggaggctttgccagcagcagctttggagagcagaagcccaccggcaccttcagcagcggcggcggctctgtggccagccagggcttcggcttcagcagccccaacaagacaggaggctttggagctgcccctgtgtttggcagcccccccacctttggaggcagccctggctttggaggagtgcctgcctttggaagtgccccagccttcaccagccccctgggcagcactggaggcaaggtgtttggagagggcacagctgctgccagcgctgggggcttcggcagcctggccatgagcctgagccccaccctgaagggccgcctgctgctgatgaggcccaaggccggcggcggccgggagcaggccgcccctggcaggaagagcaatgaaagccgcagcctgggccacctgtgcatggagcgggccctgaccagccccctgaaggtgtgggagcagcagcagcaccacatcctgcggcatgcccgggagagtgaatgtccccacttccgcatcaccgtgcccacagacttctggttctgggaccctgagtag

SEQ ID NO: 162528 - DNA, 1308 bp, Artificial Sequence
  Description of Artificial Sequence: Synthetic coding sequence
atgaagagcagcctgctgctgcggggcgtgcacttctgcttccacctgcccggggccacccccagcaccaaggagagcagccagccagatgccttcagcagcggcggcggcagcaagcccagctatgaggccatccctgagagcagcccccccagcggcatcaccagcgccagcaacaccaccccaggagagcctgctgccagcagcagcaggcctgtggcccccagcggcacagccctgagcaccaccagcagcaagctggagaccccacccagcaagctgggggagctgctcttccccagcagcctggccggggagaccctgggcagcttcagcggcctgcgggtgggccaggctgatgacagcaccaagcccaccaacaaggccagcagcaccagcctgaccagcacccagcccaccaagaccagcggcgtgcccagcggcttcaacttcaccgcccctcctgtgctgggcaagcacacagagccccctgtgaccagcagcgccaccaccacctctgtggcccccccagctgccaccagcaccagcagcacagctgtgtttggcagcctgcctgtgaccagcgctggcagcagtggagtcatcagctttggaggcaccagcctgtctgctgggaagaccagcttctcctttggcagccagcagaccaacagcacagtgccccccagcgcccccccacccaccacagctgccacccccctgcccaccagcttccccaccctgagctttggcagcctgctgagcagcgccaccacccccagcctgcccatgtctgctggccgcagcacagaggaggccaccagcagcgccctgcctgagaagccaggggacagcgaggtgtctgccagcgctgccagcctgctggaggagcagcagagcgcccagctgccccaggccccaccccagaccagtgacagcgtgaagaaggagcctgtgctggcccagcctgctgtgagcaacagcggcacagctgccagcagcaccagcctggtggccctgtctgctgaggccaccccagccaccactggagtgcctgatgccaggacagaggccgtgcccccagccagcagcttctctgtgcccggccagacagctgtgacagctgctgccatcagcagcgctggccctgtggccgtggagaccagcagcacccccatcgccagcagcaccaccagcatcgtggcccctggccccagcgctgaggccgccgccttcggcaccgtgaccagcggcagctctgtgtttgcccagcccccagctgccagcagcagcagcgccttcaactag

SEQ ID NO: 162529 - DNA, 981 bp, Artificial Sequence
  Description of Artificial Sequence: Synthetic coding sequence
atggccgcctttgctgtggagccccagggccctgccctgggcagcgagcccatgatgctgggcagccccaccagccccaagccaggagtgaatgcccagttcctgcccggcttcctgatgggagacctgcctgcccctgtgaccccccagcccaggagcatcagcggccccagcgtgggcgtgatggagatgaggagccccctgctggccggcggcagccccccccagcctgtggtgcctgcccacaaggacaagagcggggcccctcctgtgcgcagcatctatgatgacatcagcagccctggcctgggcagcacccccctgaccagccggcggcagcccaacatctctgtgatgcagagccccctggtgggcgtgaccagcaccccaggcaccggccagagcatgttctccccagccagcatcggccagcccaggaagaccaccctgagccctgcccagctggaccccttctacacccagggcgacagcctgaccagcgaggaccacctggatgacagctgggtgacagtgtttggcttcccccaggccagcgccagctacatcctgctgcagtttgcccagtatggcaacatcctgaagcacgtgatgagcaacacaggcaactggatgcacatccgctaccagagcaagctgcaggccaggaaggccctgagcaaggatggccgcatctttggagagagcatcatgattggagtgaagccctgcatcgacaagtctgtgatggagagcagtgacagatgtgccctgagcagccccagcctggccttcaccccacccatcaagaccctgggcacccccacccagcccggcagcaccccccgcatcagcaccatgaggcccctggccacagcctacaaggccagcaccagtgactaccaggtgatcagtgaccggcagacccccaagaaggatgagagcctggtgtccaaggccatggagtacatgtttggctggtag

SEQ ID NO: 162530 - DNA, 930 bp, Artificial Sequence
  Description of Artificial Sequence: Synthetic coding sequence
atgatgctgggcagccccaccagccccaagccaggagtgaatgcccagttcctgcccggcttcctgatgggagacctgcctgcccctgtgaccccccagcccaggagcatcagcggccccagcgtgggcgtgatggagatgaggagccccctgctggccggcggcagccccccccagcctgtggtgcctgcccacaaggacaagagcggggcccctcctgtgcgcagcatctatgatgacatcagcagccctggcctgggcagcacccccctgaccagccggcggcagcccaacatctctgtgatgcagagccccctggtgggcgtgaccagcaccccaggcaccggccagagcatgttcagccctgccagcatcggccagcccaggaagaccaccctgagccctgcccagctggaccccttctacacccagggcgacagcctgaccagcgaggaccacctggatgacagctgggtgacagtgtttggcttcccccaggccagcgccagctacatcctgctgcagtttgcccagtatggcaacatcctgaagcacgtgatgagcaacacaggcaactggatgcacatccgctaccagagcaagctgcaggccaggaaggccctgagcaaggatggccgcatctttggagagagcatcatgattggagtgaagccctgcatcgacaagtctgtgatggagagcagtgacagatgtgccctgagcagccccagcctggccttcaccccacccatcaagaccctgggcacccccacccagcccggcagcaccccccgcatcagcaccatgaggcccctggccacagcctacaaggccagcaccagtgactaccaggtgatcagtgaccggcagacccccaagaaggatgagagcctggtgtccaaggccatggagtacatgtttggctggtag

SEQ ID NO: 162531 - DNA, 576 bp, Artificial Sequence
  Description of Artificial Sequence: Synthetic coding sequence
atgttcagccctgccagcatcggccagcccaggaagaccaccctgagccctgcccagctggaccccttctacacccagggcgacagcctgaccagcgaggaccacctggatgacagctgggtgacagtgtttggcttcccccaggccagcgccagctacatcctgctgcagtttgcccagtatggcaacatcctgaagcacgtgatgagcaacacaggcaactggatgcacatccgctaccagagcaagctgcaggccaggaaggccctgagcaaggatggccgcatctttggagagagcatcatgattggagtgaagccctgcatcgacaagtctgtgatggagagcagtgacagatgtgccctgagcagccccagcctggccttcaccccacccatcaagaccctgggcacccccacccagcccggcagcaccccccgcatcagcaccatgaggcccctggccacagcctacaaggccagcaccagtgactaccaggtgatcagtgaccggcagacccccaagaaggatgagagcctggtgtccaaggccatggagtacatgtttggctggtag

SEQ ID NO: 162532 - DNA, 981 bp, Artificial Sequence
  Description of Artificial Sequence: Synthetic coding sequence
atgaagcaggatgccagcagaaatgctgcctacacagtggactgtgaggactatgtgcacgtggtggagttcaacccctttgaaaatggagacagcggcaacctgattgcctacggcggcaacaactacgtggtgattggcacctgcaccttccaggaggaggaggctgatgtggagggcatccagtacaagaccctgcggaccttccaccacggcgtgcgggtggatggcatcgcctggagccctgagacccggctggacagcctgccccctgtgatcaagttctgcaccagcgctgctgacatgaagatccgcctcttcaccagtgacctgcaggacaagaatgagtacaaggtgctggagggccacacagacttcatcaatggcctggtgtttgaccccaaggagggccaggagatcgcctctgtgtctgatgaccacacctgccgcatctggaacctggagggcgtgcagacagcccactttgtgctgcacagccctggcatgtctgtgtgctggcaccctgaggagaccttcaagctgatggtggccgagaagaatggcaccatccgcttctatgacctgctggcccagcaggccatcctgagcctggagagcgagcaggtgcccctgatgtctgcccactggtgcctgaagaacaccttcaaggtgggcgctgtggccggaaatgactggctgatctgggacatcaccaggagcagctacccccagaacaagaggcctgtgcacatggaccgggcctgcctcttccgctggagcaccatcagcgagaacctgtttgccaccaccggctacccaggcaagatggccagccagttccagatccaccacctgggccacccccagcccatcctgatgggctctgtggccgtgggcagcggcctgtcctggcacaggaccctgcccctgtgtgtgattggaggagaccacaagctgctcttctgggtgacagaggtgtag

SEQ ID NO: 162533 - DNA, 156 bp, Artificial Sequence
  Description of Artificial Sequence: Synthetic coding sequence
atgaagcaggatgccagcagaaatgctgcctacacagtggactgtgaggactatgtgcacgtggtggagttcaacccctttgaaaatggagacagcggcaacctgattgcctacggcggcaacaactacgtggtgattggcacctgcaccttctag

SEQ ID NO: 162534 - DNA, 981 bp, Artificial Sequence; identical to SEQ ID NO: 162532
  Description of Artificial Sequence: Synthetic coding sequence

SEQ ID NO: 162535 - DNA, 1143 bp, Artificial Sequence
  Description of Artificial Sequence: Synthetic coding sequence
atggaggagatctatgccaagtttgtgtcccagaagatcagcaagacccgctggaggcccctgcccccaggcagcctgcagacagctgagacctttgccaccggctcctgggacaatgaggagaactacatcagcctgtggagcattggagactttggaaacctggacagtgatggcggctttgaaggagaccaccagctgctgtgtgacatccgccaccacggagatgtgatggacctgcagttctttgaccaggagcgcatcgtggccgccagcagcacaggctgtgtgaccgtcttcctgcaccaccccaacaaccagaccctgtctgtgaaccagcagtggaccacagcccactaccacacaggccctggcagccccagctacagcagcgccccctgcacaggagtggtgtgcaacaaccctgagatcgtgacagtgggagaagatggccgcatcaacctcttccgggctgaccacaaggaggccgtgaggaccatcgacaatgctgacagcagcaccctgcatgctgtgaccttcctgcggaccccagagatcctgactgtgaacagcatcggccagctgaagatctgggacttccggcagcagggcaatgagcccagccagatcctgagcctgaccggggacagagtgcccctgcactgtgtggacagacaccccaaccagcagcacgtggtggccactggaggccaggacggcatgctgagcatctgggatgtgcggcagggcaccatgcctgtgtccctgctgaaggcccacgaggccgagatgtgggaggtgcacttccaccccagcaaccctgagcacctgttcacctgcagtgaagatggcagcctgtggcactgggatgccagcacagatgtgcctgagaagagcagcctcttccaccagggcggccgcagcagcaccttcctgagccacagcatcagcaaccaggccaacgtgcaccagagcgtcatcagctcctggctgagcacagatcctgccaaggaccgcatcgagatcaccagcctgctgcccagccgcagcctgtctgtgaacaccctggatgtgctgggcccctgcctggtgtgtggcacagatgctgaggccatctacgtgaccaggcacctgttctcctag

SEQ ID NO: 162536 - DNA, 747 bp, Artificial Sequence
  Description of Artificial Sequence: Synthetic coding sequence
atgggcggccccctgagcctgggcacagactgtgcccacacaggctacagaagagagctgaccctgtgcagccaccggctgcggcccaaggtgcccagcaaccagggcagcgctggccggggcggcgctgagaggagagtgctgtgcctgctgtttgctgtgcctgctgctgctgccttcggcatggaggagatctatgccaagtttgtgtcccagaagatcagcaagacccgctggaggcccctgcccccaggcagcctgcagacagctgagacctttgccaccggctcctgggacaatgaggagaactacatcagcctgtggagcatcggggactttggaaacctggacagtgatggcggctttgaaggagaccaccagctgctgtgtgacatccgccaccacggagatgtgatggacctgcagttctttgaccaggagagaattgtggccgccagcagcacaggctgtgtgacagtgttcctgcaccaccccaacaaccagaccctgtctgtgaaccagcagtggaccacagcccactaccacactggacctggcagccccagctacagcagcgccccctgcaccggggtggtgtgcaacaaccctgagatcgtgacagtgggggaggatggccgcatcaacctcttccgggctgaccacaaggaggccgtgaggaccatcggcctggtgacagagtgccacagcacagtgctgattgacatccccaccaacagcatgctgtag

SEQ ID NO: 162537 - DNA, 1143 bp, Artificial Sequence; identical to SEQ ID NO: 162535
  Description of Artificial Sequence: Synthetic coding sequence

SEQ ID NO: 162538 - DNA, 1407 bp, Artificial Sequence
  Description of Artificial Sequence: Synthetic coding sequence
atggccaagagaaatgctgagaaggagctgacagacaggaactgggaccaggaggatgaagctgaggaggtgggcaccttctccatggccagcgaggaggtgctgaagaacagagccatcaagaaggccaagagaagaaatgtgggctttgaaagtgacaccggcggggccttcaagggcttcaagggcctggtggtgcccagcggcggcggccgcttcagcggcttcggcagcggggccggcggcaagcccctggagggcctgagcaatggaaacaacatcaccagcgcccccccatttgccagcgccaaggctgctgctgaccccaaggtggccttcggcagcctggccgccaacggccccaccaccctggtggacaaggtgagcaaccccaagaccaacggggacagccagcagcccagcagcagcggcctggccagcagcaaggcctgtgtgggcaatgcctaccacaagcagctggccgccctgaactgcagcgtgcgggactggatcgtgaagcacgtgaacaccaaccccctgtgtgacctgacccccatcttcaaggactatgagaagtacctggccaacatcgagcagcagcacggcaacagcggcaggaacagcgagagcgagagcaacaaggtggccgctgagacccagagccccagcctgtttggcagcaccaagctgcagcaggagagcaccttcctgttccacggcaacaagacagaggacaccccagacaagaagatggaggtggccagcgagaagaagacagaccccagcagcctgggcgccaccagcgccagcttcaactttgggaagaaggtggacagctctgtgctgggcagcctgagctctgtgcccctgaccggcttctccttcagccctggcaacagcagcctgtttgggaaggacaccacccagagcaagcctgtgagcagccccttccccaccaagcccctggagggccaggccgagggggacagcggggagtgcaagggaggagatgaggaggagaatgatgagccccccaaggtggtggtgacagaggtgaaggaggaggatgccttctacagcaagaagtgcaagctgttctacaagaaggacaatgagttcaaggagaagggcatcggcaccctgcacctgaagcccacagccaaccagaagacccagctgctggtgcgggctgacaccaacctgggcaacatcctgctgaatgtgctgatcccccccaacatgccctgcaccaggacaggcaagaacaacgtgctgattgtgtgtgtgcccaacccccccattgatgagaagaatgccaccatgcctgtgaccatgctgatccgggtgaagaccagtgaagatgctgatgagctgcacaagatcctgctggagaagaaggatgcctag

SEQ ID NO: 162539 - DNA, 1323 bp, Artificial Sequence
  Description of Artificial Sequence: Synthetic coding sequence
atggccagcgaggaggtgctgaagaacagagccatcaagaaggccaagagaagaaatgtgggctttgaaagtgacaccggcggggccttcaagggcttcaagggcctggtggtgcccagcggcggcggccgcttcagcggcttcggcagcggggccggcggcaagcccctggagggcctgagcaatggaaacaacatcaccagcgcccccccatttgccagcgccaaggctgctgctgaccccaaggtggccttcggcagcctggccgccaacggccccaccaccctggtggacaaggtgagcaaccccaagaccaacggggacagccagcagcccagcagcagcggcctggccagcagcaaggcctgtgtgggcaatgcctaccacaagcagctggccgccctgaactgcagcgtgcgggactggatcgtgaagcacgtgaacaccaaccccctgtgtgacctgacccccatcttcaaggactatgagaagtacctggccaacatcgagcagcagcacggcaacagcggcaggaacagcgagagcgagagcaacaaggtggccgctgagacccagagccccagcctgtttggcagcaccaagctgcagcaggagagcaccttcctgttccacggcaacaagacagaggacaccccagacaagaagatggaggtggccagcgagaagaagacagaccccagcagcctgggcgccaccagcgccagcttcaactttgggaagaaggtggacagctctgtgctgggcagcctgagctctgtgcccctgaccggcttctccttcagccctggcaacagcagcctgtttgggaaggacaccacccagagcaagcctgtgagcagccccttccccaccaagcccctggagggccaggccgagggggacagcggggagtgcaagggaggagatgaggaggagaatgatgagccccccaaggtggtggtgacagaggtgaaggaggaggatgccttctacagcaagaagtgcaagctgttctacaagaaggacaatgagttcaaggagaagggcatcggcaccctgcacctgaagcccacagccaaccagaagacccagctgctggtgcgggctgacaccaacctgggcaacatcctgctgaatgtgctgatcccccccaacatgccctgcaccaggacaggcaagaacaacgtgctgattgtgtgtgtgcccaacccccccattgatgagaagaatgccaccatgcctgtgaccatgctgatccgggtgaagaccagtgaagatgctgatgagctgcacaagatcctgctggagaagaaggatgcctag

SEQ ID NO: 162540 - DNA, 1323 bp, Artificial Sequence; identical to SEQ ID NO: 162539
  Description of Artificial Sequence: Synthetic coding sequence

SEQ ID NO: 162541 - DNA, 27 bp, Artificial Sequence
  Description of Artificial Sequence: Synthetic coding sequence
atggccagcgaggaggtgctgaagtag

SEQ ID NO: 162542 - DNA, 537 bp, Artificial Sequence
  Description of Artificial Sequence: Synthetic coding sequence
atggccaagagaaatgctgagaaggagctgacagacaggaactgggaccaggaggatgaagctgaggaggtgggcaccttctccatggccagcgaggaggtgctgaagaacagagccatcaagaaggccaagagaagaaatgtgggctttgaaagtgacaccggcggggccttcaagggcttcaagggcctggtggtgcccagcggcggcggccgcttcagcggcttcggcagcggggccggcggcaagcccctggagggcctgagcaatggaaacaacatcaccagcgcccccccatttgccagcgccaaggctgctgctgaccccaaggtggcctttggaggagatgaggaggagaatgatgagccccccaaggtggtggtgacagaggtgaaggaggaggatgccttctacagcaagaagtgcaagctgttctacaagaaggacaatgagttcaaggagaagggcatcggcaccctgcacctgaagcccacagccaaccagaagacccagctgctggtgcgggctgacacctag

SEQ ID NO: 162543 - DNA, 138 bp, Artificial Sequence
  Description of Artificial Sequence: Synthetic coding sequence
atggccaagagaaatgctgagaaggagctgacagacaggaactgggaccaggaggatgaagctgaggaggtgggcaccttctccatggccagcgaggaggtgctgaagaacagagccatcaagaaggccaagaggtag

SEQ ID NO: 162544 - DNA, 657 bp, Artificial Sequence
  Description of Artificial Sequence: Synthetic coding sequence
atggaggtggccagcgagaagaagacagaccccagcagcctgggcgccaccagcgccagcttcaactttgggaagaaggtggacagctctgtgctgggcagcctgagctctgtgcccctgaccggcttctccttcagccctggcaacagcagcctgtttgggaaggacaccacccagagcaagcctgtgagcagccccttccccaccaagcccctggagggccaggccgagggggacagcggggagtgcaagggaggagatgaggaggagaatgatgagccccccaaggtggtggtgacagaggtgaaggaggaggatgccttctacagcaagaagtgcaagctgttctacaagaaggacaatgagttcaaggagaagggcatcggcaccctgcacctgaagcccacagccaaccagaagacccagctgctggtgcgggctgacaccaacctgggcaacatcctgctgaatgtgctgatcccccccaacatgccctgcaccaggacaggcaagaacaacgtgctgattgtgtgtgtgcccaacccccccattgatgagaagaatgccaccatgcctgtgaccatgctgatccgggtgaagaccagtgaagatgctgatgagctgcacaagatcctgctggagaagaaggatgcctag

SEQ ID NO: 162545 - DNA, 231 bp, Artificial Sequence
  Description of Artificial Sequence: Synthetic coding sequence
atggccaagagaaatgctgagaaggagctgacagacaggaactgggaccaggaggatgaagctgaggaggtgggcaccttctccatggccagcgaggaggtgctgaagaacagagccatcaagaaggccaagagaagaaatgtgggctttgaggtgctgctgctgcagatggccctgcccccctggctgatcaagttccagatccccaagctgatgggcaccgtgtcctag

SEQ ID NO: 162546 - DNA, 15 bp, Artificial Sequence
  Description of Artificial Sequence: Synthetic coding sequence
atggccaagaggtag

SEQ ID NO: 162547 - DNA, 33 bp, Artificial Sequence
  Description of Artificial Sequence: Synthetic coding sequence
atggccaagagaaatgctgagaaggagctgtag

SEQ ID NO: 162548 - DNA, 1524 bp, Artificial Sequence
  Description of Artificial Sequence: Synthetic coding sequence
atggccttcaactttggagcccccagcggcaccagcggcacagctgctgccacagctgccccagctgggggctttggaggcttcggcaccaccagcaccacagctggcagcgccttctccttcagcgcccccaccaacacaggcaccaccggcctgtttggaggcacccagaacaagggctttggatttggaactggatttggcaccaccaccggcaccagcacaggcctgggcaccggcctgggcaccggcctgggctttggaggcttcaacacccagcagcagcagcagaccaccctgggcggcctcttcagccagcccacccaggcccccacccagagcaaccagctgatcaacacagccagcgccctgagcgcccccaccctgctgggagatgaaagagatgccatcctggccaagtggaaccagctgcaggccttctggggcaccgggaagggctacttcaacaacaacatcccccctgtggagttcacccaggagaaccccttctgccgcttcaaggctgtgggctacagctgcatgcccagcaacaaggatgaagatggcctggtggtgctggtgttcaacaagaaggagacagagatccgcagccagcagcagcagctggtggagagcctgcacaaggtgctgggcggcaaccagaccctgactgtgaatgtggagggcaccaagaccctgcctgatgaccagacagaggtggtgatctacgtggtggagaggagccccaacggcaccagccggcgggtgcctgccaccaccctgtatgcccactttgagcaggccaacatcaagacccagctgcagcagctgggcgtgaccctgtccatgaccaggacagagctgagccctgcccagatcaagcagctgctgcagaaccccccagctggggtggaccccatcatctgggagcaggccaaggtggacaacccagattctgagaagctgatccctgtgcccatggtgggcttcaaggagctgctgcggcggctgaaggtgcaggaccagatgaccaagcagcaccagacccggctggacatcatcagcgaggacatcagcgagctgcagaagaaccagaccacctctgtggccaagatcgcccagtacaagaggaagctgatggacctgagccacaggaccctgcaggtgctgatcaagcaggagatccagaggaagagcggctacgccatccaggctgatgaggagcagctgcgggtgcagctggacaccatccagggcgagctgaatgcccccacccagttcaagggccgcctgaatgagctgatgagccagatccgcatgcagaaccactttggagctgtgcgctctgaggagcgctactacattgatgctgacctgctgcgggagatcaagcagcacctgaagcagcagcaggagggcctgagccacctgatcagcatcatcaaggatgacctggaggacatcaagctggtggagcacggcctgaatgagaccatccacatccggggcggcgtcttctcctag

SEQ ID NO: 162549 - DNA, 876 bp, Artificial Sequence
  Description of Artificial Sequence: Synthetic coding sequence
atgcccagcaacaaggatgaagatggcctggtggtgctggtgttcaacaagaaggagacagagatccgcagccagcagcagcagctggtggagagcctgcacaaggtgctgggcggcaaccagaccctgactgtgaatgtggagggcaccaagaccctgcctgatgaccagacagaggtggtgatctacgtggtggagaggagccccaacggcaccagccggcgggtgcctgccaccaccctgtatgcccactttgagcaggccaacatcaagacccagctgcagcagctgggcgtgaccctgtccatgaccaggacagagctgagccctgcccagatcaagcagctgctgcagaaccccccagctggggtggaccccatcatctgggagcaggccaaggtggacaacccagattctgagaagctgatccctgtgcccatggtgggcttcaaggagctgctgcggcggctgaaggtgcaggaccagatgaccaagcagcaccagacccggctggatgtgctgatcaagcaggagatccagaggaagagcggctacgccatccaggctgatgaggagcagctgcgggtgcagctggacaccatccagggcgagctgaatgcccccacccagttcaagggccgcctgaatgagctgatgagccagatccgcatgcagaaccactttggagctgtgcgctctgaggagcgctactacattgatgctgacctgctgcgggagatcaagcagcacctgaagcagcagcaggagggcctgagccacctgatcagcatcatcaaggatgacctggaggacatcaagctggtggagcacggcctgaatgagaccatccacatccggggcggcgtcttctcctag

SEQ ID NO: 162550 - DNA, 984 bp, Artificial Sequence
  Description of Artificial Sequence: Synthetic coding sequence
atgcccagcaacaaggatgaagatggcctggtggtgctggtgttcaacaagaaggagacagagatccgcagccagcagcagcagctggtggagagcctgcacaaggtgctgggcggcaaccagaccctgactgtgaatgtggagggcaccaagaccctgcctgatgaccagacagaggtggtgatctacgtggtggagaggagccccaacggcaccagccggcgggtgcctgccaccaccctgtatgcccactttgagcaggccaacatcaagacccagctgcagcagctgggcgtgaccctgtccatgaccaggacagagctgagccctgcccagatcaagcagctgctgcagaaccccccagctggggtggaccccatcatctgggagcaggccaaggtggacaacccagattctgagaagctgatccctgtgcccatggtgggcttcaaggagctgctgcggcggctgaaggtgcaggaccagatgaccaagcagcaccagacccggctggacatcatcagcgaggacatcagcgagctgcagaagaaccagaccacctctgtggccaagatcgcccagtacaagaggaagctgatggacctgagccacaggaccctgcaggtgctgatcaagcaggagatccagaggaagagcggctacgccatccaggctgatgaggagcagctgcgggtgcagctggacaccatccagggcgagctgaatgcccccacccagttcaagggccgcctgaatgagctgatgagccagatccgcatgcagaaccactttggagctgtgcgctctgaggagcgctactacattgatgctgacctgctgcgggagatcaagcagcacctgaagcagcagcaggagggcctgagccacctgatcagcatcatcaaggatgacctggaggacatcaagctggtggagcacggcctgaatgagaccatccacatccggggcggcgtcttctcctag

SEQ ID NO: 162551 - DNA, 1380 bp, Artificial Sequence
  Description of Artificial Sequence: Synthetic coding sequence
atggccttcaactttggagcccccagcggcaccagcggcacagctgctgccacagctgccccagctgggggctttggaggcttcggcaccaccagcaccacagctggcagcgccttctccttcagcgcccccaccaacacaggcaccacagccctgggcggcctcttcagccagcccacccaggcccccacccagagcaaccagctgatcaacacagccagcgccctgagcgcccccaccctgctgggagatgaaagagatgccatcctggccaagtggaaccagctgcaggccttctggggcaccgggaagggctacttcaacaacaacatcccccctgtggagttcacccaggagaaccccttctgccgcttcaaggctgtgggctacagctgcatgcccagcaacaaggatgaagatggcctggtggtgctggtgttcaacaagaaggagacagagatccgcagccagcagcagcagctggtggagagcctgcacaaggtgctgggcggcaaccagaccctgactgtgaatgtggagggcaccaagaccctgcctgatgaccagacagaggtggtgatctacgtggtggagaggagccccaacggcaccagccggcgggtgcctgccaccaccctgtatgcccactttgagcaggccaacatcaagacccagctgcagcagctgggcgtgaccctgtccatgaccaggacagagctgagccctgcccagatcaagcagctgctgcagaaccccccagctggggtggaccccatcatctgggagcaggccaaggtggacaacccagattctgagaagctgatccctgtgcccatggtgggcttcaaggagctgctgcggcggctgaaggtgcaggaccagatgaccaagcagcaccagacccggctggacatcatcagcgaggacatcagcgagctgcagaagaaccagaccacctctgtggccaagatcgcccagtacaagaggaagctgatggacctgagccacaggaccctgcaggtgctgatcaagcaggagatccagaggaagagcggctacgccatccaggctgatgaggagcagctgcgggtgcagctggacaccatccagggcgagctgaatgcccccacccagttcaagggccgcctgaatgagctgatgagccagatccgcatgcagaaccactttggagctgtgcgctctgaggagcgctactacattgatgctgacctgctgcgggagatcaagcagcacctgaagcagcagcaggagggcctgagccacctgatcagcatcatcaaggatgacctggaggacatcaagctggtggagcacggcctgaatgagaccatccacatccggggcggcgtcttctcctag

SEQ ID NO: 162552 - DNA, 582 bp, Artificial Sequence
  Description of Artificial Sequence: Synthetic coding sequence
atgagcggcttcaactttggaggcactggagcccccactggaggcttcaccttcggcacagccaagacagccaccaccaccccagccaccggcttctccttcagcaccagcggcactggaggcttcaactttggagcccccttccagcctgccaccagcacccccagcacaggcctcttcagcctggccacccagaccccagccacccagaccaccggcttcaccttcggcacagccaccctggccagcggcggcaccggcttcagcctgggcatcggggccagcaagctgaacctgagcaacacagctgccaccccagccatggccaaccccagcggcttcggcctgggcagcagcaacctgaccaatgccatcagcagcacagtgaccagcagccagggcacagcccccaccggctttgtgtttggccccagcaccacctctgtggccccagccaccaccagcggcggcttctccttcaccggcggcagcacagcccagcccagcggcttcaacatcggcagcgctggcaacagcgcccagcccacagccccagccaccctgcccttcaccccagcctag

SEQ ID NO: 162553 - DNA, 1569 bp, Artificial Sequence
  Description of Artificial Sequence: Synthetic coding sequence
atgagcggcttcaactttggaggcactggagcccccactggaggcttcaccttcggcacagccaagacagccaccaccaccccagccaccggcttctccttcagcaccagcggcactggaggcttcaactttggagcccccttccagcctgccaccagcacccccagcacaggcctcttcagcctggccacccagaccccagccacccagaccaccggcttcaccttcggcacagccaccctggccagcggcggcaccggcttcagcctgggcatcggggccagcaagctgaacctgagcaacacagctgccaccccagccatggccaaccccagcggcttcggcctgggcagcagcaacctgaccaatgccatcagcagcacagtgaccagcagccagggcacagcccccaccggctttgtgtttggccccagcaccacctctgtggccccagccaccaccagcggcggcttctccttcaccggcggcagcacagcccagcccagcggcttcaacatcggcagcgctggcaacagcgcccagcccacagccccagccaccctgcccttcaccccagccaccccagctgccaccacagctggggccacccagcctgctgcccccacccccacagccaccatcaccagcacaggccccagcctgtttgccagcatcgccacagcccccaccagcagcgccaccaccggcctgagcctgtgcacccctgtgaccacagctggggcccccacagctggcacccagggcttcagcctgaaggcccctggagctgccagcggcaccagcaccaccaccagcacagctgccacagccacagccaccaccaccagcagcagcagcaccaccggctttgccctgaacctgaagcccctggccccagctggcatccccagcaacacagctgctgctgtgacagcccctcctggccctggagctgctgctggagctgctgccagcagcgccatgacctacgcccagctggagagcctcatcaacaagtggagcctggagctggaggaccaggagcggcacttcctgcagcaggccacccaggtgaatgcctgggacaggaccctgattgaaaatggagagaagatcaccagcctgcaccgggaggtggagaaggtgaagctggaccagaagaggctggaccaggagctggacttcatcctgagccagcagaaggagctggaggacctgctgagccccctggaggagctggtgaaggagcagagcggcaccatctacctgcagcacgcagatgaggagcgggagaagacctacaagctggccgagaacattgatgcccagctgaagaggatggcccaggacctgaaggacatcatcgagcacctgaacaccagcggggccccagctgacaccagtgaccccctgcagcagatctgcaagatcctgaatgcccacatggacagcctgcagtggattgaccagaacagcgccctgctgcagaggaaggtggaggaggtgaccaaggtgtgtgagggccgcaggaaggagcaggagaggagcttccgcatcacctttgattag

SEQ ID NO: 162554 - DNA, 1569 bp, Artificial Sequence; identical to SEQ ID NO: 162553
  Description of Artificial Sequence: Synthetic coding sequence

SEQ ID NO: 162555 - DNA, 1569 bp, Artificial Sequence; identical to SEQ ID NO: 162553
  Description of Artificial Sequence: Synthetic coding sequence

SEQ ID NO: 162556 - DNA, 1971 bp, Artificial Sequence
  Description of Artificial Sequence: Synthetic coding sequence
atggaggagctggatggagagcccaccgtgaccctcatccctggggtgaacagcaagaagaaccagatgtactttgactggggccctggagagatgctggtgtgtgagaccagcttcaacaagaaggagaagtctgagatggtgcccagctgccccttcatctacatcatcaggaaggatgtggatgtgtacagccagatcctgaggaagctgttcaatgaaagccacggcatcttcctgggcctgcagagaattgatgaggagctgaccgggaagagcaggaagagccagctggtgcgggtgtccaagaactacagaagtgtcatccgggcctgcatggaggagatgcaccaggtggccatcgccgccaaggaccctgccaacggccggcagttcagcagccaggtgtccatcctgagcgccatggagctgatctggaacctgtgtgagatcctcttcatcgaggtggccccagctggccccctgctgctgcacctgctggactgggtgcggctgcacgtgtgtgaggtggacagcctgtctgcagatgtgctgggcagcgagaaccccagcaagcatgacagcttctggaacctggtgaccatcctggtgctgcagggccgcctggatgaggcccggcagatgctgagcaaggaggctgatgccagccctgccagcgctggcatctgccgcatcatgggagacctgatgaggaccatgcccatcctgagccctggcaacacccagaccctgacagagctggagctgaagtggcagcactggcatgaggagtgtgagcgctacctgcaggacagcacctttgccaccagcccccacctggagagcctgctgaagatcatgctgggagatgaggccgccctgctggagcagaaggagctgctgagcaactggtaccacttcctggtgacccggctgctgtacagcaaccccaccgtgaagcccatcgacctgcactactatgcccagagcagcctggacctcttcctgggcggggagagcagccctgagcccctggacaacatcctgctggccgcctttgaatttgacatccaccaggtgatcaaggaatgttccatcgccctgagcaactggtggtttgtggcccacctgacagacctgctggaccactgcaagctgctgcagagccacaacctgtacttcggcagcaacatgagggagttcctgctgctggagtatgccagcggcctgtttgcccaccccagcctgtggcagctgggcgtggactactttgactactgcccagagctgggccgggtgtccctggagctgcacatcgagcgcatccccctgaacacagagcagaaggccctgaaggtgctgcgcatctgtgagcagaggcagatgacagagcaggtgcgcagcatctgcaagatcctggccatgaaggctgtgaggaacaaccggctgggcagcgccctgtcctggagcatccgggccaaggatgctgcctttgccaccctggtgtctgaccgcttcctgcgggactactgtgagcggggctgcttcagtgacctggacctgattgacaacctgggccctgccatgatgctgagtgaccggctgaccttcctgggcaagtaccgggagttccacaggatgtacggggagaagagatttgctgatgctgccagcctgctgctgagcctgatgaccagccgcatcgcccccaggagcttctggatgaccctgctgacagatgccctgcccctgctggagcagaagcaggtgatcttctctgctgagcagacctatgagctgatgcgctgcctggaggacctgaccagccggcggcctgtgcacggggagagtgacacagagcagctgcaggatgatgacatcgagaccaccaaggtggagatgctgcggctgagcctggccaggaacctggcccgggccatcatccgggagggcagcctggagggcagctag

SEQ ID NO: 162557 - DNA, 1389 bp, Artificial Sequence
  Description of Artificial Sequence: Synthetic coding sequence
atggccgccagcagcgctgcccggagccccttctgccagcagtggagcagcagcggcacctgtgtgcgcttcttcctgctgaagtggccccaggtgaccatcctggtgctgcagggccgcctggatgaggcccggcagatgctgagcaaggaggctgatgccagccctgccagcgctggcatctgccgcatcatgggagacctgatgaggaccatgcccatcctgagccctggcaacacccagaccctgacagagctggagctgaagtggcagcactggcatgaggagtgtgagcgctacctgcaggacagcacctttgccaccagcccccacctggagagcctgctgaagatcatgctgggagatgaggccgccctgctggagcagaaggagctgctgagcaactggtaccacttcctggtgacccggctgctgtacagcaaccccaccgtgaagcccatcgacctgcactactatgcccagagcagcctggacctcttcctgggcggggagagcagccctgagcccctggacaacatcctgctggccgcctttgaatttgacatccaccaggtgatcaaggaatgttccatcgccctgagcaactggtggtttgtggcccacctgacagacctgctggaccactgcaagctgctgcagagccacaacctgtacttcggcagcaacatgagggagttcctgctgctggagtatgccagcggcctgtttgcccaccccagcctgtggcagctgggcgtggactactttgactactgcccagagctgggccgggtgtccctggagctgcacatcgagcgcatccccctgaacacagagcagaaggccctgaaggtgctgcgcatctgtgagcagaggcagatgacagagcaggtgcgcagcatctgcaagatcctggccatgaaggctgtgaggaacaaccggctgggcagcgccctgtcctggagcatccgggccaaggatgctgcctttgccaccctggtgtctgaccgcttcctgcgggactactgtgagcggggctgcttcagtgacctggacctgattgacaacctgggccctgccatgatgctgagtgaccggctgaccttcctgggcaagtaccgggagttccacaggatgtacggggagaagagatttgctgatgctgccagcctgctgctgagcctgatgaccagccgcatcgcccccaggagcttctggatgaccctgctgacagatgccctgcccctgctggagcagaagcaggtgaaggtggccgctgctgtggtgttctttgcctgccagagcctgctggagctgagctgcatcgctgtggctgatgtgcgggtgtcctcctttgtggtgctgcctgtgcgggtgtacagcccctag

SEQ ID NO: 162558 - DNA, 975 bp, Artificial Sequence
  Description of Artificial Sequence: Synthetic coding sequence
atggtgcccagctgccccttcatctacatcatcaggaaggatgtggatgtgtacagccagatcctgaggaagctgttcaatgaaagccacggcatcttcctgggcctgcagagaattgatgaggagctgaccgggaagagcaggaagagccagctggtgcgggtgtccaagaactacagaagtgtcatccgggcctgcatggaggagatgcaccaggtggccatcgccgccaaggaccctgccaacggccggcagttcagcagccaggtgtccatcctgagcgccatggagctgatctggaacctgtgtgagatcctcttcatcgaggtggccccagctggccccctgctgctgcacctgctggactgggtgcggctgcacgtgtgtgaggtggacagcctgtctgcagatgtgctgggcagcgagaaccccagcaagcatgacagcttctggaacctggtgaccatcctggtgctgcagggccgcctggatgaggcccggcagatgctgagcaaggaggctgatgccagccctgccagcgctggcatctgccgcatcatgggagacctgatgaggaccatgcccatcctgagccctggcaacacccagaccctgacagagctggagctgaagtggcagcactggcatgaggagtgtgagcgctacctgcaggacagcacctttgccaccagcccccacctggagagcctgctgaagatcatgctgggagatgaggccgccctgctggagcagaaggagctgctgagcaactggtaccacttcctggtgacccggctgctgtacagcaaccccaccgtgaagcccatcgacctgcactactatgcccagagcagcctggacctcttcctgggcggggagagcagccctgagcccctggacaacatcctgctggccgcctttgaatttgacatccaccaggtgatcaaggaatgtagagatgtgcacctgaagtag

SEQ ID NO: 162559 - DNA, 780 bp, Artificial Sequence
  Description of Artificial Sequence: Synthetic coding sequence
atgagggagttcctgctgctggagtatgccagcggcctgtttgcccaccccagcctgtggcagctgggcgtggactactttgactactgcccagagctgggccgggtgtccctggagctgcacatcgagcgcatccccctgaacacagagcagaaggccctgaaggtgctgcgcatctgtgagcagaggcagatgacagagcaggtgcgcagcatctgcaagatcctggccatgaaggctgtgaggaacaaccggctgggcagcgccctgtcctggagcatccgggccaaggatgctgcctttgccaccctggtgtctgaccgcttcctgcgggactactgtgagcggggctgcttcagtgacctggacctgattgacaacctgggccctgccatgatgctgagtgaccggctgaccttcctgggcaagtaccgggagttccacaggatgtatggagagaagagatttgctgatgctgccagcctgctgctgagcctgatgaccagcagaattgcccccaggagcttctggatgaccctgctgacagatgccctgcccctgctggagcagaagcaggtgatcttctctgctgagcagacctatgagctgatgcgctgcctggaggacctgaccagcagaagacctgtgcatggagagagtgacacagagcagctgcaggatgatgacatcgagaccaccaaggtggagatgctgcggctgagcctggccaggaacctggcccgggccatcatccgggagggcagcctggagggcagctag

SEQ ID NO: 162560 - DNA, 1833 bp, Artificial Sequence
  Description of Artificial Sequence: Synthetic coding sequence
atggtgcccagctgccccttcatctacatcatcaggaaggatgtggatgtgtacagccagatcctgaggaagctgttcaatgaaagccacggcatcttcctgggcctgcagagaattgatgaggagctgaccgggaagagcaggaagagccagctggtgcgggtgtccaagaactacagaagtgtcatccgggcctgcatggaggagatgcaccaggtggccatcgccgccaaggaccctgccaacggccggcagttcagcagccaggtgtccatcctgagcgccatggagctgatctggaacctgtgtgagatcctcttcatcgaggtggccccagctggccccctgctgctgcacctgctggactgggtgcggctgcacgtgtgtgaggtggacagcctgtctgcagatgtgctgggcagcgagaaccccagcaagcatgacagcttctggaacctggtgaccatcctggtgctgcagggccgcctggatgaggcccggcagatgctgagcaaggaggctgatgccagccctgccagcgctggcatctgccgcatcatgggagacctgatgaggaccatgcccatcctgagccctggcaacacccagaccctgacagagctggagctgaagtggcagcactggcatgaggagtgtgagcgctacctgcaggacagcacctttgccaccagcccccacctggagagcctgctgaagatcatgctgggagatgaggccgccctgctggagcagaaggagctgctgagcaactggtaccacttcctggtgacccggctgctgtacagcaaccccaccgtgaagcccatcgacctgcactactatgcccagagcagcctggacctcttcctgggcggggagagcagccctgagcccctggacaacatcctgctggccgcctttgaatttgacatccaccaggtgatcaaggaatgttccatcgccctgagcaactggtggtttgtggcccacctgacagacctgctggaccactgcaagctgctgcagagccacaacctgtacttcggcagcaacatgagggagttcctgctgctggagtatgccagcggcctgtttgcccaccccagcctgtggcagctgggcgtggactactttgactactgcccagagctgggccgggtgtccctggagctgcacatcgagcgcatccccctgaacacagagcagaaggccctgaaggtgctgcgcatctgtgagcagaggcagatgacagagcaggtgcgcagcatctgcaagatcctggccatgaaggctgtgaggaacaaccggctgggcagcgccctgtcctggagcatccgggccaaggatgctgcctttgccaccctggtgtctgaccgcttcctgcgggactactgtgagcggggctgcttcagtgacctggacctgattgacaacctgggccctgccatgatgctgagtgaccggctgaccttcctgggcaagtaccgggagttccacaggatgtacggggagaagagatttgctgatgctgccagcctgctgctgagcctgatgaccagccgcatcgcccccaggagcttctggatgaccctgctgacagatgccctgcccctgctggagcagaagcaggtgatcttctctgctgagcagacctatgagctgatgcgctgcctggaggacctgaccagccggcggcctgtgcacggggagagtgacacagagcagctgcaggatgatgacatcgagaccaccaaggtggagatgctgcggctgagcctggccaggaacctggcccgggccatcatccgggagggcagcctggagggcagctag

SEQ ID NO: 162561 - DNA, 846 bp, Artificial Sequence
  Description of Artificial Sequence: Synthetic coding sequence
atgaagctggccgccatgatcaagaagatgtgccccagcgacagcgagctgagcatcccagccaagaactgctacaggatggtgatcctgggcagcagcaaggtgggcaagacagccatcgtgagccgcttcctgaccggccgctttgaagatgcctacacccccaccatcgaggacttccacaggaagttctacagcatccggggggaggtgtaccagctggacatcctggacaccagcggcaaccaccccttccctgccatgaggcggctgagcatcctgactggagatgtgttcatcctggtgttcagcctggacaacagagacagctttgaggaggtgcagaggctgcggcagcagatcctggacaccaagagctgcctgaagaacaagaccaaggaaaatgtggatgtgcccctggtgatctgtggcaacaagggggaccgggacttctaccgggaggtggaccagcgggagattgagcagctggtgggagatgacccccagagatgtgcctactttgagatcagcgccaagaagaacagcagcctggaccagatgttccgggccctgtttgccatggccaagctgcccagcgagatgagcccagacctgcacaggaaggtgtctgtgcagtactgtgatgtgctgcacaagaaggccctgaggaacaagaagctgctgcgggccggcagcggcggcggcggcggggaccctggagatgcctttggaattgtggccccctttgcccggcggcccagcgtgcacagcgacctgatgtacatccgggagaaggccagcgctggcagccaggccaaggacaaggagcgctgcgtcatctcctag

SEQ ID NO: 162562 - DNA, 1881 bp, Artificial Sequence
  Description of Artificial Sequence: Synthetic coding sequence
atggtgctggagctgcccaagcgctggggcaagaacagcgagtttgaaggaggcaagagcacagtgaactgcagcaccacccctgtggccgagcgcttcttcaccagcagcaccagcctgaccctgaagcatgctgcctggtaccccagcgagatcctggacccccacgtggtgctgctgaccagtgacaacgtcatccgcatctacagcctgcgggagccccagacccccaccaacgtcatcatcctgtctgaggccgaggaggagagcctggtgctgaacaagggccgggcctacacagccagcctgggggagacagctgtggcctttgattttggccccctggccgctgtgcccaagaccctgtttggccagaatggcaaggatgaggtggtggcctaccccctgtacatcctgtatgaaaatggagagaccttcctgacctacatcagcctgctgcacagccctggcaacatcggcaagctgctgggccccctgcccatgcaccctgctgctgaggacaactacggctatgatgcctgtgctgtgctgtgcctgccctgtgtgcccaacatcctggtgattgccacagaaagtggcatgctgtaccactgtgtggtgctggagggggaggaggaggatgaccacaccagcgagaagtcctgggacagcagaattgacctgatccccagcctgtatgtgtttgaatgtgtggagctggagctggccctgaagctggccagcggggaggatgacccctttgacagcgacttcagctgccctgtgaagctgcaccgggaccccaagtgccccagccgctaccactgcacccatgaggccggcgtgcacagcgtgggcctgacctggatccacaagctgcacaagttcctgggcagtgatgaggaggacaaggacagcctgcaggagctgagcacagagcagaagtgctttgtggagcacatcctgtgcaccaagcccctgccctgccggcagcctgcccccatccggggcttctggatcgtgcctgacatcctgggccccaccatgatctgcatcaccagcacctatgaatgtctcatctggcccctgctgagcacagtgcacccagccagcccccccctgctgtgcaccagagaagatgtggaggtggccgagagccccctgcgggtgctggccgagaccccagacagctttgagaagcacatccgcagcatcctgcagaggtctgtggccaacccagccttcctgaactgcttcacccagctgaggaagatcaaggtggagaccctcttcctgcgggccagcgagaaggacatcgcccctcctccagaagaatgtctgcagctgctgagccgggccacccaggtgttccgggagcagtacatcctgaagcaggacctggccaaggaggagatccagaggagagtgaagctgctgtgtgaccagaagaagaagcagctggaggacctgagctactgccgggaggagaggaagagcctgcgggagatggccgagcggctggccgacaagtatgaggaggccaaggagaagcaggaggacatcatgaacaggatgaagaagctgctgcacagcttccacagcgagctgcctgtgctgagtgacagcgagcgggacatgaagaaggagctgcagctgatcccagaccagctgcggcacctgggcaatgccatcaagcaggtgaccatgaagaaggactaccagcagcagaagatggagaaggtgctgagcctgcccaagcccaccatcatcctgagcgcctaccagaggaagtgcatccagagcatcctgaaggaggagggggagcacatccgggagatggtgaagcagatcaatgacatcagaaatcatgtgaacttctag

SEQ ID NO: 162563 - DNA, 2226 bp, Artificial Sequence; identical to SEQ ID NO: 148155
  Description of Artificial Sequence: Synthetic coding sequence

SEQ ID NO: 162564 - DNA, 2460 bp, Artificial Sequence
  Description of Artificial Sequence: Synthetic coding sequence
atggacacagagggctttggagagctgctgcagcaggccgagcagctggccgctgagacagagggcatcagcgagctgccccacgtggagaggaacctgcaggagatccagcaggccggggagcggctgcggagcaggaccctgaccaggaccagccaggagacagcagatgtgaaggcctctgtgctgctgggcagccggggcctggacatcagccacatcagccagaggctggagagcctgtctgctgccaccacctttgagcccctggagcctgtgaaggacacagacatccagggcttcctgaagaatgagaaggacaatgccctgctgagcgccatcgaggagagcaggaagaggaccttcggcatggccgaggagtaccaccgggagagcatgctggtggagtgggagcaggtgaagcagaggatcctgcacaccctgctggccagcggagaagatgccctggacttcacccaggagagcgagcccagctacatcagtgatgtgggccccccaggccgcagcagcctggacaacatcgagatggcctatgcccggcagatctacatctacaatgagaagatcgtgaatggccacctgcagcccaacctggtggacctgtgtgcctctgtggccgagctggatgacaagagcatcagtgacatgtggaccatggtgaagcagatgacagatgtgctgctgaccccagccacagatgccctgaagaacagaagctctgtggaggtgaggatggagtttgtgcggcaggccctggcctacctggagcagagctacaagaactacaccctggtgacagtgtttggaaacctgcaccaggcccagctgggcggcgtgcccggcacctaccagctggtgcgctccttcctgaacatcaagctgcctgcccccctgcccggcctgcaggatggagaggtggagggccaccctgtgtgggccctgatctactactgcatgagatgtggggacctgctggccgccagccaggtggtgaacagagcccagcaccagctgggggagttcaagacctggttccaggagtacatgaacagcaaggaccggcggctgagccctgccacagagaacaagctgcggctgcactaccgccgggccctgaggaacaacacagacccctacaagagagctgtgtactgcatcatcggccgctgtgatgtgacagacaaccagagcgaggtggccgacaagacagaggactacctgtggctgaagctgaaccaggtgtgctttgatgatgatggcaccagcagcccccaggaccggctgaccctgagccagttccagaagcagctgctggaggactatggagagagccacttcaccgtgaaccagcagcccttcctgtacttccaggtgctcttcctgacagcccagtttgaggccgctgtggccttcctgttcaggatggagcggctgcgctgccacgctgtgcacgtggccctggtgctgtttgagctgaagctgctgctgaagagcagcggccagagcgcccagctgctgagccatgagcccggggaccccccctgcctgcggcggctgaactttgtgcggctgctgatgctgtacaccaggaagtttgagagcacagacccccgggaggccctgcagtacttctacttcctgagagatgagaaggacagccagggcgagaacatgttcctgcgctgtgtgtctgagctggtgattgagagccgggagtttgacatgatcctgggcaagctggagaatgatggcagcaggaagccaggagtcatcgacaagttcaccagtgacaccaagcccatcatcaacaaggtggcctctgtggctgaaaataaaggcctgtttgaggaggccgccaagctgtatgacctggccaagaatgctgacaaggtgctggagctgatgaacaagctgctgagccctgtggtgccccagatcagcgccccccagagcaacaaggagcggctgaagaacatggccctgagcattgctgagcgctaccgggcccagggcatcagcgccaacaagtttgtggacagcaccttctacctgctgctggacctgatcaccttctttgatgagtaccacagcggccacatcgaccgggcctttgacatcatcgagcggctgaagctggtgcccctgaaccaggagagcgtggaggagcgggtggccgccttcaggaacttcagtgatgagatccgccacaacctgtctgaggtgctgctggccaccatgaacatcctcttcacccagttcaagaggctgaagggcaccagccccagcagcagcagccggccccagagggtgattgaagatcgggacagccagctgcggagccaggcccggaccctcatcacctttgctggcatgatcccctaccgcaccagcggggacaccaatgcccggctggtgcagatggaggtgctgatgaactag

SEQ ID NO: 162565 - DNA, 2091 bp, Artificial Sequence
  Description of Artificial Sequence: Synthetic coding sequence
atggccgaggagtaccaccgggagagcatgctggtggagtgggagcaggtgaagcagaggatcctgcacaccctgctggccagcggggaggatgccctggacttcacccaggagagcgagcccagctacatcagtgatgtgggccccccaggccgcagcagcctggacaacatcgagatggcctatgcccggcagatctacatctacaatgagaagatcgtgaatggccacctgcagcccaacctggtggacctgtgtgcctctgtggccgagctggatgacaagagcatcagtgacatgtggaccatggtgaagcagatgacagatgtgctgctgaccccagccacagatgccctgaagaacagaagctctgtggaggtgaggatggagtttgtgcggcaggccctggcctacctggagcagagctacaagaactacaccctggtgacagtgtttggaaacctgcaccaggcccagctgggcggcgtgcccggcacctaccagctggtgcgctccttcctgaacatcaagctgcctgcccccctgcccggcctgcaggatggagaggtggagggccaccctgtgtgggccctgatctactactgcatgagatgtggggacctgctggccgccagccaggtggtgaacagagcccagcaccagctgggggagttcaagacctggttccaggagtacatgaacagcaaggaccggcggctgagccctgccacagagaacaagctgcggctgcactacagaagagccctgaggaacaacacagacccctacaagagagctgtgtactgcatcatcggccgctgtgatgtgacagacaaccagagcgaggtggccgacaagacagaggactacctgtggctgaagctgaaccaggtgtgctttgatgatgatggcaccagcagcccccaggaccggctgaccctgagccagttccagaagcagctgctggaggactatggagagagccacttcaccgtgaaccagcagcccttcctgtacttccaggtgctcttcctgacagcccagtttgaagctgctgtggccttcctgttcaggatggagcggctgcgctgccacgctgtgcacgtggccctggtgctgtttgagctgaagctgctgctgaagagcagcggccagagcgcccagctgctgagccatgagcccggggaccccccctgcctgcggcggctgaactttgtgcggctgctgatgctgtacaccaggaagtttgagagcacagacccccgggaggccctgcagtacttctacttcctgagagatgagaaggacagccagggcgagaacatgttcctgcgctgtgtgtctgagctggtgattgagagccgggagtttgacatgatcctgggcaagctggagaatgatggcagcaggaagccaggagtgattgacaagttcaccagtgacaccaagcccatcatcaacaaggtggcctctgtggccgagaacaagggcctgtttgaggaggccgccaagctgtatgacctggccaagaatgctgacaaggtgctggagctgatgaacaagctgctgagccctgtggtgccccagatcagcgccccccagagcaacaaggagcggctgaagaacatggccctgagcattgctgagcgctaccgggcccagggcatcagcgccaacaagtttgtggacagcaccttctacctgctgctggacctgatcaccttctttgatgagtaccacagcggccacatcgaccgggcctttgacatcatcgagcggctgaagctggtgcccctgaaccaggagagcgtggaggagcgggtggccgccttcaggaacttcagtgatgagatccgccacaacctgtctgaggtgctgctggccaccatgaacatcctcttcacccagttcaagaggctgaagggcaccagccccagcagcagcagccggccccagagggtgattgaggaccgggacagccagctgcggagccaggcccggaccctcatcacctttgctggcatgatcccctaccgcaccagcggggacaccaatgcccggctggtgcagatggaggtgctgatgaactag

SEQ ID NO: 162566 - DNA, 2091 bp, Artificial Sequence; identical to SEQ ID NO: 162565
  Description of Artificial Sequence: Synthetic coding sequence

SEQ ID NO: 162567 - DNA, 5403 bp, Artificial Sequence
  Description of Artificial Sequence: Synthetic coding sequence
atgttcaacaagagctttggcaccccatttggaggcggcaccggcggcttcggcaccaccagcaccttcggccagaacacaggcttcggcaccaccagcggcggggccttcggcaccagcgccttcggcagcagcaacaacacaggaggcctgtttggaaacagccagaccaagccaggcggcctgtttggcaccagcagcttcagccagcctgccaccagcaccagcactggatttggatttggcaccagcactggaacagccaacaccctgtttggaacagccagcacaggcaccagcctcttcagcagccagaacaatgcctttgcccagaacaagcccactggatttggaaactttggcaccagcaccagcagcggcggcctgtttggcaccaccaacaccaccagcaaccccttcggcagcaccagcggcagcctgtttggccccagcagcttcaccgctgcccccaccggcaccaccatcaagttcaacccccccaccggcacagacaccatggtgaaggccggcgtgtccaccaacatcagcaccaagcaccagtgcatcacagccatgaaggagtatgagagcaagagcctggaggagctgcggctggaggactaccaggccaacaggaagggcccccagaaccaggtgggcgccggcaccaccaccggcctgtttggcagcagccctgccaccagcagcgccaccggcctcttcagcagcagcaccaccaacagcggctttgcctacggccagaacaagacagccttcggcaccagcaccaccggcttcggcaccaaccctgggggcctgtttggccagcagaaccagcagaccaccagcctcttcagcaagcccttcggccaggccaccaccacccagaacacaggcttctcctttggaaacaccagcaccatcggccagcccagcaccaacaccatgggcctgtttggagtgacccaggccagccagcccggcggcctgtttggaacagccaccaacaccagcactggaacagcctttggaactggaacaggcctgtttggccagaccaacacaggctttggagctgtgggcagcaccctgtttggaaacaacaagctgaccaccttcggcagcagcaccaccagcgcccccagctttggcaccaccagcggcggcctgtttggatttggcaccaacaccagcggcaacagcatcttcggcagcaagccagcccctggcaccctgggcaccggcctgggcgccggcttcggcacagccctgggcgccggccaggccagcctgtttggaaacaaccagcccaagattggaggccccctgggcactggagccttcggggcccctggcttcaacaccaccacagccaccctgggctttggagccccccaggcccctgtggccctgacagaccccaatgccagcgctgcccagcaggccgtgctgcagcagcacatcaacagcctgacctacagcccctttggagacagccccctcttcaggaaccccatgtctgaccccaagaagaaggaggagcggctgaagcccaccaacccagctgcccagaaggccctgaccacccccacccactacaagctgacccccaggcctgccaccagggtgcggcccaaggccctgcagaccactggaacagccaagagccacctgtttgatggcctggatgatgatgagcccagcctggccaatggagccttcatgcccaagaagagcatcaagaagctggtgctgaagaacctgaacaacagcaacctcttcagccctgtgaacagagattctgagaacctggccagccccagcgagtacccagaaaatggagagcgcttctccttcctgagcaagcctgtggatgagaaccaccagcaggatggagatgaggacagcctggtgagccacttctacaccaaccccatcgccaagcccatcccccagaccccagagagcgctggcaacaagcacagcaacagcaacagcgtggatgacaccatcgtggccctgaacatgagagctgccctgagaaatggcctggagggcagcagcgaggagaccagcttccatgatgagagcctgcaggatgaccgggaggagattgagaacaacagctaccacatgcaccctgctggcatcatcctgaccaaggtgggctactacaccatccccagcatggatgacctggccaagatcaccaatgagaagggggagtgcatcgtgtctgacttcaccatcggcaggaagggctacggcagcatctactttgaaggagatgtgaacctgaccaacctgaacctggatgacatcgtgcacatccggaggaaggaggtggtggtgtacctggatgacaaccagaagccccctgtgggggagggcctgaacaggaaggccgaggtgaccctggatggagtgtggcccacagacaagaccagccgctgcctgatcaagagcccagaccggctggccgacatcaactatgagggccgcctggaggccgtgtccaggaagcagggcgcccagttcaaggagtacagacctgagaccggctcctgggtgttcaaggtgagccacttcagcaaatatggcctgcaggacagtgatgaggaggaggaggagcaccccagcaagaccagcaccaagaagctgaagacagcccccctgcccccagccagccagaccacccccctgcagatggccctgaatggcaagccagcccccccaccccagagccagagccctgaggtggagcagctgggccgggtggtggagctggacagcgacatggtggacatcacccaggagcctgtgctggacaccatgctggaggagagcatgcctgaggaccaggagcctgtgtctgccagcacccacatcgccagcagcctgggcatcaacccccacgtgctgcagatcatgaaggccagcctgctgacagatgaggaggatgtggacatggccctggaccagcgcttcagccggctgcccagcaaggctgacaccagccaggagatctgcagcccccggctgcccatcagcgccagccacagcagcaagaccaggagcctggtgggcggcctgctgcagagcaagttcaccagcggggccttcctgagccccagcgtgtctgtgcaggagtgcaggaccccccgggccgccagcctgatgaacatccccagcaccagctcctggagcgtgcccccacccctgaccagcgtcttcaccatgcccagccctgcccctgaggtgcccctgaagacagtgggcacccggcggcagctgggcctggtgccccgggagaagtctgtgacctacggcaagggcaagctgctgatggacatggccctcttcatgggccgctccttccgggtgggctggggccccaactggaccctggccaacagcggggagcagctgaatggcagccatgagctggagaaccaccagattgctgacagcatggagtttggcttcctgcccaaccctgtggccgtgaagcccctgacagagagccccttcaaggtgcacctggagaagctgagcctgcggcagaggaagccagatgaggacatgaagctgtaccagacccccctggagctgaagctgaagcacagcacagtgcacgtggatgagctgtgccccctcatcgtgcccaacctgggcgtggccgtcatccatgactatgctgactgggtgaaggaggccagcggggacctgcctgaggcccagatcgtgaagcactggagcctgacctggaccctgtgtgaggccctgtggggccacctgaaggagctggacagccagctgaatgagccccgggagtacatccagatcctggagcggcggcgggccttcagccgctggctgagctgcacagccaccccccagatcgaggaggaggtgtccctgacccagaagaacagccctgtggaggccgtgttctcctacctgaccgggaagaggatcagcgaggcctgcagcctggcccagcagagcggggaccaccggctggccctgctgctgagccagtttgtgggcagccagagcgtgcgggagctgctgaccatgcagctggtggactggcaccagctgcaggccgacagcttcatccaggatgagcggctgcgcatctttgccctgctggccggcaagcctgtgtggcagctgtctgagaagaagcagatcaacgtgtgcagccagctggactggaagaggagcctggccatccacctgtggtacctgctgcccccaacagccagcatcagccgggccctgtccatgtatgaggaggccttccagaacaccagtgacagcgacagatatgcctgcagccccctgcccagctacctggagggcagcggctgtgtgattgctgaggagcagaacagccagacccccctgagagatgtgtgcttccacctgctgaagctgtacagcgacagacactatgacctgaaccagctgctggagcccaggagcatcacagctgaccccctggactaccgcctgtcctggcacctgtgggaggtgctgcgggccctgaactacacccacctgagcgcccagtgtgaaggagtgctgcaggccagctatgccggccagctggagagcgagggcctgtgggagtgggccatctttgtgctgctgcacatcgacaacagcggcatccgggagaaggctgtgcgggagctgctgaccaggcactgccagctgctggagaccccagagagctgggccaaggagaccttcctgacccagaagctgcgggtgcctgccaagtggatccacgaggccaaggctgtgcgggcccacatggagagtgacaagcacctggaggccctgtgcctcttcaaggccgagcactggaaccgctgccacaagctgatcatccgccacctggccagtgatgccatcatcaatgaaaattatgactacctgaagggcttcctggaggacctggcccctcctgagaggagcagcctcatccaggactgggagaccagcggcctggtgtacctggactacatccgggtgattgagatgctgcggcacatccagcaggtggactgcagcggaaatgacctggagcagctgcacatcaaggtgaccagcctgtgcagcagaattgagcagatccagtgctacagcgccaaggaccggctggcccagagcgacatggccaagagggtggccaacctgctgcgggtggtgctgagcctgcaccaccccccagacaggaccagtgacagcaccccagacccccagagggtgcccctgcggctgctggccccccacatcggccgcctgcccatgccagaagattatgccatggatgagctgcggagcctgacccagagctacctgcgggagctggccgtgggcagcctgtag

SEQ ID NO: 162568 - DNA, 5181 bp, Artificial Sequence
  Description of Artificial Sequence: Synthetic coding sequence
atgttcaacaagagctttggcaccccatttggaggcggcaccggcggcttcggcaccaccagcaccttcggccagaacacaggcttcggcaccaccagcggcggggccttcggcaccagcgccttcggcagcagcaacaacacaggaggcctgtttggaaacagccagaccaagccaggcggcctgtttggcaccagcagcttcagccagcctgccaccagcaccagcactggatttggatttggcaccagcactggaacagccaacaccctgtttggaacagccagcacaggcaccagcctcttcagcagccagaacaatgcctttgcccagaacaagcccactggatttggaaactttggcaccagcaccagcagcggcggcctgtttggcaccaccaacaccaccagcaaccccttcggcagcaccagcggcagcctgtttggccccagcagcttcaccgctgcccccaccggcaccaccatcaagttcaacccccccaccggcacagacaccatggtgaaggccggcgtgtccaccaacatcagcaccaagcaccagtgcatcacagccatgaaggagtatgagagcaagagcctggaggagctgcggctggaggactaccaggccaacaggaagggcccccagaaccaggtgggcgccggcaccaccaccggcctgtttggcagcagccctgccaccagcagcgccaccggcctcttcagcagcagcaccaccaacagcggctttgcctacggccagaacaagacagccttcggcaccagcaccaccggcttcggcaccaaccctgggggcctgtttggccagcagaaccagcagaccaccagcctcttcagcaagcccttcggccaggccaccaccacccagaacacaggcttctcctttggaaacaccagcaccatcggccagcccagcaccaacaccatgggcctgtttggagtgacccaggccagccagcccggcggcctgtttggaacagccaccaacaccagcactggaacagcctttggaactggaacaggcctgtttggccagaccaacacaggctttggagctgtgggcagcaccctgtttggaaacaacaagctgaccaccttcggcagcagcaccaccagcgcccccagctttggcaccaccagcggcggcctgtttggatttggcaccaacaccagcggcaacagcatcttcggcagcaagccagcccctggcaccctgggcaccggcctgggcgccggcttcggcacagccctgggcgccggccaggccagcctgtttggaaacaaccagcccaagattggaggccccctgggcactggagccttcggggcccctggcttcaacaccaccacagccaccctgggctttggagccccccaggcccctgtggccctgacagaccccaatgccagcgctgcccagcaggccgtgctgcagcagcacatcaacagcctgacctacagcccctttggagacagccccctcttcaggaaccccatgtctgaccccaagaagaaggaggagcggctgaagcccaccaacccagctgcccagaaggccctgaccacccccacccactacaagctgacccccaggcctgccaccagggtgcggcccaaggccctgcagaccactggaacagccaagagccacctgtttgatggcctggatgatgatgagcccagcctggccaatggagccttcatgcccaagaagagcatcaagaagctggtgctgaagaacctgaacaacagcaacctcttcagccctgtgaacagagattctgagaacctggccagccccagcgagtacccagaaaatggagagcgcttctccttcctgagcaagcctgtggatgagaaccaccagcaggatggagatgaggacagcctggtgagccacttctacaccaaccccatcgccaagcccatcccccagaccccagagagcgctggcaacaagcacagcaacagcaacagcgtggatgacaccatcgtggccctgaacatgagagctgccctgagaaatggcctggagggcagcagcgaggagaccagcttccatgatgagagcctgcaggatgaccgggaggagattgagaacaacagctaccacatgcaccctgctggcatcatcctgaccaaggtgggctactacaccatccccagcatggatgacctggccaagatcaccaatgagaagggggagtgcatcgtgtctgacttcaccatcggcaggaagggctacggcagcatctactttgaaggagatgtgaacctgaccaacctgaacctggatgacatcgtgcacatccggaggaaggaggtggtggtgtacctggatgacaaccagaagccccctgtgggggagggcctgaacaggaaggccgaggtgaccctggatggagtgtggcccacagacaagaccagccgctgcctgatcaagagcccagaccggctggccgacatcaactatgagggccgcctggaggccgtgtccaggaagcagggcgcccagttcaaggagtacagacctgagaccggctcctgggtgttcaaggtgagccacttcagcaaatatggcctgcaggacagtgatgaggaggaggaggagcaccccagcaagaccagcaccaagaagctgaagacagcccccctgcccccagccagccagaccacccccctgcagatggccctgaatggcaagccagcccccccaccccagagccagagccctgaggtggagcagctgggccgggtggtggagctggacagcgacatggtggacatcacccaggagcctgtgctggacaccatgctggaggagagcatgcctgaggaccaggagcctgtgtctgccagcacccacatcgccagcagcctgggcatcaacccccacgtgctgcagatcatgaaggccagcctgctgacagatgaggaggatgtggacatggccctggaccagcgcttcagccggctgcccagcaaggctgacaccagccaggagatctgcagcccccggctgcccatcagcgccagccacagcagcaagaccaggagcctggtgggcggcctgctgcagagcaagttcaccagcggggccttcctgagccccagcgtgtctgtgcaggagtgcaggaccccccgggccgccagcctgatgaacatccccagcaccagctcctggagcgtgcccccacccctgaccagcgtcttcaccatgcccagccctgcccctgaggtgcccctgaagacagtgggcacccggcggcagctgggcctggtgccccgggagaagtctgtgacctacggcaagggcaagctgctgatggacatggccctcttcatgggccgctccttccgggtgggctggggccccaactggaccctggccaacagcggggagcagctgaatggcagccatgagctggagaaccaccagattgctgacagcatggagtttggcttcctgcccaaccctgtggccgtgaagcccctgacagagagccccttcaaggtgcacctggagaagctgagcctgcggcagaggaagccagatgaggacatgaagctgtaccagacccccctggagctgaagctgaagcacagcacagtgcacgtggatgagctgtgccccctcatcgtgcccaacctgggcgtggccgtcatccatgactatgctgactgggtgaaggaggccagcggggacctgcctgaggcccagatcgtgaagcactggagcctgacctggaccctgtgtgaggccctgtggggccacctgaaggagctggacagccagctgaatgagccccgggagtacatccagatcctggagcggcggcgggccttcagccgctggctgagctgcacagccaccccccagatcgaggaggaggtgtccctgacccagaagaacagccctgtggaggccgtgttctcctacctgaccgggaagaggatcagcgaggcctgcagcctggcccagcagagcggggaccaccggctggccctgctgctgagccagtttgtgggcagccagagcgtgcgggagctgctgaccatgcagctggtggactggcaccagctgcaggccgacagcttcatccaggatgagcggctgcgcatctttgccctgctggccggcaagcctgtgtggcagctgtctgagaagaagcagatcaacgtgtgcagccagctggactggaagaggagcctggccatccacctgtggtacctgctgcccccaacagccagcatcagccgggccctgtccatgtatgaggaggccttccagaacaccagtgacagcgacagatatgcctgcagccccctgcccagctacctggagggcagcggctgtgtgattgctgaggagcagaacagccagacccccctgagagatgtgtgcttccacctgctgaagctgtacagcgacagcatccgggagaaggctgtgcgggagctgctgaccaggcactgccagctgctggagaccccagagagctgggccaaggagaccttcctgacccagaagctgcgggtgcctgccaagtggatccacgaggccaaggctgtgcgggcccacatggagagtgacaagcacctggaggccctgtgcctcttcaaggccgagcactggaaccgctgccacaagctgatcatccgccacctggccagtgatgccatcatcaatgaaaattatgactacctgaagggcttcctggaggacctggcccctcctgagaggagcagcctcatccaggactgggagaccagcggcctggtgtacctggactacatccgggtgattgagatgctgcggcacatccagcaggtggactgcagcggaaatgacctggagcagctgcacatcaaggtgaccagcctgtgcagcagaattgagcagatccagtgctacagcgccaaggaccggctggcccagagcgacatggccaagagggtggccaacctgctgcgggtggtgctgagcctgcaccaccccccagacaggaccagtgacagcaccccagacccccagagggtgcccctgcggctgctggccccccacatcggccgcctgcccatgccagaagattatgccatggatgagctgcggagcctgacccagagctacctgcgggagctggccgtgggcagcctgtag

SEQ ID NO: 162569 - DNA, 4917 bp, Artificial Sequence
  Description of Artificial Sequence: Synthetic coding sequence
atgttcaacaagagctttggcaccccatttggaggcggcaccggcggcttcggcaccaccagcaccttcggccagaacacaggcttcggcaccaccagcggcggggccttcggcaccagcgccttcggcagcagcaacaacacaggaggcctgtttggaaacagccagaccaagccaggcggcctgtttggcaccagcagcttcagccagcctgccaccagcaccagcactggatttggatttggcaccagcactggaacagccaacaccctgtttggaacagccagcacaggcaccagcctcttcagcagccagaacaatgcctttgcccagaacaagcccactggatttggaaactttggcaccagcaccagcagcggcggcctgtttggcaccaccaacaccaccagcaaccccttcggcagcaccagcggcagcctgtttggccccagcagcttcaccgctgcccccaccggcaccaccatcaagttcaacccccccaccggcacagacaccatggtgaaggccggcgtgtccaccaacatcagcaccaagcaccagtgcatcacagccatgaaggagtatgagagcaagagcctggaggagctgcggctggaggactaccaggccaacaggaagggcccccagaaccaggtgggcgccggcaccaccaccggcctgtttggcagcagccctgccaccagcagcgccaccggcctcttcagcagcagcaccaccaacagcggctttgcctacggccagaacaagacagccttcggcaccagcaccaccggcttcggcaccaaccctgggggcctgtttggccagcagaaccagcagaccaccagcctcttcagcaagcccttcggccaggccaccaccacccagaacacaggcttctcctttggaaacaccagcaccatcggccagcccagcaccaacaccatgggcctgtttggagtgacccaggccagccagcccggcggcctgtttggaacagccaccaacaccagcactggaacagcctttggaactggaacaggcctgtttggccagaccaacacaggctttggagctgtgggcagcaccctgtttggaaacaacaagctgaccaccttcggcagcagcaccaccagcgcccccagctttggcaccaccagcggcggcctgtttggatttggcaccaacaccagcggcaacagcatcttcggcagcaagccagcccctggcaccctgggcaccggcctgggcgccggcttcggcacagccctgggcgccggccaggccagcctgtttggaaacaaccagcccaagattggaggccccctgggcactggagccttcggggcccctggcttcaacaccaccacagccaccctgggctttggagccccccaggcccctgtggccctgacagaccccaatgccagcgctgcccagcaggccgtgctgcagcagcacatcaacagcctgacctacagcccctttggagacagccccctcttcaggaaccccatgtctgaccccaagaagaaggaggagcggctgaagcccaccaacccagctgcccagaaggccctgaccacccccacccactacaagctgacccccaggcctgccaccagggtgcggcccaaggccctgcagaccactggaacagccaagagccacctgtttgatggcctggatgatgatgagcccagcctggccaatggagccttcatgcccaagaagagcatcaagaagctggtgctgaagaacctgaacaacagcaacctcttcagccctgtgaacagagattctgagaacctggccagccccagcgagtacccagaaaatggagagcgcttctccttcctgagcaagcctgtggatgagaaccaccagcaggatggagatgaggacagcctggtgagccacttctacaccaaccccatcgccaagcccatcccccagaccccagagagcgctggcaacaagcacagcaacagcaacagcgtggatgacaccatcgtggccctgaacatgagagctgccctgagaaatggcctggagggcagcagcgaggagaccagcttccatgatgagagcctgcaggatgaccgggaggagattgagaacaacagctaccacatgcaccctgctggcatcatcctgaccaaggtgggctactacaccatccccagcatggatgacctggccaagatcaccaatgagaagggggagtgcatcgtgtctgacttcaccatcggcaggaagggctacggcagcatctactttgaaggagatgtgaacctgaccaacctgaacctggatgacatcgtgcacatccggaggaaggaggtggtggtgtacctggatgacaaccagaagccccctgtgggggagggcctgaacaggaaggccgaggtgaccctggatggagtgtggcccacagacaagaccagccgctgcctgatcaagagcccagaccggctggccgacatcaactatgagggccgcctggaggccgtgtccaggaagcagggcgcccagttcaaggagtacagacctgagaccggctcctgggtgttcaaggtgagccacttcagcaaatatggcctgcaggacagtgatgaggaggaggaggagcaccccagcaagaccagcaccaagaagctgaagacagcccccctgcccccagccagccagaccacccccctgcagatggccctgaatggcaagccagcccccccaccccagagccagagccctgaggtggagcagctgggccgggtggtggagctggacagcgacatggtggacatcacccaggagcctgtgctggacaccatgctggaggagagcatgcctgaggaccaggagcctgtgtctgccagcacccacatcgccagcagcctgggcatcaacccccacgtgctgcagatcatgaaggccagcctgctgacagatgaggaggatgtggacatggccctggaccagcgcttcagccggctgcccagcaaggctgacaccagccaggagatctgcagcccccggctgcccatcagcgccagccacagcagcaagaccaggagcctggtgggcggcctgctgcagagcaagttcaccagcggggccttcctgagccccagcgtgtctgtgcaggagtgcaggaccccccgggccgccagcctgatgaacatccccagcaccagctcctggagcgtgcccccacccctgaccagcgtcttcaccatgcccagccctgcccctgaggtgcccctgaagacagtgggcacccggcggcagctgggcctggtgccccgggagaagtctgtgacctacggcaagggcaagctgctgatggacatggccctcttcatgggccgctccttccgggtgggctggggccccaactggaccctggccaacagcggggagcagctgaatggcagccatgagctggagaaccaccagattgctgacagcatggagtttggcttcctgcccaaccctgtggccgtgaagcccctgacagagagccccttcaaggtgcacctggagaagctgagcctgcggcagaggaagccagatgaggacatgaagctgtaccagacccccctggagctgaagctgaagcacagcacagtgcacgtggatgagctgtgccccctcatcgtgcccaacctgggcgtggccgtcatccatgactatgctgactgggtgaaggaggccagcggggacctgcctgaggcccagatcgtgaagcactggagcctgacctggaccctgtgtgaggccctgtggggccacctgaaggagctggacagccagctgaatgagccccgggagtacatccagatcctggagcggcggcgggccttcagccgctggctgagctgcacagccaccccccagatcgaggaggaggtgtccctgacccagaagaacagccctgtggaggccgtgttctcctacctgaccgggaagaggatcagcgaggcctgcagcctggcccagcagagcggggaccaccggctggccctgctgctgagccagtttgtgggcagccagagcgtgcgggagctgctgaccatgcagctggtggactggcaccagctgcaggccgacagcttcatccaggatgagcggctgcgcatctttgccctgctggccggcaagcctgtgtggcagctgtctgagaagaagcagatcaacgtgtgcagccagctggactggaagaggagcctggccatccacctgtggtacctgctgcccccaacagccagcatcagccgggccctgtccatgtatgaggaggccttccagaacaccagtgacagcgacagatatgcctgcagccccctgcccagctacctggagggcagcggctgtgtgattgctgaggagcagaacagccagacccccctgagagatgtgtgcttccacctgctgaagctgtacagcgacagcatccgggagaaggctgtgcgggagctgctgaccaggcactgccagctgctggagaccccagagagctgggccaaggagaccttcctgacccagaagctgcgggtgcctgccaagtggatccacgaggccaaggctgtgcgggcccacatggagagtgacaagcacctggaggccctgtgcctcttcaaggccgagcactggaaccgctgccacaagctgatcatccgccacctggccagtgatgccatcatcaatgaaaattatgactacctgaagggcttcctggaggacctggcccctcctgagaggagcagcctcatccaggactgggagaccagcggcctggtgtacctggactacatccgggtgattgagatgctgcggcacatccagcagatcgccctcttctgtgtggagtggatcgcccaggtgatgacctggagcagctacaccagcaagtag

SEQ ID NO: 162570 - DNA, 2763 bp, Artificial Sequence
  Description of Artificial Sequence: Synthetic coding sequence
atgttcaacaagagctttggcaccccatttggaggcggcaccggcggcttcggcaccaccagcaccttcggccagaacacaggcttcggcaccaccagcggcggggccttcggcaccagcgccttcggcagcagcaacaacacaggaggcctgtttggaaacagccagaccaagccaggcggcctgtttggcaccagcagcttcagccagcctgccaccagcaccagcactggatttggatttggcaccagcactggaacagccaacaccctgtttggaacagccagcacaggcaccagcctcttcagcagccagaacaatgcctttgcccagaacaagcccactggatttggaaactttggcaccagcaccagcagcggcggcctgtttggcaccaccaacaccaccagcaaccccttcggcagcaccagcggcagcctgtttggccccagcagcttcaccgctgcccccaccggcaccaccatcaagttcaacccccccaccggcacagacaccatggtgaaggccggcgtgtccaccaacatcagcaccaagcaccagtgcatcacagccatgaaggagtatgagagcaagagcctggaggagctgcggctggaggactaccaggccaacaggaagggcccccagaaccaggtgggcgccggcaccaccaccggcctgtttggcagcagccctgccaccagcagcgccaccggcctcttcagcagcagcaccaccaacagcggctttgcctacggccagaacaagacagccttcggcaccagcaccaccggcttcggcaccaaccctgggggcctgtttggccagcagaaccagcagaccaccagcctcttcagcaagcccttcggccaggccaccaccacccagaacacaggcttctcctttggaaacaccagcaccatcggccagcccagcaccaacaccatgggcctgtttggagtgacccaggccagccagcccggcggcctgtttggaacagccaccaacaccagcactggaacagcctttggaactggaacaggcctgtttggccagaccaacacaggctttggagctgtgggcagcaccctgtttggaaacaacaagctgaccaccttcggcagcagcaccaccagcgcccccagctttggcaccaccagcggcggcctgtttggatttggcaccaacaccagcggcaacagcatcttcggcagcaagccagcccctggcaccctgggcaccggcctgggcgccggcttcggcacagccctgggcgccggccaggccagcctgtttggaaacaaccagcccaagattggaggccccctgggcactggagccttcggggcccctggcttcaacaccaccacagccaccctgggctttggagccccccaggcccctgtggccctgacagaccccaatgccagcgctgcccagcaggccgtgctgcagcagcacatcaacagcctgacctacagcccctttggagacagccccctcttcaggaaccccatgtctgaccccaagaagaaggaggagcggctgaagcccaccaacccagctgcccagaaggccctgaccacccccacccactacaagctgacccccaggcctgccaccagggtgcggcccaaggccctgcagaccactggaacagccaagagccacctgtttgatggcctggatgatgatgagcccagcctggccaatggagccttcatgcccaagaagagcatcaagaagctggtgctgaagaacctgaacaacagcaacctcttcagccctgtgaacagagattctgagaacctggccagccccagcgagtacccagaaaatggagagcgcttctccttcctgagcaagcctgtggatgagaaccaccagcaggatggagatgaggacagcctggtgagccacttctacaccaaccccatcgccaagcccatcccccagaccccagagagcgctggcaacaagcacagcaacagcaacagcgtggatgacaccatcgtggccctgaacatgagagctgccctgagaaatggcctggagggcagcagcgaggagaccagcttccatgatgagagcctgcaggatgaccgggaggagattgagaacaacagctaccacatgcaccctgctggcatcatcctgaccaaggtgggctactacaccatccccagcatggatgacctggccaagatcaccaatgagaagggggagtgcatcgtgtctgacttcaccatcggcaggaagggctacggcagcatctactttgaaggagatgtgaacctgaccaacctgaacctggatgacatcgtgcacatccggaggaaggaggtggtggtgtacctggatgacaaccagaagccccctgtgggggagggcctgaacaggaaggccgaggtgaccctggatggagtgtggcccacagacaagaccagccgctgcctgatcaagagcccagaccggctggccgacatcaactatgagggccgcctggaggccgtgtccaggaagcagggcgcccagttcaaggagtacagacctgagaccggctcctgggtgttcaaggtgagccacttcagcaaatatggcctgcaggacagtgatgaggaggaggaggagcaccccagcaagaccagcaccaagaagctgaagacagcccccctgcccccagccagccagaccacccccctgcagatggccctgaatggcaagccagcccccccaccccaggtggagaagaagggccagtag

SEQ ID NO: 162571 - DNA, 2814 bp, Artificial Sequence
  Description of Artificial Sequence: Synthetic coding sequence
atgttcaacaagagctttggcaccccatttggaggcggcaccggcggcttcggcaccaccagcaccttcggccagaacacaggcttcggcaccaccagcggcggggccttcggcaccagcgccttcggcagcagcaacaacacaggaggcctgtttggaaacagccagaccaagccaggcggcctgtttggcaccagcagcttcagccagcctgccaccagcaccagcactggatttggatttggcaccagcactggaacagccaacaccctgtttggaacagccagcacaggcaccagcctcttcagcagccagaacaatgcctttgcccagaacaagcccactggatttggaaactttggcaccagcaccagcagcggcggcctgtttggcaccaccaacaccaccagcaaccccttcggcagcaccagcggcagcctgtttggccccagcagcttcaccgctgcccccaccggcaccaccatcaagttcaacccccccaccggcacagacaccatggtgaaggccggcgtgtccaccaacatcagcaccaagcaccagtgcatcacagccatgaaggagtatgagagcaagagcctggaggagctgcggctggaggactaccaggccaacaggaagggcccccagaaccaggtgggcgccggcaccaccaccggcctgtttggcagcagccctgccaccagcagcgccaccggcctcttcagcagcagcaccaccaacagcggctttgcctacggccagaacaagacagccttcggcaccagcaccaccggcttcggcaccaaccctgggggcctgtttggccagcagaaccagcagaccaccagcctcttcagcaagcccttcggccaggccaccaccacccagaacacaggcttctcctttggaaacaccagcaccatcggccagcccagcaccaacaccatgggcctgtttggagtgacccaggccagccagcccggcggcctgtttggaacagccaccaacaccagcactggaacagcctttggaactggaacaggcctgtttggccagaccaacacaggctttggagctgtgggcagcaccctgtttggaaacaacaagctgaccaccttcggcagcagcaccaccagcgcccccagctttggcaccaccagcggcggcctgtttggaaacaagcccaccctgaccctgggcaccaacaccaacaccagcaactttggcttcggcaccaacaccagcggcaacagcatcttcggcagcaagccagcccctggcaccctgggcaccggcctgggcgccggctttggaacagccctgggcgccggccaggccagcctgtttggaaacaaccagcccaagattggaggccccctgggcaccggggcctttggagcccctggcttcaacaccaccacagccaccctgggctttggagccccccaggcccctgtggccctgacagaccccaatgccagcgctgcccagcaggccgtgctgcagcagcacatcaacagcctgacctacagcccctttggagacagccccctcttcaggaaccccatgtctgaccccaagaagaaggaggagcggctgaagcccaccaacccagctgcccagaaggccctgaccacccccacccactacaagctgacccccaggcctgccaccagggtgcggcccaaggccctgcagaccaccggcacagccaagagccacctgtttgatggcctggatgatgatgagcccagcctggccaacggggccttcatgcccaagaagagcatcaagaagctggtgctgaagaacctgaacaacagcaacctcttcagccctgtgaacagagacagcgagaacctggccagccccagcgagtacccagaaaatggagagcgcttctccttcctgagcaagcctgtggatgagaaccaccagcaggatggagatgaggacagcctggtgagccacttctacaccaaccccatcgccaagcccatcccccagaccccagagagcgctggcaacaagcacagcaacagcaacagcgtggatgacaccatcgtggccctgaacatgagagctgccctgagaaatggcctggagggcagcagcgaggagaccagcttccatgatgagagcctgcaggatgaccgggaggagattgagaacaacagctaccacatgcaccctgctggcatcatcctgaccaaggtgggctactacaccatccccagcatggatgacctggccaagatcaccaatgaaaaaggagaatgtattgtgtctgacttcaccatcggcaggaagggctacggcagcatctactttgaaggagatgtgaacctgaccaacctgaacctggatgacatcgtgcacatccggaggaaggaggtggtggtgtacctggatgacaaccagaagccccctgtgggggagggcctgaacaggaaggccgaggtgaccctggatggagtgtggcccacagacaagaccagccgctgcctgatcaagagcccagaccggctggccgacatcaactatgagggccgcctggaggccgtgtccaggaagcagggcgcccagttcaaggagtacagacctgagaccggctcctgggtgttcaaggtgagccacttcagcaaatatggcctgcaggacagtgatgaggaggaggaggagcaccccagcaagaccagcaccaagaagctgaagacagcccccctgcccccagccagccagaccacccccctgcagatggccctgaatggcaagccagcccccccaccccaggtggagaagaagggccagtag

SEQ ID NO: 162572 - DNA, 1731 bp, Artificial Sequence
  Description of Artificial Sequence: Synthetic coding sequence
atgagcacaggcttctcctttggaactggagccagcagcaaccccagcgtgggcctgaactttggaaacctgggcagcaccagcaccccagccaccaccagcgcccccagcagcggcttcggcaccggcctgtttggcagcaagccagccaccggcttcaccctgggcggcaccaacacaggcatcgccaccaccatcaccaccggcctgaccctgggcaccccagccaccaccagcgctgccaccaccggcttcagcctgggcttcaacaagccagctgccagcgccaccccatttgccctgcccatcaccagcaccagcgccagcggcctgaccctgagcagcgccctgaccagcaccccagctgccagcacaggcttcaccctgaacaacctgggcggcaccacagccaccaccaccacagccagcacaggcctgagcctgggcggggccctggccggcctgggcggcagcctcttccagagcaccaacacaggcaccagcggcctgggccagaatgccctgggcctgaccctgggcaccacagctgccaccagcacagctggaaatgaaggcctgggcggcatcgacttcagcagcagcagtgacaagaagagtgacaagacaggcaccaggcctgaggacagcaaggccctgaaggatgagaacctgccccctgtgatctgccaggatgtggagaacctgcagaagtttgtgaaggagcagaagcaggtgcaggaggagatcagcaggatgagcagcaaggccatgctgaaggtgcaggaggacatcaaggccctgaagcagctgctgagcctggccgccaacggcatccagaggaacaccctgaacatcgacaagctgaagattgaaacagcccaggagctgaagaatgctgagatcgccctgcggacccagaagaccccacctggcctgcagcacgagtatgctgccccagctgactacttccgcatcctggtgcagcagtttgaggtgcagctgcagcagtaccggcagcagatcgaggagctggagaaccacctggccacccaggccaacaacagccacatcaccccccaggacctgtccatggccatgcagaagatctaccagacctttgtggccctggccgcccagctgcagagcatccatgaaaatgtgaaggtgctgaaggagcagtacctgggctacaggaagatgttcctgggagatgctgtggatgtgtttgagacccggcgggcagaggccaagaagtggcagaacaccccccgggtgaccaccggccccacccccttcagcaccatgcccaatgctgctgctgtggccatggccgccaccctgacccagcagcagcagcctgccaccggcccccagcccagcctgggcgtgtcctttggcaccccatttggaagtggcattggaacaggcctgcagagcagcggcctgggcagcagcaacctgggcggcttcggcaccagcagcggcttcggctgcagcaccactggagccagcaccttcggcttcggcaccaccaacaagcccagcggcagcctgtctgctggcttcggcagcagcagcaccagcggcttcaacttcagcaaccctggcatcacagccagcgctggcctgacctttggagtgagcaacccagccagcgctggctttggaactggaggccagctgctgcagctgaagaagcccccagctggcaacaagaggggcaagaggtag

SEQ ID NO: 162573 - DNA, 1764 bp, Artificial Sequence
  Description of Artificial Sequence: Synthetic coding sequence
atgagcacaggcttctcctttggaagtggcaccctgggcagcaccaccgtggccgccggcggcaccagcactggaggagtcttctcctttggcaccggggccagcagcaaccccagcgtgggcctgaactttggaaacctgggcagcaccagcaccccagccaccaccagcgcccccagcagcggctttggaacaggcctgtttggcagcaagccagccaccggcttcaccctgggcggcaccaacacaggcaccccagccaccaccagcgctgccaccaccggcttcagcctgggcttcaacaagccagctgccagcgccaccccatttgccctgcccatcaccagcaccagcgccagcggcctgaccctgagcagcgccctgaccagcaccccagctgccagcacaggcttcaccctgaacaacctgggcggcaccacagccaccaccaccacagccagcacaggcctgagcctgggcggggccctggccggcctgggcggcagcctcttccagagcaccaacacaggcaccagcggcctgggccagaatgccctgggcctgaccctgggcaccacagctgccaccagcacagctggaaatgaaggcctgggcggcatcgacttcagcagcagcagtgacaagaagagtgacaagacaggcaccaggcctgaggacagcaaggccctgaaggatgagaacctgccccctgtgatctgccaggatgtggagaacctgcagaagtttgtgaaggagcagaagcaggtgcaggaggagatcagcaggatgagcagcaaggccatgctgaaggtgcaggaggacatcaaggccctgaagcagctgctgagcctggccgccaacggcatccagaggaacaccctgaacatcgacaagctgaagattgaaacagcccaggagctgaagaatgctgagatcgccctgcggacccagaagaccccacctggcctgcagcatgaatatgctgccccagctgactacttccgcatcctggtgcagcagtttgaggtgcagctgcagcagtaccggcagcagatcgaggagctggagaaccacctggccacccaggccaacaacagccacatcaccccccaggacctgtccatggccatgcagaagatctaccagacctttgtggccctggccgcccagctgcagagcatccatgaaaatgtgaaggtgctgaaggagcagtacctgggctacaggaagatgttcctgggagatgctgtggatgtgtttgagaccaggagagctgaggccaagaagtggcagaacaccccccgggtgaccaccggccccacccccttcagcaccatgcccaatgctgctgctgtggccatggccgccaccctgacccagcagcagcagcctgccaccggcccccagcccagcctgggcgtgtcctttggcacccccttcggcagcggcatcggcaccggcctgcagagcagcggcctgggcagcagcaacctgggcggcttcggcaccagcagcggcttcggctgcagcaccaccggggccagcacctttggatttggcaccaccaacaagcccagcggcagcctgtctgctggcttcggcagcagcagcaccagcggcttcaacttcagcaaccctggcatcacagccagcgctggcctgaccttcggcgtgagcaacccagccagcgctggcttcggcaccggcggccagctgctgcagctgaagaagcccccagctggcaacaagaggggcaagaggtag

SEQ ID NO: 162574 - DNA, 1800 bp, Artificial Sequence
  Description of Artificial Sequence: Synthetic coding sequence
atgagcacaggcttctcctttggaagtggcaccctgggcagcaccaccgtggccgccggcggcaccagcactggaggagtcttctcctttggcaccggggccagcagcaaccccagcgtgggcctgaactttggaaacctgggcagcaccagcaccccagccaccaccagcgcccccagcagcggctttggaacaggcctgtttggcagcaagccagccaccggcttcaccctgggcggcaccaacacaggaattgccaccaccatcaccaccggcctgaccctgggcaccccagccaccaccagcgctgccaccaccggcttcagcctgggcttcaacaagccagctgccagcgccaccccatttgccctgcccatcaccagcaccagcgccagcggcctgaccctgagcagcgccctgaccagcaccccagctgccagcacaggcttcaccctgaacaacctgggcggcaccacagccaccaccaccacagccagcacaggcctgagcctgggcggggccctggccggcctgggcggcagcctcttccagagcaccaacacaggcaccagcggcctgggccagaatgccctgggcctgaccctgggcaccacagctgccaccagcacagctggaaatgaaggcctgggcggcatcgacttcagcagcagcagtgacaagaagagtgacaagacaggcaccaggcctgaggacagcaaggccctgaaggatgagaacctgccccctgtgatctgccaggatgtggagaacctgcagaagtttgtgaaggagcagaagcaggtgcaggaggagatcagcaggatgagcagcaaggccatgctgaaggtgcaggaggacatcaaggccctgaagcagctgctgagcctggccgccaacggcatccagaggaacaccctgaacatcgacaagctgaagattgaaacagcccaggagctgaagaatgctgagatcgccctgcggacccagaagaccccacctggcctgcagcatgaatatgctgccccagctgactacttccgcatcctggtgcagcagtttgaggtgcagctgcagcagtaccggcagcagatcgaggagctggagaaccacctggccacccaggccaacaacagccacatcaccccccaggacctgtccatggccatgcagaagatctaccagacctttgtggccctggccgcccagctgcagagcatccatgaaaatgtgaaggtgctgaaggagcagtacctgggctacaggaagatgttcctgggagatgctgtggatgtgtttgagaccaggagagctgaggccaagaagtggcagaacaccccccgggtgaccaccggccccacccccttcagcaccatgcccaatgctgctgctgtggccatggccgccaccctgacccagcagcagcagcctgccaccggcccccagcccagcctgggcgtgtcctttggcacccccttcggcagcggcatcggcaccggcctgcagagcagcggcctgggcagcagcaacctgggcggcttcggcaccagcagcggcttcggctgcagcaccaccggggccagcacctttggatttggcaccaccaacaagcccagcggcagcctgtctgctggcttcggcagcagcagcaccagcggcttcaacttcagcaaccctggcatcacagccagcgctggcctgaccttcggcgtgagcaacccagccagcgctggcttcggcaccggcggccagctgctgcagctgaagaagcccccagctggcaacaagaggggcaagaggtag

SEQ ID NO: 162575 - DNA, 1515 bp, Artificial Sequence
  Description of Artificial Sequence: Synthetic coding sequence
atgagcacaggcttctcctttggaagtggcaccctgggcagcaccaccgtggccgccggcggcaccagcactggaggagtcttctcctttggcaccggggccagcagcaaccccagcgtgggcctgaactttggaaacctgggcagcaccagcaccccagccaccaccagcgcccccagcagcggctttggaacaggcctgtttggcagcaagccagccaccggcttcaccctgggcggcaccaacacaggcaccccagccaccaccagcgctgccaccaccggcttcagcctgggcttcaacaagccagctgccagcgccaccccatttgccctgcccatcaccagcaccagcgccagcggcctgaccctgagcagcgccctgaccagcaccccagctgccagcacaggcttcaccctgaacaacctgggcggcaccacagccaccaccaccacagccagcacaggcctgagcctgggcggggccctggccggcctgggcggcagcctcttccagagcaccaacacaggcaccagcggcctgggccagaatgccctgggcctgaccctgggcaccacagctgccaccagcacagctggaaatgaaggcctgggcggcatcgacttcagcagcagcagtgacaagaagagtgacaagacaggcaccaggcctgaggacagcaaggccctgaaggatgagaacctgccccctgtgatctgccaggatgtggagaacctgcagaagtttgtgaaggagcagaagcaggtgcaggaggagatcagcaggatgagcagcaaggccatgctgaaggtgcaggaggacatcaaggccctgaagcagctgctgagcctggccgccaacggcatccagaggaacaccctgaacatcgacaagctgaagattgaaacagcccaggagctgaagaatgctgagatcgccctgcggacccagaagaccccacctggcctgcagcatgaatatgctgccccagctgactacttccgcatcctggtgcagcagtttgaggtgcagctgcagcagtaccggcagcagatcgaggagctggagaaccacctggccacccaggccaacaacagccacatcaccccccaggacctgtccatggccatgcagaagatctaccagacctttgtggccctggccgcccagctgcagagcatccatgaaaatgtgaaggtgctgaaggagcagtacctgggctacaggaagatgttcctgggagatgctgtggatgtgtttgagaccaggagagctgaggccaagaagtggcagaacaccccccgggtgaccaccggccccacccccttcagcaccatgcccaatgctgctgctgtggccatggccgccaccctgacccagcagcagcagcctgccaccggggacaagtggtgcaatgtggccgagctgaagaacagaacccagctgagcctgtttgtgaacaagctggagctgagctgctactgtgtgattgacctgctgtacaatgagcagtag

SEQ ID NO: 162576 - DNA, 1458 bp, Artificial Sequence
  Description of Artificial Sequence: Synthetic coding sequence
atgagcacaggcttctcctttggaagtggcaccctgggcagcaccaccgtggccgccggcggcaccagcactggaggagtcttctcctttggcaccggggccagcagcaaccccagcgtgggcctgaactttggaaacctgggcagcaccagcaccccagccaccaccagcgcccccagcagcggctttggaacaggcctgtttggcagcaagccagccaccggcttcaccctgggcggcaccaacacaggaattgccaccaccatcaccaccggcctgaccctgggcaccccagccaccaccagcgctgccaccaccggcttcagcctgggcttcaacaagccagctgccagcgccaccccatttgccctgcccatcaccagcaccagcgccagcggcctgaccctgagcagcgccctgaccagcaccccagctgccagcacaggcttcaccctgaacaacctgggcggcaccacagccaccaccaccacagccagcacaggcctgagcctgggcggggccctggccggcctgggcggcagcctcttccagagcaccaacacaggcaccagcggcctgggccagaatgccctgggcctgaccctgggcaccacagctgccaccagcacagctggaaatgaaggcctgggcggcatcgacttcagcagcagcagtgacaagaagagtgacaagacaggcaccaggcctgaggacagcaaggccctgaaggatgagaacctgccccctgtgatctgccaggatgtggagaacctgcagaagtttgtgaaggagcagaagcaggtgcaggaggagatcagcaggatgagcagcaaggccatgctgaaggtgcaggaggacatcaaggccctgaagcagctgctgagcctggccgccaacggcatccagaggaacaccctgaacatcgacaagctgaagattgaaacagcccaggagctgaagaatgctgagatcgccctgcggacccagaagaccccacctggcctgcagcatgaatatgctgccccagctgactacttccgcatcctggtgcagcagtttgaggtgcagctgcagcagtaccggcagcagatcgaggagctggagaaccacctggccacccaggccaacaacagccacatcaccccccaggacctgtccatggccatgcagaagatctaccagacctttgtggccctggccgcccagctgcagagcatccatgaaaatgtgaaggtgctgaaggagcagtacctgggctacaggaagatgttcctgggagatgctgtggatgtgtttgagaccaggagagctgaggccaagaagtggcagaacaccccccgggtgaccaccggccccacccccttcagcaccatgcccaatgctgctgctgtggccatggccgccaccctgacccagcagcagcagcctgccaccggcctgaatgccttcaagctgtag

SEQ ID NO: 162577 - DNA, 1308 bp, Artificial Sequence
  Description of Artificial Sequence: Synthetic coding sequence
atgagcggcttcctggaggagctgctgggggagaagctggtgactggaggaggagaggaggtggatgtgcacagcctgggcgcccggggcatcagcctgctgggcctgtacttcggctgcagcctgagcgccccctgtgcccagctgagcgccagcctggccgccttctacggccgcctgcggggagatgctgctgctggccctggccctggggccggggccggggctgctgctgagcctgagccccggcggcggctggagatcgtgtttgtgtccagtgaccaggaccagaggcagtggcaggactttgtgcgggacatgccctggctggccctgccctacaaggagaagcacaggaagctgaagctgtggaacaagtaccgcatcagcaacatccccagcctcatcttcctggatgccaccaccgggaaggtggtgtgcagaaatggcctgctggtgatcagagatgatcctgagggcctggagttcccctggggccccaagcccttccgggaggtgattgctggccccctgctgaggaacaacggccagagcctggagagcagcagcctggagggcagccacgtgggcgtgtacttcagcgcccactggtgccccccctgccgcagcctgaccagggtgctggtggagagctacaggaagatcaaggaggccggccagaactttgagatcatctttgtgtctgctgacagaagtgaggagagcttcaagcagtacttcagcgagatgccctggctggccgtgccctacacagatgaggcccggcgcagccggctgaaccggctgtatggcatccagggcatccccaccctcatcatgctggacccccagggcgaggtgatcacccggcagggccgggtggaggtgctgaatgatgaggactgccgggagttcccctggcaccccaagcctgtgctggagctgagtgacagcaatgctgcccagctgaatgaaggcccctgcctggtgctgtttgtggacagtgaagatgatggagagagcgaggccgccaagcagctgatccagcccatcgccgagaagatcatcgccaagtacaaggccaaggaggaggaggcccccctgctcttctttgtggccggagaagatgacatgacagacagcctgcgggactacaccaacctgcctgaggccgcccccctgctgaccatcctggacatgtctgcccgggccaagtatgtgatggatgtggaggagatcaccccagccatcgtggaggcctttgtgaatgacttcctggccgagaagctgaagccagagcccatctag

SEQ ID NO: 162578 - DNA, 984 bp, Artificial Sequence
  Description of Artificial Sequence: Synthetic coding sequence
atggctgatgtgtccctgcacaggaacccagccaccctgaagctgtggaacaagtaccgcatcagcaacatccccagcctcatcttcctggatgccaccaccgggaaggtggtgtgcagaaatggcctgctggtgatcagagatgatcctgagggcctggagttcccctggggccccaagcccttccgggaggtgattgctggccccctgctgaggaacaacggccagagcctggagagcagcagcctggagggcagccacgtgggcgtgtacttcagcgcccactggtgccccccctgccgcagcctgaccagggtgctggtggagagctacaggaagatcaaggaggccggccagaactttgagatcatctttgtgtctgctgacagaagtgaggagagcttcaagcagtacttcagcgagatgccctggctggccgtgccctacacagatgaggcccggcgcagccggctgaaccggctgtatggcatccagggcatccccaccctcatcatgctggacccccagggcgaggtgatcacccggcagggccgggtggaggtgctgaatgatgaggactgccgggagttcccctggcaccccaagcctgtgctggagctgagtgacagcaatgctgcccagctgaatgaaggcccctgcctggtgctgtttgtggacagtgaagatgatggagagagcgaggccgccaagcagctgatccagcccatcgccgagaagatcatcgccaagtacaaggccaaggaggaggaggcccccctgctcttctttgtggccggagaagatgacatgacagacagcctgcgggactacaccaacctgcctgaggccgcccccctgctgaccatcctggacatgtctgcccgggccaagtatgtgatggatgtggaggagatcaccccagccatcgtggaggcctttgtgaatgacttcctggccgagaagctgaagccagagcccatctag

SEQ ID NO: 162579 - DNA, 381 bp, Artificial Sequence
  Description of Artificial Sequence: Synthetic coding sequence
atgccctggctggccgtgccctacacagatgaggcccggcgcagccggctgaaccggctgtatggcatccaggacagtgaagatgatggagagagcgaggccgccaagcagctgatccagcccatcgccgagaagatcatcgccaagtacaaggccaaggaggaggaggcccccctgctcttctttgtggccggggaggatgacatgacagacagcctgcgggactacaccaacctgcctgaggccgcccccctgctgaccatcctggacatgtctgcccgggccaagtatgtgatggatgtggaggagatcaccccagccatcgtggaggcctttgtgaatgacttcctggccgagaagctgaagccagagcccatctag

SEQ ID NO: 162580 - DNA, 984 bp, Artificial Sequence; identical to SEQ ID NO: 162578
  Description of Artificial Sequence: Synthetic coding sequence

SEQ ID NO: 162581 - DNA, 1176 bp, Artificial Sequence
  Description of Artificial Sequence: Synthetic coding sequence
atggctgacatcgacaacaaggagcagagcgagctggaccaggacctggatgatgtggaggaggtggaggaggaggagactggagaggagaccaagctgaaggcccggcagctgactgtgcagatgatgcagaacccccagatcctggccgccctgcaggagcggctggatggcctggtggagacccccaccggctacatcgagagcctgccccgggtggtgaagagaagagtgaatgccctgaagaacctgcaggtgaagtgtgcccagatcgaggccaagttctatgaggaggtgcatgacctggagaggaaatatgctgtgctgtaccagcccctgtttgacaagagatttgagatcatcaatgccatctatgagcccacagaggaggagtgtgagtggaagccagatgaagaagatgagatcagcgaggagctgaaggagaaggccaagattgaagatgagaagaaggatgaggagaaggaggaccccaagggcatccctgagttctggctgactgtgttcaagaatgtggacctgctgagtgacatggtgcaggagcatgatgagcccatcctgaagcacctgaaggacatcaaggtgaagttcagtgatgctggccagcccatgagctttgtgctggagttccactttgagcccaatgagtacttcaccaatgaggtgctgaccaagacctacaggatgaggtctgagccagatgacagcgaccccttctcctttgatggccctgagatcatgggctgcaccggctgccagattgactggaagaagggcaagaatgtgaccctgaagaccatcaagaagaagcagaagcacaagggccggggcaccgtgaggacagtgaccaagacagtgtccaatgacagcttcttcaacttctttgcccctcctgaggtgcctgagagcggggacctggatgatgatgctgaggccatcctggccgctgactttgagatcggccacttcctgcgggagcgcatcatccccaggtctgtgctgtacttcaccggggaggccattgaagatgatgatgatgattatgatgaggagggggaggaggctgatgaggagggggaggaggagggagatgaggagaatgaccctgactatgaccccaagaaggaccagaacccagctgagtgcaagcagcagtag

SEQ ID NO: 162582 - DNA, 1176 bp, Artificial Sequence; identical to SEQ ID NO: 162581
  Description of Artificial Sequence: Synthetic coding sequence

SEQ ID NO: 162583 - DNA, 972 bp, Artificial Sequence
  Description of Artificial Sequence: Synthetic coding sequence
atgatgcagaacccccagatcctggccgccctgcaggagcggctggatggcctggtggagacccccaccggctacatcgagagcctgccccgggtggtgaagagaagagtgaatgccctgaagaacctgcaggtgaagtgtgcccagatcgaggccaagttctatgaggaggtgcatgacctggagaggaaatatgctgtgctgtaccagcccctgtttgacaaggaggagctgaaggagaaggccaagattgaagatgagaagaaggatgaggagaaggaggaccccaagggcatccctgagttctggctgactgtgttcaagaatgtggacctgctgagtgacatggtgcaggagcatgatgagcccatcctgaagcacctgaaggacatcaaggtgaagttcagtgatgctggccagcccatgagctttgtgctggagttccactttgagcccaatgagtacttcaccaatgaggtgctgaccaagacctacaggatgaggtctgagccagatgacagcgaccccttctcctttgatggccctgagatcatgggctgcaccggctgccagattgactggaagaagggcaagaatgtgaccctgaagaccatcaagaagaagcagaagcacaagggccggggcaccgtgaggacagtgaccaagacagtgtccaatgacagcttcttcaacttctttgcccctcctgaggtgcctgagagcggggacctggatgatgatgctgaggccatcctggccgctgactttgagatcggccacttcctgcgggagcgcatcatccccaggtctgtgctgtacttcaccggggaggccattgaagatgatgatgatgattatgatgaggagggggaggaggctgatgaggagggggaggaggagggagatgaggagaatgaccctgactatgaccccaagaaggaccagaacccagctgagtgcaagcagcagtag

SEQ ID NO: 162584 - DNA, 1050 bp, Artificial Sequence
  Description of Artificial Sequence: Synthetic coding sequence
atgatgcagaacccccagatcctggccgccctgcaggagcggctggatggcctggtggagacccccaccggctacatcgagagcctgccccgggtggtgaagagaagagtgaatgccctgaagaacctgcaggtgaagtgtgcccagatcgaggccaagttctatgaggaggtgcatgacctggagaggaaatatgctgtgctgtaccagcccctgtttgacaagagatttgagatcatcaatgccatctatgagcccacagaggaggagtgtgagtggaagccagatgaggaggatgagatcagcgagctgaaggagaaggccaagattgaagatgagaagaaggatgaggagaaggaggaccccaagggcatccctgagttctggctgactgtgttcaagaatgtggacctgctgagtgacatggtgcaggagcatgatgagcccatcctgaagcacctgaaggacatcaaggtgaagttcagtgatgctggccagcccatgagctttgtgctggagttccactttgagcccaatgagtacttcaccaatgaggtgctgaccaagacctacaggatgaggtctgagccagatgacagcgaccccttctcctttgatggccctgagatcatgggctgcaccggctgccagattgactggaagaagggcaagaatgtgaccctgaagaccatcaagaagaagcagaagcacaagggccggggcaccgtgaggacagtgaccaagacagtgtccaatgacagcttcttcaacttctttgcccctcctgaggtgcctgagagcggggacctggatgatgatgctgaggccatcctggccgctgactttgagatcggccacttcctgcgggagcgcatcatccccaggtctgtgctgtacttcaccggggaggccattgaagatgatgatgatgattatgatgaggagggggaggaggctgatgaggagggggaggaggagggagatgaggagaatgaccctgactatgaccccaagaaggaccagaacccagctgagtgcaagcagcagtag

SEQ ID NO: 162585 - DNA, 627 bp, Artificial Sequence
  Description of Artificial Sequence: Synthetic coding sequence
atggtgcaggagcatgatgagcccatcctgaagcacctgaaggacatcaaggtgaagttcagtgatgctggccagcccatgagctttgtgctggagttccactttgagcccaatgagtacttcaccaatgaggtgctgaccaagacctacaggatgaggtctgagccagatgacagcgaccccttctcctttgatggccctgagatcatgggctgcaccggctgccagattgactggaagaagggcaagaatgtgaccctgaagaccatcaagaagaagcagaagcacaagggccggggcaccgtgaggacagtgaccaagacagtgtccaatgacagcttcttcaacttctttgcccctcctgaggtgcctgagagcggggacctggatgatgatgctgaggccatcctggccgctgactttgaaattggccacttcctgcgggagcgcatcatccccaggtctgtgctgtacttcaccggggaggccattgaagatgatgatgatgattatgatgaggagggggaggaggctgatgaggagggggaggaggagggagatgaagaaaatgaccctgactatgaccccaagaaggaccagaacccagctgagtgcaagcagcagtag

SEQ ID NO: 162586 - DNA, 987 bp, Artificial Sequence
  Description of Artificial Sequence: Synthetic coding sequence
atggctgacatcgacaacctgccccgggtggtgaagagaagagtgaatgccctgaagaacctgcaggtgaagtgtgcccagatcgaggccaagttctatgaggaggtgcatgacctggagaggaaatatgctgtgctgtaccagcccctgtttgacaagagatttgagatcatcaatgccatctatgagcccacagaggaggagtgtgagtggaagccagatgaggaggatgagatcagcgaggagctgaaggagaaggccaagattgaagatgagaagaaggatgaggagaaggaggaccccaagggcatccctgagttctggctgaccgtcttcaagaatgtggacctgctgagtgacatggtgcaggagcatgatgagcccatcctgaagcacctgaaggacatcaaggtgaagttcagtgatgctggccagcccatgagctttgtgctggagttccactttgagcccaatgagtacttcaccaatgaggtgctgaccaagacctacaggatgaggtctgagccagatgacagcgaccccttctcctttgatggccctgagatcatgggctgcaccggctgccagattgactggaagaagggcaagaatgtgaccctgaagaccatcaagaagaagcagaagcacaagggccggggcaccgtgaggacagtgaccaagacagtgtccaatgacagcttcttcaacttctttgcccctcctgaggtgcctgagagcggggacctggatgatgatgctgaggccatcctggccgctgactttgaaattggccacttcctgcgggagcgcatcatccccaggtctgtgctgtacttcaccggggaggccattgaagatgatgatgatgattatgatgaggagggggaggaggctgatgaggagggggaggaggagggagatgaagaaaatgaccctgactatgaccccaagaaggaccagaacccagctgagtgcaagcagcagtag

SEQ ID NO: 162587 - DNA, 1107 bp, Artificial Sequence
  Description of Artificial Sequence: Synthetic coding sequence
atggctgacatcgacaacaaggagcagagcgagctggaccaggacctggatgatgtggaggaggtggaggaggaggagactggagaggagaccaagctgaaggcccggcagctgactgtgcagatgatgcagaacccccagatcctggccgccctgcaggagcggctggatggcctggtggagacccccaccggctacatcgagagcctgccccgggtggtgaagagaagagtgaatgccctgaagaacctgcaggtgaagtgtgcccagatcgaggccaagttctatgaggaggtgcatgacctggagaggaaatatgctgtgctgtaccagcccctgtttgacaagagatttgagatcatcaatgccatctatgagcccacagaggaggagtgtgagtggaagccagatgaagaagatgagatcagcgaggagctgaaggagaaggccaagattgaagatgagaagaaggatgaggagaaggaggaccccaagggcatccctgagttctggctgactgtgttcaagaatgtggacctgctgagtgacatggtgcaggagcatgatgagcccatcctgaagcacctgaaggacatcaaggtgaagttcagtgatgctggccagcccatgagctttgtgctggagttccactttgagcccaatgagtacttcaccaatgaggtgctgaccaagacctacaggatgaggtctgagccagatgacagcgaccccttctcctttgatggccctgagatcatgggctgcaccggctgccagattgactggaagaagggcaagaatgtgaccctgaagaccatcaagaagaagcagaagcacaagggccggggcaccgtgaggacagtgaccaagacagtgtccaatgacagcttcttcaacttctttgcccctcctgaggtgcctgagagcggggacctggatgatgatgctgaggccatcctggccgctgactttgagatcggccacttcctgcgggagcgcatcatccccaggtctgtgctgtacttcaccggggaggccattgaagatgatgatgatgattatgatgaggagggggaggaggctgatgaggtgatgttcaccaagtag

SEQ ID NO: 162588 - DNA, 795 bp, Artificial Sequence
  Description of Artificial Sequence: Synthetic coding sequence
atggctgacatcgacaacaaggagcagagcgagctggaccaggacctggatgatgtggaggaggtggaggaggaggagactggagaggagaccaagctgaaggcccggcagctgactgtgcagatgatgcagaacccccagatcctggccgccctgcaggagcggctggatggcctggtggagacccccaccggctacatcgagagcctgccccgggtggtgaagagaagagtgaatgccctgaagaacctgcaggtgaagtgtgcccagatcgaggccaagttctatgaggaggtgcatgacctggagaggaaatatgctgtgctgtaccagcccctgtttgacaagagatttgagatcatcaatgccatctatgagcccacagaggaggagtgtgagtggaagccagatgaagaagatgagatcagcgaggagctgaaggagaaggccaagattgaagatgagaagaaggatgaggagaaggaggaccccaagggcatccctgagttctggctgactgtgttcaagaatgtggacctgctgagtgacatggtgcaggagcatgatgagcccatcctgaagcacctgaaggacatcaaggtgaagttcagtgatgctggccagcccatgagctttgtgctggagttccactttgagcccaatgagtacttcaccaatgaggtgctgaccaagacctacaggatgaggtctgagccagatgacagcgaccccttctcctttgatggccctgagatcatgggctgcaccggctgccagattgactggaagaagtag

SEQ ID NO: 162589 - DNA, 1158 bp, Artificial Sequence
  Description of Artificial Sequence: Synthetic coding sequence
aaggagcagagcgagctggaccaggacctggatgatgtggaggaggtggaggaggaggagactggagaggagaccaagctgaaggcccggcagctgactgtgcagatgatgcagaacccccagatcctggccgccctgcaggagcggctggatggcctggtggagacccccaccggctacatcgagagcctgccccgggtggtgaagagaagagtgaatgccctgaagaacctgcaggtgaagtgtgcccagatcgaggccaagttctatgaggaggtgcatgacctggagaggaaatatgctgtgctgtaccagcccctgtttgacaagagatttgagatcatcaatgccatctatgagcccacagaggaggagtgtgagtggaagccagatgaagaagatgagatcagcgaggagctgaaggagaaggccaagattgaagatgagaagaaggatgaggagaaggaggaccccaagggcatccctgagttctggctgactgtgttcaagaatgtggacctgctgagtgacatggtgcaggagcatgatgagcccatcctgaagcacctgaaggacatcaaggtgaagttcagtgatgctggccagcccatgagctttgtgctggagttccactttgagcccaatgagtacttcaccaatgaggtgctgaccaagacctacaggatgaggtctgagccagatgacagcgaccccttctcctttgatggccctgagatcatgggctgcaccggctgccagattgactggaagaagggcaagaatgtgaccctgaagaccatcaagaagaagcagaagcacaagggccggggcaccgtgaggacagtgaccaagacagtgtccaatgacagcttcttcaacttctttgcccctcctgaggtgcctgagagcggggacctggatgatgatgctgaggccatcctggccgctgactttgagatcggccacttcctgcgggagcgcatcatccccaggtctgtgctgtacttcaccggggaggccattgaagatgatgatgatgattatgatgaggagggggaggaggctgatgaggagggggaggaggagggagatgaggagaatgaccctgactatgaccccaagaaggaccagaacccagctgagtgcaagcagcagtag

SEQ ID NO: 162590 - DNA, 1521 bp, Artificial Sequence
  Description of Artificial Sequence: Synthetic coding sequence
atggccgaggccgacttcaagatggtgtctgagcctgtggcccatggagtggccgaggaggagatggccagcagcaccagtgacagcggggaggagagtgacagcagcagcagcagcagcagcaccagtgacagcagcagcagcagcagcaccagcggcagcagcagcggcagcggcagcagcagcagcagcagcggcagcaccagcagccgcagccggctgtacaggaagaagagggtgcctgagcccagcagaagagcccggcgggcccccctgggcaccaactttgtggaccggctgccccaggccgtgaggaacagagtgcaggccctgaggaacatccaggatgaatgtgacaaggtggacaccctcttcctgaaggccatccatgacctggagaggaaatatgcagagctgaacaagcccctgtatgaccggcgcttccagatcatcaatgcagaatatgagcccacagaggaggagtgtgagtggaacagtgaagatgaggagttcagcagtgatgaggaggtgcaggacaacaccccatctgagatgccacccctggagggggaggaggaggagaaccccaaggagaaccctgaggtgaaggccgaggagaaggaggtgcccaaggagatccctgaggtgaaggatgaggagaaggaggtgcccaaggagatccctgaggtgaaggccgaggagaaggctgacagcaaggactgcatggaggccaccccagaggtgaaggaggaccccaaggaggtgccccaggtgaaggcagatgacaaggagcagcccaaggccacagaggccaaggcccgggctgctgtgcgggagacccacaagagggtgcctgaggagcggctgcaggacagcgtggacctgaagagggccaggaagggcaagcccaagcgggaggaccccaagggcatcccagactactggctgattgtgctgaagaatgtggacaagctgggccccatgatccagaagtatgatgagcccatcctgaagttcctgagtgatgtgtccctgaagttcagcaagccaggccagcctgtgtcctacacctttgagttccacttcctgcccaacccctacttcagaaatgaggtgctggtgaagacctacatcatcaaggccaagccagaccacaatgaccccttcttctcctggggctgggagattgaggactgcaagggctgcaagattgactggaggcggggcaaggatgtgacagtgaccaccacccagagcaggaccacagccaccggggagattgagatccagccccgggtggtgcccaatgccagcttcttcaacttcttcagccccccagagatccccatgattggcaagctggagccccgggaggatgccatcctggatgaggactttgagatcggccagatcctgcatgacaacgtcatcctgaagagcatctactactacacaggagaggtgaatggcacctactaccagtttgggaagcactacggcaacaagaagtacaggaagtag

SEQ ID NO: 162591 - DNA, 1500 bp, Artificial Sequence
  Description of Artificial Sequence: Synthetic coding sequence
atggtgtctgagcctgtggcccacggcgtggccgaggaggagatggccagcagcaccagtgacagcggggaggagagtgacagcagcagcagcagcagcagcaccagtgacagcagcagcagcagcagcaccagcggcagcagcagcggcagcggcagcagcagcagcagcagcggcagcaccagcagccgcagccggctgtacaggaagaagagggtgcctgagcccagccggcgggcccggcgggcccccctgggcaccaactttgtggaccggctgccccaggccgtgaggaacagagtgcaggccctgaggaacatccaggatgaatgtgacaaggtggacaccctcttcctgaaggccatccatgacctggagaggaaatatgcagagctgaacaagcccctgtatgaccggcgcttccagatcatcaatgcagaatatgagcccacagaggaggagtgtgagtggaacagtgaagatgaggagttcagcagtgatgaggaggtgcaggacaacacccccagcgagatgccacccctggagggggaggaggaggagaaccccaaggaaaatcctgaggtgaaggccgaggagaaggaggtgcccaaggagatccctgaggtgaaggatgaggagaaggaggtgcccaaggagatccctgaggtgaaggccgaggagaaggctgacagcaaggactgcatggaggccaccccagaggtgaaggaggaccccaaggaggtgccccaggtgaaggcagatgacaaggagcagcccaaggccacagaggccaaggcccgggctgctgtgcgggagacccacaagagggtgcctgaggagcggctgcaggacagcgtggacctgaagagggccaggaagggcaagcccaagcgggaggaccccaagggcatcccagactactggctgattgtgctgaagaatgtggacaagctgggccccatgatccagaagtatgatgagcccatcctgaagttcctgagtgatgtgtccctgaagttcagcaagccaggccagcctgtgtcctacacctttgagttccacttcctgcccaacccctacttcagaaatgaggtgctggtgaagacctacatcatcaaggccaagccagaccacaatgaccccttcttctcctggggctgggagattgaggactgcaagggctgcaagattgactggaggcggggcaaggatgtgacagtgaccaccacccagagcaggaccacagccactggagaaattgagatccagccccgggtggtgcccaatgccagcttcttcaacttcttcagccccccagagatccccatgattggcaagctggagcccagagaagatgccatcctggatgaagattttgaaattggccagatcctgcatgacaacgtcatcctgaagagcatctactactacaccggggaggtgaatggcacctactaccagtttgggaagcactacggcaacaagaagtacaggaagtag

SEQ ID NO: 162592 - DNA, 1128 bp, Artificial Sequence
  Description of Artificial Sequence: Synthetic coding sequence
atggctgaccacagcttcagtgatggagtgcccagcgacagcgtggaggccgccaagaatgccagcaacacagagaagctgacagaccaggtgatgcagaacccccgggtgctggccgccctgcaggagcggctggacaacgtgccccacacccccagcagctacatcgagaccctgcccaaggctgtgaagaggcgcatcaatgccctgaagcagctgcaggtgcgctgtgcccacatcgaggccaagttctatgaggaggtgcatgacctggagaggaaatatgctgccctgtaccagcccctgtttgacaagaggcgggagttcatcactggagatgtggagcccacagatgctgagagcgagtggcacagtgaaaatgaggaggaggagaagctggccggggacatgaagagcaaggtggtggtgacagagaaggccgccgccacagctgaggagccagaccccaagggcatccctgagttctggttcaccatcttcagaaatgtggacatgctgtctgagctggtgcaggagtatgatgagcccatcctgaagcacctgcaggacatcaaggtgaagttcagtgaccccggccagcccatgagctttgtgctggagttccactttgagcccaatgactacttcaccaacagcgtgctgaccaagacctacaagatgaagtctgagccagacaaggctgaccccttctcctttgagggccctgagatcgtggactgtgatggctgcaccatcgactggaagaagggcaagaatgtgacagtgaagaccatcaagaagaagcagaagcacaagggccggggcaccgtgaggaccatcaccaagcaggtgcccaatgaaagcttcttcaacttcttcaaccccctgaaggccagcggagatggagagagcctggatgaagattctgagttcaccctggccagtgactttgaaattggccacttcttccgggagagaattgtgcccagggctgtgctgtacttcaccggggaggccattgaagatgatgacaactttgaggagggggaggagggggaggaggaggagctggagggagatgaggagggggaggatgaagatgatgctgagatcaaccccaaggtgtag

SEQ ID NO: 162593 - DNA, 1161 bp, Artificial Sequence
  Description of Artificial Sequence: Synthetic coding sequence
atggctgaccacagcttcagtgatggagtgcccagcgacagcgtggaggccgccaagaatgccagcaacacagagaagctgacagaccaggtgatgcagaacccccgggtgctggccgccctgcaggagcggctggacaacgtgccccacacccccagcagctacatcgagaccctgcccaaggctgtgaagaggcgcatcaatgccctgaagcagctgcaggtgcgctgtgcccacatcgaggccaagttctatgaggaggtgcatgacctggagaggaaatatgctgccctgtaccagcccctgtttgacaagaggcgggagttcatcactggagatgtggagcccacagatgctgagagcgagtggcacagtgaaaatgaggaggaggagaagctggccggggacatgaagagcaaggtggtggtgacagagaaggccgccgccacagctgaggagccagaccccaagggcatccctgagttctggttcaccatcttcagaaatgtggacatgctgtctgagctggtgcaggagtatgatgagcccatcctgaagcacctgcaggacatcaaggtgaagttcagtgaccccggccagcccatgagctttgtgctggagttccactttgagcccaatgactacttcaccaacagcgtgctgaccaagacctacaagatgaagtctgagccagacaaggctgaccccttctcctttgagggccctgagatcgtggactgtgatggctgcaccatcgactggaagaagggcaagaatgtgacagtgaagaccatcaagaagaagcagaagcacaagggccggggcaccgtgaggaccatcaccaagcaggtgcccaatgaaagcttcttcaacttcttcaaccccctgaagggcaagggccagagcaagagcaaggatgaagattctgagttcaccctggccagtgactttgaaattggccacttcttccgggagagaattgtgcccagggctgtgctgtacttcaccggggaggccattgaagatgatgacaactttgaggagggggaggagggggaggaggaggagctggagggagatgaggagggggaggatgaagatgatgctgagatcaaccccaagaaggagcccagccagcctgctgagtgcaagcagcagtag

SEQ ID NO: 162594 - DNA, 537 bp, Artificial Sequence
  Description of Artificial Sequence: Synthetic coding sequence
atggctgaccacagcttcagtgatggagtgcccagcgacagcgtggaggccgccaagaatgccagcaacacagagaagctgacagaccaggtgatgcagaacccccgggtgctggccgccctgcaggagcggctggacaacgtgccccacacccccagcagctacatcgagaccctgcccaaggctgtgaagaggcgcatcaatgccctgaagcagctgcaggtgcgctgtgcccacatcgaggccaagttctatgaggaggtgcatgacctggagaggaaatatgctgccctgtaccagcccctgtttgacaagaggcgggagttcatcactggagatgtggagcccacagatgctgagagcgagtggcacagtgaaaatgaggaggaggagaagctggccggggacatgaagagcaaggtggtggtgacagagaaggccgccgccacagctgaggagccagaccccaagggcatccctgagttctggttcaccatcttcagaaatgtggacatgctgtctgagctggtgcagtag

SEQ ID NO: 162595 - DNA, 1161 bp, Artificial Sequence
  Description of Artificial Sequence: Synthetic coding sequence
atggctgaccacagcttcagtgatggagtgcccagcgacagcgtggaggccgccaagaatgccagcaacacagagaagctgacagaccaggtgatgcagaacccccgggtgctggccgccctgcaggagcggctggacaacgtgccccacacccccagcagctacatcgagaccctgcccaaggctgtgaagaggcgcatcaatgccctgaagcagctgcaggtgcgctgtgcccacatcgaggccaagttctatgaggaggtgcatgacctggagaggaaatatgctgccctgtaccagcccctgtttgacaagaggcgggagttcatcactggagatgtggagcccacagatgctgagagcgagtggcacagtgaaaatgaggaggaggagaagctggccggggacatgaagagcaaggtggtggtgacagagaaggccgccgccacagctgaggagccagaccccaagggcatccctgagttctggttcaccatcttcagaaatgtggacatgctgtctgagctggtgcaggagtatgatgagcccatcctgaagcacctgcaggacatcaaggtgaagttcagtgaccccggccagcccatgagctttgtgctggagttccactttgagcccaatgactacttcaccaacagcgtgctgaccaagacctacaagatgaagtctgagccagacaaggctgaccccttctcctttgagggccctgagatcgtggactgtgatggctgcaccatcgactggaagaagggcaagaatgtgacagtgaagaccatcaagaagaagcagaagcacaagggccggggcaccgtgaggaccatcaccaagcaggtgcccaatgaaagcttcttcaacttcttcaaccccctgaaggccagcggagatggagagagcctggatgaagattctgagttcaccctggccagtgactttgaaattggccacttcttccgggagagaattgtgcccagggctgtgctgtacttcaccggggaggccattgaagatgatgacaactttgaggagggggaggagggggaggaggaggagctggagggagatgaggagggggaggatgaagatgatgctgagatcaaccccaagaaggagcccagccagcctgctgagtgcaagcagcagtag

SEQ ID NO: 162596 - DNA, 387 bp, Artificial Sequence
  Description of Artificial Sequence: Synthetic coding sequence
atggctgaccacagcttcagtgatggagtgcccagcgacagcgtggaggccgccaagaatgccagcaacacagagaagctgacagaccaggtgatgcagaacccccgggtgctggccgccctgcaggagcggctggacaacgtgccccacacccccagcagctacatcgagaccctgcccaaggctgtgaagaggcgcatcaatgccctgaagcagctgcaggtgcgctgtgcccacatcgaggccaagttctatgaggaggtgcatgacctggagaggaaatatgctgccctgtaccagcccctgtttgacaagaggcgggagttcatcactggagatgtggagcccacagatgctgagagcgagtggcacagtgaaaatgaatag

SEQ ID NO: 162597 - DNA, 423 bp, Artificial Sequence
  Description of Artificial Sequence: Synthetic coding sequence
atggctgaccacagcttcagtgatggagtgcccagcgacagcgtggaggccgccaagaatgccagcaacacagagaagctgacagaccaggtgatgcagaacccccgggtgctggccgccctgcaggagcggctggacaacgtgccccacacccccagcagctacatcgagaccctgcccaaggctgtgaagaggcgcatcaatgccctgaagcagctgcaggtgcgctgtgcccacatcgaggccaagttctatgaggaggtgcatgacctggagaggaaatatgctgccctgtaccagcccctgtttgacaagaggcgggagttcatcactggagatgtggagcccacagatgctgagagcgagtggcacagtgaaaatgaggaggaggagaagctggccggggacatgaagagcaagtag

SEQ ID NO: 162598 - DNA, 402 bp, Artificial Sequence
  Description of Artificial Sequence: Synthetic coding sequence
atggctgaccacagcttcagtgatggagtgcccagcgacagcgtggaggccgccaagaatgccagcaacacagagaagctgacagaccaggtgatgcagaacccccgggtgctggccgccctgcaggagcggctggacaacgtgccccacacccccagcagctacatcgagaccctgcccaaggctgtgaagaggcgcatcaatgccctgaagcagctgcaggtgcgctgtgcccacatcgaggccaagttctatgaggaggtgcatgacctggagaggaaatatgctgccctgtaccagcccctgtttgacaagaggcgggagttcatcactggagatgtggagcccacagatgctgagagcgagtggcacagtgaaaatgaggaggaggagaagctgtag

SEQ ID NO: 162599 - DNA, 324 bp, Artificial Sequence
  Description of Artificial Sequence: Synthetic coding sequence
atggctgaccacagcttcagtgatggagtgcccagcgacagcgtggaggccgccaagaatgccagcaacacagagaagctgacagaccaggtgatgcagaacccccgggtgctggccgccctgcaggagcggctggacaacgtgccccacacccccagcagctacatcgagaccctgcccaaggctgtgaagaggcgcatcaatgccctgaagcagctgcaggtgcgctgtgcccacatcgaggccaagttctatgaggaggtgcatgacctggagaggaaatatgctgccctgtaccagcccctgtttgacaagagaagatag

SEQ ID NO: 162600 - DNA, 237 bp, Artificial Sequence
  Description of Artificial Sequence: Synthetic coding sequence
atggctgaccacagcttcagtgatggagtgcccagcgacagcgtggaggccgccaagaatgccagcaacacagagaagctgacagaccaggtgatgcagaacccccgggtgctggccgccctgcaggagcggctggacaacgtgccccacacccccagcagctacatcgagaccctgcccaaggctgtgaagaggcgcatcaatgccctgaagcagctgcaggtgcgctgtgcctag

SEQ ID NO: 162601 - DNA, 549 bp, Artificial Sequence
  Description of Artificial Sequence: Synthetic coding sequence
atggctgacagcgagaaccagggccctgctgagcccagccaggccgctgctgctgctgaggccgctgctgaggaggtgatggccgagggcggggcccagggcggggactgtgacagcgctgctggggaccctgacagcgctgctggccagatggccgaggagccccagaccccagcagaaaatgcccccaagcccaagaatgacttcatcgagagcctgcccaacagcgtgaagtgccgggtgctggccctgaagaagctgcagaagagatgtgacaagattgaggccaagtttgacaaggagttccaggccctggagaagaagtacaatgacatctacaagcccctgctggccaagatccaggagctgaccggggagatggagggctgtgcctggaccctggagggggaggaggaggaggaggaggagtatgaagatgatgaggaggagggggaggatgaggaggaggaggaggccgctgctgaggccgctgctggggccaagcatgatgatgcccacgccgagatgccagatgatgccaagaagtag

SEQ ID NO: 162602 - DNA, 438 bp, Artificial Sequence
  Description of Artificial Sequence: Synthetic coding sequence
atggctgacagcgagaaccagggccctgctgagcccagccaggccgctgctgctgctgaggccgctgctgaggaggtgatggccgagggcggggcccagggcggggactgtgacagcgctgctggggaccctgacagcgctgctggccagatggccgaggagccccagaccccagcagaaaatgcccccaagcccaagaatgacttcatcgagagcctgcccaacagcgtgaagtgccgggtgctggccctgaagaagctgcagaagagatgtgacaagattgaggccaagtttgacaaggagttccaggccctggagaagaagtacaatgacatctacaagcccctgctggccaagatccaggagctgaccggggagatggagggctgtgcctggaccctggagggggaggagaggaggaagagggtgcggggctag

SEQ ID NO: 162603 - DNA, 963 bp, Artificial Sequence
  Description of Artificial Sequence: Synthetic coding sequence
atggaggaggtgccccatgactgccctggagctgacagcgcccaggccggccgcggggccagctgccagggctgccccaaccagaggctgtgtgccagcggggccggggccaccccagacacagccatcgaggagatcaaggagaagatgaagacagtgaagcacaagatcctggtgctgtctggaaaaggaggagtgggcaagagcaccttcagcgcccacctggcccacggcctggctgaagatgagaacacccagatcgccctgctggacatcgacatctgtggccccagcatccccaagatcatgggcctggagggggagcaggtgcaccagagcggcagcggctggagccctgtgtatgtggaggacaacctgggcgtgatgtctgtgggcttcctgctgagcagcccagatgatgctgtgatctggaggggccccaagaagaatggcatgatcaagcagttcctgagagatgtggactggggcgaggtggactacctgattgtggacaccccacctggcaccagtgatgagcacctgtctgtggtgcgctacctggccacagcccacattgatggagctgtgatcatcaccaccccccaggaggtgtccctgcaggatgtgaggaaggagatcaacttctgcaggaaggtgaagctgcccatcatcggcgtggtggagaacatgagcggcttcatctgccccaagtgcaagaaggagagccagatcttcccccccaccactggaggagctgagctgatgtgccaggacctggaggtgcccctgctgggccgggtgcccctggaccccctgattggcaagaactgtgacaagggccagagcttcttcattgatgccccagacagccctgccaccctggcctaccgcagcatcatccagaggatccaggagttctgcaacctgcaccagagcaaggaggagaacctgatcagcagctag

SEQ ID NO: 162604 - DNA, 930 bp, Artificial Sequence
  Description of Artificial Sequence: Synthetic coding sequence
atggaggaggtgccccatgactgccctggagctgacagcgcccaggccggccgcggggccagctgccagggctgccccaaccagaggctgtgtgccagcggggccggggccaccccagacacagccatcgaggagatcaaggagaagatgaagacagtgaagcacaagatcctggtgctgtctggaaaaggaggagtgggcaagagcaccttcagcgcccacctggcccacggcctggctgaagatgagaacacccagatcgccctgctggacatcgacatctgtggccccagcatccccaagatcatgggcctggagggggagcagtatgtggaggacaacctgggcgtgatgtctgtgggcttcctgctgagcagcccagatgatgctgtgatctggaggggccccaagaagaatggcatgatcaagcagttcctgagagatgtggactggggcgaggtggactacctgattgtggacaccccacctggcaccagtgatgagcacctgtctgtggtgcgctacctggccacagcccacattgatggagctgtgatcatcaccaccccccaggaggtgtccctgcaggatgtgaggaaggagatcaacttctgcaggaaggtgaagctgcccatcattggagtggtggagaacatgagcggcttcatctgccccaagtgcaagaaggagagccagatcttcccccccaccaccggcggcgctgagctgatgtgccaggacctggaggtgcccctgctgggccgggtgcccctggaccccctcatcggcaagaactgtgacaagggccagagcttcttcattgatgccccagacagccctgccaccctggcctaccgcagcatcatccagaggatccaggagttctgcaacctgcaccagagcaaggaggagaacctgatcagcagctag

SEQ ID NO: 162605 - DNA, 816 bp, Artificial Sequence
  Description of Artificial Sequence: Synthetic coding sequence
atggaggccgctgctgagcccggcaacctggccggcgtgcgccacatcatcctggtgctgtctggaaaaggaggagtgggcaagagcaccatcagcacagagctggccctggccctgcggcatgctgggaagaaggtgggcatcctggatgtggacctgtgtggccccagcatccccaggatgctgggcgcccagggccgggctgtgcaccagtgtgaccggggctgggcccctgtgttcctggaccgggagcagagcatcagcctgatgtctgtgggcttcctgctggagaagccagatgaggccgtggtgtggaggggccccaagaagaatgccctgatcaagcagtttgtgtctgatgtggcctggggcgagctggactacctggtggtggacaccccacctggcaccagtgatgagcacatggccaccatcgaggccctgcggccctaccagcccctgggcgccctggtggtgaccaccccccaggccgtgtctgtgggagatgtgagaagagagctgaccttctgcaggaagacaggcctgcgggtgatgggcatcgtggagaacatgagcggcttcacctgcccccactgcacagaatgtaccagcgtcttcagcagaggaggaggagaggagctggcccagctggccggcgtgcccttcctgggctctgtgcccctggaccctgccctgatgaggaccctggaggagggccatgacttcatccaggagttccctggcagccctgcctttgctgccctgaccagcatcgcccagaagatcctggatgccaccccagcctgcctgccctag

SEQ ID NO: 162606 - DNA, 393 bp, Artificial Sequence
  Description of Artificial Sequence: Synthetic coding sequence
atggccaccatcgaggccctgcggccctaccagcccctgggcgccctggtggtgaccaccccccaggccgtgtctgtgggagatgtgcggcgggagctgaccttctgcaggaagacaggcctgcgggtgatgggcatcgtggagaacatgagcggcttcacctgcccccactgcacagagtgcacctctgtgttcagccggggcggcggggaggagctggcccagctggccggcgtgcccttcctgggctctgtgcccctggaccctgccctgatgaggaccctggaggagggccatgacttcatccaggagttccctggcagccctgcctttgctgccctgaccagcatcgcccagaagatcctggatgccaccccagcctgcctgccctag

SEQ ID NO: 162607 - DNA, 960 bp, Artificial Sequence
  Description of Artificial Sequence: Synthetic coding sequence
atgggcatctggcagaggctgctgctgtttggaggagtgtccctgcgggccggcggcggggccacagcccccctgggcggcagccgggccatggtgtgtggccggcagctgagcggggccggcagcgagaccctgaagcagaggaggacccagatcatgagccggggcctgcccaagcagaagcccattgaaggagtgaagcaggtgattgtggtggccagcggcaagggcggcgtgggcaagagcaccacagctgtgaacctggccctggccctggccgccaatgacagcagcaaggccatcggcctgctggatgtggatgtgtatggccccagcgtgcccaagatgatgaacctgaagggcaaccctgagctgagccagagcaacctgatgaggcccctgctgaactatggaattgcctgcatgtccatgggcttcctggtggaggagagcgagcctgtggtgtggaggggcctgatggtgatgtctgccatcgagaagctgctgcggcaggtggactggggccagctggactacctggtggtggacatgcctcctggcactggagatgtgcagctgtctgtgtcccagaacatccccatcaccggggccgtcatcgtgtccaccccccaggacatcgccctgatggatgcccacaagggagctgagatgttccggcgggtgcacgtgcctgtgctgggcctggtgcagaacatgtctgtgttccagtgccccaagtgcaagcacaagacccacatctttggagcagatggagccaggaagctggcccagaccctgggcctggaggtgctgggggacatccccctgcacctgaacatccgggaggccagtgacaccggccagcccatcgtgttcagccagcctgagagtgatgaggccaaggcctacctgagaattgctgtggaggtggtgcggcggctgcccagccccagcgagtag

SEQ ID NO: 162608 - DNA, 672 bp, Artificial Sequence
  Description of Artificial Sequence: Synthetic coding sequence
atgagcaaggccatcggcctgctggatgtggatgtgtatggccccagcgtgcccaagatgatgaacctgaagggcaaccctgagctgagccagagcaacctgatgaggcccctgctgaactatggaattgcctgcatgtccatgggcttcctggtggaggagagcgagcctgtggtgtggaggggcctgatggtgatgtctgccatcgagaagctgctgcggcaggtggactggggccagctggactacctggtggtggacatgcctcctggcactggagatgtgcagctgtctgtgtcccagaacatccccatcaccggggccgtcatcgtgtccaccccccaggacatcgccctgatggatgcccacaagggagctgagatgttccggcgggtgcacgtgcctgtgctgggcctggtgcagaacatgtctgtgttccagtgccccaagtgcaagcacaagacccacatctttggagcagatggagccaggaagctggcccagaccctgggcctggaggtgctgggggacatccccctgcacctgaacatccgggaggccagtgacaccggccagcccatcgtgttcagccagcctgagagtgatgaggccaaggcctacctgagaattgctgtggaggtggtgcggcggctgcccagccccagcgagtag

SEQ ID NO: 162609 - DNA, 3123 bp, Artificial Sequence
  Description of Artificial Sequence: Synthetic coding sequence
atgggagaggagggcggcagcgccagccatgatgaggaggagcgggcctctgtgctgctgggccacagccctggctgtgagatgtgcagccaggaggccttccaggcccagaggagccagctggtggagctgctggtgtctggcagcctggagggctttgaatctgtgctggactggctgctgtcctgggaggtgctgtcctgggaggactatgagggcttccacctgctgggccagcccctgagccacctggcccggcggctgctggacacagtgtggaacaagggcacctgggcctgccagaagctgattgctgctgcccaggaggcccaggccgacagccagagccccaagctgcacggctgctgggacccccacagcctgcacccagcccgggacctgcagagccacaggcctgccatcgtgcggcggctgcacagccacgtggagaacatgctggacctggcctgggagcggggctttgtgtcccagtatgaatgtgatgagatccggctgcccatcttcacccccagccagagggcccggcggctgctggacctggccaccgtgaaggccaacggcctggccgccttcctgctgcagcacgtgcaggagctgcctgtgcccctggccctgcccctggaggccgccacctgcaagaagtacatggccaagctgcggaccaccgtgtctgcccagagccgcttcctgagcacctatgatggagctgagaccctgtgcctggaggacatctacacagaaaatgtgctggaggtgtgggcagatgtgggcatggccggccccccccagaagagccctgccaccctgggcctggaggagctgttcagcaccccaggccacctgaatgatgatgctgacacagtgctggtggtgggggaggccggcagcggcaagagcaccctgctgcagaggctgcacctgctgtgggccgccggccaggacttccaggagttcctgtttgtgttccccttcagctgccggcagctgcagtgcatggccaagcccctgtctgtgaggaccctgctgtttgagcactgctgctggccagatgtgggccaggaggacatcttccagctgctgctggaccacccagacagagtgctgctgacctttgatggctttgatgagttcaagttccgcttcacagaccgggagcggcactgcagccccacagaccccacctctgtgcagaccctgctcttcaacctgctgcagggcaacctgctgaagaatgccaggaaggtggtgaccagcaggcctgctgctgtgtctgccttcctgaggaagtacatcagaacagagttcaacctgaagggcttcagcgagcagggcatcgagctgtacctgaggaagaggcaccacgagcccggggtggccgacaggctcatccggctgctgcaggagaccagcgccctgcacggcctgtgccacctgcccgtcttctcctggatggtgtccaagtgccaccaggagctgctgctgcaggagggcggcagccccaagaccaccacagacatgtacctgctgatcctgcagcacttcctgctgcacgccaccccaccagacagcgccagccagggcctgggccccagcctgctgcggggccgcctgcccaccctgctgcacctgggccgcctggccctgtggggcctgggcatgtgctgctacgtgttcagcgcccagcagctgcaggccgcccaggtgtccccagatgacatcagcctgggcttcctggtgcgggccaagggcgtggtgcccggcagcacagcccccctggagttcctgcacatcaccttccagtgcttctttgctgccttctacctggccctgtctgcagatgtgcccccagccctgctgcggcacctgttcaactgtggccggcccggcaacagccccatggcccggctgctgcccaccatgtgcatccaggccagcgagggcaaggacagctctgtggccgccctgctgcagaaggccgagccccacaacctgcagatcacagctgccttcctggccggcctgctgagccgggagcactggggcctgctggccgagtgccagaccagcgagaaggccctgctgcggcggcaggcctgtgcccgctggtgcctggcccggagcctgaggaagcacttccacagcatccccccagctgcccctggagaggccaagtctgtgcacgccatgcctggcttcatctggctgatccgcagcctgtatgagatgcaggaggagcggctggccaggaaggccgcccggggcctgaatgtgggccacctgaagctgaccttctgcagcgtgggccccacagaatgtgccgccctggcctttgtgctgcagcacctgcggcggcctgtggccctgcagctggactacaacagcgtgggggacattggagtggagcagctgctgccctgcctgggcgtgtgcaaggccctgtacctgcgggacaacaacatcagtgaccggggcatctgcaagctgattgaatgtgccctgcactgtgagcagctgcagaagctggccctcttcaacaacaagctgacagatggctgtgcccacagcatggccaagctgctggcctgccggcagaacttcctggccctgcggctgggcaacaactacatcacagctgctggggcccaggtgctggccgagggcctgcggggcaacaccagcctgcagttcctgggcttctggggcaacagagtgggagatgaaggagcccaggccctggccgaggccctgggggaccaccagagcctgcgctggctgagcctggtgggcaacaacatcggctctgtgggcgcccaggccctggccctgatgctggccaagaatgtgatgctggaggagctgtgcctggaggagaaccacctgcaggatgaaggagtgtgcagcctggccgagggcctgaagaagaacagcagcctgaagatcctgaagctgagcaacaactgcatcacctacctgggcgctgaggccctgctgcaggccctggagagaaatgacaccatcctggaggtgtggctgcggggcaacaccttcagcctggaggaggtggacaagctgggctgccgggacacccggctgctgctgtag

SEQ ID NO: 162610 - DNA, 543 bp, Artificial Sequence
  Description of Artificial Sequence: Synthetic coding sequence
atgtggctgctgcccccaggccaggtgttcaatgccttcttccccagccggctgggcaacaactacatcacagctgctggggcccaggtgctggccgagggcctgcggggcaacaccagcctgcagttcctgggcttctggggcaacagagtgggagatgaaggagcccaggccctggccgaggccctgggggaccaccagagcctgcgctggctgagcctggtgggcaacaacatcggctctgtgggcgcccaggccctggccctgatgctggccaagaatgtgatgctggaggagctgtgcctggaggagaaccacctgcaggatgaaggagtgtgcagcctggccgagggcctgaagaagaacagcagcctgaagatcctgaagctgagcaacaactgcatcacctacctgggcgctgaggccctgctgcaggccctggagagaaatgacaccatcctggaggtgtggctgcggggcaacaccttcagcctggaggaggtggacaagctgggctgccgggacacccggctgctgctgtag

SEQ ID NO: 162611 - DNA, 1008 bp, Artificial Sequence
  Description of Artificial Sequence: Synthetic coding sequence
atggaggacagcggcaagaccttcagcagcgaggaggaggaggccaactactggaaggacctggccatgacctacaagcagagagctgagaacacccaggaggagctgcgggagttccaggagggcagccgggagtatgaggccgagctggagacccagctgcagcagatcgagaccaggaacagagacctgctgtctgagaacaaccggctgaggatggagctggagaccatcaaggagaagtttgaggtgcagcacagcgagggctaccggcagatcagcgccctggaggatgacctggcccagaccaaggccatcaaggaccagctgcagaagtacatccgggagctggagcaggccaatgatgacctggagcgggccaagagggccaccatcatgagcctggaggactttgagcagaggctgaaccaggccatcgagagaaatgccttcctggagagcgagctggatgagaaggagaacctgctggagagcgtgcagaggctgaaggatgaggcccgggacctgcggcaggagctggccgtgcagcagaagcaggagaagcccaggacccccatgcccagctctgtggaggccgagaggacagacacagctgtgcaggccactggatctgtgcccagcacccccatcgcccaccggggccccagcagcagcctgaacaccccaggcagcttcagaagaggcctggatgacagcactggaggcacccccctgaccccagctgcccgcatcagcgccctgaacatcgtgggggacctgctgaggaaggtgggcgccctggagagcaagctggccagctgcaggaacctggtgtatgaccagagccccaacagaactggaggccctgccagcggccgcagcagcaagaacagagatggaggagagcggcggcccagcagcacctctgtgcccctgggggacaagggcctggacaccagctgccgctggctgagcaagagcaccaccaggagcagcagcagctgctag

SEQ ID NO: 162612 - DNA, 1041 bp, Artificial Sequence
  Description of Artificial Sequence: Synthetic coding sequence
atggaggacagcggcaagaccttcagcagcgaggaggaggaggccaactactggaaggacctggccatgacctacaagcagagagctgagaacacccaggaggagctgcgggagttccaggagggcagccgggagtatgaggccgagctggagacccagctgcagcagatcgagaccaggaacagagacctgctgtctgagaacaaccggctgaggatggagctggagaccatcaaggagaagtttgaggtgcagcacagcgagggctaccggcagatcagcgccctggaggatgacctggcccagaccaaggccatcaaggaccagctgcagaagtacatccgggagctggagcaggccaatgatgacctggagcgggccaagagggccaccatcatgagcctggaggactttgagcagaggctgaaccaggccatcgagagaaatgccttcctggagagcgagctggatgagaaggagaacctgctggagagcgtgcagaggctgaaggatgaggcccgggacctgcggcaggagctggccgtgcagcagaagcaggagaagcccaggacccccatgcccagctctgtggaggccgagaggacagacacagctgtgcaggccactggatctgtgcccagcacccccatcgcccaccggggccccagcagcagcctgaacaccccaggcagcttcagaagaggcctggatgacagcactggaggcacccccctgaccccagctgcccgcatcagcgccctgaacatcgtgggggacctgctgaggaaggtgggcgccctggagagcaagctggccagctgcaggaacctggtgtatgaccagagccccaacagaactggaggccctgccagcggccgcagcagcaagaacagagatggaggagagcggcggcccagcagcacctctgtgcccctgggggacaagggcctgggcaagaggctggagtttgggaagccacccagccacatgagcagcagccccctgcccagcgcccagggcgtggtgaagatgctgctgtag

SEQ ID NO: 162613 - DNA, 1008 bp, Artificial Sequence; identical to SEQ ID NO: 162611
  Description of Artificial Sequence: Synthetic coding sequence

SEQ ID NO: 162614 - DNA, 1008 bp, Artificial Sequence; identical to SEQ ID NO: 162611
  Description of Artificial Sequence: Synthetic coding sequence

SEQ ID NO: 162615 - DNA, 471 bp, Artificial Sequence
  Description of Artificial Sequence: Synthetic coding sequence
atgggcgccagccggctgtacaccctggtgctggtgctgcagccccagagggtgctgctgggcatgaagaagaggggctttggagctggccgctggaatggatttggaggcaaggtgcaggagggggagaccattgaagatggagcccggcgggagctgcaggaggagagcggcctgactgtggatgccctgcacaaggtgggccagatcgtgtttgaatttgtgggggagcctgagctgatggatgtgcacgtgttctgcacagacagcatccagggcacccctgtggagagtgatgagatgaggccctgctggttccagctggaccagatccccttcaaggacatgtggccagatgacagctactggttccccctgctgctgcagaagaagaagttccacggctacttcaagttccagggccaggacaccatcctggactacaccctgcgggaggtggacacagtgtag

SEQ ID NO: 162616 - DNA, 540 bp, Artificial Sequence
  Description of Artificial Sequence: Synthetic coding sequence
atgagcggcatcagcccccagcagatgggagagcctgagggctcctggagcggcaagaaccctggcaccatgggcgccagccggctgtacaccctggtgctggtgctgcagccccagagggtgctgctgggcatgaagaagaggggctttggagctggccgctggaatggatttggaggcaaggtgcaggagggggagaccattgaagatggagcccggcgggagctgcaggaggagagcggcctgactgtggatgccctgcacaaggtgggccagatcgtgtttgaatttgtgggggagcctgagctgatggatgtgcacgtgttctgcacagacagcatccagggcacccctgtggagagtgatgagatgaggccctgctggttccagctggaccagatccccttcaaggacatgtggccagatgacagctactggttccccctgctgctgcagaagaagaagttccacggctacttcaagttccagggccaggacaccatcctggactacaccctgcgggaggtggacacagtgtag

SEQ ID NO: 162617 - DNA, 471 bp, Artificial Sequence; identical to SEQ ID NO: 162615
  Description of Artificial Sequence: Synthetic coding sequence

SEQ ID NO: 162618 - DNA, 471 bp, Artificial Sequence; identical to SEQ ID NO: 162615
  Description of Artificial Sequence: Synthetic coding sequence

SEQ ID NO: 162619 - DNA, 540 bp, Artificial Sequence; identical to SEQ ID NO: 162616
  Description of Artificial Sequence: Synthetic coding sequence

SEQ ID NO: 162620 - DNA, 540 bp, Artificial Sequence; identical to SEQ ID NO: 162616
  Description of Artificial Sequence: Synthetic coding sequence

SEQ ID NO: 162621 - DNA, 114 bp, Artificial Sequence
  Description of Artificial Sequence: Synthetic coding sequence
atgggcgccagccggctgtacaccctggtgctggtgctgcagccccagagggtgctgctgggcatgaagaagaggggctttggagctggccgctggaatggatttggaggatag

SEQ ID NO: 162622 - DNA, 495 bp, Artificial Sequence
  Description of Artificial Sequence: Synthetic coding sequence
atgaagtgcaagcccaaccagaccaggacctatgaccctgagggcttcaagaagagagctgcctgcctgtgcttccgctctgagcgggaggatgaggtgctgctggtgagcagcagccgctacccagaccgctggatcgtgcctgggggcggcatggagcctgaggaggagcccggcggcgctgctgtgcgggaggtgtatgaggaggccggcgtgaagggcaagctgggccgcctgctgggcgtgtttgagcagaaccaggaccccaagcacaggacctacgtgtatgtgctgactgtgacagagctgctggaggactgggaggacagcgtgtccattggaaggaagcgggagtggttcaaggtggaggatgccatcaaggtgctgcagtgccacaagcctgtgcatgctgagtacctggagaagctgaagctgggcggcagccccaccaatggaaacagcatggcccccagcagcccagacagcgacccctag

SEQ ID NO: 162623 - DNA, 495 bp, Artificial Sequence; identical to SEQ ID NO: 162622
  Description of Artificial Sequence: Synthetic coding sequence

SEQ ID NO: 162624 - DNA, 444 bp, Artificial Sequence
  Description of Artificial Sequence: Synthetic coding sequence
atggccctgcgggcctgtggcctcatcatcttccgccgctgcctgatccccaaggtggacaacaatgccatcgagttcctgctgctgcaggccagtgatggcatccaccactggaccccacccaagggccacgtggagcctggagaagatgacctggagacagccctgcgggagacccaggaggaggccggcattgaagctggccagctgaccatcatcgagggcttcaagcgggagctgaactacgtggccaggaacaagcccaagacagtcatctactggctggccgaggtgaaggactatgatgtggagatccggctgagccatgagcaccaggcctaccgctggctgggcctggaggaggcctgccagctggcccagttcaaggagatgaaggccgccctgcaggagggccaccagttcctgtgcagcattgaggcctag

SEQ ID NO: 162625 - DNA, 444 bp, Artificial Sequence; identical to SEQ ID NO: 162624
  Description of Artificial Sequence: Synthetic coding sequence

SEQ ID NO: 162626 - DNA, 444 bp, Artificial Sequence; identical to SEQ ID NO: 162624
  Description of Artificial Sequence: Synthetic coding sequence

SEQ ID NO: 162627 - DNA, 444 bp, Artificial Sequence; identical to SEQ ID NO: 162624
  Description of Artificial Sequence: Synthetic coding sequence

SEQ ID NO: 162628 - DNA, 444 bp, Artificial Sequence; identical to SEQ ID NO: 162624
  Description of Artificial Sequence: Synthetic coding sequence

SEQ ID NO: 162629 - DNA, 1395 bp, Artificial Sequence
  Description of Artificial Sequence: Synthetic coding sequence
atggagaccctgtccttcccccgctacaacgtggccgagatcgtcatccacatccggaacaagatcctgaccggggctgatggcaagaacctgaccaagaatgacctgtaccccaaccccaagccagaggtgctgcacatgatctacatgagggccctgcagatcgtgtatggcatccggctggagcacttctacatgatgcctgtgaacagcgaggtgatgtacccccacctgatggagggcttcctgcccttcagcaacctggtgacccacctggacagcttcctgcccatctgccgggtgaatgactttgaaacagctgacatcctgtgccccaaggccaagaggaccagccgcttcctgagcggcatcatcaacttcatccacttccgggaggcctgccgggagacctacatggagttcctgtggcagtacaagagcagcgctgacaagatgcagcagctgaatgctgcccaccaggaggccctgatgaagctggagcggctggacagcgtgcctgtggaggagcaggaggagttcaagcagctgagtgatggcatccaggagctgcagcagagcctgaaccaggacttccaccagaagaccatcgtgctgcaggagggcaacagccagaagaagagcaacatcagcgagaagaccaagaggctgaatgagctgaagctgtctgtggtgtccctgaaggagatccaggagagcctgaagaccaagatcgtggacagccctgagaagctgaagaactacaaggagaagatgaaggacacagtgcagaagctgaagaatgcccggcaggaggtggtggagaagtatgagatctatggagacagcgtggactgcctgcccagctgccagctggaggtgcagctgtaccagaagaagatccaggacctgagtgacaaccgggagaagctggccagcatcctgaaggagagcctgaacctggaggaccagatcgagagtgatgaaagtgagctgaagaagctgaagacagaggagaacagcttcaagaggctgatgattgtgaagaaggagaagctggccacagcccagttcaagatcaacaagaagcatgaagatgtgaagcagtacaagaggacagtgattgaggactgcaacaaggtgcaggagaagagaggagctgtgtatgaaagagtgaccaccatcaaccaggagatccagaagatcaagctgggcatccagcagctgaaggatgctgctgagcgggagaagctgaagagccaggagatcttcctgaacctgaagacagccctggagaagtaccatgatggcatcgagaaggctgctgaggacagctatgccaagattgatgagaagacagctgagctgaagaggaagatgttcaagatgagcacctag

SEQ ID NO: 162630 - DNA, 1395 bp, Artificial Sequence; identical to SEQ ID NO: 162629
  Description of Artificial Sequence: Synthetic coding sequence

SEQ ID NO: 162631 - DNA, 609 bp, Artificial Sequence
  Description of Artificial Sequence: Synthetic coding sequence
atggagaccctgtccttcccccgctacaacgtggccgagatcgtcatccacatccggaacaagatcctgaccggggctgatggcaagaacctgaccaagaatgacctgtaccccaaccccaagccagaggtgctgcacatgatctacatgagggccctgcagatcgtgtatggcatccggctggagcacttctacatgatgcctgtgaacagcgaggtgatgtacccccacctgatggagggcttcctgcccttcagcaacctggtgacccacctggacagcttcctgcccatctgccgggtgaatgactttgaaacagctgacatcctgtgccccaaggccaagaggaccagccgcttcctgagcggcatcatcaacttcatccacttccgggaggcctgccgggagacctacatggagttcctgtggcagtacaagagcagcgctgacaagatgcagcagctgaatgctgcccaccaggaggccctgatgaagctggagcggctggacagcgtgcctgtggaggagcaggaggagttcaagcagctgagtgatggcatccaggagctgcagcagagcctgaaccaggacttccaccagaagacctag

SEQ ID NO: 162632 - DNA, 438 bp, Artificial Sequence
  Description of Artificial Sequence: Synthetic coding sequence
atggagaccctgtccttcccccgctacaacgtggccgagatcgtcatccacatccggaacaagatcctgaccggggctgatggcaagaacctgaccaagaatgacctgtaccccaaccccaagccagaggtgctgcacatgatctacatgagggccctgcagatcgtgtatggcatccggctggagcacttctacatgatgcctgtgaacagcgaggtgatgtacccccacctgatggagggcttcctgcccttcagcaacctggtgacccacctggacagcttcctgcccatctgccgggtgaatgactttgaaacagctgacatcctgtgccccaaggccaagaggaccagccgcttcctgagcggcatcatcaacttcatccacttccgggaggcctgccgggagacctacatggagttcctgtggcagtactag

SEQ ID NO: 162633 - DNA, 666 bp, Artificial Sequence
  Description of Artificial Sequence: Synthetic coding sequence
atggagaccctgtccttcccccgctacaacgtggccgagatcgtcatccacatccggaacaagatcctgaccggggctgatggcaagaacctgaccaagaatgacctgtaccccaaccccaagccagaggtgctgcacatgatctacatgagggccctgcagatcgtgtatggcatccggctggagcacttctacatgatgcctgtgaacagcgaggtgatgtacccccacctgatggagggcttcctgcccttcagcaacctggtgacccacctggacagcttcctgcccatctgccgggtgaatgactttgaaacagctgacatcctgtgccccaaggccaagaggaccagccgcttcctgagcggcatcatcaacttcatccacttccgggaggcctgccgggagacctacatggagttcctgtggcagtacaagagcagcgctgacaagatgcagcagctgaatgctgcccaccaggaggccctgatgaagctggagcggctggacagcgtgcctgtggaggagcaggaggagttcaagcagctgagtgatggcatccaggagctgcagcagagcctgaaccaggacttccaccagaagacctgctgcaagcgggagatccccaagaggagccagatcttccagaggaagcccagcgtgtag

SEQ ID NO: 162634 - DNA, 1254 bp, Artificial Sequence
  Description of Artificial Sequence: Synthetic coding sequence
atggagaccctgtccttcccccgctacaacgtggccgagatcgtcatccacatccggaacaagatcctgaccggggctgatggcaagaacctgaccaagaatgacctgtaccccaaccccaagccagaggtgctgcacatgatctacatgagggccctgcagatcgtgtatggcatccggctggagcacttctacatgatgcctgtgaacagcgaggtgatgtacccccacctgatggagggcttcctgcccttcagcaacctggtgacccacctggacagcttcctgcccatctgccgggtgaatgactttgaaacagctgacatcctgtgccccaaggccaagaggaccagccgcttcctgagcggcatcatcaacttcatccacttccgggaggcctgccgggagacctacatggagttcctgtggcagtacaagagcagcgctgacaagatgcagcagctgaatgctgcccaccaggaggccctgatgaagctggagcggctggacagcgtgcctgtggaggagcaggaggagttcaagcagctgagtgatggcatccaggagctgcagcagagcctgaaccaggacttccaccagaagaccatcgtgctgcaggagggcaacagccagaagaagagcaacatcagcgagaagaccaagaggctgaatgagctgaagctgtctgtggtgtccctgaaggagatccaggagagcctgaagaccaagatcgtggacagccctgagaagctgaagaactacaaggagaagatgaaggacacagtgcagaagctgaagaatgcccggagcctgaacctggaggaccagattgaaagtgatgagagcgagctgaagaagctgaagacagaagaaaattccttcaagaggctgatgattgtgaagaaggagaagctggccacagcccagttcaagatcaacaagaagcatgaagatgtgaagcagtacaagaggacagtgattgaggactgcaacaaggtgcaggagaagagaggagctgtgtatgagcgggtgaccaccatcaaccaggagatccagaagatcaagctgggcatccagcagctgaaggatgctgctgagcgggagaagctgaagagccaggagatcttcctgaacctgaagacagccctggagaagtaccatgatggcatcgagaaggccgcagaagattcctatgccaagattgatgagaagacagctgagctgaagaggaagatgttcaagatgagcacctag

SEQ ID NO: 162635 - DNA, 375 bp, Artificial Sequence
  Description of Artificial Sequence: Synthetic coding sequence
atggagaccctgtccttcccccgctacaacgtggccgagatcgtcatccacatccggaacaagatcctgaccggggctgatggcaagaacctgaccaagaatgacctgtaccccaaccccaagccagaggtgctgcacatgatctacatgagggccctgcagatcgtgtatggcatccggctggagcacttctacatgatgcctgtgaacagcgaggtgatgtacccccacctgatggagggcttcctgcccttcagcaacctggtgacccacctggacagcttcctgcccatctgccgggtgaatgactttgaaacagctgacatcctgtgccccaaggccaagaggaccagccgcttcctgagcggcatctag

SEQ ID NO: 162636 - DNA, 702 bp, Artificial Sequence
  Description of Artificial Sequence: Synthetic coding sequence
atgaacaagctgcggcagagcttccggaggaagaaggatgtgtatgtgcctgaggccagccggccccaccagtggcagacagatgaggagggcgtgaggacaggcaagtgcagcttccctgtgaagacaggcaagaaggctgtgaaggctgtgctgtgggtgtctgcagatggcctgcgggtggtggatgagaagaccaaggacctgattgtggaccagaccatcgagaaggtgtccttctgtgccccagacaggaactttgaccgggccttctcctacatctgcagagatggcaccacccggcgctggatctgccactgcttcatggctgtgaaggacaccggggagcggctgagccatgctgtgggctgtgcctttgctgcctgcctggagaggaagcagaagcgggagaaggaatgtggggtgacagccacctttgatgccagcaggaccaccttcacccgggagggcagcttccgggtgaccacagccacagagcaggccgagcgggaggagatcatgaagcagatgcaggatgccaagaaggccgagacagacaagatcgtggtgggcagctctgtggcccctggcaacacagcccccagccccagcagccccaccagccccaccagtgatgccaccaccagcctggagatgaacaacccccacgccatccccaggagacatgcccccatcgagtag

SEQ ID NO: 162637 - DNA, 1956 bp, Artificial Sequence
  Description of Artificial Sequence: Synthetic coding sequence
atgaacaagctgcggcagagcttccggaggaagaaggatgtgtatgtgcctgaggccagccggccccaccagtggcagacagatgaggagggcgtgaggacaggcaagtgcagcttccctgtgaagtacctgggccacgtggaggtggatgagagccggggcatgcacatctgtgaagatgctgtgaagaggctgaaggccgagaggaagttcttcaagggcttcttcggcaagacaggcaagaaggctgtgaaggctgtgctgtgggtgtctgcagatggcctgcgggtggtggatgagaagaccaaggacctgattgtggaccagaccatcgagaaggtgtccttctgtgccccagacaggaactttgaccgggccttctcctacatctgcagagatggcaccacccggcgctggatctgccactgcttcatggctgtgaaggacaccggggagcggctgagccatgctgtgggctgtgcctttgctgcctgcctggagaggaagcagaagcgggagaaggaatgtggggtgacagccacctttgatgccagcaggaccaccttcacccgggagggcagcttccgggtgaccacagccacagagcaggccgagcgggaggagatcatgaagcagatgcaggatgccaagaaggccgagacagacaagatcgtggtgggcagctctgtggcccctggcaacacagcccccagccccagcagccccaccagccccaccagtgatgccaccaccagcctggagatgaacaacccccacgccatccccaggagacatgcccccatcgagcagctggcccggcagggcagcttccggggcttccctgccctgagccagaagatgagccccttcaagaggcagctgagcctgcgcatcaatgagctgcccagcaccatgcagaggaagacagacttccccatcaagaatgctgtgcctgaggtggagggggaggccgagagcatcagcagcctgtgcagccagatcaccaatgccttcagcaccccagaggaccccttcagcagcgcccccatgaccaagcctgtgacagtggtggccccccagagccccaccttccaggccaatggaacagattctgccttccacgtgctggccaagccagcccacacagccctggcccctgtggccatgcctgtgcgggagaccaacccctgggcccacgccccagatgctgccaacaaggagattgctgccacctgcagcggcacagagtggggccagagcagtggagctgccagccctggcctcttccaggccggccacaggaggacccccagcgaggccgaccgctggctggaggaggtgtccaagtctgtgcgggcccagcagccccaggccagcgctgcccccctgcagcctgtgctgcagcccccaccacccacagccatcagccagcctgccagccccttccagggcaatgccttcctgaccagccagcctgtgcctgtgggcgtggtgcctgccctgcagcctgcctttgtgcctgcccagagctaccctgtggccaacggcatgccctacccagccccaaatgtgcctgtggtgggcatcacccccagccagatggtggccaacgtgtttggaacagctggccacccccaggccgcccacccccaccagagccccagcctggtgcggcagcagaccttcccccactatgaggccagcagcgccaccaccagccccttcttcaagcccccagcccagcacctgaatggcagcgctgccttcaacggggtggatgatggccgcctggccagcgctgacagacacacagaggtgcccaccggcacctgccctgtggacccctttgaggcccagtgggccgccctggagaacaagagcaagcagaggaccaaccccagccccaccaaccccttcagcagtgacctgcagaagacctttgaaattgagctgtag

SEQ ID NO: 162638 - DNA, 1812 bp, Artificial Sequence
  Description of Artificial Sequence: Synthetic coding sequence
atgaacaagctgcggcagagcttccggaggaagaaggatgtgtatgtgcctgaggccagccggccccaccagtggcagacagatgaggagggcgtgaggacaggcaagtgcagcttccctgtgaagtacctgggccacgtggaggtggatgagagccggggcatgcacatctgtgaagatgctgtgaagaggctgaaggccgagaggaagttcttcaagggcttcttcggcaagacaggcaagaaggctgtgaaggctgtgctgtgggtgtctgcagatggcctgcgggtggtggatgagaagaccaaggacctgattgtggaccagaccatcgagaaggtgtccttctgtgccccagacaggaactttgaccgggccttctcctacatctgcagagatggcaccacccggcgctggatctgccactgcttcatggctgtgaaggacaccggggagcggctgagccatgctgtgggctgtgcctttgctgcctgcctggagaggaagcagaagcgggagaaggaatgtggggtgacagccacctttgatgccagcaggaccaccttcacccgggagggcagcttccgggtgaccacagccacagagcaggccgagcgggaggagatcatgaagcagatgcaggatgccaagaaggccgagacagacaagatcgtggtgggcagctctgtggcccctggcaacacagcccccagccccagcagccccaccagccccaccagtgatgccaccaccagcctggagatgaacaacccccacgccatccccaggagacatgcccccatcgagcagctggcccggcagggcagcttccggggcttccctgccctgagccagaagatgagccccttcaagaggcagctgagcctgcgcatcaatgagctgcccagcaccatgcagaggaagacagacttccccatcaagaatgctgtgcctgaggtggagggggaggccgagagcatcagcagcctgtgcagccagatcaccaatgccttcagcaccccagaggaccccttcagcagcgcccccatgaccaagcctgtgacagtggtggccccccagagccccaccttccagggcacagagtggggccagagcagtggagctgccagccctggcctcttccaggccggccacaggaggacccccagcgaggccgaccgctggctggaggaggtgtccaagtctgtgcgggcccagcagccccaggccagcgctgcccccctgcagcctgtgctgcagcccccaccacccacagccatcagccagcctgccagccccttccagggcaatgccttcctgaccagccagcctgtgcctgtgggcgtggtgcctgccctgcagcctgcctttgtgcctgcccagagctaccctgtggccaacggcatgccctacccagccccaaatgtgcctgtggtgggcatcacccccagccagatggtggccaacgtgtttggaacagctggccacccccaggccgcccacccccaccagagccccagcctggtgcggcagcagaccttcccccactatgaggccagcagcgccaccaccagccccttcttcaagcccccagcccagcacctgaatggcagcgctgccttcaacggggtggatgatggccgcctggccagcgctgacagacacacagaggtgcccaccggcacctgccctgtggacccctttgaggcccagtgggccgccctggagaacaagagcaagcagaggaccaaccccagccccaccaaccccttcagcagtgacctgcagaagacctttgaaattgagctgtag

SEQ ID NO: 162639 - DNA, 1923 bp, Artificial Sequence
  Description of Artificial Sequence: Synthetic coding sequence
atgaacaagctgcggcagagcttccggaggaagaaggatgtgtatgtgcctgaggccagccggccccaccagtggcagacagatgaggagggcgtgaggacaggcaagtgcagcttccctgtgaagtacctgggccacgtggaggtggatgagagccggggcatgcacatctgtgaagatgctgtgaagaggctgaaggccaccgggaagaaggctgtgaaggctgtgctgtgggtgtctgcagatggcctgcgggtggtggatgagaagaccaaggacctgattgtggaccagaccatcgagaaggtgtccttctgtgccccagacaggaactttgaccgggccttctcctacatctgcagagatggcaccacccggcgctggatctgccactgcttcatggctgtgaaggacacaggagagcggctgagccatgctgtgggctgtgcctttgctgcctgcctggagaggaagcagaagcgggagaaggaatgtggggtgacagccacctttgatgccagcaggaccaccttcacccgggagggcagcttccgggtgaccacagccacagagcaggccgagcgggaggagatcatgaagcagatgcaggatgccaagaaggccgagacagacaagatcgtggtgggcagctctgtggcccctggcaacacagcccccagccccagcagccccaccagccccaccagtgatgccaccaccagcctggagatgaacaacccccacgccatccccaggagacatgcccccatcgagcagctggcccggcagggcagcttccggggcttccctgccctgagccagaagatgagccccttcaagaggcagctgagcctgcgcatcaatgagctgcccagcaccatgcagaggaagacagacttccccatcaagaatgctgtgcctgaggtggagggggaggccgagagcatcagcagcctgtgcagccagatcaccaatgccttcagcaccccagaggaccccttcagcagcgcccccatgaccaagcctgtgacagtggtggccccccagagccccaccttccaggccaacggcacagacagcgccttccacgtgctggccaagccagcccacacagccctggcccctgtggccatgcctgtgcgggagaccaacccctgggcccacgccccagatgctgccaacaaggagattgctgccacctgcagcggcacagagtggggccagagcagcggggccgccagccctggcctcttccaggccggccacaggaggaccccatctgaggccgaccgctggctggaggaggtgtccaagtctgtgcgggcccagcagccccaggccagcgctgcccccctgcagcctgtgctgcagcccccaccacccacagccatcagccagcctgccagccccttccagggcaatgccttcctgaccagccagcctgtgcctgtgggcgtggtgcctgccctgcagcctgcctttgtgcctgcccagagctaccctgtggccaacggcatgccctacccagcccccaacgtgcctgtggtgggcatcacccccagccagatggtggccaacgtgtttggaacagctggccacccccaggccgcccacccccaccagagccccagcctggtgcggcagcagaccttcccccactatgaggccagcagcgccaccaccagccccttcttcaagcccccagcccagcacctgaatggatctgctgccttcaatggagtggatgatggccgcctggccagcgctgacagacacacagaggtgcccaccggcacctgccctgtggacccctttgaggcccagtgggccgccctggagaacaagagcaagcagaggaccaaccccagccccaccaaccccttcagcagtgacctgcagaagacctttgaaattgagctgtag

SEQ ID NO: 162640 - DNA, 1518 bp, Artificial Sequence
  Description of Artificial Sequence: Synthetic coding sequence
atgaacaagctgcggcagagcttccggaggaagaaggatgtgtatgtgcctgaggccagccggccccaccagtggcagacagatgaggagggcgtgaggacaggcaagtgcagcttccctgtgaagtacctgggccacgtggaggtggatgagagccggggcatgcacatctgtgaagatgctgtgaagaggctgaaggccgagaggaagttcttcaagggcttcttcggcaagacaggcaagaaggctgtgaaggctgtgctgtgggtgtctgcagatggcctgcgggtggtggatgagaagaccaaggacctgattgtggaccagaccatcgagaaggtgtccttctgtgccccagacaggaactttgaccgggccttctcctacatctgcagagatggcaccacccggcgctggatctgccactgcttcatggctgtgaaggacaccggggagcggctgagccatgctgtgggctgtgcctttgctgcctgcctggagaggaagcagaagcgggagaaggaatgtggggtgacagccacctttgatgccagcaggaccaccttcacccgggagggcagcttccgggtgaccacagccacagagcaggccgagcgggaggagatcatgaagcagatgcaggatgccaagaaggtgcctgaggtggagggggaggccgagagcatcagcagcctgtgcagccagatcaccaatgccttcagcaccccagaggaccccttcagcagcgcccccatgaccaagcctgtgacagtggtggccccccagagccccaccttccagggcacagagtggggccagagcagtggagctgccagccctggcctcttccaggccggccacaggaggacccccagcgaggccgaccgctggctggaggaggtgtccaagtctgtgcgggcccagcagccccaggccagcgctgcccccctgcagcctgtgctgcagcccccaccacccacagccatcagccagcctgccagccccttccagggcaatgccttcctgaccagccagcctgtgcctgtgggcgtggtgcctgccctgcagcctgcctttgtgcctgcccagagctaccctgtggccaacggcatgccctacccagccccaaatgtgcctgtggtgggcatcacccccagccagatggtggccaacgtgtttggaacagctggccacccccaggccgcccacccccaccagagccccagcctggtgcggcagcagaccttcccccactatgaggccagcagcgccaccaccagccccttcttcaagcccccagcccagcacctgaatggcagcgctgccttcaacggggtggatgatggccgcctggccagcgctgacagacacacagaggtgcccaccggcacctgccctgtggacccctttgaggcccagtgggccgccctggagaacaagagcaagcagaggaccaaccccagccccaccaaccccttcagcagtgacctgcagaagacctttgaaattgagctgtag

SEQ ID NO: 162641 - DNA, 1923 bp, Artificial Sequence; identical to SEQ ID NO: 162639
  Description of Artificial Sequence: Synthetic coding sequence

SEQ ID NO: 162642 - DNA, 1371 bp, Artificial Sequence
  Description of Artificial Sequence: Synthetic coding sequence
atgaacaagctgcggcagagcttccggaggaagaaggatgtgtatgtgcctgaggccagccggccccaccagtggcagacagatgaggagggcgtgaggacaggcaagtgcagcttccctgtgaagtacctgggccacgtggaggtggatgagagccggggcatgcacatctgtgaagatgctgtgaagaggctgaaggccgagaggaagttcttcaagggcttcttcggcaagacaggcaagaaggctgtgaaggctgtgctgtgggtgtctgcagatggcctgcgggtggtggatgagaagaccaaggacctgattgtggaccagaccatcgagaaggtgtccttctgtgccccagacaggaactttgaccgggccttctcctacatctgcagagatggcaccacccggcgctggatctgccactgcttcatggctgtgaaggacaccggggagcggctgagccatgctgtgggctgtgcctttgctgcctgcctggagaggaagcagaagcgggagaaggaatgtggggtgacagccacctttgatgccagcaggaccaccttcacccgggagggcagcttccgggtgaccacagccacagagcaggccgagcgggaggagatcatgaagcagatgcaggatgccaagaagggcacagagtggggccagagcagcggggccgccagccctggcctcttccaggccggccacaggaggaccccatctgaggccgaccgctggctggaggaggtgtccaagtctgtgcgggcccagcagccccaggccagcgctgcccccctgcagcctgtgctgcagcccccaccacccacagccatcagccagcctgccagccccttccagggcaatgccttcctgaccagccagcctgtgcctgtgggcgtggtgcctgccctgcagcctgcctttgtgcctgcccagagctaccctgtggccaacggcatgccctacccagcccccaacgtgcctgtggtgggcatcacccccagccagatggtggccaacgtgtttggaacagctggccacccccaggccgcccacccccaccagagccccagcctggtgcggcagcagaccttcccccactatgaggccagcagcgccaccaccagccccttcttcaagcccccagcccagcacctgaatggatctgctgccttcaatggagtggatgatggccgcctggccagcgctgacagacacacagaggtgcccaccggcacctgccctgtggacccctttgaggcccagtgggccgccctggagaacaagagcaagcagaggaccaaccccagccccaccaaccccttcagcagtgacctgcagaagacctttgaaattgagctgtag

SEQ ID NO: 162643 - DNA, 777 bp, Artificial Sequence
  Description of Artificial Sequence: Synthetic coding sequence
atgaacaagctgcggcagagcttccggaggaagaaggatgtgtatgtgcctgaggccagccggccccaccagtggcagacagatgaggagggcgtgaggacaggcaagtgcagcttccctgtgaagtacctgggccacgtggaggtggatgagagccggggcatgcacatctgtgaagatgctgtgaagaggctgaaggccgagaggaagttcttcaagggcttcttcggcaagacaggcaagaaggctgtgaaggctgtgctgtgggtgtctgcagatggcctgcgggtggtggatgagaagaccaaggacctgattgtggaccagaccatcgagaaggtgtccttctgtgccccagacaggaactttgaccgggccttctcctacatctgcagagatggcaccacccggcgctggatctgccactgcttcatggctgtgaaggacaccggggagcggctgagccatgctgtgggctgtgcctttgctgcctgcctggagaggaagcagaagcgggagaaggaatgtggggtgacagccacctttgatgccagcaggaccaccttcacccgggagggcagcttccgggtgaccacagccacagagcaggccgagcgggaggagatcatgaagcagatgcaggatgccaagaaggccgagacagacaagatcgtggtgggcagctctgtggcccctggcaacacagcccccagccccagcagccccaccagccccaccagtgatgccaccaccagcctggagatgaacaacccctag

SEQ ID NO: 162644 - DNA, 1779 bp, Artificial Sequence
  Description of Artificial Sequence: Synthetic coding sequence
atgaacaagctgcggcagagcttccggaggaagaaggatgtgtatgtgcctgaggccagccggccccaccagtggcagacagatgaggagggcgtgaggacaggcaagtgcagcttccctgtgaagtacctgggccacgtggaggtggatgagagccggggcatgcacatctgtgaagatgctgtgaagaggctgaaggccaccgggaagaaggctgtgaaggctgtgctgtgggtgtctgcagatggcctgcgggtggtggatgagaagaccaaggacctgattgtggaccagaccatcgagaaggtgtccttctgtgccccagacaggaactttgaccgggccttctcctacatctgcagagatggcaccacccggcgctggatctgccactgcttcatggctgtgaaggacacaggagagcggctgagccatgctgtgggctgtgcctttgctgcctgcctggagaggaagcagaagcgggagaaggaatgtggggtgacagccacctttgatgccagcaggaccaccttcacccgggagggcagcttccgggtgaccacagccacagagcaggccgagcgggaggagatcatgaagcagatgcaggatgccaagaaggccgagacagacaagatcgtggtgggcagctctgtggcccctggcaacacagcccccagccccagcagccccaccagccccaccagtgatgccaccaccagcctggagatgaacaacccccacgccatccccaggagacatgcccccatcgagcagctggcccggcagggcagcttccggggcttccctgccctgagccagaagatgagccccttcaagaggcagctgagcctgcgcatcaatgagctgcccagcaccatgcagaggaagacagacttccccatcaagaatgctgtgcctgaggtggagggggaggccgagagcatcagcagcctgtgcagccagatcaccaatgccttcagcaccccagaggaccccttcagcagcgcccccatgaccaagcctgtgacagtggtggccccccagagccccaccttccagggcacagagtggggccagagcagcggggccgccagccctggcctcttccaggccggccacaggaggaccccatctgaggccgaccgctggctggaggaggtgtccaagtctgtgcgggcccagcagccccaggccagcgctgcccccctgcagcctgtgctgcagcccccaccacccacagccatcagccagcctgccagccccttccagggcaatgccttcctgaccagccagcctgtgcctgtgggcgtggtgcctgccctgcagcctgcctttgtgcctgcccagagctaccctgtggccaacggcatgccctacccagcccccaacgtgcctgtggtgggcatcacccccagccagatggtggccaacgtgtttggaacagctggccacccccaggccgcccacccccaccagagccccagcctggtgcggcagcagaccttcccccactatgaggccagcagcgccaccaccagccccttcttcaagcccccagcccagcacctgaatggatctgctgccttcaatggagtggatgatggccgcctggccagcgctgacagacacacagaggtgcccaccggcacctgccctgtggacccctttgaggcccagtgggccgccctggagaacaagagcaagcagaggaccaaccccagccccaccaaccccttcagcagtgacctgcagaagacctttgaaattgagctgtag

SEQ ID NO: 162645 - DNA, 204 bp, Artificial Sequence
  Description of Artificial Sequence: Synthetic coding sequence
atgaacaagctgcggcagagcttccggaggaagaaggatgtgtatgtgcctgaggccagccggccccaccagtggcagacagatgaggagggcgtgaggacaggcaagtgcagcttccctgtgaagtacctgggccacgtggaggtggatgagagccggggcatgcacatctgtgaagatgctgtgaagaggctgaaggcctag

SEQ ID NO: 162646 - DNA, 1956 bp, Artificial Sequence; identical to SEQ ID NO: 162637
  Description of Artificial Sequence: Synthetic coding sequence

SEQ ID NO: 162647 - DNA, 777 bp, Artificial Sequence; identical to SEQ ID NO: 162643
  Description of Artificial Sequence: Synthetic coding sequence

SEQ ID NO: 162648 - DNA, 1812 bp, Artificial Sequence; identical to SEQ ID NO: 162638
  Description of Artificial Sequence: Synthetic coding sequence

SEQ ID NO: 162649 - DNA, 1923 bp, Artificial Sequence; identical to SEQ ID NO: 162639
  Description of Artificial Sequence: Synthetic coding sequence

SEQ ID NO: 162650 - DNA, 1830 bp, Artificial Sequence
  Description of Artificial Sequence: Synthetic coding sequence
atgagccgctctgctgctgccagcggcggcccccggcggcctgagcggcacctgcccccagccccctgtggggcccctggccccccagagacctgcaggacagagccagatggagctggcaccatgaacaagctgcggcagagcctgcggcggaggaagccagcctacgtgcctgaggccagccggccccaccagtggcaggctgatgaagatgctgtgaggaagggcacctgcagcttccctgtgcgctacctgggccacgtggaggtggaggagagccggggcatgcacgtgtgtgaagatgctgtgaagaagctgaaggccatgggcaggaagtctgtgaagtctgtgctgtgggtgtctgcagatggcctgcgggtggtggatgacaagaccaaggacctgctggtggaccagaccatcgagaaggtgtccttctgtgccccagacaggaacctggacaaggccttctcctacatctgcagagatggcaccacccggcgctggatctgccactgcttcctggccctgaaggacagcggggagcggctgagccatgctgtgggctgtgcctttgctgcctgcctggagaggaagcagaggcgggagaaggaatgtggggtgacagctgcctttgatgccagcaggaccagctttgcccgggagggcagcttccggctgagcggcggcggccggcctgctgagcgggaggccccagacaagaagaaggccgaggccgccgccgcccccaccgtggcccctggccctgcccagcccggccacgtgagccccaccccagccaccaccagccctggagagaagggggaggccggcacccctgtggccgccggcaccacagctgctgccatccccaggagacatgcccccctggagcagctggtgcggcagggcagcttccggggcttccctgccctgagccagaagaacagccccttcaagaggcagctgagcctgcggctgaatgagctgcccagcaccctgcagaggagaacagacttccaggtgaagggcaccgtgcctgagatggagcccccaggggccggggacagcgacagcatcaatgccctgtgcacccagatcagcagcagctttgccagcgctggggccccagcccctggccccccaccagccaccaccggcaccagcgcctggggcgagcccagcgtgcccccagctgctgccttccagcccggccacaagaggaccccatctgaggccgagcgctggctggaggaggtgtcccaggtggccaaggcccagcagcagcagcagcagcagcagcagcagcagcagcagcagcagcagcagcagcagcaggccgcctctgtggcccctgtgcccaccatgcccccagccctgcagcccttccctgcccctgtgggcccctttgatgctgccccagcccaggtggccgtgttcctgcccccaccccacatgcagcccccatttgtgcctgcctacccaggcctgggctacccacccatgccccgggtgcctgtggtgggcatcacccccagccagatggtggccaatgccttctgcagcgctgcccagctgcagccccagcctgccaccctgctgggcaaggccggggccttccccccaccagccatccccagcgcccctggcagccaggcccggccccggcccaacggggccccctggcccccagagcccgccccagccccagcccctgagctggacccctttgaggcccagtgggccgccctggagggcaaggccaccgtggagaagcccagcaaccccttcagcggggacctgcagaagacctttgaaattgagctgtag

SEQ ID NO: 162651 - DNA, 1707 bp, Artificial Sequence
  Description of Artificial Sequence: Synthetic coding sequence
atgaacaagctgcggcagagcctgcggcggaggaagccagcctacgtgcctgaggccagccggccccaccagtggcaggctgatgaagatgctgtgaggaagggcacctgcagcttccctgtgcgctacctgggccacgtggaggtggaggagagccggggcatgcacgtgtgtgaagatgctgtgaagaagctgaaggccatgggcaggaagtctgtgaagtctgtgctgtgggtgtctgcagatggcctgcgggtggtggatgacaagaccaaggacctgctggtggaccagaccatcgagaaggtgtccttctgtgccccagacaggaacctggacaaggccttctcctacatctgcagagatggcaccacccggcgctggatctgccactgcttcctggccctgaaggacagcggggagcggctgagccatgctgtgggctgtgcctttgctgcctgcctggagaggaagcagaggcgggagaaggaatgtggggtgacagctgcctttgatgccagcaggaccagctttgcccgggagggcagcttccggctgagcggcggcggccggcctgctgagcgggaggccccagacaagaagaaggccgaggccgctgctgcccccaccgtggcccctggccctgcccagcccggccacgtgagccccaccccagccaccaccagccctggagagaagggggaggccggcacccctgtggccgccggcaccacagctgctgccatccccaggagacatgcccccctggagcagctggtgcggcagggcagcttccggggcttccctgccctgagccagaagaacagccccttcaagaggcagctgagcctgcggctgaatgagctgcccagcaccctgcagaggagaacagacttccaggtgaagggcaccgtgcctgagatggagcccccaggagctggggacagcgacagcatcaatgccctgtgcacccagatcagcagcagctttgccagcgctggggccccagcccctggccccccaccagccaccaccggcaccagcgcctggggcgagcccagcgtgcccccagctgctgccttccagcccggccacaagaggacccccagcgaggccgagcgctggctggaggaggtgtcccaggtggccaaggcccagcagcagcagcagcagcagcagcagcagcagcagcagcagcagcagcagcagcagcaggccgcctctgtggcccctgtgcccaccatgcccccagccctgcagcccttccctgcccctgtgggcccctttgatgctgccccagcccaggtggccgtgttcctgcccccaccccacatgcagcccccatttgtgcctgcctacccaggcctgggctacccacccatgccccgggtgcctgtggtgggcatcacccccagccagatggtggccaatgccttctgcagcgctgcccagctgcagccccagcctgccaccctgctgggcaaggccggggccttccccccaccagccatccccagcgcccctggcagccaggcccggccccggcccaatggagccccctggcccccagagcccgccccagccccagcccctgagctggacccctttgaggcccagtgggccgccctggagggcaaggccaccgtggagaagcccagcaaccccttcagcggggacctgcagaagacctttgaaattgagctgtag

SEQ ID NO: 162652 - DNA, 1446 bp, Artificial Sequence
  Description of Artificial Sequence: Synthetic coding sequence
atgaagggccggggcatgctggtgctgctgctgcatgctgtggtgctgggcctgcccagcgcctgggccgtgggcgcctgtgcccgggcctgcccagctgcctgtgcctgcagcacagtggagcggggctgcagcgtgcgctgtgacagagctggcctgctgcgggtgcctgctgagctgccctgtgaggccgtgtccattgacctggacagaaatggcctgcgcttcctgggggagcgggccttcggcaccctgcccagcctgcggcggctgagcctgcggcacaacaacctgtccttcatcacccctggggccttcaagggcctgccccggctggccgagctgcggctggcccacaacggggacctgcgctacctgcacgcccggacctttgctgccctgagccggctgcggcggctggacctggccgcctgccgcctcttctctgtgcctgagcggctgctggccgagctgcctgccctgcgggagctggccgcctttgacaacctcttccggcgggtgcctggggccctgcggggcctggccaacctgacccacgcccacctggagcggggccgcatcgaggccgtggccagcagcagcctgcagggcctgcggcggctgcggagcctgagcctgcaggccaacagagtgcgggctgtgcatgctggggccttcggggactgtggggtgctggagcacctgctgctgaatgacaacctgctggccgagctgcctgcagatgccttccggggcctgcggcggctgcggaccctgaacctgggcggcaatgccctggacagagtggcccgggcctggtttgctgacctggccgagctggagctgctgtacctggacagaaattccatcgcctttgtggaggagggcgccttccagaacctgagcggcctgctggccctgcacctgaatggaaaccggctgactgtgctggcctgggtggccttccagcccggcttcttcctgggccgcctcttcctgttcaggaacccctggtgctgtgactgccgcctggagtggctgcgggactggatggagggcagcggccgggtgacagatgtgccctgtgccagccctggctctgtggccggcctggacctgagccaggtgaccttcggccgcagcagtgatggcctgtgtgtggaccctgaggagctgaacctgaccaccagcagccctggccccagccctgagcctgctgccaccaccgtgagccgcttcagcagcctgctgagcaagctgctggccccccgggtgcctgtggaggaggccgccaacaccaccggcggcctggccaatgccagcctgagtgacagcctgagcagccggggcgtgggcggggccggccggcagccctggttcctgctggccagctgcctgctgcccagcgtggcccagcacgtggtgtttggcctgcagatggactag

SEQ ID NO: 162653 - DNA, 1446 bp, Artificial Sequence; identical to SEQ ID NO: 162652
  Description of Artificial Sequence: Synthetic coding sequence

SEQ ID NO: 162654 - DNA, 1191 bp, Artificial Sequence
  Description of Artificial Sequence: Synthetic coding sequence
atgccacccaagaagggaggagatggcatcaagcccccacccatcatcggccgcttcggcaccagcctgaagattggaattgtgggcctgcccaacgtgggcaagagcaccttcttcaacgtgctgaccaacagccaggccagcgctgagaacttccccttctgcaccatcgaccccaatgaaagccgggtgcctgtgcctgatgaaagatttgacttcctgtgccagtaccacaagccagccagcaagatcccagccttcctgaatgtggtggacattgctggcctggtgaagggggcccacaacggccagggcctgggcaatgccttcctgagccacatcagcgcctgtgatggcatcttccacctgacccgggcctttgaagatgatgacatcacccacgtggagggctctgtggaccccatccgggacatcgagatcatccacgaggagctgcagctgaaggatgaggagatgattggccccatcatcgacaagctggagaaggtggccgtgcggggcggggacaagaagctgaagccagaatatgacatcatgtgcaaggtgaagtcctgggtgattgaccagaagaagcctgtgcgcttctaccatgactggaatgacaaggagattgaggtgctgaacaagcacctgttcctgaccagcaagcccatggtgtacctggtgaacctgtctgagaaggactacatcaggaagaagaacaagtggctgatcaagatcaaggagtgggtggacaagtatgaccccggggccctggtgatccccttcagcggggccctggagctgaagctgcaggagctgtctgctgaggagcggcagaagtacctggaggccaacatgacccagagcgccctgcccaagatcatcaaggccggctttgctgccctgcagctggagtacttcttcaccgctggcccagatgaggtgcgggcctggaccatcaggaagggcaccaaggccccccaggccgccggcaagatccacacagactttgagaagggcttcatcatggccgaggtgatgaagtatgaggacttcaaggaggagggctctgaaaatgctgtgaaggctgctgggaagtaccggcagcagggcaggaactacatcgtggaggatggagacatcatcttcttcaagttcaacaccccccagcagcccaagaagaagtag

SEQ ID NO: 162655 - DNA, 717 bp, Artificial Sequence
  Description of Artificial Sequence: Synthetic coding sequence
atgattggccccatcatcgacaagctggagaaggtggccgtgcggggcggggacaagaagctgaagccagaatatgacatcatgtgcaaggtgaagtcctgggtgattgaccagaagaagcctgtgcgcttctaccatgactggaatgacaaggagattgaggtgctgaacaagcacctgttcctgaccagcaagcccatggtgtacctggtgaacctgtctgagaaggactacatcaggaagaagaacaagtggctgatcaagatcaaggagtgggtggacaagtatgaccccggggccctggtgatccccttcagcggggccctggagctgaagctgcaggagctgtctgctgaggagcggcagaagtacctggaggccaacatgacccagagcgccctgcccaagatcatcaaggccggctttgctgccctgcagctggagtacttcttcaccgctggcccagatgaggtgcgggcctggaccatcaggaagggcaccaaggccccccaggccgccggcaagatccacacagactttgagaagggcttcatcatggccgaggtgatgaagtatgaggacttcaaggaggagggctctgaaaatgctgtgaaggctgctgggaagtaccggcagcagggcaggaactacatcgtggaggatggagacatcatcttcttcaagttcaacaccccccagcagcccaagaagaagtag

SEQ ID NO: 162656 - DNA, 1251 bp, Artificial Sequence
  Description of Artificial Sequence: Synthetic coding sequence
atgagcaggaccttcagcgccaagggcggccgggacctggtggagggcccccagtacctgatgccacccaagaagggaggagatggcatcaagcccccacccatcatcggccgcttcggcaccagcctgaagattggaattgtgggcctgcccaacgtgggcaagagcaccttcttcaacgtgctgaccaacagccaggccagcgctgagaacttccccttctgcaccatcgaccccaatgaaagccgggtgcctgtgcctgatgaaagatttgacttcctgtgccagtaccacaagccagccagcaagatcccagccttcctgaatgtggtggacattgctggcctggtgaagggggcccacaacggccagggcctgggcaatgccttcctgagccacatcagcgcctgtgatggcatcttccacctgacccgggcctttgaagatgatgacatcacccacgtggagggctctgtggaccccatccgggacatcgagatcatccacgaggagctgcagctgaaggatgaggagatgattggccccatcatcgacaagctggagaaggtggccgtgcggggcggggacaagaagctgaagccagaatatgacatcatgtgcaaggtgaagtcctgggtgattgaccagaagaagcctgtgcgcttctaccatgactggaatgacaaggagattgaggtgctgaacaagcacctgttcctgaccagcaagcccatggtgtacctggtgaacctgtctgagaaggactacatcaggaagaagaacaagtggctgatcaagatcaaggagtgggtggacaagtatgaccccggggccctggtgatccccttcagcggggccctggagctgaagctgcaggagctgtctgctgaggagcggcagaagtacctggaggccaacatgacccagagcgccctgcccaagatcatcaaggccggctttgctgccctgcagctggagtacttcttcaccgctggcccagatgaggtgcgggcctggaccatcaggaagggcaccaaggccccccaggccgccggcaagatccacacagactttgagaagggcttcatcatggccgaggtgatgaagtatgaggacttcaaggaggagggctctgaaaatgctgtgaaggctgctgggaagtaccggcagcagggcaggaactacatcgtggaggatggagacatcatcttcttcaagttcaacaccccccagcagcccaagaagaagtag

SEQ ID NO: 162657 - DNA, 351 bp, Artificial Sequence
  Description of Artificial Sequence: Synthetic coding sequence
atgccacccaagaagggaggagatggcatcaagcccccacccatcatcggccgcttcggcaccagcctgaagattggaattgtgggcctgcccaacgtgggcaagagcaccttcttcaacgtgctgaccaacagccaggccagcgctgagaacttccccttctgcaccatcgaccccaatgaaagccgggtgcctgtgcctgatgaaagatttgacttcctgtgccagtaccacaagccagccagcaagatcccagccttcctgaatgtggtggacattgctggcctggtgaagggggcccacaacggccagggcctgggcaatgccttcctgagccacatcagcgcctag

SEQ ID NO: 162658 - DNA, 837 bp, Artificial Sequence
  Description of Artificial Sequence: Synthetic coding sequence
atgccacccaagaagggaggagatggcatcaagcccccacccatcatcggccgcttcggcaccagcctgaagattggaattgtgggcctgcccaacgtgggcaagagcaccttcttcaacgtgctgaccaacagccaggccagcgctgagaacttccccttctgcaccatcgaccccaatgaaagccgggtgcctgtgcctgatgaaagatttgacttcctgtgccagtaccacaagccagccagcaagatcccagccttcctgaatgtggtggacattgctggcctggtgaagggggcccacaacggccagggcctgggcaatgccttcctgagccacatcagcgcctgtgatggcatcttccacctgacccgggcctttgaagatgatgacatcacccacgtggagggctctgtggaccccatccgggacatcgagatcatccacgaggagctgcagctgaaggatgaggagatgattggccccatcatcgacaagctggagaaggtggccgtgcggggcggggacaagaagctgaagccagaatatgacatcatgtgcaaggtgaagtcctgggtgattgaccagaagaagcctgtgcgcttctaccatgactggaatgacaaggagattgaggtgctgaacaagcacctgttcctgaccagcaagcccatggtgtacctggtgaacctgtctgagaaggactacatcaggaagaagaacaagtggctgctggagagcacagacaacaaggccgagatcatcctgctgaagatggagatcctgagcagcagcaacctgacccacctgaacaacagaagaagaaacaagatctag

SEQ ID NO: 162659 - DNA, 312 bp, Artificial Sequence
  Description of Artificial Sequence: Synthetic coding sequence
atgattggccccatcatcgacaagctggagaaggtggccgtgcggggcggggacaagaagctgaagccagaatatgacatcatgtgcaaggtgaagtcctgggtgattgaccagaagaagcctgtgcgcttctaccatgactggaatgacaaggagattgaggtgctgaacaagcacctgttcctgaccagcaagcccatggtgtacctggtgaacctgtctgagaaggactacatcaggaagaagaacaagtggctgatcaagatcaaggagtgggtggacaagtatgaccccggggccctggtgatctag

SEQ ID NO: 162660 - DNA, 1329 bp, Artificial Sequence
  Description of Artificial Sequence: Synthetic coding sequence
atgtgtgagctgagcagagaagatgcccctgtgcgctggtacaaggatggcctggaggtggaggagagcgaggccctggtgctggagagagatggcccccgctgccgcctggtgctgcctgctgcccagccagaagatggaggagaatttgtgtgtgatgctggagatgacagcgccttcttcaccgtgacagtgacagcccctcctgagcgcatcgtgcaccctgctgcccggagcctggacctgcactttggagcccctggccgggtggagctgcgctgtgaggtggccccagctggcagccaggtgcgctggtacaaggatggcctggaggtggaggccagtgatgccctgcagctgggcgctgagggccccaccaggaccctgaccctgccccacgcccagccagaagatgctggggagtatgtgtgtgagaccaggcatgaggccatcaccttcaacgtcatcctggccgagccccctgtgcagttcctggccctggagaccacccccagccccctgtgtgtggcccctggagagcctgtggtgctgagctgtgagctgagcagagctggggcccctgtggtgtggagccacaacggccggcctgtgcaggagggggagggcctggagctgcacgccgagggcccccggcgggtgctgtgcatccaggccgccggccctgcccatgctggcctgtacacctgccagagcggggccgcccctggggcccccagcctgtccttcaccgtgcaggtggccgagcccctgctggtgaagctggtgtctgagctgacccccctgactgtgcatgaaggagatgatgccaccttccgctgtgaggtgagccccccagatgctgatgtgacctggctgagaaatggagctgtggtgaccccaggcccccaggtggagatggcccagaatggcagcagccgcatcctgaccctgcggggctgccagctgggagatgctggcaccgtgaccctgcgggccggcagcacagccaccagcgcccggctgcacgtgcgggagacagagctgctcttcctgcggcggctgcaggatgtgcgggcagaggagggccaggatgtgtgcctggaggtggagaccggccgggtgggcgctgctggagctgtgcgctgggtgcggggcggccagcccctgccccatgacagccggctgtccatggcccaggacggccacatccacaggctcttcatccatggagtcatcctggccgaccagggcacctacggctgtgagagccaccacgacaggaccctggcccggctgtctgtgagaagagaatgtcctgtgctgtcctag

SEQ ID NO: 162661 - DNA, 4206 bp, Artificial Sequence
  Description of Artificial Sequence: Synthetic coding sequence
atgaaggccagcagcggggaccagggcagccccccctgcttcctgcgcttccccaggcctgtgcgggtggtgtctggagctgaggccgagctgaagtgtgtggtgctgggggagcccccacctgtggtggtgtgggagaagggcggccagcagctggccgccagcgagcggctgtccttcccagcagatggagctgagcacggcctgctgctgacagctgccctgcccacagatgctggggtgtatgtgtgccgggccagaaatgctgctggggaggcctatgctgctgctgctgtgacagtgctggagcccccagccagtgaccctgagctgcagcctgctgagcggcccctgcccagccctggcagcggggagggcgcccctgtgttcctgaccggccccaggagccagtgggtgctgcggggagctgaggtggtgctgacctgcagagctgggggcctgcctgagcccaccctgtactgggagaaggatggcatggccctggatgaggtgtgggacagcagccactttgccctgcagcccggccgggcagaagatggccctggggccagcctggccctgcgcatcctggccgcccggctgcctgacagcggcgtgtatgtgtgccacgccagaaatgcccacggccacgcccaggccggggccctgctgcaggtgcaccagcccccagagagccccccagctgaccctgatgaggccccagcccctgtggtggagcccctgaagtgtgcccccaagaccttctgggtgaatgaaggcaagcacgccaagttccgctgctacgtgatgggcaagccagagcctgagattgagtggcactgggagggccggcccctgctgcctgacagaagaaggctgatgtacagagacagagatggcggctttgtgctgaaggtgctgtactgccaggccaaggaccggggcctgtatgtgtgtgccgccaggaacagcgctggccagaccctgtctgctgtgcagctgcacgtgaaggagccccggctgcgcttcacccggcccctgcaggatgtggagggccgggagcacggcattgctgtgctggagtgcaaggtgcccaacagccgcatccccacagcctggttccgggaggaccagaggctgctgccctgcaggaaatatgagcagatcgaggagggcaccgtgagaagactcatcatccaccggctgaaggcagatgatgatggcatctacctgtgtgagatgaggggccgggtgaggacagtggccaacgtgacagtgaagggccccatcctgaagaggctgcccaggaagctggatgtgctggagggggagaatgctgtgctgctggtggagaccctggaggccggcgtggagggccgctggagcagagatggagaggagctgcctgtgatctgccagagcagcagcggccacatgcacgccctggtgctgcccggggtgacccgggaggatgctggggaggtgaccttcagcctgggcaacagcaggaccaccaccctgctgcgggtgaagtgtgtgaagcacagccccccaggcccccccatcctggccgagatgttcaagggccacaagaacacagtgctgctgacctggaagcccccagagcccgcccctgagacccccttcatctaccgcctggagcggcaggaggtgggcagcgaggactggatccagtgcttcagcattgagaaggccggggctgtggaggtgcctggggactgtgtgcccagcgagggggactaccgcttccgcatctgcaccgtgtctggccacggccgcagcccccacgtggtgttccacggcagcgcccacctggtgcccacagcccggctggtggccggcctggaggatgtgcaggtgtatgatggagaagatgctgtgttcagcctggacctgagcaccatcatccagggcacctggttcctgaatggagaggagctgaagagcaatgaacctgagggccaggtggagcccggggccctgcgctaccgcatcgagcagaagggcctgcagcacaggctcatcctgcatgctgtgaagcaccaggacagcggggccctggtgggcttcagctgccctggggtgcaggacagcgctgccctgaccatccaggagagccctgtgcacatcctgagcccccaggacagagtgtccctgaccttcaccaccagcgagcgggtggtgctgacctgtgagctgagccgggtggacttccctgccacctggtacaaggatggccagaaggtggaggagagcgagctgctggtggtgaagatggatggcaggaagcacaggctcatcctgcctgaggccaaggtgcaggacagcggggagtttgaatgtagaacagagggcgtgtctgccttctttggagtgacagtgcaggacccccctgtgcacatcgtggacccccgggagcacgtgtttgtgcacgccatcaccagtgaatgtgtgatgctggcctgtgaggtggaccgggaggatgcccctgtgcgctggtacaaggatggccaggaggtggaggagagtgactttgtggtgctggagaatgaaggcccccaccggcggctggtgctgcctgccacccagcccagtgatggaggagagttccagtgtgtggccggagatgaatgtgcctacttcaccgtgaccatcacagatgtgtcctcctggatcgtgtaccccagcggcaaggtgtatgtggccgctgtgcggctggagcgggtggtgctgacctgtgagctgtgccggccctgggccgaggtgcgctggaccaaggatggagaggaggtggtggagagccctgccctgctgctgcagaaggaggacacagtgcggcggctggtgctgcctgctgtgcagctggaggacagcggggagtacctgtgtgaaattgatgatgagagcgccagcttcaccgtgacagtgacagagccccctgtgcgcatcatctaccccagagatgaggtgaccctgattgctgtgaccctggagtgtgtggtgctgatgtgtgagctgagccgggaggatgcccctgtgcgctggtacaaggatggcctggaggtggaggagagcgaggccctggtgctggagagagatggcccccgctgccgcctggtgctgcctgctgcccagccagaagatggaggagaatttgtgtgtgatgctggagatgattctgccttcttcaccgtgacagtgacagagccccctgtgcagttcctggccctggagaccacccccagccccctgtgtgtggcccctggagagcctgtggtgctgagctgtgagctgagccgggccggggcccctgtggtgtggagccacaacggccggcctgtgcaggagggggagggcctggagctgcatgctgagggccccaggagagtgctgtgcatccaggccgccggccctgcccacgccggcctgtacacctgccagagcggggccgcccctggggcccccagcctgtccttcaccgtgcaggtggccgagccccctgtgcgggtggtggcccctgaggccgcccagaccagggtgcgcagcaccccaggaggagacctggagctggtggtgcacctgagcggccctgggggccctgtgcgctggtacaaggatggagagcggctggccagccagggccgggtgcagctggagcaggccggggcccggcaggtgctgcgggtgcagggcgcccggtctggagatgctggggagtacctgtgtgatgccccccaggacagccgcatcttcctggtgtctgtggaggagcccctgctggtgaagctggtgtctgagctgacccccctgactgtgcatgaaggagatgatgccaccttccgctgtgaggtgtccccaccagatgctgatgtgacctggctgagaaatggagctgtggtgaccccaggcccccagaggcagagctgctgcagctatggaggctgcaggatgtgtggccagaggaaggccaggatgtgtgtgtccaagtggaggcaggccgagtgggtgcagaggggcccctgtgccggctgtgaggtgggcagcccctgccccaccaccctggcctgcccctggcccaggatgggcaccagcacagccagcagctccatggtgtcctactggcccacccgggcccccacagctgcccgggccaccaccatcgccccctggccaggcagcgcctag

SEQ ID NO: 162662 - DNA, 3078 bp, Artificial Sequence
  Description of Artificial Sequence: Synthetic coding sequence
atgaaggccagcagcggggaccagggcagccccccctgcttcctgcgcttccccaggcctgtgcgggtggtgtctggagctgaggccgagctgaagtgtgtggtgctgggggagcccccacctgtggtggtgtgggagaagggcggccagcagctggccgccagcgagcggctgtccttcccagcagatggagctgagcacggcctgctgctgacagctgccctgcccacagatgctggggtgtatgtgtgccgggccagaaatgctgctggggaggcctatgctgctgctgctgtgacagtgctggagcccccagccagtgaccctgagctgcagcctgctgagcggcccctgcccagccctggcagcggggagggcgcccctgtgttcctgaccggccccaggagccagtgggtgctgcggggagctgaggtggtgctgacctgcagagctgggggcctgcctgagcccaccctgtactgggagaaggatggcatggccctggatgaggtgtgggacagcagccactttgccctgcagcccggccgggcagaagatggccctggggccagcctggccctgcgcatcctggccgcccggctgcctgacagcggcgtgtatgtgtgccacgccagaaatgcccacggccacgcccaggccggggccctgctgcaggtgcaccagcccccagagagccccccagctgaccctgatgaggccccagcccctgtggtggagcccctgaagtgtgcccccaagaccttctgggtgaatgaaggcaagcacgccaagttccgctgctacgtgatgggcaagccagagcctgagattgagtggcactgggagggccggcccctgctgcctgacagaagaaggctgatgtacagagacagagatggcggctttgtgctgaaggtgctgtactgccaggccaaggaccggggcctgtatgtgtgtgccgccaggaacagcgctggccagaccctgtctgctgtgcagctgcacgtgaaggagccccggctgcgcttcacccggcccctgcaggatgtggagggccgggagcacggcattgctgtgctggagtgcaaggtgcccaacagccgcatccccacagcctggttccgggaggaccagaggctgctgccctgcaggaaatatgagcagatcgaggagggcaccgtgagaagactcatcatccaccggctgaaggcagatgatgatggcatctacctgtgtgagatgaggggccgggtgaggacagtggccaacgtgacagtgaagggccccatcctgaagaggctgcccaggaagctggatgtgctggagggggagaatgctgtgctgctggtggagaccctggaggccggcgtggagggccgctggagcagagatggagaggagctgcctgtgatctgccagagcagcagcggccacatgcacgccctggtgctgcccggggtgacccgggaggatgctggggaggtgaccttcagcctgggcaacagcaggaccaccaccctgctgcgggtgaagtgtgtgaagcacagccccccaggcccccccatcctggccgagatgttcaagggccacaagaacacagtgctgctgacctggaagcccccagagcccgcccctgagacccccttcatctaccgcctggagcggcaggaggtgggcagcgaggactggatccagtgcttcagcattgagaaggccggggctgtggaggtgcctggggactgtgtgcccagcgagggggactaccgcttccgcatctgcaccgtgtctggccacggccgcagcccccacgtggtgttccacggcagcgcccacctggtgcccacagcccggctggtggccggcctggaggatgtgcaggtgtatgatggagaagatgctgtgttcagcctggacctgagcaccatcatccagggcacctggttcctgaatggagaggagctgaagagcaatgaacctgagggccaggtggagcccggggccctgcgctaccgcatcgagcagaagggcctgcagcacaggctcatcctgcatgctgtgaagcaccaggacagcggggccctggtgggcttcagctgccctggggtgcaggacagcgctgccctgaccatccaggagagccctgtgcacatcctgagcccccaggacagagtgtccctgaccttcaccaccagcgagcgggtggtgctgacctgtgagctgagccgggtggacttccctgccacctggtacaaggatggccagaaggtggaggagagcgagctgctggtggtgaagatggatggcaggaagcacaggctcatcctgcctgaggccaaggtgcaggacagcggggagtttgaatgtagaacagagggcgtgtctgccttctttggagtgacagtgcaggacccccctgtgcacatcgtggacccccgggagcacgtgtttgtgcacgccatcaccagtgaatgtgtgatgctggcctgtgaggtggaccgggaggatgcccctgtgcgctggtacaaggatggccaggaggtggaggagagtgactttgtggtgctggagaatgaaggcccccaccggcggctggtgctgcctgccacccagcccagtgatggaggagagttccagtgtgtggccggagatgaatgtgcctacttcaccgtgaccatcacagatgtgtcctcctggatcgtgtaccccagcggcaaggtgtatgtggccgctgtgcggctggagcgggtggtgctgacctgtgagctgtgccggccctgggccgaggtgcgctggaccaaggatggagaggaggtggtggagagccctgccctgctgctgcagaaggaggacacagtgcggcggctggtgctgcctgctgtgcagctggaggacagcggggagtacctgtgtgaaattgatgatgagagcgccagcttcaccgtgacagtgacagagagctaccagagccaggacagcagcaacaacaaccctgagctgtgtgtgctgctgaagaagcccaagacccggcggctgtggagccgcttccccccctggaggagaacagctggaacagaatag

SEQ ID NO: 162663 - DNA, 5691 bp, Artificial Sequence
  Description of Artificial Sequence: Synthetic coding sequence
atgaaggccagcagcggggaccagggcagccccccctgcttcctgcgcttccccaggcctgtgcgggtggtgtctggagctgaggccgagctgaagtgtgtggtgctgggggagcccccacctgtggtggtgtgggagaagggcggccagcagctggccgccagcgagcggctgtccttcccagcagatggagctgagcacggcctgctgctgacagctgccctgcccacagatgctggggtgtatgtgtgccgggccagaaatgctgctggggaggcctatgctgctgctgctgtgacagtgctggagcccccagccagtgaccctgagctgcagcctgctgagcggcccctgcccagccctggcagcggggagggcgcccctgtgttcctgaccggccccaggagccagtgggtgctgcggggagctgaggtggtgctgacctgcagagctgggggcctgcctgagcccaccctgtactgggagaaggatggcatggccctggatgaggtgtgggacagcagccactttgccctgcagcccggccgggcagaagatggccctggggccagcctggccctgcgcatcctggccgcccggctgcctgacagcggcgtgtatgtgtgccacgccagaaatgcccacggccacgcccaggccggggccctgctgcaggtgcaccagcccccagagagccccccagctgaccctgatgaggccccagcccctgtggtggagcccctgaagtgtgcccccaagaccttctgggtgaatgaaggcaagcacgccaagttccgctgctacgtgatgggcaagccagagcctgagattgagtggcactgggagggccggcccctgctgcctgacagaagaaggctgatgtacagagacagagatggcggctttgtgctgaaggtgctgtactgccaggccaaggaccggggcctgtatgtgtgtgccgccaggaacagcgctggccagaccctgtctgctgtgcagctgcacgtgaaggagccccggctgcgcttcacccggcccctgcaggatgtggagggccgggagcacggcattgctgtgctggagtgcaaggtgcccaacagccgcatccccacagcctggttccgggaggaccagaggctgctgccctgcaggaaatatgagcagatcgaggagggcaccgtgagaagactcatcatccaccggctgaaggcagatgatgatggcatctacctgtgtgagatgaggggccgggtgaggacagtggccaacgtgacagtgaagggccccatcctgaagaggctgcccaggaagctggatgtgctggagggggagaatgctgtgctgctggtggagaccctggaggccggcgtggagggccgctggagcagagatggagaggagctgcctgtgatctgccagagcagcagcggccacatgcacgccctggtgctgcccggggtgacccgggaggatgctggggaggtgaccttcagcctgggcaacagcaggaccaccaccctgctgcgggtgaagtgtgtgaagcacagccccccaggcccccccatcctggccgagatgttcaagggccacaagaacacagtgctgctgacctggaagcccccagagcccgcccctgagacccccttcatctaccgcctggagcggcaggaggtgggcagcgaggactggatccagtgcttcagcattgagaaggccggggctgtggaggtgcctggggactgtgtgcccagcgagggggactaccgcttccgcatctgcaccgtgtctggccacggccgcagcccccacgtggtgttccacggcagcgcccacctggtgcccacagcccggctggtggccggcctggaggatgtgcaggtgtatgatggagaagatgctgtgttcagcctggacctgagcaccatcatccagggcacctggttcctgaatggagaggagctgaagagcaatgaacctgagggccaggtggagcccggggccctgcgctaccgcatcgagcagaagggcctgcagcacaggctcatcctgcatgctgtgaagcaccaggacagcggggccctggtgggcttcagctgccctggggtgcaggacagcgctgccctgaccatccaggagagccctgtgcacatcctgagcccccaggacagagtgtccctgaccttcaccaccagcgagcgggtggtgctgacctgtgagctgagccgggtggacttccctgccacctggtacaaggatggccagaaggtggaggagagcgagctgctggtggtgaagatggatggcaggaagcacaggctcatcctgcctgaggccaaggtgcaggacagcggggagtttgaatgtagaacagagggcgtgtctgccttctttggagtgacagtgcaggacccccctgtgcacatcgtggacccccgggagcacgtgtttgtgcacgccatcaccagtgaatgtgtgatgctggcctgtgaggtggaccgggaggatgcccctgtgcgctggtacaaggatggccaggaggtggaggagagtgactttgtggtgctggagaatgaaggcccccaccggcggctggtgctgcctgccacccagcccagtgatggaggagagttccagtgtgtggccggagatgaatgtgcctacttcaccgtgaccatcacagatgtgtcctcctggatcgtgtaccccagcggcaaggtgtatgtggccgctgtgcggctggagcgggtggtgctgacctgtgagctgtgccggccctgggccgaggtgcgctggaccaaggatggagaggaggtggtggagagccctgccctgctgctgcagaaggaggacacagtgcggcggctggtgctgcctgctgtgcagctggaggacagcggggagtacctgtgtgaaattgatgatgagagcgccagcttcaccgtgacagtgacagagccccctgtgcgcatcatctaccccagagatgaggtgaccctgattgctgtgaccctggagtgtgtggtgctgatgtgtgagctgagccgggaggatgcccctgtgcgctggtacaaggatggcctggaggtggaggagagcgaggccctggtgctggagagagatggcccccgctgccgcctggtgctgcctgctgcccagccagaagatggaggagaatttgtgtgtgatgctggagatgattctgccttcttcaccgtgacagtgacagcccctcctgagagaattgtgcaccctgctgcccggagcctggacctgcactttggagcccctggccgggtggagctgcgctgtgaggtggccccagctggcagccaggtgcgctggtacaaggatggcctggaggtggaggccagtgatgccctgcagctgggcgctgagggccccaccaggaccctgaccctgccccacgcccagccagaagatgctggggagtatgtgtgtgagaccaggcatgaggccatcaccttcaacgtcatcctggccgagccccctgtgcagttcctggccctggagaccacccccagccccctgtgtgtggcccctggagagcctgtggtgctgagctgtgagctgagccgggccggggcccctgtggtgtggagccacaacggccggcctgtgcaggagggggagggcctggagctgcatgctgagggccccaggagagtgctgtgcatccaggccgccggccctgcccacgccggcctgtacacctgccagagcggggccgcccctggggcccccagcctgtccttcaccgtgcaggtggccgagccccctgtgcgggtggtggcccctgaggccgcccagaccagggtgcgcagcaccccaggaggagacctggagctggtggtgcacctgagcggccctgggggccctgtgcgctggtacaaggatggagagcggctggccagccagggccgggtgcagctggagcaggccggggcccggcaggtgctgcgggtgcagggcgcccggtctggagatgctggggagtacctgtgtgatgccccccaggacagccgcatcttcctggtgtctgtggaggagcccctgctggtgaagctggtgtctgagctgacccccctgactgtgcatgaaggagatgatgccaccttccgctgtgaggtgtccccaccagatgctgatgtgacctggctgagaaatggagctgtggtgaccccaggcccccaggtggagatggcccagaatggcagcagccgcatcctgaccctgcggggctgccagctgggagatgctggcaccgtgaccctgcgggccggcagcacagccaccagcgcccggctgcacgtgcgggagacagagctgctcttcctgcggcggctgcaggatgtgcgggcagaggagggccaggatgtgtgcctggaggtggagaccggccgggtgggcgccgccggggctgtgcgctgggtgcggggcggccagcccctgccccatgacagccggctgtccatggcccaggacggccacatccacaggctcttcatccacggcgtcatcctggccgaccagggcacctacggctgtgagagccaccacgacaggaccctggcccggctgtctgtgcggccccggcagctgcgggtgctgcggcccctggaggatgtgaccatcagcgagggcggcagcgccaccttccagctggagctgagccaggagggcgtgactggagagtgggcccggggcggcgtgcagctgtacccaggccccaagtgccacatccacagtgatggccaccgccaccggctggtgctgaatggcctgggcctggccgacagcggctgtgtgtccttcaccgctgacagcctgcgctgtgccgcccggctgattgtgcgggaggtgcctgtgaccatcgtgcggggcccccatgacctggaggtgacagaaggagacacagccacctttgaatgtgagctgagccaggccctggctgatgtgacctgggagaaggatggaaatgccctgacccccagcccccggctgcggctgcaggccctgggcacccggcggctgctgcagctgcggcgctgtggccccagtgatgctggcacctacagctgtgctgtgggcacagcccgggccggccctgtgcggctgactgtgcgggagaggacagtggccgtgctgtctgagctgcggtctgtgtctgcccgggagggagatggagccacctttgaatgtactgtgtctgaggtggagaccaccggccgctgggagctgggcggccggcccctgcggcctggggcccgggtgcgcatccggcaggagggcaagaagcacatcctggtgctgtctgagctgcgggcagaagatgctggggaggtgcgcttccaggccggccctgcccagagcctggccctgctggaggtggaggccctgcccctgcagatgtgccgccaccccccccgggagaagacagtgctggtgggccggcgggctgtgctggaggtgacagtgagccgcagcggcggccacgtgtgctggctgcgggagggcgctgagctgtgccctggggacaagtatgagatgaggagccacggccccacccacagcctggtgattcatgatgtgcggcctgaggaccagggcacctactgctgccaggccggccaggacagcacccacacccggctgctggtggagggcaactag

SEQ ID NO: 162664 - DNA, 2682 bp, Artificial Sequence
  Description of Artificial Sequence: Synthetic coding sequence
atggagccccccctgcctgtgggcgcccagcccctggccaccgtggagggcatggagatgaagggccccctgcgggagccctgtgccctgaccctggcccagagaaatggccagtatgagctgatcatccagctgcacgagaaggagcagcacgtgcaggacatcatccccatcaacagccacttccgctgtgtgcaggaggccgaggagaccctgctgattgacatcgccagcaacagcggctgcaagatccgggtgcagggcgactggatccgggagaggagatttgagatcccagatgaggagcactgcctgaagttcctgtctgctgtgctggccgcccagaaggcccagagccagctgctggtgcctgagcagaaggacagcagctcctggtaccagaagctggacaccaaggacaagcccagcgtcttcagcggcctgctgggctttgaggacaacttcagctccatgaacctggacaagaagatcaacagccagaaccagcccaccggcatccaccgggagcccccacctccacccttctctgtgaacaagatgctgccccgggagaaggaggccagcaacaaggagcagcccaaggtgaccaacaccatgaggaagctgtttgtgcccaacacccagagcggccagcgggagggcctcatcaagcacatcctggccaagcgggagaaggagtatgtgaacatccagaccttccgcttctttgtgggcacctggaatgtgaatggccagagcccagacagcggcctggagccctggctgaactgtgaccccaaccccccagacatctactgcatcggcttccaggagctggacctgagcacagaggccttcttctactttgaatctgtgaaggagcaggagtggagcatggctgtggagcggggcctgcacagcaaggccaagtacaagaaggtgcagctggtgcggctggtgggcatgatgctgctgatctttgccaggaaggaccagtgccgctacatccgggacatcgccacagaaacagtgggcaccggcatcatgggcaagatgggcaacaagggcggcgtggccgtgcgctttgtgttccacaacaccaccttctgcatcgtgaacagccacctggccgcccacgtggaggactttgaaagaagaaaccaggactacaaggacatctgtgccaggatgagctttgtggtgcccaaccagaccctgccccagctgaacatcatgaagcatgaggtggtgatctggctgggggacctgaactaccgcctgtgcatgccagatgccaatgaggtgaagagcctcatcaacaagaaggacctgcagaggctgctgaagtttgaccagctgaacatccagaggacccagaagaaggcctttgtggacttcaatgaaggagagatcaagttcatccccacctacaagtatgacagcaagacagaccgctgggacagcagtggaaaatgtcgggtgcctgcctggtgtgaccgcatcctgtggaggggcaccaacgtgaaccagctgaactaccgcagccacatggagctgaagaccagtgaccacaagcctgtgtctgccctcttccacatcggcgtgaaggtggtggatgaaagacgctacaggaaggtgtttgaggacagcgtgcgcatcatggacaggatggagaatgacttcctgcccagcctggagctgagcagaagagaatttgtgtttgaaaatgtgaagttccggcagctgcagaaggagaagttccagatcagcaacaacggccaggtgccctgccacttctccttcatccccaagctgaatgacagccagtactgcaagccctggctgcgggcagagccctttgagggctacctggagcccaatgaaacagtggacatcagcctggatgtgtatgtgtccaaggacagcgtgaccatcctgaacagcggggaggacaagattgaggacatcctggtgctgcacctggaccggggcaaggactacttcctgaccatcagcggcaactacctgcccagctgcttcggcaccagcctggaggccctgtgcaggatgaagaggcccatccgggaggtgcctgtgaccaagctgattgacctggagaagagcctgctgcagatggtgcccctggatgagggcgccagcgagcggcccctgcaggtgcccaaggagatctggctgctggtggaccacctgttcaagtatgcctgccaccaggaggacctcttccagaccccaggcatgcaggaggagctgcagcagatcatcgactgcctggacaccagcatccctgagaccatccctggcagcaaccacagcgtggccgaggccctgctgatcttcctggaggccctgcctgagcctgtgatctgctatgagctgtaccagcgctgcctggacagcgcctatgacccccgcatctgccggcaggtgatcagccagctgccccgctgccacagaaatgtgttccgctacctgatggccttcctgcgggagctgctgaagttcagcgagtacaacagcgtgaatgccaacatgattgccaccctcttcaccagcctgctgctgcggcccccacccaacctgatggcccggcagacccccagcgaccggcagagggccatccagttcctgctgggcttcctgctgggcagcgaggaggactag

SEQ ID NO: 162665 - DNA, 2706 bp, Artificial Sequence
  Description of Artificial Sequence: Synthetic coding sequence
atggagccccccctgcctgtgggcgcccagcccctggccaccgtggagggcatggagatgaagggccccctgcgggagccctgtgccctgaccctggcccagagaaatggccagtatgagctgatcatccagctgcacgagaaggagcagcacgtgcaggacatcatccccatcaacagccacttccgctgtgtgcaggaggccgaggagaccctgctgattgacatcgccagcaacagcggctgcaagatccgggtgcagggcgactggatccgggagaggagatttgagatcccagatgaggagcactgcctgaagttcctgtctgctgtgctggccgcccagaaggcccagagccagctgctggtgcctgagcagaaggacagcagctcctggtaccagaagctggacaccaaggacaagcccagcgtcttcagcggcctgctgggctttgaggacaacttcagctccatgaacctggacaagaagatcaacagccagaaccagcccaccggcatccaccgggagcccccacctccacccttctctgtgaacaagatgctgccccgggagaaggaggccagcaacaaggagcagcccaaggtgaccaacaccatgaggaagctgtttgtgcccaacacccagagcggccagcgggagggcctcatcaagcacatcctggccaagcgggagaaggagtatgtgaacatccagaccttccgcttctttgtgggcacctggaatgtgaatggccagagcccagacagcggcctggagccctggctgaactgtgaccccaaccccccagacatctactgcatcggcttccaggagctggacctgagcacagaggccttcttctactttgaatctgtgaaggagcaggagtggagcatggctgtggagcggggcctgcacagcaaggccaagtacaagaaggtgcagctggtgcggctggtgggcatgatgctgctgatctttgccaggaaggaccagtgccgctacatccgggacatcgccacagaaacagtgggcaccggcatcatgggcaagatgggcaacaagggcggcgtggccgtgcgctttgtgttccacaacaccaccttctgcatcgtgaacagccacctggccgcccacgtggaggactttgaaagaagaaaccaggactacaaggacatctgtgccaggatgagctttgtggtgcccaaccagaccctgccccagctgaacatcatgaagcatgaggtggtgatctggctgggggacctgaactaccgcctgtgcatgccagatgccaatgaggtgaagagcctcatcaacaagaaggacctgcagaggctgctgaagtttgaccagctgaacatccagaggacccagaagaaggcctttgtggacttcaatgaaggagagatcaagttcatccccacctacaagtatgacagcaagacagaccgctgggacagcagtggaaaatgtcgggtgcctgcctggtgtgaccgcatcctgtggaggggcaccaacgtgaaccagctgaactaccgcagccacatggagctgaagaccagtgaccacaagcctgtgtctgccctcttccacatcggcgtgaaggtggtggatgaaagacgctacaggaaggtgtttgaggacagcgtgcgcatcatggacaggatggagaatgacttcctgcccagcctggagctgagcagaagagaatttgtgtttgaaaatgtgaagttccggcagctgcagaaggagaagttccagatcagcaacaacggccaggtgccctgccacttctccttcatccccaagctgaatgacagccagtactgcaagccctggctgcgggcagagccctttgagggctacctggagcccaatgaaacagtggacatcagcctggatgtgtatgtgtccaaggacagcgtgaccatcctgaacagcggggaggacaagattgaggacatcctggtgctgcacctggaccggggcaaggactacttcctgaccatcagcggcaactacctgcccagctgcttcggcaccagcctggaggccctgtgcaggatgaagaggcccatccgggaggtgcctgtgaccaagctgattgacctggaggaggacagcttcctggagaaggagaagagcctgctgcagatggtgcccctggatgagggcgccagcgagcggcccctgcaggtgcccaaggagatctggctgctggtggaccacctgttcaagtatgcctgccaccaggaggacctcttccagaccccaggcatgcaggaggagctgcagcagatcatcgactgcctggacaccagcatccctgagaccatccctggcagcaaccacagcgtggccgaggccctgctgatcttcctggaggccctgcctgagcctgtgatctgctatgagctgtaccagcgctgcctggacagcgcctatgacccccgcatctgccggcaggtgatcagccagctgccccgctgccacagaaatgtgttccgctacctgatggccttcctgcgggagctgctgaagttcagcgagtacaacagcgtgaatgccaacatgattgccaccctcttcaccagcctgctgctgcggcccccacccaacctgatggcccggcagacccccagcgaccggcagagggccatccagttcctgctgggcttcctgctgggcagcgaggaggactag

SEQ ID NO: 162666 - DNA, 2445 bp, Artificial Sequence
  Description of Artificial Sequence: Synthetic coding sequence
atgcacctggagggcagagatggaagacgctacccaggggccccagctgtggagctgctgcagacctctgtgcccagcggcctggccgagctggtggccggcaagaggcggctgcccaggggggccggcggcgctgaccccagccacagctgccccagaggagctgctggccagagctcctgggccccagctggccaggagtttgccagcttcctgaccaagggccgcagccacagcagcctgccccagatgagcagcagccgcagcaaggacagctgcttcacagagaacacccccctgctgaggaacagcctgcaggagaagggcagccgctgcatccctgtgtaccaccctgagttcatcacagctgaggagagctgggaggacagcagcgctgactgggagcggcgctacctgctgagccgggaggtgtctggcctgagcgccagcgccagcagcgagaagggggacctgctggacagcccccacatccggctgcggctgagcaagctgcggcgctgtgtgcagtggctgaaggtgatgggcctgtttgcctttgtggtgctgtgcagcatcctcttcagcctgtacccagaccagggcaagctgtggcagctgctggccctgagccccctggagaactacagcgtgaacctgagcagccacgtggacagcaccctgctgcaggtggacctggccggggccctggtggccagcggccccagccggcccggccgggaggagcacatcgtggtggagctgacccaggctgatgccctgggcagccgctggaggcggccccagcaggtgacccacaactggacagtgtacctgaaccccaggagaagtgagcacagcgtgatgagcaggacctttgaggtgctgacccgggagaccgtgtccatcagcatccgggccagcctgcagcagacccaggccgtgcccctgctgatggcccaccagtacctgcggggctctgtggagacccaggtgaccatcgccacagccatcctggccggcgtgtatgccctgatcatctttgagcggcccagcctgacccacgtggtggagtggattgactttgagaccctggccctgctgtttggcatgatgatcctggtggccatcttcagcgagaccggcttctttgactactgtgctgtgaaggcctaccgcctgagccggggccgggtgtgggccatgatcatcatgctgtgcctgattgctgctgtgctgagcgccttcctggacaacgtgaccaccatgctgctcttcacccctgtgaccatccggctgtgtgaggtgctgaacctggacccccggcaggtgctgattgctgaggtgatcttcaccaacattggaggagctgccacagccatcggggaccccccaaatgtcatcatcgtgagcaaccaggagctgaggaagatgggcctggactttgctggcttcaccgcccacatgttcatcggcatctgcctggtgctgctggtgtgcttccccctgctgcggctgctgtactggaacaggaagctgtacaacaaggagcccagcgagatcgtggagctgaagcatgagatccacgtgtggaggctgacagcccagaggatcagccctgccagccgggaggagacagctgtgcggcggctgctgctgggcaaggtgctggccctggagcacctgctggcccggcggctgcacaccttccaccggcagatcagccaggaggacaagaactgggagaccaacatccaggagctgcagaagaagcaccgcatcagtgatggcatcctgctggccaagtgcctgactgtgctgggcttcgtcatcttcatgttcttcctgaacagctttgtgcccggcatccacctggacctgggctggatcgccatcctgggcgccatctggctgctgatcctggccgacatccatgactttgagatcatcctgcaccgggtggagtgggccaccctgctcttctttgctgccctgtttgtgctgatggaggccctggcccacctgcacctgattgaatatgtgggggagcagacagccctgctgatcaagatggtgcctgaggagcagaggctgattgctgccatcgtgctggtggtgtgggtgtctgccctggccagcagcctgattgacaacatccccttcaccgccaccatgatccctgtgctgctgaacctgagccatgaccctgaggtgggcctgcctgccccacccctgatgtatgccctggccttcggggcctgcctgggcggcaatggcaccctgattggagccagcgccaacgtggtgtgtgccggcattgctgagcagcacggctacggcttctccttcatggagttcttccggctgggcttccccatgatggtggtgtcctgcaccgtgggcatgtgctacctgctggtggcccacgtggtggtgggctggaactag

SEQ ID NO: 162667 - DNA, 2517 bp, Artificial Sequence
  Description of Artificial Sequence: Synthetic coding sequence
atgcacctggagggcagagatggaagacgctacccaggggccccagctgtggagctgctgcagacctctgtgcccagcggcctggccgagctggtggccggcaagaggcggctgcccaggggggccggcggcgctgaccccagccacagctgccccagaggagctgctggccagagctcctgggccccagctggccaggagtttgccagcttcctgaccaagggccgcagccacagcagcctgccccagatgagcagcagccgcagcaaggacagctgcttcacagagaacacccccctgctgaggaacagcctgcaggagaagggcagccgctgcatccctgtgtaccaccctgagttcatcacagctgaggagagctgggaggacagcagcgctgactgggagcggcgctacctgctgagccgggaggtgtctggcctgagcgccagcgccagcagcgagaagggggacctgctggacagcccccacatccggctgcggctgagcaagctgcggcgctgtgtgcagtggctgaaggtgatgggcctgtttgcctttgtggtgctgtgcagcatcctcttcagcctgtacccagaccagggcaagctgtggcagctgctggccctgagccccctggagaactacagcgtgaacctgagcagccacgtggacagcaccctgctgcaggtggacctggccggggccctggtggccagcggccccagccggcccggccgggaggagcacatcgtggtggagctgacccaggctgatgccctgggcagccgctggaggcggccccagcaggtgacccacaactggacagtgtacctgaaccccaggagaagtgagcacagcgtgatgagcaggacctttgaggtgctgacccgggagaccgtgtccatcagcatccgggccagcctgcagcagacccaggccgtgcccctgctgatggcccaccagtacctgcggggctctgtggagacccaggtgaccatcgccacagccatcctggccggcgtgtatgccctgatcatctttgaaattgtgcacaggaccctggccgccatgctgggcagcctggccgccctggccgccctggccgtcatcggggaccggcccagcctgacccacgtggtggagtggattgactttgagaccctggccctgctgtttggcatgatgatcctggtggccatcttcagcgagaccggcttctttgactactgtgctgtgaaggcctaccgcctgagccggggccgggtgtgggccatgatcatcatgctgtgcctgattgctgctgtgctgagcgccttcctggacaacgtgaccaccatgctgctcttcacccctgtgaccatccggctgtgtgaggtgctgaacctggacccccggcaggtgctgattgctgaggtgatcttcaccaacattggaggagctgccacagccatcggggaccccccaaatgtcatcatcgtgagcaaccaggagctgaggaagatgggcctggactttgctggcttcaccgcccacatgttcatcggcatctgcctggtgctgctggtgtgcttccccctgctgcggctgctgtactggaacaggaagctgtacaacaaggagcccagcgagatcgtggagctgaagcatgagatccacgtgtggaggctgacagcccagaggatcagccctgccagccgggaggagacagctgtgcggcggctgctgctgggcaaggtgctggccctggagcacctgctggcccggcggctgcacaccttccaccggcagatcagccaggaggacaagaactgggagaccaacatccaggagctgcagaagaagcaccgcatcagtgatggcatcctgctggccaagtgcctgactgtgctgggcttcgtcatcttcatgttcttcctgaacagctttgtgcccggcatccacctggacctgggctggatcgccatcctgggcgccatctggctgctgatcctggccgacatccatgactttgagatcatcctgcaccgggtggagtgggccaccctgctcttctttgctgccctgtttgtgctgatggaggccctggcccacctgcacctgattgaatatgtgggggagcagacagccctgctgatcaagatggtgcctgaggagcagaggctgattgctgccatcgtgctggtggtgtgggtgtctgccctggccagcagcctgattgacaacatccccttcaccgccaccatgatccctgtgctgctgaacctgagccatgaccctgaggtgggcctgcctgccccacccctgatgtatgccctggccttcggggcctgcctgggcggcaatggcaccctgattggagccagcgccaacgtggtgtgtgccggcattgctgagcagcacggctacggcttctccttcatggagttcttccggctgggcttccccatgatggtggtgtcctgcaccgtgggcatgtgctacctgctggtggcccacgtggtggtgggctggaactag

SEQ ID NO: 162668 - DNA, 2007 bp, Artificial Sequence
  Description of Artificial Sequence: Synthetic coding sequence
atgcacctggagggcagagatggaagacgctacccaggggccccagctgtggagctgctgcagacctctgtgcccagcggcctggccgagctggtggccggcaagaggcggctgcccaggggggccggcggcgctgaccccagccacagctgccccagaggagctgctggccagagctcctgggccccagctggccaggagtttgccagcttcctgaccaagggccgcagccacagcagcctgccccagatgagcagcagccgcagcaaggacagctgcttcacagagaacacccccctgctgaggaacagcctgcaggagaagggcagccgctgcatccctgtgtaccaccctgagttcatcacagctgaggagagctgggaggacagcagcgctgactgggagcggcgctacctgctgagccgggaggtgtctggcctgagcgccagcgccagcagcgagaagggggacctgctggacagcccccacatccggctgcggctgagcaagctgcggcgctgtgtgcagtggctgaaggtgatgggcctgtttgcctttgtggtgctgtgcagcatcctcttcagcctgtacccagaccagggcaagctgtggcagctgctggccctgagccccctggagaactacagcgtgaacctgagcagccacgtggacagcaccctgctgcaggtggacctggccggggccctggtggccagcggccccagccggcccggccgggaggagcacatcgtggtggagctgacccaggctgatgccctgggcagccgctggaggcggccccagcaggtgacccacaactggacagtgtacctgaaccccaggagaagtgagcacagcgtgatgagcaggacctttgaggtgctgacccgggagaccgtgtccatcagcatccgggccagcctgcagcagacccaggccgtgcccctgctgatggcccaccagtacctgcggggctctgtggagacccaggtgaccatcgccacagccatcctggccggcgtgtatgccctgatcatctttgaaattgtgcacaggaccctggccgccatgctgggcagcctggccgccctggccgccctggccgtcatcggggaccggcccagcctgacccacgtggtggagtggattgactttgagaccctggccctgctgtttggcatgatgatcctggtggccatcttcagcgagaccggcttctttgactactgtgctgtgaaggcctaccgcctgagccggggccgggtgtgggccatgatcatcatgctgtgcctgattgctgctgtgctgagcgccttcctggacaacgtgaccaccatgctgctcttcacccctgtgaccatccggctgtgtgaggtgctgaacctggacccccggcaggtgctgattgctgaggtgatcttcaccaacattggaggagctgccacagccatcggggaccccccaaatgtcatcatcgtgagcaaccaggagctgaggaagatgggcctggactttgctggcttcaccgcccacatgttcatcggcatctgcctggtgctgctggtgtgcttccccctgctgcggctgctgtactggaacaggaagctgtacaacaaggagcccagcgagatcgtggagctgaagcatgagatccacgtgtggaggctgacagcccagaggatcagccctgccagccgggaggagacagctgtgcggcggctgctgctgggcaaggtgctggccctggagcacctgctggcccggcggctgcacaccttccaccggcagatcagccaggaggacaagaactgggagaccaacatccaggagctgcagaagaagcaccgcatcagtgatggcatcctgctggccaagtgcctgactgtgctgggcttcgtcatcttcatgttcttcctgaacagctttgtgcccggcatccacctggacctgggcggcctgggcctggtgcaggccggccgctactacctgagcaccccagagagctag

SEQ ID NO: 162669 - DNA, 795 bp, Artificial Sequence
  Description of Artificial Sequence: Synthetic coding sequence
atgcacctggagggcagagatggaagacgctacccaggggccccagctgtggagctgctgcagacctctgtgcccagcggcctggccgagctggtggccggcaagaggcggctgcccaggggggccggcggcgctgaccccagccacagctgccccagaggagctgctggccagagctcctgggccccagctggccaggagtttgccagcttcctgaccaagggccgcagccacagcagcctgccccagatgagcagcagccgcagcaaggacagctgcttcacagagaacacccccctgctgaggaacagcctgcaggagaagggcagccgctgcatccctgtgtaccaccctgagttcatcacagctgaggagagctgggaggacagcagcgctgactgggagcggcgctacctgctgagccgggaggtgtctggcctgagcgccagcgccagcagcgagaagggggacctgctggacagcccccacatccggctgcggctgagcaagctgcggcgctgtgtgcagtggctgaaggtgatgggcctgtttgcctttgtggtgctgtgcagcatcctcttcagcctgtacccagaccagggcaagctgtggcagctgctggccctgagccccctggagaactacagcgtgaacctgagcagccacgtggacagcaccctgctgcaggtggacctggccggggccctggtggccagcggccccagccggcccggccgggaggagcacatcgtggtggagctgacccaggctgatgccctgggcagccgctggtag

SEQ ID NO: 162670 - DNA, 657 bp, Artificial Sequence
  Description of Artificial Sequence: Synthetic coding sequence
atgcacctggagggcagagatggaagacgctacccaggggccccagctgtggagctgctgcagacctctgtgcccagcggcctggccgagctggtggccggcaagaggcggctgcccaggggggccggcggcgctgaccccagccacagctgccccagaggagctgctggccagagctcctgggccccagctggccaggagtttgccagcttcctgaccaagggccgcagccacagcagcctgccccagatgagcagcagccgcagcaaggacagctgcttcacagagaacacccccctgctgaggaacagcctgcaggagaagggcagccgctgcatccctgtgtaccaccctgagttcatcacagctgaggagagctgggaggacagcagcgctgactgggagcggcgctacctgctgagccgggaggtgtctggcctgagcgccagcgccagcagcgagaagggggacctgctggacagcccccacatccggctgcggctgagcaagctgcggcgctgtgtgcagtggctgaaggtgatgggcctgtttgcctttgtggtgctgtgcagcgtgacccacaactggacagtgtacctgaaccccaggagaagtgagcacagcgtgatgagcaggacctttgaggtgctgacctag

SEQ ID NO: 162671 - DNA, 801 bp, Artificial Sequence
  Description of Artificial Sequence: Synthetic coding sequence
atgggcagcaagaccctgcctgcccctgtgcccatccaccccagcctgcagctgaccaactacagcttcctgcaggccgtgaatggcctgcccaccgtgcccagcgaccacctgcccaacctgtatggcttcagcgccctgcatgctgtgcacctgcaccagtggaccctgggctacccagccatgcacctgcccaggagcagcttcagcaaggtgcccggcaccgtgagcagcctggtggatgcccgcttccagctgcctgccttcccctggttcccccacgtgatccagcccaagccagagatcacagctgggggctctgtgcctgccctgaagaccaagcccaggtttgattttgccaacctggccctggccgccacccaggaggaccctgccaagctgggccgcggggagggccctggcagccctgctgggggcctgggcgccctgctggatgtgaccaagctgagccctgagaagaagcccacccggggccgcctgcccagcaagaccaagaaggagtttgtgtgcaagttctgtggccgccacttcaccaagagctacaacctgctgattcatgagaggacccacacagatgagcggccctacacctgtgacatctgccacaaggccttccggcggcaggaccacctgcgggaccaccgctacatccacagcaaggagaagcccttcaagtgccaggagtgtgggaagggcttctgccagagcaggaccctggccgtgcacaagaccctgcacagccaggtgaaggagctgaagaccagcaagatcaagtgctag

SEQ ID NO: 162672 - DNA, 801 bp, Artificial Sequence; identical to SEQ ID NO: 162671
  Description of Artificial Sequence: Synthetic coding sequence

SEQ ID NO: 162673 - DNA, 939 bp, Artificial Sequence
  Description of Artificial Sequence: Synthetic coding sequence
atgggcagcaaggccctgcctgcccccatccccctgcaccccagcctgcagctgaccaactacagcttcctgcaggccgtgaacaccttccctgccaccgtggaccacctgcagggcctgtatggcctgtctgctgtgcagaccatgcacatgaaccactggaccctgggctaccccaacgtgcatgagatcaccaggagcaccatcacagagatggccgccgcccagggcctggtggatgcccgcttccccttccctgccctgcccttcaccacccacctgttccaccccaagcagggcgccatcgcccacgtgctgcctgccctgcacaaggaccggcccaggtttgattttgccaacctggccgtggccgccacccaggaggacccccccaagatgggagacctgagcaagctgagccctggcctgggcagccccatcagcggcctgagcaagctgaccccagacaggaagcccagccggggccgcctgcccagcaagaccaagaaggagttcatctgcaagttctgtggccgccacttcaccaagagctacaacctgctgatccacgagaggacccacacagatgagcggccctacacctgtgacatctgccacaaggccttccggcggcaggaccacctgcgggaccaccgctacatccacagcaaggagaagcccttcaagtgccaggagtgtgggaagggcttctgccagagcaggaccctggccgtgcacaagaccctgcacatgcaggagagcccccacaagtgccccacctgtggccgcaccttcaaccagaggagcaacctgaagacccacctgctgacccacacagacatcaagccctacagctgtgagcagtgtgggaaggtgttcagaagaaactgtgacctgcggcggcacagcctgacccacaccccccggcaggacttctag

SEQ ID NO: 162674 - DNA, 831 bp, Artificial Sequence
  Description of Artificial Sequence: Synthetic coding sequence
atgggcagcaaggccctgcctgcccccatccccctgcaccccagcctgcagctgaccaactacagcttcctgcaggccgtgaacaccttccctgccaccgtggaccacctgcagggcctgtatggcctgtctgctgtgcagaccatgcacatgaaccactggaccctgggctaccccaacgtgcatgagatcaccaggagcaccatcacagagatggccgccgcccagggcctggtggatgcccgcttccccttccctgccctgcccttcaccacccacctgttccaccccaagcagggcgccatcgcccacgtgctgcctgccctgcacaaggaccggcccaggtttgattttgccaacctggccgtggccgccacccaggaggacccccccaagatgggagacctgagcaagctgagccctggcctgggcagccccatcagcggcctgagcaagctgaccccagacaggaagcccagccggggccgcctgcccagcaagaccaagaaggagttcatctgcaagttctgtggccgccacttcaccaagagctacaacctgctgatccacgagaggacccacacagatgagcggccctacacctgtgacatctgccacaaggccttccggcggcaggaccacctgcgggaccaccgctacatccacagcaaggagaagcccttcaagtgccaggagtgtgggaagggcttctgccagagcaggaccctggccgtgcacaagaccctgcacatgcagaccagcagccccacagctgccagcagcgctgccaagtgcagcggggagaccgtcatctgtggcggcacagcctag

SEQ ID NO: 162675 - DNA, 1302 bp, Artificial Sequence
  Description of Artificial Sequence: Synthetic coding sequence
atgggcctgcgggcagaggagggcaagaggaagccacccaggtctgtgcggggggaggtgagccccagccagggccccctggcccaggaggatgaggcccggcggctgcggagctgcaccccagcctgccaccctgggaagaggggcaagggcggccaccgggcccggcggcagaggtctgcctgggacctgaccacccaccccctgacccacaggagccaggagctgcggggagctgctgccacagagggcttcctgtatgtgctgctgagccactgggtgtttgtgggcgccccccggcccccagccagtgacagctggaagaagggcctggtgcccagcgcccccccagccagcaggaagatgggcagcaaggccctgcctgcccccatccccctgcaccccagcctgcagctgaccaactacagcttcctgcaggccgtgaacaccttccctgccaccgtggaccacctgcagggcctgtatggcctgtctgctgtgcagaccatgcacatgaaccactggaccctgggctacccaaatgtgcatgagatcaccaggagcaccatcacagagatggctgctgcccagggcctggtggatgcccgcttccccttccctgccctgcccttcaccacccacctgttccaccccaagcagggcgccatcgcccacgtgctgcctgccctgcacaaggaccggcccaggtttgattttgccaacctggccgtggccgccacccaggaggacccccccaagatgggagacctgagcaagctgagccctggcctgggcagccccatcagcggcctgagcaagctgaccccagacaggaagcccagccggggccgcctgcccagcaagaccaagaaggagttcatctgcaagttctgtggccgccacttcaccaagagctacaacctgctgattcatgagaggacccacacagatgagcggccctacacctgtgacatctgccacaaggccttccggcggcaggaccacctgcgggaccaccgctacatccacagcaaggagaagcccttcaagtgccaggagtgtgggaagggcttctgccagagcaggaccctggccgtgcacaagaccctgcacatgcaggagagcccccacaagtgccccacctgtggccgcaccttcaaccagaggagcaacctgaagacccacctgctgacccacacagacatcaagccctacagctgtgagcagtgtgggaaggtgttcagaagaaactgtgacctgcggcggcacagcctgacccacaccccccggcaggacttctag

SEQ ID NO: 162676 - DNA, 642 bp, Artificial Sequence
  Description of Artificial Sequence: Synthetic coding sequence
atgggcagcaaggccctgcctgcccccatccccctgcaccccagcctgcagctgaccaactacagcttcctgcaggccgtgaacaccttccctgccaccgtggaccacctgcagggcctgtatggcctgtctgctgtgcagaccatgcacatgaaccactggaccctgggctaccccaacgtgcatgagatcaccaggagcaccatcacagagatggccgccgcccagggcctggtggatgcccgcttccccttccctgccctgcccttcaccacccacctgttccaccccaagcagggcgccatcgcccacgtgctgcctgccctgcacaaggaccggcccaggtttgattttgccaacctggccgtggccgccacccaggaggacccccccaagatgggagacctgagcaagctgagccctggcctgggcagccccatcagcggcctgagcaagctgaccccagacaggaagcccagccggggccgcctgcccagcaagaccaagaaggagttcatctgcaagttctgtggccgccacttcaccaagagctacaacctgctgatccacgagaggacccacacagatgagcggccctacacctgtgacatctgccacaaggccttccggcggcaggactag

SEQ ID NO: 162677 - DNA, 939 bp, Artificial Sequence; identical to SEQ ID NO: 162673
  Description of Artificial Sequence: Synthetic coding sequence

SEQ ID NO: 162678 - DNA, 687 bp, Artificial Sequence
  Description of Artificial Sequence: Synthetic coding sequence
atgaagaccctcttcctgggcgtgaccctgggcctggccgccgccctgtccttcaccctggaggaggaggacatcaccggcacctggtacgtgaaggccatggtggtggacaaggacttccctgaggaccggcggcccaggaaggtgtcccctgtgaaggtgacagccctgggcggcggcaacctggaggccaccttcaccttcatgagagaagatcgctgcatccagaagaagatcctgatgaggaagacagaggagcccgggaagttcagcgcctatggaggcaggaagctgatctacctgcaggagctgcctggaacagatgattatgtgttctactgcaaggaccagaggcggggcggcctgcgctacatgggcaagctggtggccagcgccccctgcagagctgtgcccctgagccccccctggctgacctggccaccccacctgcaggtgggcatcctgatccccacctggaggccctggaagaacctgaggaactggtgcagcacccgggacagcagaagaaggaccttcagctgcccctgccggcgggaggccgccttcagcaacacccggcagcccccaggcctgcacctgcagagccccccctaccaccagacccagagcccagaccacctggacctgcccagcagccatgaccccagcctgctgccccccacctag

SEQ ID NO: 162679 - DNA, 444 bp, Artificial Sequence
  Description of Artificial Sequence: Synthetic coding sequence
atgaagaccctcttcctgggcgtgaccctgggcctggccgccgccctgtccttcaccctggaggaggaggatgagggcggctctgtgcacccagaagaaaatccagatgctgaagatggaggagcctggcagatccagaggctgtggggccaggaggcccacatcccagctggagctgccagagatggccgcctgcggctgctgctgcagaggcctgccccctggggccctgccctgcacggcaaggcctgtggcatctgcagcctgcagggccgggctgctgtgcccaccctggcccacctggccaccagccctgctggcaggaaccccaacaccaacctggaggccctggaggagttcaagaagctggtgcagcacaagggcctgtctgaggaggacatcttcatgcccctgcagacaggcagctgtgtgctggagcactag

SEQ ID NO: 162680 - DNA, 513 bp, Artificial Sequence
  Description of Artificial Sequence: Synthetic coding sequence
atgaagaccctcttcctgggcgtgaccctgggcctggccgccgccctgtccttcaccctggaggaggaggacatcaccggcacctggtacgtgaaggccatggtggtggacaaggacttccctgaggaccggcggcccaggaaggtgtcccctgtgaaggtgacagccctgggcggcggcaacctggaggccaccttcaccttcatgagagaagatcgctgcatccagaagaagatcctgatgaggaagacagaggagcccgggaagttcagcgcctatggaggcaggaagctgatctacctgcaggagctgcctggaacagatgattatgtgttctactgcaaggaccagaggcggggcggcctgcgctacatgggcaagctggtgggcaggaaccccaacaccaacctggaggccctggaggagttcaagaagctggtgcagcacaagggcctgtctgaggaggacatcttcatgcccctgcagacaggcagctgtgtgctggagcactag

SEQ ID NO: 162681 - DNA, 513 bp, Artificial Sequence; identical to SEQ ID NO: 162680
  Description of Artificial Sequence: Synthetic coding sequence

SEQ ID NO: 162682 - DNA, 258 bp, Artificial Sequence
  Description of Artificial Sequence: Synthetic coding sequence
atgaagaccctcttcctgggcgtgaccctgggcctggccgccgccctgtccttcaccctggaggaggaggatgatggcccctgggtgcacccagaagaaaatccagatgctgaagatggaggagcctggcagatccagaggctgtggggccaggaggcccacgtgcctgctggagctgcccaggagggccccctgcacctgctgctgcagaggcctgccccctggggccctgccccccacggcaaggcctgtggctag

SEQ ID NO: 162683 - DNA, 513 bp, Artificial Sequence
  Description of Artificial Sequence: Synthetic coding sequence
atgaagaccctcttcctgggcgtgaccctgggcctggccgccgccctgtccttcaccctggaggaggaggacatcaccggcacctggtacgtgaaggccatggtggtggacaaggacttccctgaggaccggcggcccaggaaggtgtcccctgtgaaggtgacagccctgggcggcggcaagctggaggccaccttcaccttcatgagagaagatcgctgcatccagaagaagatcctgatgaggaagacagaggagcccgggaagtacagcgcctatggaggcaggaagctgatgtacctgcaggagctgccccggcgggaccactacatcttctactgcaaggaccagcaccacggcggcctgctgcacatgggcaagctggtgggcaggaacagcgacaccaaccgggaggccctggaggagttcaagaagctggtgcagaggaagggcctgtctgaggaggacatcttcacccccctgcagacaggcagctgtgtgcctgagcactag

SEQ ID NO: 162684 - DNA, 8310 bp, Artificial Sequence
  Description of Artificial Sequence: Synthetic coding sequence
atggatgtgaaggagaggaagccctaccgcagcctgaccaggagaagagatgctgagcggcgctacaccagcagcagcgctgacagcgaggagggcaaggccccccagaagagctacagcagcagcgagaccctgaaggcctatgaccaggatgcccggctggcctacggcagccgggtgaaggacatcgtgccccaggaggccgaggagttctgcaggactggagccaacttcaccctgcgggagctgggcctggaggaggtgaccccaccccacggcaccctgtacagaacagacatcggcctgccccactgcggctacagcatgggcgccggcagtgatgctgacatggaggccgacacagtgctgagccctgagcaccctgtgcggctgtggggccgcagcaccaggagcggccgcagcagctgcctgagcagccgggccaacagcaacctgaccctgacagacacagaacatgagaacacagaaacagaccaccctgggggcctgcagaaccacgcccggctgcggaccccacctccacccctgagccacgcccacacccccaaccagcaccacgccgccagcatcaacagcctgaacagaggcaacttcacccccaggagcaaccccagccctgcccccacagaccacagcctgtctggagagcccccagctgggggcgcccaggagcccgcccacgcccaggagaactggctgctgaacagcaacatccccctggagaccaggaacctgggcaagcagcccttcctgggcaccctgcaggacaacctgattgagatggacatcctgggcgccagcagacatgatggagcctacagtgatggccacttcctgttcaagccaggcggcaccagccccctcttctgcaccaccagccctggctaccccctgaccagcagcacagtgtacagccccccaccccggcccctgcccaggagcacctttgcccggcctgccttcaacctgaagaagcccagcaagtactgcaactggaagtgtgccgccctgagcgccatcgtcatcagcgccaccctggtgatcctgctggcctactttgtggccatgcacctgtttggcctgaactggcacctgcagcccatggagggccagatgtatgagatcacagaggacacagccagctcctggcctgtgcccacagatgtgtccctgtaccccagcggcggcaccggcctggagaccccagacaggaagggcaagggcaccacagagggcaagcccagcagcttcttcccagaagattccttcattgattctggagaaattgatgtgggccggcgggccagccagaagatccccccaggcaccttctggaggagccaggtgttcatcgaccaccctgtgcacctgaagttcaacgtgtccctgggcaaggccgccctggtgggcatctacggcaggaagggcctgccccccagccacacccagtttgattttgtggagctgctggatggccggcggctgctgacccaggaggcccggagcctggagggcaccccccggcagagccggggcaccgtgccccccagcagccatgagaccggcttcatccagtacctggacagcggcatctggcacctggccttctacaatgatggcaaggagagcgaggtggtgtccttcctgaccacagccatcgagagcgtggacaactgccccagcaactgctatggaaatggagactgcatcagcggcacctgccactgcttcctgggcttcctgggccctgactgtggccgggccagctgccctgtgctgtgcagcggaaatggccagtacatgaagggccgctgcctgtgccacagcggctggaagggagcagaatgtgatgtgcccaccaaccagtgcattgatgtggcctgcagcaaccacggcacctgcatcaccggcacctgcatctgcaaccctggctacaagggggagagctgtgaggaggtggactgcatggaccccacctgcagcggccggggcgtgtgtgtgagaggagagtgccactgcagcgtgggctggggcggcaccaactgtgagaccccccgggccacctgcctggaccagtgcagcggccacggcaccttcctgcctgacaccggcctgtgcagctgtgaccccagctggacaggccatgactgcagcattgagatctgtgccgctgactgtggcggccacggcgtgtgtgtgggcggcacctgccgctgtgaagatggctggatgggcgccgcctgtgaccagagggcctgccacccccgctgtgccgagcacggcacctgcagagatggaaaatgtgagtgcagccctggctggaatggagagcactgcaccatcgcccactacctggacagagtggtgaaggagggctgccccggcctgtgcaatggaaatggccgctgcaccctggacctgaatggctggcactgtgtgtgccagctgggctggaggggggccggctgtgacacctccatggagacagcctgtggggacagcaaggacaatgatggagatggcctggtggactgcatggaccctgactgctgcctgcagcccctgtgccacatcaaccccctgtgcctgggcagccccaaccccctggacatcatccaggagacccaggtgcctgtgtcccagcagaacctgcacagcttctatgaccgcatcaagttcctggtgggccgggacagcacccacatcatccctggagagaacccctttgatggcggccacgcctgcgtcatccggggccaggtgatgaccagtgatggcacccccctggtgggcgtgaacatcagctttgtgaacaaccccctgtttggctacaccatcagccggcaggacggcagctttgacctggtgaccaatggaggcatcagcatcatcctgcgctttgagcgggcccccttcatcacccaggagcacaccctgtggctgccctgggaccgcttctttgtgatggagaccatcatcatgagacatgaagaaaatgagatccccagctgtgacctgagcaactttgcccggcccaaccctgtggtgagccccagccccctgaccagctttgccagcagctgtgccgagaagggccccatcgtgcctgagatccaggccctgcaggaggagatcagcatcagcggctgcaagatgaggctgagctacctgagcagcaggaccccaggctacaagtctgtgctgcgcatcagcctgacccaccccaccatccccttcaacctgatgaaggtgcacctgatggtggccgtggagggccgcctcttcaggaagtggtttgctgctgccccagacctgagctactacttcatctgggacaagacagatgtgtacaaccagaaggtgtttggcctgtctgaggcctttgtgtctgtgggctatgaatatgagagctgcccagacctgatcctgtgggagaagaggaccaccgtgctgcagggctatgaaattgatgccagcaagctgggcggctggagcctggacaagcaccacgccctgaacatccagagcggcatcctgcacaagggaaatggagagaaccagtttgtgtcccagcagccccctgtgattggcagcatcatgggaaatggaagaagaagaagcatcagctgccccagctgcaatggcctggctgatggcaacaagctgctggcccctgtggccctgacctgtggcagtgatggcagcctgtatgtgggggacttcaactacatccgccgcatcttccccagcggaaatgtgaccaacatcctggagctgaggaacaaggacttccgccacagccacagccctgcccacaagtactacctggccacagaccccatgtctggagctgtgttcctgagtgacagcaacagccggcgggtcttcaagatcaagagcacagtggtggtgaaggacctggtgaagaacagcgaggtggtggccggcaccggggaccagtgcctgccctttgatgacacccgctgtggagatggcggcaaggccacagaggccaccctgaccaacccccggggcatcaccgtggacaagtttggcctcatctactttgtggatggcaccatgatcagaagaattgaccagaatggcatcatcagcaccctgctgggcagcaatgacctgaccagcgcccggcccctgagctgtgacagcgtgatggacatcagccaggtgcacctggagtggcccacagacctggccatcaaccccatggacaacagcctgtatgtgctggacaacaacgtggtgctgcagatcagcgagaaccaccaggtgcgcatcgtggccggccggcccatgcactgccaggtgcccggcatcgaccacttcctgctgagcaaggtggccatccacgccaccctggagagcgccacagccctggccgtgagccacaacggggtgctgtacatcgccgagacagatgagaagaagatcaaccgcatccggcaggtgaccaccagcggggagatcagcctggtggccggggcccccagcggctgtgactgcaagaatgatgccaactgtgactgcttctctggagatgatggctacgccaaggatgccaagctgaacacccccagcagcctggccgtgtgtgctgatggagagctgtatgtggccgacctgggcaacatccgcatccgcttcatcaggaagaacaagcccttcctgaacacccagaacatgtatgagctgagcagccccatcgaccaggagctgtacctgtttgacaccaccgggaagcacctgtacacccagagcctgcccactggagactacctgtacaacttcacctacacaggagatggagacatcaccctcatcacagacaacaatggaaacatggtgaatgtgcggcgggacagcacaggcatgcccctgtggctggtggtgcctgatggccaggtgtactgggtgaccatgggcaccaacagcgccctgaagtctgtgaccacccagggccacgagctggccatgatgacctaccacggcaacagcggcctgctggccaccaagagcaatgaaaatggctggaccaccttctatgaatatgacagctttggccgcctgaccaacgtgaccttccccaccggccaggtgtcctccttcagaagtgacacagacagctctgtgcacgtgcaggtggagaccagcagcaaggatgatgtgaccatcaccaccaacctgagcgccagcggggccttctacaccctgctgcaggaccaggtgagaaattcctactacatcggggctgatggcagcctgcggctgctgctggccaacggcatggaggtggccctgcagacagagccccacctgctggccggcaccgtgaaccccaccgtgggcaagagaaatgtgaccctgcccatcgacaatggcctgaacctggtggagtggaggcagaggaaggagcaggcccggggccaggtgacagtgtttggaagaaggctgcgggtgcacaacagaaacctgctgagcctggactttgacagagtgaccaggacagagaagatctatgatgaccacaggaagttcaccctgcgcatcctgtatgaccaggccggccggcccagcctgtggagccccagcagccggctgaatggagtgaatgtgacctacagccctgggggctacatcgccggcatccagaggggcatcatgtctgagaggatggagtatgaccaggccggccgcatcaccagccgcatctttgctgatggcaagacctggagctacacctacctggagaagtccatggtgctgctgctgcacagccagaggcagtacatctttgaatttgacaagaatgaccggctgagctctgtgaccatgcccaacgtggcccggcagaccctggagaccatccgctctgtgggctactacagaaacatctaccagcccccagagggcaatgccagcgtcatccaggacttcacagaagatggccacctgctgcacaccttctacctgggcaccggccggcgggtcatctacaagtatggcaagctgagcaagctggccgagaccctgtatgacaccaccaaggtgtccttcacctatgatgaaacagctggcatgctgaagaccatcaacctgcagaatgaaggcttcacctgcaccatccgctaccggcagatcggccccctgattgaccggcagatcttccgcttcacagaggagggcatggtgaatgccaggtttgactacaactatgacaacagcttccgggtgacctccatgcaggccgtcatcaatgagacccccctgcccatcgacctgtaccgctatgatgatgtgtctgggaagacagagcagtttgggaagtttggagtcatctactatgacatcaaccagatcatcaccacagctgtgatgacccacaccaagcactttgatgcctacggccgcatgaaggaggtgcagtatgagatcttccgcagcctgatgtactggatgacagtgcagtatgacaacatgggccgggtggtgaagaaggagctgaaggtgggcccctatgccaacaccacccgctacagctatgaatatgatgctgatggccagctgcagacagtgtccatcaatgacaagcccctgtggagatacagctatgacctgaatggaaacctgcacctgctgagccctggcaacagcgcccggctgacccccctgcgctatgacatccgggaccgcatcacccggctgggagatgtgcagtacaagatggatgaagatggcttcctgcggcagagaggaggagacatctttgagtacaacagcgctggcctgctgatcaaggcctacaacagagctggctcctggagcgtgcgctaccgctatgatggcctgggccggcgggtgagcagcaagagcagccacagccaccacctgcagttcttctatgctgacctgaccaaccccaccaaggtgacccacctgtacaaccacagcagcagcgagatcaccagcctgtactatgacctgcagggccacctgtttgccatggagctgagcagtggagatgagttctacatcgcctgtgacaacatcggcacccccctggccgtgttttctggaacaggcctgatgatcaagcagatcctgtacacagcctatggagagatctacatggacaccaaccccaacttccagatcatcatcggctaccatggaggcctgtatgaccccctgaccaagctggtgcacatgggccggcgggactatgatgtgctggccggccgctggaccagcccagaccacgagctgtggaagcacctgagcagcagcaatgtgatgcccttcaacctgtacatgttcaagaacaacaaccccatcagcaacagccaggacatcaagtgcttcatgacagatgtgaacagctggctgctgaccttcggcttccagctgcacaacgtcatccctggctaccccaagccagacatggatgccatggagcccagctatgagctgatccacacccagatgaagacccaggagtgggacaacagcaagagcatcctgggcgtgcagtgtgaggtgcagaagcagctgaaggcctttgtgaccctggagagatttgaccagctgtatggcagcaccatcaccagctgccagcaggcccccaagaccaagaagtttgccagcagcggctctgtgtttgggaagggcgtgaagtttgccctgaaggatggccgggtgaccacagacatcatctctgtggccaatgaagatggccggcgggtggccgccatcctgaaccacgcccactacctggagaacctgcacttcaccattgatggagtggacacccactactttgtgaagccaggccccagcgagggggacctggccatcctgggcctgagcggcggccgccgcaccctggagaatggagtgaatgtgacagtgtcccagatcaacacagtgctgaatggaagaacaagacgctacacagacatccagctgcagtacggggccctgtgcctgaacaccaggtatggcaccaccctggatgaggagaaggcccgggtgctggagctggcccggcagagagctgtgcggcaggcctgggcccgggagcagcagaggctgcgggagggggaggagggcctgcgggcctggacagaaggagagaagcagcaggtgctgagcacaggccgggtgcagggctatgatggcttctttgtgatctctgtggagcagtacccagagctgagtgacagcgccaacaacatccacttcatgaggcagagcgagatgggcagaagatag

SEQ ID NO: 162685 - DNA, 6 bp, Artificial Sequence
  Description of Artificial Sequence: Synthetic coding sequence
atgtag

SEQ ID NO: 162686 - DNA, 1404 bp, Artificial Sequence
  Description of Artificial Sequence: Synthetic coding sequence
atgcctggccgctggcgctggcagagggacatgcacccagccaggaagctgctgagcctgctcttcctgatcctgatgggcacagagctgacccaggtgctgcccaccaaccctgaggagagctggcaggtgtacagcagcgcccaggacagcgagggccgctgcatctgcaccgtggtggccccccagcagaccatgtgcagcagagatgcccggaccaagcagctgcggcagctgctggagaaggtgcagaacatgagccagagcattgaggtgctggacaggaggacccagagggacctgcagtatgtggagaagatggagaaccagatgaagggcctggagagcaagttcaagcaggtggaggagagccacaagcagcacctggcccggcagttcaaggccatcaaggccaagatggatgagctgcggcccctcatccctgtgctggaggagtacaaggcagatgccaagctggtgctgcagttcaaggaggaggtgcagaacctgacctctgtgctgaatgagctgcaggaggagattggagcctatgactatgatgagctgcagagccgggtgagcaacctggaggagcggctgcgggcctgcatgcagaagctggcctgtgggaagctgaccggcatcagtgaccctgtgacagtgaagaccagcggcagccgcttcggctcctggatgacagaccccctggcccctgagggggacaacagagtgtggtacatggatggctaccacaacaacagatttgtgcgggagtacaagtccatggtggacttcatgaacacagacaacttcaccagccaccggctgccccacccctggagcggcaccggccaggtggtgtacaacggcagcatctacttcaacaagttccagagccacatcatcatccgctttgacctgaagacagagaccatcctgaagaccaggagcctggactatgccggctacaacaacatgtaccactacgcctggggcggccacagcgacatcgacctgatggtggatgagagcggcctgtgggccgtgtatgccaccaaccagaatgccggcaacatcgtggtgtcccggctggaccctgtgtccctgcagaccctgcagacctggaacaccagctaccccaagaggtctgctggggaggccttcatcatctgtggcaccctgtatgtgaccaacggctacagcggcggcaccaaggtgcactacgcctaccagaccaatgccagcacctatgagtacatcgacatccccttccagaacaagtacagccacatctccatgctggactacaaccccaaggaccgggccctgtatgcctggaacaacggccaccagatcctgtacaacgtgaccctcttccacgtgatccgcagtgatgagctgtag

SEQ ID NO: 162687 - DNA, 408 bp, Artificial Sequence
  Description of Artificial Sequence: Synthetic coding sequence
atgcctggccgctggcgctggcagagggacatgcacccagccaggaagctgctgagcctgctcttcctgatcctgatgggcacagagctgacccaggtgctgcccaccaaccctgaggagagctggcaggtgtacagcagcgcccaggacagcgagggccgctgcatctgcaccgtggtggccccccagcagaccatgtgcagcagagatgcccggaccaagcagctgcggcagctgctggagaaggtgcagaacatgagccagagcattgaggtgctggacaggaggacccagagggacctgcagtatgtggagaagatggagaaccagatgaagggcctggagagcaagttcaagcaggtggaggagagccacaagcagcacctggcccggcagttcaagggctag

SEQ ID NO: 162688 - DNA, 1458 bp, Artificial Sequence
  Description of Artificial Sequence: Synthetic coding sequence
atgtctgtgcccctgctgaagattggagtggtgctgagcaccatggccatgatcaccaactggatgagccagaccctgcccagcctggtgggcctgaacaccaccaagctgtctgctgctgggggcggcaccctggacaggagcactggagtgctgcccaccaaccctgaggagagctggcaggtgtacagcagcgcccaggacagcgagggccgctgcatctgcaccgtggtggccccccagcagaccatgtgcagcagagatgcccggaccaagcagctgcggcagctgctggagaaggtgcagaacatgagccagagcattgaggtgctggacaggaggacccagagggacctgcagtatgtggagaagatggagaaccagatgaagggcctggagagcaagttcaagcaggtggaggagagccacaagcagcacctggcccggcagttcaaggccatcaaggccaagatggatgagctgcggcccctcatccctgtgctggaggagtacaaggcagatgccaagctggtgctgcagttcaaggaggaggtgcagaacctgacctctgtgctgaatgagctgcaggaggagattggagcctatgactatgatgagctgcagagccgggtgagcaacctggaggagcggctgcgggcctgcatgcagaagctggcctgtgggaagctgaccggcatcagtgaccctgtgacagtgaagaccagcggcagccgcttcggctcctggatgacagaccccctggcccctgagggggacaacagagtgtggtacatggatggctaccacaacaacagatttgtgcgggagtacaagtccatggtggacttcatgaacacagacaacttcaccagccaccggctgccccacccctggagcggcaccggccaggtggtgtacaacggcagcatctacttcaacaagttccagagccacatcatcatccgctttgacctgaagacagagaccatcctgaagaccaggagcctggactatgccggctacaacaacatgtaccactacgcctggggcggccacagcgacatcgacctgatggtggatgagagcggcctgtgggccgtgtatgccaccaaccagaatgccggcaacatcgtggtgtcccggctggaccctgtgtccctgcagaccctgcagacctggaacaccagctaccccaagaggtctgctggggaggccttcatcatctgtggcaccctgtatgtgaccaacggctacagcggcggcaccaaggtgcactacgcctaccagaccaatgccagcacctatgagtacatcgacatccccttccagaacaagtacagccacatctccatgctggactacaaccccaaggaccgggccctgtatgcctggaacaacggccaccagatcctgtacaacgtgaccctcttccacgtgatccgcagtgatgagctgtag

SEQ ID NO: 162689 - DNA, 1377 bp, Artificial Sequence
  Description of Artificial Sequence: Synthetic coding sequence
atgggagaggcccctggccgggagggccggggcccctgcccccagctggagagccccaggagaagaagagtgctgcccaccaaccctgaggagagctggcaggtgtacagcagcgcccaggacagcgagggccgctgcatctgcaccgtggtggccccccagcagaccatgtgcagcagagatgcccggaccaagcagctgcggcagctgctggagaaggtgcagaacatgagccagagcattgaggtgctggacaggaggacccagagggacctgcagtatgtggagaagatggagaaccagatgaagggcctggagagcaagttcaagcaggtggaggagagccacaagcagcacctggcccggcagttcaaggccatcaaggccaagatggatgagctgcggcccctcatccctgtgctggaggagtacaaggcagatgccaagctggtgctgcagttcaaggaggaggtgcagaacctgacctctgtgctgaatgagctgcaggaggagatcggggcctatgactatgatgagctgcagagccgggtgagcaacctggaggagcggctgcgggcctgcatgcagaagctggcctgtgggaagctgaccggcatcagtgaccctgtgacagtgaagaccagcggcagcagatttggctcctggatgacagaccccctggcccctgagggggacaacagagtgtggtacatggatggctaccacaacaacagatttgtgcgggagtacaagtccatggtggacttcatgaacacagacaacttcaccagccaccggctgccccacccctggagcggcaccggccaggtggtgtacaacggcagcatctacttcaacaagttccagagccacatcatcatccgctttgacctgaagacagagaccatcctgaagaccaggagcctggactatgccggctacaacaacatgtaccactacgcctggggcggccacagcgacatcgacctgatggtggatgaaagtggcctgtgggccgtgtatgccaccaaccagaatgccggcaacatcgtggtgtcccggctggaccctgtgtccctgcagaccctgcagacctggaacaccagctaccccaagaggtctgctggggaggccttcatcatctgtggcaccctgtatgtgaccaacggctacagcggcggcaccaaggtgcactacgcctaccagaccaatgccagcacctatgagtacatcgacatccccttccagaacaagtacagccacatctccatgctggactacaaccccaaggaccgggccctgtatgcctggaacaacggccaccagatcctgtacaacgtgaccctcttccacgtgatccgcagtgatgagctgtag

SEQ ID NO: 162690 - DNA, 462 bp, Artificial Sequence
  Description of Artificial Sequence: Synthetic coding sequence
atgtctgtgcccctgctgaagattggagtggtgctgagcaccatggccatgatcaccaactggatgagccagaccctgcccagcctggtgggcctgaacaccaccaagctgtctgctgctgggggcggcaccctggacaggagcactggagtgctgcccaccaaccctgaggagagctggcaggtgtacagcagcgcccaggacagcgagggccgctgcatctgcaccgtggtggccccccagcagaccatgtgcagcagagatgcccggaccaagcagctgcggcagctgctggagaaggtgcagaacatgagccagagcattgaggtgctggacaggaggacccagagggacctgcagtatgtggagaagatggagaaccagatgaagggcctggagagcaagttcaagcaggtggaggagagccacaagcagcacctggcccggcagttcaagggctag

SEQ ID NO: 162691 - DNA, 729 bp, Artificial Sequence
  Description of Artificial Sequence: Synthetic coding sequence
atgaacctgcacgtgaagaccctgagcctgatgacctggaggagccgcttcctggaggagagcttctggagcctggaggagacagctgccctggccaagcagctgcccctgaagagccccagcgagaacatcttcctgcacatcgtggacctgagtgaccccaagcagatctggaagtttgtggagaacttcaagcaggagcacaagctgcacgtgctgatcaacaatgccggctgcatggtgaacaagcgggagctgacagaagatggcctggagaagaactttgctgccaacaccctgggcgtgtacatcctgaccaccggcctcatccctgtgctggagaaggagcatgaccccagggtcatcaccgtgagcagcggcggcatgctggtgcagaagctgaacaccaatgacctgcagagcgagaggaccccatttgatggcaccatggtgtatgcccagaacaagaggcagcaggtggtgctgacagagcgctgggcccagggccacccagccatccacttcagctccatgcaccctggctgggccgacaccccaggagtgcggcaggccatgcctggcttccacgccaggtttggagaccggctgcggtctgaggcccagggcgctgacaccatgctgtggctggccctgagcagcgctgctgctgcccagcccagcggccgcttcttccagggcgacttcctgcccggctgtgagggcagctag

SEQ ID NO: 162692 - DNA, 492 bp, Artificial Sequence
  Description of Artificial Sequence: Synthetic coding sequence
atggctgaagatcggccccagcagccccagctggacatgcccctggtgctggaccagggcctgacccggcagatgaggctgcgggtggagagcctgaagcagagaggagagaagaggcaggatggagagaagctgctgcagcctgctgagagcgtgtaccgcctgaacttcacccagcagcagaggctgcagtttgagcgctggaatgtggtgctggacaagccaggcaaggtgaccatcaccggcaccagccagaactggaccccagacctgaccaacctgatgacccggcagctgctggaccccacagccatcttctggaggaaggaggacagtgatgccatcgactggaatgaagcagatgccctggagtttggagagcggctgagtgacctggccaagatcaggaaggtgatgtacttcctggtgacctttggagagggcgtggagcccgccaacctgaaggcctctgtggtgttcaaccagctgtag

SEQ ID NO: 162693 - DNA, 939 bp, Artificial Sequence
  Description of Artificial Sequence: Synthetic coding sequence
atggatggcggcaaccagagcgagggcagcgagttcctgctgctgggcatgtctgagagccctgagcagcagaggatcctcttctggatgttcctgtccatgtacctggtgacagtggtgggcaatgtgctgatcatcctggccatcagcagtgacagccggctgcacacccctgtgtacttcttcctggccaacctgtccttcacagacctcttctttgtgaccaacaccatccccaagatgctggtgaacctgcagagccacaacaaggccatctcctatgccggctgcctgacccagctgtacttcctggtgtccctggtggccctggacaacctgatcctggccgtgatggcctatgacagatatgtggccatctgctgccccctgcactacaccacagccatgagccccaagctgtgcatcctgctgctgagcctgtgctgggtgctgtctgtgctgtatggcctcatccacaccctgctgatgaccagggtgaccttctgtggcagcaggaagatccactacatcttctgtgagatgtatgtgctgctgaggatggcctgcagcaacatccagatcaaccacacagtgctgattgccaccggctgcttcatcttcctgatcccctttggatttgtgatcatctcctatgtgctgatcatccgggccatcctgcgcatccccagcgtgtccaagaagtacaaggccttcagcacctgtgccagccacctgggcgctgtgtccctcttctacggcaccctgtgcatggtgtacctgaagcccctgcacacctacagcgtgaaggacagcgtggccaccgtgatgtatgctgtggtgacccccatgatgaaccccttcatctacagcctgaggaacaaggacatgcatggagccctgggccgcctgctggacaagcacttcaagaggctgacctag

SEQ ID NO: 162694 - DNA, 939 bp, Artificial Sequence
  Description of Artificial Sequence: Synthetic coding sequence
atgagcggcaccaaccagagctctgtgtctgagttcctgctgctgggcctgagccggcagccccagcagcagcacctgctgtttgtgttcttcctgtccatgtacctggccaccgtgctgggcaacctgctgatcatcctgtctgtgtccattgacagctgcctgcacacccccatgtacttcttcctgagcaacctgagctttgtggacatctgcttctccttcaccaccgtgcccaagatgctggccaaccacatcctggagacccagaccatctccttctgtggctgcctgacccagatgtactttgtgttcatgtttgtggacatggacaacttcctgctggccgtgatggcctatgaccactttgtggccgtgtgccaccccctgcactacacagccaagatgacccaccagctgtgtgccctgctggtggccggcctgtgggtggtggccaacctgaatgtgctgctgcacaccctgctgatggcccccctgtccttctgtgccgacaatgccatcacccacttcttctgtgatgtgacccccctgctgaagctgagctgcagcgacacccacctgaatgaagtcatcatcctgtctgagggcgccctggtgatgatcacccccttcctgtgcatcctggccagctacatgcacatcacctgcaccgtgctgaaggtgcccagcaccaagggccgctggaaggccttcagcacctgtggcagccacctggccgtggtgctgctcttctacagcaccatcatcgctgtgtacttcaaccccctgagcagccacagcgctgagaaggacaccatggccaccgtgctgtacacagtggtgacccccatgctgaaccccttcatctacagcctgaggaaccgctacctgaagggggccctgaagaaggtggtgggccgggtggtgttttctgtgtag

SEQ ID NO: 162695 - DNA, 924 bp, Artificial Sequence
  Description of Artificial Sequence: Synthetic coding sequence
atgaaccacagcgtggtgacagagttcatcatcctgggcctgaccaagaagccagagctgcagggcatcatcttcctgttcttcctgattgtgtacctggtggccttcctgggcaacatgctgatcatcatcgccaagatctacaacaacaccctgcacacccccatgtatgtgttcctgctgaccctggccgtggtggacatcatctgcaccaccagcatcatccccaagatgctgggcaccatgctgaccagcgagaacaccatctcctatgccggctgcatgagccagctgttcctgttcacctggagcctgggcgctgagatggtgctcttcaccaccatggcctatgaccgctacgtggccatctgcttccccctgcactacagcaccatcatgaaccaccacatgtgtgtggccctgctgtccatggtgatggccatcgctgtgaccaacagctgggtgcacacagccctgatcatgaggctgaccttctgtggccccaacaccatcgaccacttcttctgtgagatcccccccctgctggccctgagctgcagccctgtgcgcatcaatgaggtgatggtgtatgtggccgacatcaccctggccatcggggacttcatcctgacctgcatctcctatggcttcatcatcgtggccatcctgcgcatcagaacagtggagggcaagaggaaggccttcagcacctgcagcagccacctgactgtggtgaccctgtactacagccctgtgatctacacctacatccggcctgccagcagctacacctttgagcgggacaaggtggtggccgccctgtacaccctggtgacccccaccctgaaccccatggtgtacagcttccagaaccgggagatgcaggccggcatcaggaaggtgtttgccttcctgaagcactag

SEQ ID NO: 162696 - DNA, 930 bp, Artificial Sequence
  Description of Artificial Sequence: Synthetic coding sequence
atggagaacagaaacaacatgacagaatttgtgctgctgggcctgacagagaaccccaagatgcagaagatcatctttgtggtgttcttcgtcatctacatcatcaccgtggtgggctacgtgctgattgtggtgaccatcacagccagccccagcctgggcagccccatgtacctgagcctggcctacctgtccttcattgatgcctgctacagctctgtgaacacccccaacctgatcacccacagcctgtatggcaagaaggccatcctcttcaacggctgcatgacccaggtgtttggagagcacttctttggaggagctgagggcatcctgctgactgtgatggcctatgaccactacgtggccatctgcaagcccctgcactacatgaccatcatgaaccagtgtgtgtgtgccctgctgatgggcgtggtgtggatgggcggcttcctgcacgccaccatccagatcctcttcatcttccagctgcccttctgtggccccaacgtcatcgaccacttcatgtgtgacctgaaccccctgctgaacctggcctgcacagacacccacatgctggagctgttcatcgccgccaacagcggcttcatctgcctgctgaactttgccctgctgctggtgtcctatgtggtgatcctgtgcagcctgcggacccacagcctggaggcccggcacaaggccctgagcacctgtgtgagccacatcaccgtggtgatcctcttctttgtgccctgcatctttgtgtacatgaggcctgctgccaccctgcccatcgacaaggctgtggccatcttctacaccatgatcacccccatgctgaaccccctcatctacaccctgaagaatgcccagatgaagaatgccatcaggaagctgtgcagcaggaaggacatcagcggggacaagtag

SEQ ID NO: 162697 - DNA, 978 bp, Artificial Sequence
  Description of Artificial Sequence: Synthetic coding sequence
atgttcctgtacctgtgcttcatcttccagaggacctgcagcgaggagatggaggaggagaatgccaccctgctgacagaatttgtgctgaccggcttcctgcaccagcctgactgcaagatccccctcttcctggccttcctggtgatctacctgatcaccatcatgggcaacctgggcctcatcgtgctgatctggaaggacccccacctgcacatccccatgtacctgttcctgggcagcctggcctttgtggatgccagcctgagcagcacagtgacccccaagatgctgatcaacttcctggccaagagcaagatgatcagcctgtctgagtgcatggtgcagttcttcagcctggtgaccaccgtgaccacagagtgcttcctgctggccaccatggcctatgacagatatgtggccatctgcaaggccctgctgtaccctgtgatcatgaccaatgagctgtgcatccagctgctggtgctgtccttcatcggcggcctgctgcacgccctgattcatgaggccttctccttccggctgaccttctgcaacagcaacatcatccagcacttctactgtgacatcatccccctgctgaagatcagctgcacagacagcagcatcaacttcctgatggtgttcatctttgctggctctgtgcaggtgttcaccatcggcaccatcctgatctcctacaccatcatcctcttcaccatcctggagaagaagagcatcaagggcatcaggaaggctgtgtccacctgtggggcccacctgctgtctgtgtccctgtactacggccccctgaccttcaagtacctgggcagcgccagcccccaggctgatgaccaggacatgatggagagcctcttctacacagtgattgtgcccctgctgaaccccatgatctacagcctgaggaacaagcaggtgattgccagcttcaccaagatgttcaagagcaatgtgtag

SEQ ID NO: 162698 - DNA, 963 bp, Artificial Sequence
  Description of Artificial Sequence: Synthetic coding sequence
atggagactggaaaccagacccacgcccaggagttcctgctgctgggcttcagcgccaccagcgagatccagttcatcctgtttggcctcttcctgtccatgtacctggtgaccttcaccggcaacctgctgatcatcctggccatctgcagcgacagccacctgcacacccccatgtacttcttcctgagcaacctgagctttgctgacctgtgcttcaccagcaccaccgtgcccaagatgctgctgaacatcctgacccagaacaagttcatcacctacgccggctgcctgagccagatcttcttcttcaccagctttggctgcctggacaacctgctgctgactgtgatggcctatgacagatttgtggccgtgtgccaccccctgcactacaccgtcatcatgaacccccagctgtgtggcctgctggtgctgggctcctggtgcatctctgtgatgggcagcctgctggagaccctgactgtgctgcggctgtccttctgcacagagatggagatcccccacttcttctgtgacctgctggaggtgctgaagctggcctgcagcgacaccttcatcaacaacgtggtgatctactttgccactggagtgctgggcgtcatctccttcaccggcatcttcttctcctactacaagatcgtgttcagcatcctgcgcatcagcagcgctggcaggaagcacaaggccttcagcacctgtggcagccacctgtctgtggtgaccctcttctacggcaccggcttcggcgtgtacctgagcagcgctgccacccccagcagcaggaccagcctggtggcctctgtgatgtacaccatggtgacccccatgctgaaccccttcatctacagcctgaggaacacagacatgaagagggccctgggccgcctgctgagccgggccaccttcttcaacggggacatcacagctggcctgtcctag

SEQ ID NO: 162699 - DNA, 960 bp, Artificial Sequence
  Description of Artificial Sequence: Synthetic coding sequence
atggagcggggcaaccagacagaggtgggcaacttcctgctgctgggctttgctgaagattctgacatgcagctgctgctgcacggcctcttcctgtccatgtacctggtgaccatcatcggcaacctgctgatcatcctgaccatcagcagtgacagccacctgcacacccccatgtacttcttcctgagcaacctgagctttgctgacatctgcttcaccagcaccaccgtgcccaagatgctggtgaacatccagacccagagcaagatgatcacctttgctggctgcctgacccagatcttcttcttcatcgccttcggctgcctggacaacctgctgctgaccatgacagcctatgacagatttgtggccatctgctaccccctgcactacaccgtcatcatgaacccccggctgtgtggcctgctggtgctgggctcctggtgcatctctgtgatgggcagcctgctggagaccctgaccatcctgcggctgtccttctgcaccaacatggagatcccccacttcttctgtgaccccagcgaggtgctgaagctggcctgcagcgacaccttcatcaacaacatcgtgatgtactttgtgaccatcgtgctgggcgtcttccccctgtgtggcatcctcttctcctacagccagatcttcagctctgtgctgcgggtgtctgcccggggccagcacaaggccttcagcacctgtggcagccacctgtctgtggtgtccctcttctatggaacaggcctgggcgtgtacctgagcagcgctgtgaccccacccagcaggaccagcctggccgcctctgtgatgtacaccatggtgacccccatgctgaaccccttcatctacagcctgaggaacaaggacatgaagggcagcctgggccgcctgctgctgcgggccaccagcctgaaggagggcaccatcgccaagctgtcctag

SEQ ID NO: 162700 - DNA, 939 bp, Artificial Sequence
  Description of Artificial Sequence: Synthetic coding sequence
atggaggccgagaacctgacagagctgagcaagttcctgctgctgggcctgagtgatgatcctgagctgcagcctgtgctgtttggcctcttcctgtccatgtacctggtgacagtgctgggcaacctgctgatcatcctggccgtgtccagtgacagccacctgcacacccccatgtacttcttcctgagcaacctgagctttgtggacatctgcttcatcagcaccaccgtgcccaagatgctggtgtccatccaggcccggagcaaggacatctcctacatgggctgcctgacccaggtgtacttcctgatgatgtttgctggcatggacaccttcctgctggccgtgatggcctatgacagatttgtggccatctgccaccccctgcactacaccgtcatcatgaacccctgcctgtgtggcctgctggtgctggcctcctggttcatcatcttctggttcagcctggtgcacatcctgctgatgaagaggctgaccttcagcactggaacagagatcccccacttcttctgtgagcccgcccaggtgctgaaggtggcctgcagcaacaccctgctgaacaacatcgtgctgtatgtggccacagccctgctgggcgtcttccctgtggccggcatcctcttctcctacagccagatcgtgagcagcctgatgggcatgagcagcaccaagggcaagtacaaggccttcagcacctgtggcagccacctgtgtgtggtgtccctcttctacggcaccggcctgggcgtgtacctgagcagcgctgtgacccacagcagccagagcagcagcacagcctctgtgatgtatgccatggtgacccccatgctgaaccccttcatctacagcctgaggaacaaggatgtgaagggggccctggagcggctgctgagcagagctgacagctgcccctag

SEQ ID NO: 162701 - DNA, 972 bp, Artificial Sequence
  Description of Artificial Sequence: Synthetic coding sequence
atggacagtgatgccagcctggtgagcagccggcccagcagccctgagccagatgacctcttcctgcctgcccggagcaagggcagcagcggcagcgccttcaccggcggcaccgtgagcagcagcacccccagcgactgccccccagagctgtctgctgagctgcggggggccatgggcagcgctggggcccaccctggggacaagctgggcggcagcggcttcaagagcagcagcagcagcaccagcagcagcaccagcagcgctgctgccagcagcaccaagaaggacaagaagcagatgacagagcctgagctgcagcagctgcggctgaagatcaacagccgggagaggaagaggatgcatgacctgaacatcgccatggatggcctgcgggaggtgatgccctatgcccacggccccagcgtgaggaagctgagcaagatcgccaccctgctgctggccaggaactacatcctgatgctgaccaacagcctggaggagatgaagaggctggtgtctgagatctatggaggccaccacgccggcttccaccccagcgcctgtggcggcctggcccacagcgcccccctgcctgctgccacagcccaccctgctgctgctgcccatgctgcccaccaccctgctgtgcaccaccccatcctgcccccagctgctgctgctgctgctgctgctgctgctgctgctgctgtgagcagcgccagcctgcccggcagcggcctgcccagcgtgggcagcatccggcccccccacggcctgctgaagagccccagcgctgctgctgctgcccccctgggcggcggcggcggcggcagcggggccagcggcggcttccagcactggggcggcatgccctgcccctgcagcatgtgccaggtgcccccaccccaccaccacgtgtctgccatgggcgccggcagcctgccccggctgaccagtgatgccaagtag

SEQ ID NO: 162702 - DNA, 972 bp, Artificial Sequence; identical to SEQ ID NO: 162701
  Description of Artificial Sequence: Synthetic coding sequence

SEQ ID NO: 162703 - DNA, 189 bp, Artificial Sequence
  Description of Artificial Sequence: Synthetic coding sequence
atggacagtgatgccagcctggtgagcagccggcccagcagccctgagccagatgacctcttcctgcctgcccggagcaagggcagcagcggcagcgccttcaccggcggcaccgtgagcagcagcacccccagcgactgccccccagagctgtctgctgagctgcggggggccatgggcagcgcctag

SEQ ID NO: 162704 - DNA, 1323 bp, Artificial Sequence
  Description of Artificial Sequence: Synthetic coding sequence
atggagtaccagatcctgaagatgagcctgtgcctcttcatcctgctcttcctgaccccaggcatcctgtgcatctgccccctgcagtgcatctgcacagagcggcaccgccacgtggactgcagcggcaggaacctgagcaccctgcccagcggcctgcaggagaacatcatccacctgaacctgagctacaaccacttcacagacctgcacaaccagctgacccagtacaccaacctgcggaccctggacatcagcaacaaccggctggagagcctgcctgcccacctgcccaggagcctgtggaacatgtctgctgccaacaacaacatcaagctgctggacaagagtgacacagcctaccagtggaacctgaagtacctggatgtgtccaagaacatgctggagaaggtggtgctgatcaagaacaccctgcggagcctggaggtgctgaacctgagcagcaacaagctgtggacagtgcccaccaacatgcccagcaagctgcacatcgtggacctgagcaacaacagcctgacccagatcctgcccggcaccctcatcaacctgaccaacctgacccacctgtacctgcacaacaacaagttcaccttcatcccagaccagagctttgaccagctgttccagctgcaggagatcaccctgtacaacaaccgctggagctgtgaccacaagcagaacatcacctacctgctgaagtggatgatggagaccaaggcccacgtgattggcaccccctgcagcacccagatcagcagcctgaaggagcacaacatgtaccccaccccatctggcttcaccagcagcctcttcaccgtgtctggcatgcagacagtggacaccatcaacagcctgtctgtggtgacccagcccaaggtgaccaagatccccaagcagtaccgcaccaaggagaccaccttcggggccaccctgagcaaggacaccaccttcaccagcacagacaaggcctttgtgccctacccagaggacaccagcacagagaccatcaacagccatgaggccgccgccgccaccctgaccatccacctgcaggacggcatggtgaccaacaccagcctgaccagcagcaccaagagcagccccacccccatgaccctgagcatcaccagcggcatgcccaacaacttcagcgagatgccccagcagagcaccaccctgaacctgtggagggaggagaccaccaccaacgtgaagacccccctgcccagcgtggccaatgcctggaaggtgaatgccagcttcctgctgctgctgaatgtggtggtgatgctggccgtgtag

SEQ ID NO: 162705 - DNA, 819 bp, Artificial Sequence
  Description of Artificial Sequence: Synthetic coding sequence
atgaacagcgacagcagctctgtgagcagccgggccagcagcccagacatggatgagatgtacctgcgggaccaccaccaccgccaccaccaccaccaggagagccggctgaacagcgtgagcagcacccagggcgacatgatgcagaagatgcctggagagagcctgagcagagctggggccaaggccgccggggagagcagcaagtacaagatcaagaagcagctgtctgagcaggacctgcagcagctgcggctgaagatcaatggccgggagaggaagaggatgcatgacctgaacctggccatggatggcctgcgggaggtgatgccctatgcccacggccccagcgtgaggaagctgagcaagatcgccaccctgctgctggccaggaactacatcctgatgctgaccagcagcctggaggagatgaagaggctggtgggggagatctacggcggccaccacagcgccttccactgcggcaccgtgggccacagcgctggccacccagcccacgccgccaacagcgtgcaccctgtgcaccccatcctgggcggggccctgagcagtggaaatgccagcagccccctgtctgctgccagcctgcctgccatcggcaccatccggcccccccacagcctgctgaaggcccccagcaccccaccagccctgcagctgggcagcggcttccagcactgggccggcctgccctgcccctgcaccatctgccagatgcctcctccaccccacctgagcgccctgagcacagccaacatggcccggctgtctgctgagagcaaggacctgctgaagtag

SEQ ID NO: 162706 - DNA, 375 bp, Artificial Sequence
  Description of Artificial Sequence: Synthetic coding sequence
atgtggaagggctgcctgaccctgtacacaggccggggcggggagctgcagaagattggagagttctgcatggtgtacagcgaggtgcccaacttcagcgagcccaacccagactaccggggccagcagaacaagggggcccagagcgagcagaagaacaacagcatgaacagcaacatgggcaccggcacctttggacctgtgggcaatggagtgcacacaggccctgagagccgggagcaccagttcagccacgccggccgcagcaatggccggggcctcatcaacccccagctgcagggcacagccagcaaccagacagtgatgaccaccatcagcaatggccgggacccccggcgggccttcaagaggtag

SEQ ID NO: 162707 - DNA, 375 bp, Artificial Sequence; identical to SEQ ID NO: 162706
  Description of Artificial Sequence: Synthetic coding sequence

SEQ ID NO: 162708 - DNA, 615 bp, Artificial Sequence
  Description of Artificial Sequence: Synthetic coding sequence
atgaacagagtgaatgaccccctcatcttcatccgggacatcaagccaggcctgaagaacctgaatgtggtgttcatcgtgctggagatcggccgggtgaccaagaccaaggatggccacgaggtgcgcagctgcaaggtggccgacaagacaggcagcatcaccatctctgtgtgggatgagatcggcggcctcatccagcccggggacatcatccggctgacccggggctacgcctccatgtggaagggctgcctgaccctgtacacaggccggggcggggagctgcagaagattggagagttctgcatggtgtacagcgaggtgcccaacttcagcgagcccaacccagactaccggggccagcagaacaagggggcccagagcgagcagaagaacaacagcatgaacagcaacatgggcaccggcacctttggacctgtgggcaatggagtgcacacaggccctgagagccgggagcaccagttcagccacgccggccgcagcaatggccggggcctcatcaacccccagctgcagggcacagccagcaaccagacagtgatgaccaccatcagcaatggccgggacccccggcgggccttcaagaggtag

SEQ ID NO: 162709 - DNA, 636 bp, Artificial Sequence
  Description of Artificial Sequence: Synthetic coding sequence
atgaccacagagacctttgtgaaggacatcaagccaggcctgaagaacctgaacctgatcttcatcgtgctggagaccggccgggtgaccaagaccaaggatggccacgaggtgaggacctgcaaggtggccgacaagacaggcagcatcaacatctctgtgtgggatgatgtgggcaacctgatccagcccggggacatcatccggctgaccaagggctacgccagcgtcttcaagggctgcctgaccctgtacacaggccggggcggggacctgcagaagattggagagttctgcatggtgtacagcgaggtgcccaacttcagcgagcccaaccctgagtacagcacccagcaggcccccaacaaggctgtgcagaatgacagcaaccccagcgccagccagcccaccaccggccccagcgctgccagccctgccagcgagaaccagaatggaaatggcctgagcgcccctcctggccctgggggcggcccccaccccccccacacccccagccacccccccagcacccgcatcaccaggagccagcccaaccacaccccagctggccccccaggccccagcagcaaccctgtgtccaatggcaaggagacccggcgcagcagcaagaggtag

SEQ ID NO: 162710 - DNA, 636 bp, Artificial Sequence; identical to SEQ ID NO: 162709
  Description of Artificial Sequence: Synthetic coding sequence

SEQ ID NO: 162711 - DNA, 636 bp, Artificial Sequence; identical to SEQ ID NO: 162709
  Description of Artificial Sequence: Synthetic coding sequence

SEQ ID NO: 162712 - DNA, 459 bp, Artificial Sequence
  Description of Artificial Sequence: Synthetic coding sequence
atgaccacagagacctttgtgaaggacatcaagccaggcctgaagaacctgaacctgatcttcatcgtgctggagaccggccgggtgaccaagaccaaggatggccacgaggtgaggacctgcaaggtggccgacaagacaggcagcatcaacatctctgtgtgggatgatgtgggcaacctgatccagcccggggacatcatccggctgaccaagggctacgccagcgtcttcaagggctgcctgaccctgtacacaggccggggcggggacctgcagaagattggagagttctgcatggtgtacagcgaggtgcccaacttcagcgagcccaaccctgagtacagcacccagcaggcccccaacaaggctgtgcagaatgacagcaaccccagcgccagccagcccaccaccggccccagcgctgccagccctgccagcgagaaccagaatggatag

SEQ ID NO: 162713 - DNA, 435 bp, Artificial Sequence
  Description of Artificial Sequence: Synthetic coding sequence
atgaccacagagacctttgtgaaggacatcaagccaggcctgaagaacctgaacctgatcttcatcgtgctggagaccggccgggtgaccaagaccaaggatggccacgaggtgaggacctgcaaggtggccgacaagacaggcagcatcaacatctctgtgtgggatgatgtgggcaacctgatccagcccggggacatcatccggctgaccaagggctacgccagcgtcttcaagggctgcctgaccctgtacacaggccggggcggggacctgcagaagattggagagttctgcatggtgtacagcgaggtgcccaacttcagcgagcccaaccctgagtacagcacccagcaggcccccaacaaggctgtgcagaatgacagcaaccccagcgccagccagcccaccaccggccccagcgctgccagctag

SEQ ID NO: 162714 - DNA, 2409 bp, Artificial Sequence
  Description of Artificial Sequence: Synthetic coding sequence
atgggccacccccccctggagttcagtgactgctacctggacagcccagacttccgggagcggctgaagtgctatgagcaggagctggagaggaccaacaagttcatcaaggatgtgatcaaggatggaaatgccctgatcagcgccatgaggaactacagcagcgctgtgcagaagttcagccagaccctgcagagcttccagtttgacttcatcggggacaccctgacagatgatgagatcaacattgctgagagcttcaaggagtttgctgagctgctgaatgaggtggagaatgaaagaatgatgatggtgcacaatgccagtgacctgctgatcaagcccctggagaacttcaggaaggagcagatcggcttcaccaaggagaggaagaagaagtttgagaaggatggagagcgcttctacagcctgctggacagacacctgcacctgagcagcaagaagaaggagagccagctgcaggaggccgacctgcaggtggacaaggagcggcacaacttctttgagagcagcctggactatgtgtaccagatccaggaggtgcaggagagcaagaagttcaacatcgtggagcctgtgctggccttcctgcacagcctcttcatcagcaacagcctgactgtggagctgacccaggacttcctgccctacaagcagcagctgcagctgagcctgcagaacaccaggaaccacttcagcagcacccgggaggagatggaggagctgaagaagaggatgaaggaggccccccagacctgcaagctgcccggccagcccaccatcgagggctacctgtacacccaggagaagtgggccctgggcatctcctgggtgaagtactactgccagtatgagaaggagaccaagaccctgaccatgacccccatggagcagaagccaggggccaagcagggccccctggacctgaccctgaagtactgtgtgcggaggaagacagagagcattgacaagcgcttctgctttgatattgagaccaatgaaagacctggcaccatcaccctgcaggccctgtctgaggccaacagaaggctgtggatggaggccatggatggcaaggagcccatctaccacagccccatcaccaagcagcaggagatggagctgaatgaggtgggcttcaagtttgtgaggaagtgcatcaacatcatcgagaccaagggcatcaagacagagggcctgtacagaacagtgggcagcaacatccaggtgcagaagctgctgaatgccttctttgaccccaagtgccctggagatgtggacttccacaacagcgactgggacatcaagaccatcaccagcagcctgaagttctacctgaggaacctgtctgagcctgtgatgacctaccgcctgcacaaggagctggtgtctgctgccaagagtgacaacctggactaccgcctgggcgccatccacagcctggtgtacaagctgcctgagaagaaccgggagatgctggagctgctgatccgccacctggtgaatgtgtgtgagcacagcaaggagaacctgatgacccccagcaacatgggcgtcatcttcggccccaccctgatgagggcccaggaggacacagtggccgccatgatgaacatcaagttccagaacatcgtggtggagatcctgattgagcactttgggaagatctacctgggccccccagaggagagcgctgcccctcctgtgcccccaccccgggtgacagcccggcggcacaagcccatcaccatcagcaagaggctgctgcgggagaggacagtgttctacaccagcagcctggatgaaagtgaagatgagatccagcaccagacccccaacggcaccatcaccagcagcattgagccccccaagccaccccagcaccccaagctgcccatccagaggtctggagaaacagaccccggcaggaagagccccagccggcccatcctggatggcaagctggagccctgcccagaggtggatgtgggcaagctggtgtcccggctgcaggacggcggcaccaagatcacccccaaggccaccaacggccccatgcctggcagcggccccaccaagacccccagcttccacatcaagaggcctgccccccggcccctggcccaccacaaggagggagatgctgacagcttcagcaaggtgcggcccccaggagagaagcccaccatcatccggccccctgtgcggcccccagaccccccctgcagagctgccaccccccagaagccagagcccaagccagacatcgtggccggaaatgctggggagatcaccagctctgtggtggccagcaggacccgcttctttgaaacagccagcaggaagacaggcagcagccagggccgcctgcctggagatgagagctag

SEQ ID NO: 162715 - DNA, 2085 bp, Artificial Sequence
  Description of Artificial Sequence: Synthetic coding sequence
atgggccacccccccctggagttcagtgactgctacctggacagcccagacttccgggagcggctgaagtgctatgagcaggagctggagaggaccaacaagttcatcaaggatgtgatcaaggatggaaatgccctgatcagcgccatgaggaactacagcagcgctgtgcagaagttcagccagaccctgcagagcttccagtttgacttcatcggggacaccctgacagatgatgagatcaacattgctgagagcttcaaggagtttgctgagctgctgaatgaggtggagaatgaaagaatgatgatggtgcacaatgccagtgacctgctgatcaagcccctggagaacttcaggaaggagcagatcggcttcaccaaggagaggaagaagaagtttgagaaggatggagagcgcttctacagcctgctggacagacacctgcacctgagcagcaagaagaaggagagccagctgcaggaggccgacctgcaggtggacaaggagcggcacaacttctttgagagcagcctggactatgtgtaccagatccaggaggtgcaggagagcaagaagttcaacatcgtggagcctgtgctggccttcctgcacagcctcttcatcagcaacagcctgactgtggagctgacccaggacttcctgccctacaagcagcagctgcagctgagcctgcagaacaccaggaaccacttcagcagcacccgggaggagatggaggagctgaagaagaggatgaaggaggccccccagacctgcaagctgcccggccagcccaccatcgagggctacctgtacacccaggagaagtgggccctgggcatctcctgggtgaagtactactgccagtatgagaaggagaccaagaccctgaccatgacccccatggagcagaagccaggggccaagcagggccccctggacctgaccctgaagtactgtgtgcggaggaagacagagagcattgacaagcgcttctgctttgatattgagaccaatgaaagacctggcaccatcaccctgcaggccctgtctgaggccaacagaaggctgtggatggaggccatggatggcaaggagcccatctaccacagccccatcaccaagcagcaggagatggagctgaatgaggtgggcttcaagtttgtgaggaagtgcatcaacatcatcgagaccaagggcatcaagacagagggcctgtacagaacagtgggcagcaacatccaggtgcagaagctgctgaatgccttctttgaccccaagtgccctggagatgtggacttccacaacagcgactgggacatcaagaccatcaccagcagcctgaagttctacctgaggaacctgtctgagcctgtgatgacctaccgcctgcacaaggagctggtgtctgctgccaagagtgacaacctggactaccgcctgggcgccatccacagcctggtgtacaagctgcctgagaagaaccgggagatgctggagctgctgatccgccacctggtgaatgtgtgtgagcacagcaaggagaacctgatgacccccagcaacatgggcgtcatcttcggccccaccctgatgagggcccaggaggacacagtggccgccatgatgaacatcaagttccagaacatcgtggtggagatcctgattgagcactttgggaagatctacctgggccccccagaggagagcgctgcccctcctgtgcccccaccccgggtgacagcccggcggcacaagcccatcaccatcagcaagaggctgctgcgggagaggacagtgttctacaccagcagcctggatgaaagtgaaggagatgctgacagcttcagcaaggtgcggcccccaggagagaagcccaccatcatccggccccctgtgcggcccccagaccccccctgcagagctgccaccccccagaagccagagcccaagccagacatcgtggccggaaatgctggggagatcaccagctctgtggtggccagcaggacccgcttctttgaaacagccagcaggaagacaggcagcagccagggccgcctgcctggagatgagagctag

SEQ ID NO: 162716 - DNA, 225 bp, Artificial Sequence
  Description of Artificial Sequence: Synthetic coding sequence
atgctggagctgctgatccgccacctggtgaatgtgtgtgagcacagcaaggagaacctgatgacccccagcaacatgggcgtcatcttcggccccaccctgatgagggcccaggaggacacagtggccgccatgatgaacatcaagttccagaacatcgtggtggagatcctgattgagcactttgggaagatcagcagcttcttcctgcacaggagcatctag

SEQ ID NO: 162717 - DNA, 3111 bp, Artificial Sequence
  Description of Artificial Sequence: Synthetic coding sequence
atggccagctctgtgggcaatgtggccgacagcacaggcctggccgagctggcccaccgggagtaccaggccggggactttgaagctgctgagcggcactgcatgcagctgtggaggcaggagccagacaacacaggagtgctgctgctgctgagcagcatccacttccagtgccggcggctggacagaagtgcccacttcagcaccctggccatcaagcagaaccccctgctggccgaggcctacagcaacctgggcaatgtgtacaaggagcggggccagctgcaggaggccatcgagcactacagacatgccctgcggctgaagccagacttcattgatggctacatcaacctggccgccgccctggtggccgccggggacatggagggcgctgtgcaggcctacgtgtctgccctgcagtacaacccagacctgtactgtgtgcggagtgacctgggcaacctgctgaaggccctgggccgcctggaggaggccaaggcctgctacctgaaggccatcgagacccagcccaactttgctgtggcctggagcaacctgggctgtgtgttcaatgcccagggcgagatctggctggccatccaccactttgagaaggctgtgaccctggaccccaacttcctggatgcctacatcaacctgggcaatgtgctgaaggaggcccgcatctttgacagagctgtggccgcctacctgcgggccctgagcctgagccccaaccacgctgtggtgcacggcaacctggcctgtgtgtactatgagcagggcctgattgacctggccatcgacacctacagaagagccatcgagctgcagccccacttcccagatgcctactgcaacctggccaatgccctgaaggagaagggctctgtggccgaggccgaggactgctacaacacagccctgcggctgtgccccacccatgctgacagcctgaacaacctggccaacatcaagcgggagcagggcaacatcgaggaggccgtgcggctgtacaggaaggccctggaggtgtttcctgagtttgctgctgcccacagcaacctggcctctgtgctgcagcagcagggcaagctgcaggaggccctgatgcactacaaggaggccatccgcatcagccccacctttgctgatgcctacagcaacatgggcaacaccctgaaggagatgcaggatgtgcagggcgccctgcagtgctacacccgggccatccagatcaacccagcctttgctgatgcccacagcaacctggccagcatccacaaggacagcggcaacatccctgaggccatcgccagctacagaacagccctgaagctgaagccagacttcccagatgcctactgcaacctggcccactgcctgcagatcgtgtgtgactggacagattatgatgagaggatgaagaagctggtgtccatcgtggccgaccagctggagaagaaccggctgcccagcgtgcacccccaccacagcatgctgtaccccctgagccacggcttcaggaaggccatcgccgagagacatggcaacctgtgcctggacaagatcaacgtgctgcacaagccaccctatgagcaccccaaggacctgaagctgagtgatggccgcctgcgggtgggctacgtgtccagtgactttggaaaccaccccaccagccacctgatgcagagcatccctggcatgcacaacccagacaagtttgaggtgttctgctacgccctgagcccagatgatggcaccaacttccgggtgaaggtgatggccgaggccaaccacttcatcgacctgagccagatcccctgcaatggcaaggctgctgaccgcatccaccaggacggcatccacatcctggtgaacatgaatggctacaccaagggggccagaaatgagctgtttgccctgcggcctgcccccatccaggccatgtggctgggctacccaggcaccagcggggccctcttcatggactacatcatcacagaccaggagaccagccctgctgaggtggccgagcagtacagcgagaagctggcctacatgccccacaccttcttcatcggggaccacgccaacatgttcccccacctgaagaagaaggctgtgattgacttcaagagcaatggccacatctatgacaaccgcatcgtgctgaatggaattgacctgaaggccttcctggacagcctgcctgatgtgaagatcgtgaagatgaagtgcccagatggaggagacaatgctgacagcagcaacacagccctgaacatgcctgtgatccccatgaacaccatcgccgaggccgtgattgagatgatcaacagaggccagatccagatcaccatcaatggcttcagcatcagcaatggcctggccaccacccagatcaacaacaaggccgccactggagaggaggtgcccaggaccatcatcgtgaccaccaggagccagtatggcctgcctgaagatgccatcgtgtactgcaacttcaaccagctgtacaagattgaccccagcaccctgcagatgtgggccaacatcctgaagagggtgcccaacagcgtgctgtggctgctgcgcttccctgctgtgggggagcccaacatccagcagtatgcccagaacatgggcctgccccagaaccgcatcatcttcagccctgtggcccccaaggaggagcacgtgagaagaggccagctggctgatgtgtgcctggacacccccctgtgcaatggccacaccaccggcatggatgtgctgtgggccggcacccccatggtgaccatgcctggagagaccctggccagccgggtggccgccagccagctgacctgcctgggctgcctggagctgattgccaagaaccggcaggagtatgaagatattgctgtgaagctgggcacagacctggagtacctgaagaaggtgcggggcaaggtgtggaagcagaggatcagcagccccctcttcaacaccaagcagtacaccatggagctggagcggctgtacctgcagatgtgggagcactacgccgccggcaacaagccagaccacatgatcaagcctgtggaggtgacagaaagtgcctag

SEQ ID NO: 162718 - DNA, 3141 bp, Artificial Sequence
  Description of Artificial Sequence: Synthetic coding sequence
atggccagctctgtgggcaatgtggccgacagcacagagcccaccaagaggatgctgtccttccagggcctggccgagctggcccaccgggagtaccaggccggggactttgaagctgctgagcggcactgcatgcagctgtggaggcaggagccagacaacacaggagtgctgctgctgctgagcagcatccacttccagtgccggcggctggacagaagtgcccacttcagcaccctggccatcaagcagaaccccctgctggccgaggcctacagcaacctgggcaatgtgtacaaggagcggggccagctgcaggaggccatcgagcactacagacatgccctgcggctgaagccagacttcattgatggctacatcaacctggccgccgccctggtggccgccggggacatggagggcgctgtgcaggcctacgtgtctgccctgcagtacaacccagacctgtactgtgtgcggagtgacctgggcaacctgctgaaggccctgggccgcctggaggaggccaaggcctgctacctgaaggccatcgagacccagcccaactttgctgtggcctggagcaacctgggctgtgtgttcaatgcccagggcgagatctggctggccatccaccactttgagaaggctgtgaccctggaccccaacttcctggatgcctacatcaacctgggcaatgtgctgaaggaggcccgcatctttgacagagctgtggccgcctacctgcgggccctgagcctgagccccaaccacgctgtggtgcacggcaacctggcctgtgtgtactatgagcagggcctgattgacctggccatcgacacctacagaagagccatcgagctgcagccccacttcccagatgcctactgcaacctggccaatgccctgaaggagaagggctctgtggccgaggccgaggactgctacaacacagccctgcggctgtgccccacccatgctgacagcctgaacaacctggccaacatcaagcgggagcagggcaacatcgaggaggccgtgcggctgtacaggaaggccctggaggtgtttcctgagtttgctgctgcccacagcaacctggcctctgtgctgcagcagcagggcaagctgcaggaggccctgatgcactacaaggaggccatccgcatcagccccacctttgctgatgcctacagcaacatgggcaacaccctgaaggagatgcaggatgtgcagggcgccctgcagtgctacacccgggccatccagatcaacccagcctttgctgatgcccacagcaacctggccagcatccacaaggacagcggcaacatccctgaggccatcgccagctacagaacagccctgaagctgaagccagacttcccagatgcctactgcaacctggcccactgcctgcagatcgtgtgtgactggacagattatgatgagaggatgaagaagctggtgtccatcgtggccgaccagctggagaagaaccggctgcccagcgtgcacccccaccacagcatgctgtaccccctgagccacggcttcaggaaggccatcgccgagagacatggcaacctgtgcctggacaagatcaacgtgctgcacaagccaccctatgagcaccccaaggacctgaagctgagtgatggccgcctgcgggtgggctacgtgtccagtgactttggaaaccaccccaccagccacctgatgcagagcatccctggcatgcacaacccagacaagtttgaggtgttctgctacgccctgagcccagatgatggcaccaacttccgggtgaaggtgatggccgaggccaaccacttcatcgacctgagccagatcccctgcaatggcaaggctgctgaccgcatccaccaggacggcatccacatcctggtgaacatgaatggctacaccaagggggccagaaatgagctgtttgccctgcggcctgcccccatccaggccatgtggctgggctacccaggcaccagcggggccctcttcatggactacatcatcacagaccaggagaccagccctgctgaggtggccgagcagtacagcgagaagctggcctacatgccccacaccttcttcatcggggaccacgccaacatgttcccccacctgaagaagaaggctgtgattgacttcaagagcaatggccacatctatgacaaccgcatcgtgctgaatggaattgacctgaaggccttcctggacagcctgcctgatgtgaagatcgtgaagatgaagtgcccagatggaggagacaatgctgacagcagcaacacagccctgaacatgcctgtgatccccatgaacaccatcgccgaggccgtgattgagatgatcaacagaggccagatccagatcaccatcaatggcttcagcatcagcaatggcctggccaccacccagatcaacaacaaggccgccactggagaggaggtgcccaggaccatcatcgtgaccaccaggagccagtatggcctgcctgaagatgccatcgtgtactgcaacttcaaccagctgtacaagattgaccccagcaccctgcagatgtgggccaacatcctgaagagggtgcccaacagcgtgctgtggctgctgcgcttccctgctgtgggggagcccaacatccagcagtatgcccagaacatgggcctgccccagaaccgcatcatcttcagccctgtggcccccaaggaggagcacgtgagaagaggccagctggctgatgtgtgcctggacacccccctgtgcaatggccacaccaccggcatggatgtgctgtgggccggcacccccatggtgaccatgcctggagagaccctggccagccgggtggccgccagccagctgacctgcctgggctgcctggagctgattgccaagaaccggcaggagtatgaagatattgctgtgaagctgggcacagacctggagtacctgaagaaggtgcggggcaaggtgtggaagcagaggatcagcagccccctcttcaacaccaagcagtacaccatggagctggagcggctgtacctgcagatgtgggagcactacgccgccggcaacaagccagaccacatgatcaagcctgtggaggtgacagaaagtgcctag

SEQ ID NO: 162719 - DNA, 330 bp, Artificial Sequence
  Description of Artificial Sequence: Synthetic coding sequence
atgagcatcacagatgtgctgtctgcagatgacattgctgctgccctgcaggagtgccgggaccctgacacctttgagccccagaagttcttccagaccagcggcctgagcaagatgtctgccaaccaggtgaaggatgtgttccgcttcatcgacaatgaccagagcggctacctggatgaggaggagctgaagttcttcctgcagaagtttgaaagtggggcccgggagctgacagaaagtgagaccaagagcctgatggctgctgctgacaatgatggagatggcaagatcggggctgaggagttccaggagatggtgcacagctag

SEQ ID NO: 162720 - DNA, 330 bp, Artificial Sequence; identical to SEQ ID NO: 162719
  Description of Artificial Sequence: Synthetic coding sequence

SEQ ID NO: 162721 - DNA, 1638 bp, Artificial Sequence
  Description of Artificial Sequence: Synthetic coding sequence
atgccacccttcctgctgctgacctgcctcttcatcaccggcacctctgtgtcccctgtggccctggacccctgcagcgcctacatcagcctgaatgagccctggaggaacacagaccaccagctggatgagagccagggcccccccctgtgtgacaaccacgtgaatggagagtggtaccacttcaccggcatggctggagatgccatgcccaccttctgcatccctgagaaccactgcggcacccacgcccctgtgtggctgaatggcagccaccccctggagggagatggcatcgtgcagaggcaggcctgtgccagcttcaatggaaactgctgcctgtggaacaccaccgtggaggtgaaggcctgccctgggggctactacgtgtaccgcctgaccaagcccagcgtgtgcttccacgtgtactgcggccacttctatgacatctgtgatgaggactgccacggcagctgcagcgacaccagcgagtgcacctgtgcccctggcaccgtgctgggccctgaccggcagacctgctttgatgaaaatgaatgtgagcagaacaacggcggctgcagcgagatctgtgtgaacctgaagaacagctaccgctgtgaatgtggggtgggccgggtgctgcggagtgatggcaagacctgtgaagatgtggagggctgccacaacaacaatggaggctgcagccacagctgcctgggcagcgagaagggctaccagtgtgagtgcccccggggcctggtgctgtctgaggacaaccacacctgccaggtgcctgtgctgtgcaagagcaatgccatcgaggtgaacatcccccgggagctggtgggcggcctggagctgttcctgaccaacaccagctgccggggcgtgtccaatggcacccacgtgaacatcctcttcagcctgaagacctgtggcaccgtggtggatgtggtgaatgacaagatcgtggccagcaacctggtgacaggcctgcccaagcagaccccaggcagcagcggggacttcatcatccgcaccagcaagctgctgatccctgtgacctgtgagttcccccggctgtacaccatcagcgagggctacgtgcccaacctgaggaacagccccctggagatcatgagcaggaaccacggcatcttccccttcaccctggagatcttcaaggacaatgaatttgaggagccctaccgggaggccctgcccaccctgaagctgcgggacagcctgtacttcggcatcgagcctgtggtgcacgtgtctggcctggagagcctggtggagagctgctttgccacccccaccagcaagattgatgaggtgctgaagtactacctgatcagagatggctgtgtgtctgatgacagcgtgaagcagtacaccagccgggaccacctggccaagcacttccaggtgcctgtgttcaagtttgtgggcaaggaccacaaggaggtgttcctgcactgccgggtgctggtgtgtggggtgctggatgagaggagccgctgtgcccagggctgccacaggaggatgagaagaggagctggaggagaggacagcgctggcctgcagggccagaccctgactggaggccccatcagaattgactgggaggactag

SEQ ID NO: 162722 - DNA, 966 bp, Artificial Sequence
  Description of Artificial Sequence: Synthetic coding sequence
atgccacccttcctgctgctgacctgcctcttcatcaccggcacctctgtgtcccctgtggccctggacccctgcagcgcctacatcagcctgaatgagccctggaggaacacagaccaccagctggatgagagccagggcccccccctgtgtgacaaccacgtgaatggagagtggtaccacttcaccggcatggctggagatgccatgcccaccttctgcatccctgagaaccactgcggcacccacgcccctgtgtggctgaatggcagccaccccctggagggagatggcatcgtgcagaggcaggcctgtgccagcttcaatggaaactgctgcctgtggaacaccaccgtggaggtgaaggcctgccctgggggctactacgtgtaccgcctgaccaagcccagcgtgtgcttccacgtgtactgcggccacttctatgacatctgtgatgaggactgccacggcagctgcagcgacaccagcgagtgcacctgtgcccctggcaccgtgctgggccctgaccggcagacctgctttgatgaaaatgaatgtgagcagaacaacggcggctgcagcgagatctgtgtgaacctgaagaacagctaccgctgtgaatgtggggtgggccgggtgctgcggagtgatggcaagacctgtgaagatgtggagggctgccacaacaacaatggaggctgcagccacagctgcctgggcagcgagaagggctaccagtgtgagtgcccccggggcctggtgctgtctgaggacaaccacacctgccaggtgcctgtgctgtgcaagagcaatgccatcgaggtgaacatcccccgggagctggtgggcggcctggagctgttcctgaccaacaccagctgccggggcgtgtccaatggcacccacgtgaacatcctcttcagcctgaagacctgtggcaccgtggtggacagctgcttccagtag

SEQ ID NO: 162723 - DNA, 735 bp, Artificial Sequence
  Description of Artificial Sequence: Synthetic coding sequence
atgggcctggagctgttcctggacctggtgtcccagcccagcagagctgtgtacatctttgccaagaagaatggcatccccctggagctgaggacagtggacctggtgaagggccagcacaagagcaaggagttcctgcagatcaacagcctgggcaagctgcccaccctgaaggatggagacttcatcctgacagagagcagcgccatcctgatctacctgagctgcaagtaccagaccccagaccactggtaccccagcgacctgcaggcccgggcccgggtgcatgagtacctgggctggcatgctgactgcatccggggcaccttcggcatccccctgtgggtgcaggtgctgggccccctgattggagtgcaggtgcccaaggagaaggtggagaggaacagaacagccatggaccaggccctgcagtggctggaggacaagttcctgggggaccggcccttcctggccggccagcaggtgaccctggccgacctgatggccctggaggagctgatgcagcctgtggccctgggctatgagctgtttgagggccggccccggctggccgcctggaggggccgggtggaggccttcctgggcgctgagctgtgccaggaggcccacagcatcatcctgagcatcctggagcaggccgccaagaagaccctgcccacccccagccctgaggcctaccaggccatgctgctgcgcatcgcccgcatcccctag

SEQ ID NO: 162724 - DNA, 696 bp, Artificial Sequence
  Description of Artificial Sequence: Synthetic coding sequence
atggcctccatggccgccatcggcagctgcagcaaggagtacagagtgctgctgggccagctgcagaagcagacagacctgatgcaggacaccagccggctgctggacccctacatccgcatccagggcctggatgtgcccaagctgcgggagcactgccgggagaggcctggggccttccccagcgaggagaccctgcggggcctgggcagaagaggcttcctgcagaccctgaatgccaccctgggctgtgtgctgcaccggctggccgacctggagcagaggctgcccaaggcccaggacctggagaggagcggcctgaacatcgaggacctggagaagctgcagatggcccggcccaacatcctgggcctgaggaacaacatctactgcatggcccagctgctggacaacagcgacacagctgagcccaccaaggccggccgcggggccagccagccccccacccccaccccagccagtgatgccttccagaggaagctggagggctgccgcttcctgcacggctaccaccgcttcatgcacagcgtgggccgggtcttcagcaagtggggcgagagccccaacagaagcagaagacacagcccccaccaggccctgaggaaaggagtgcggaggacccggcccagcaggaagggcaagaggctgatgacccggggccagctgcccaggtag

SEQ ID NO: 162725 - DNA, 2940 bp, Artificial Sequence
  Description of Artificial Sequence: Synthetic coding sequence
atggccctgtttgctgtgttccagaccaccttcttcctgaccctgctgagcctgcggacctaccagagcgaggtgctggccgagcggctgcccctgacccctgtgtccctgaaggtgtccaccaacagcacccggcagagcctgcacctgcagtggacagtgcacaacctgccctaccaccaggagctgaagatggtgttccagatccagatcagccgcatcgagaccagcaatgtcatctgggtgggcaactacagcaccaccgtgaagtggaaccaggtgctgcactggagctgggagagcgagctgcccctggagtgtgccacccactttgtgcgcatcaagagcctggtggatgatgccaagtttcctgagcccaacttctggagcaactggagctcctgggaggaggtgtctgtgcaggacagcacaggccaggacatcctgtttgtgttccccaaggacaagctggtggaggagggcaccaacgtgaccatctgctacgtgtccaggaacatccagaacaacgtgtcctgctacctggagggcaagcagatccatggagagcagctggacccccacgtgacagccttcaacctgaacagcgtgcccttcatcagaaataaaggcaccaacatctactgtgaggccagccagggcaatgtgtctgagggcatgaagggcatcgtgctgtttgtgtccaaggtgctggaggagcccaaggacttcagctgtgaaacagaggacttcaagaccctgcactgcacctgggaccctggaacagacacagccctgggctggagcaagcagcccagccagagctacaccctgtttgagagcttcagcggggagaagaagctgtgcacccacaagaactggtgcaactggcagatcacccaggacagccaggagacctacaacttcaccctgattgctgagaactacctgaggaagaggtctgtgaacatcctcttcaacctgacccaccgggtgtacctgatgaaccccttctctgtgaactttgaaaatgtgaatgccaccaatgccatcatgacctggaaggtgcacagcatccggaacaacttcacctacctgtgccagatcgagctgcatggagagggcaagatgatgcagtacaacgtgtccatcaaggtgaatggagagtacttcctgtctgagctggagcccgccacagagtacatggcccgggtgcgctgtgctgatgccagccacttctggaagtggagcgagtggagcggccagaacttcaccaccctggaggccgcccccagcgaggccccagatgtgtggagaattgtgtccctggagcccggcaaccacacagtgaccctcttctggaagcccctgagcaagctgcacgccaacgggaagatcctcttctacaacgtggtggtggagaacctggacaagcccagcagcagcgagctgcacagcatcccagccccagccaacagcaccaagctgatcctggaccgctgcagctaccagatctgtgtgattgccaacaacagcgtgggcgccagccctgccagcgtcatcgtcatctctgctgaccctgagaacaaggaggtggaggaggagagaattgctggaacagaaggaggcttcagcctgtcctggaagccccagcctggagatgtgattggctacgtggtggactggtgtgaccacacccaggatgtgctgggggacttccagtggaagaatgtgggccccaacaccaccagcaccgtcatcagcacagatgccttccggcctggggtgcgctatgacttccgcatctacggcctgagcaccaagagaattgcctgcctgctggagaagaagacaggctacagccaggagctggcccccagcgacaacccccacgtgctggtggacaccctgaccagccacagcttcaccctgtcctggaaggactacagcacagagagccagcccggcttcatccagggctaccacgtgtacctgaagagcaaggcccggcagtgccaccccaggtttgagaaggctgtgctgagtgatggcagcgagtgctgcaagtacaagattgacaaccctgaggagaaggccctgattgtggacaacctgaagccagagagcttctatgagttcttcatcacccccttcaccagcgctggggagggccccagcgccaccttcaccaaggtgaccaccccagatgagcacagctccatgctgatccacatcctgctgcccatggtgttctgtgtgctgctgatcatggtgatgtgctacctgaagagccagtggatcaaggagacctgctacccagacatcccagacccctacaagagcagcatcctgagcctcatcaagttcaaggagaacccccacctgatcatcatgaatgtgtctgactgcatcccagatgccatcgaggtggtgtccaagccagagggcaccaagatccagttcctgggcaccaggaagagcctgacagaaacagagctgaccaagcccaactacctgtacctgctgcccacagagaagaaccacagcggccctggcccctgcatctgctttgagaacctgacctacaaccaggccgccagtgacagcggcagctgtggccacgtgcctgtgagccccaaggcccccagcatgctgggcctgatgaccagcccagaaaatgtgctgaaggccctggagaagaactacatgaacagcctgggggagatcccagctggggagaccagcctgaactacgtgtcccagctggccagccccatgtttggagacaaggacagcctgcccaccaaccctgtggaggccccccactgcagcgagtacaagatgcagatggctgtgtccctgcggctggccctgcccccacccacagagaacagcagcctgagcagcatcaccctgctggaccccggggagcactactgctag

SEQ ID NO: 162726 - DNA, 1029 bp, Artificial Sequence
  Description of Artificial Sequence: Synthetic coding sequence
atggccctgtttgctgtgttccagaccaccttcttcctgaccctgctgagcctgcggacctaccagagcgaggtgctggccgagcggctgcccctgacccctgtgtccctgaaggtgtccaccaacagcacccggcagagcctgcacctgcagtggacagtgcacaacctgccctaccaccaggagctgaagatggtgttccagatccagatcagccgcatcgagaccagcaatgtcatctgggtgggcaactacagcaccaccgtgaagtggaaccaggtgctgcactggagctgggagagcgagctgcccctggagtgtgccacccactttgtgcgcatcaagagcctggtggatgatgccaagtttcctgagcccaacttctggagcaactggagctcctgggaggaggtgtctgtgcaggacagcacaggccaggacatcctgtttgtgttccccaaggacaagctggtggaggagggcaccaacgtgaccatctgctacgtgtccaggaacatccagaacaacgtgtcctgctacctggagggcaagcagatccatggagagcagctggacccccacgtgacagccttcaacctgaacagcgtgcccttcatcagaaataaaggcaccaacatctactgtgaggccagccagggcaatgtgtctgagggcatgaagggcatcgtgctgtttgtgtccaaggtgctggaggagcccaaggacttcagctgtgaaacagaggacttcaagaccctgcactgcacctgggaccctggaacagacacagccctgggctggagcaagcagcccagccagagctacaccctgtttgagagcttcagcggggagaagaagctgtgcacccacaagaactggtgcaactggcagatcacccaggacagccaggagacctacaacttcaccctgattgctgagaactacctgaggaagaggtctgtgaacatcctcttcaacctgacccacagaggagagaccagggtggtgacagcccaccggggccactag

SEQ ID NO: 162727 - DNA, 1398 bp, Artificial Sequence
  Description of Artificial Sequence: Synthetic coding sequence
atgaatgcccagctgaccatggaggccatcggggagctgcacggcgtgtcccatgagcctgtgcctgccccagctgacctgctgggcggcagcccccacgcccggagctctgtggcccaccggggcagccacctgcccccagcccaccccaggtccatgggcatggccagcctgctggatggcggcagcggcggcggggactaccaccaccaccaccgggcccctgagcacagcctggccggccccctgcaccccaccatgaccatggcctgtgagaccccacctggcatgtccatgcccaccacctacaccaccctgacccccctgcagcccctgccccccatcagcacagtgtctgacaagttcccccaccaccaccaccaccaccaccaccaccaccacccccaccaccaccagaggctggccggaaatgtgtctggcagcttcaccctgatgagagatgagcggggcctggcctccatgaacaacctgtacaccccctaccacaaggatgtggccggcatgggccagagcctgagccccctgagcagcagcggcctgggcagcatccacaacagccagcagggcctgccccactacgcccaccctggagctgccatgcccacagacaagatgctgacccccaacggctttgaggcccaccacccagccatgctgggcagacatggagagcagcacctgacccccaccagcgctggcatggtgcccatcaatggcctgcccccccaccacccccacgcccacctgaatgcccagggccacggccagctgctgggcacagcccgggagcccaaccccagcgtgactggagcccaggtgtccaatggcagcaacagcggccagatggaggagatcaacaccaaggaggtggcccagaggatcaccacagagctgaagcgctacagcatcccccaggccatctttgcccagagggtgctgtgccgcagccagggcaccctgagtgacctgctgaggaaccccaagccctggagcaagctgaagagcggccgggagaccttccggaggatgtggaagtggctgcaggagcctgagttccagaggatgtctgccctgcggctggccgcctgcaagaggaaggagcaggagcacggcaaggaccggggcaacacccccaagaagccccggctggtgttcacagatgtgcagaggaggaccctgcacgccatcttcaaggagaacaagaggcccagcaaggagctgcagatcaccatcagccagcagctgggcctggagctgagcacagtgagcaacttcttcatgaatgcccggcggcgcagcctggacaagtggcaggatgagggcagcagcaacagcggcaacagcagcagcagcagcagcacctgcaccaaggcctag

SEQ ID NO: 162728 - DNA, 1515 bp, Artificial Sequence
  Description of Artificial Sequence: Synthetic coding sequence
atgaaggccgcctacacagcctaccgctgcctgaccaaggacctggagggctgtgccatgaaccctgagctgaccatggagagcctgggcaccctgcacggccctgctgggggcggcagcggcggcggcggcggcggcggcggcggcggcggcggcggcggccctggccacgagcaggagctgctggccagccccagcccccaccacgccggccgcggggctgctggcagcctgcggggccccccacctccacccacagcccaccaggagctgggcacagctgctgctgctgctgctgctgccagccgcagcgccatggtgacctccatggccagcatcctggatggaggagactacagacctgagctgagcatccccctgcaccacgccatgtccatgagctgtgacagcagccccccaggcatgggcatgagcaacacctacaccaccctgacccccctgcagcccctgccccccatcagcacagtgtctgacaagttccaccacccccacccccaccaccacccccaccaccaccaccaccaccaccaccagaggctgtctggaaatgtgtctggcagcttcaccctgatgagagatgagcggggcctgcctgccatgaacaacctgtacagcccctacaaggagatgcctggcatgagccagagcctgagccccctggccgccacccccctgggcaatggcctgggcggcctgcacaatgcccagcagagcctgcccaactacggccccccaggccatgacaagatgctgagccccaactttgatgcccaccacacagccatgctgaccagaggagagcagcacctgagccggggcctgggcaccccacctgctgccatgatgagccacctgaatggcctgcaccaccctggccacacccagagccacggccctgtgctggcccccagccgggagaggcctcccagcagcagcagcggcagccaggtggccaccagcggccagctggaggagatcaacaccaaggaggtggcccagaggatcacagctgagctgaagcgctacagcatcccccaggccatctttgcccagagggtgctgtgccgcagccagggcaccctgagtgacctgctgaggaaccccaagccctggagcaagctgaagagcggccgggagaccttccggaggatgtggaagtggctgcaggagcctgagttccagaggatgtctgccctgcggctggccgcctgcaagaggaaggagcaggagcccaacaaggacaggaacaacagccagaagaagagccggctggtgttcacagacctgcagaggaggaccctgtttgccatcttcaaggagaacaagaggcccagcaaggagatgcagatcaccatcagccagcagctgggcctggagctgaccaccgtgagcaacttcttcatgaatgccaggagaagaagcctggagaagtggcaggatgacctgagcactggaggcagcagcagcaccagcagcacctgcaccaaggcctag

SEQ ID NO: 162729 - DNA, 1458 bp, Artificial Sequence
  Description of Artificial Sequence: Synthetic coding sequence
atgaaccctgagctgaccatggagagcctgggcaccctgcacggccctgctgggggcggcagcggcggcggcggcggcggcggcggcggcggcggcggcggcggccctggccacgagcaggagctgctggccagccccagcccccaccacgccggcagaggagctgctggcagcctgcggggccccccacctccacccacagcccaccaggagctgggcacagctgctgctgctgctgctgctgccagccgcagcgccatggtgacctccatggccagcatcctggatggaggagactacagacctgagctgagcatccccctgcaccacgccatgtccatgagctgtgacagcagccccccaggcatgggcatgagcaacacctacaccaccctgacccccctgcagcccctgccccccatcagcacagtgtctgacaagttccaccacccccacccccaccaccacccccaccaccaccaccaccaccaccaccagaggctgtctggaaatgtgtctggcagcttcaccctgatgagagatgagcggggcctgcctgccatgaacaacctgtacagcccctacaaggagatgcctggcatgagccagagcctgagccccctggccgccacccccctgggcaatggcctgggcggcctgcacaatgcccagcagagcctgcccaactacggccccccaggccatgacaagatgctgagccccaactttgatgcccaccacacagccatgctgaccagaggagagcagcacctgagccggggcctgggcaccccacctgctgccatgatgagccacctgaatggcctgcaccaccctggccacacccagagccacggccctgtgctggcccccagccgggagcggccccccagcagcagcagcggcagccaggtggccaccagcggccagctggaggagatcaacaccaaggaggtggcccagaggatcacagctgagctgaagcgctacagcatcccccaggccatctttgcccagagggtgctgtgccgcagccagggcaccctgagtgacctgctgaggaaccccaagccctggagcaagctgaagagcggccgggagaccttccggaggatgtggaagtggctgcaggagcctgagttccagaggatgtctgccctgcggctggccgcctgcaagaggaaggagcaggagcccaacaaggacaggaacaacagccagaagaagagccggctggtgttcacagacctgcagaggaggaccctgtttgccatcttcaaggagaacaagaggcccagcaaggagatgcagatcaccatcagccagcagctgggcctggagctgaccaccgtgagcaacttcttcatgaatgcccggcggcgcagcctggagaagtggcaggatgacctgagcactggaggcagcagcagcaccagcagcacctgcaccaaggcctag

SEQ ID NO: 162730 - DNA, 450 bp, Artificial Sequence
  Description of Artificial Sequence: Synthetic coding sequence
atggtggatgatgctggagctgctgagagccagaggggcaagcagaccccagcccacagcctggagcagctgcggcggctgcccctgcccccaccccagatccgcatccggccctggtggttccctgtgcaggagctgcgggaccccctggtgttctacctggaggcctggctggctgatgagctgtttggaccagaccgggccatcatccctgagatggagtggaccagccaggccctgctgactgtggacatcgtggacagcggcaacctggtggagatcaccgtgtttggccggccccgggtgcagaacagagtgaagtccatgctgctgtgcctggcctggttccaccgggagcaccgggcccgggcagagaagatgaagcacctggagaagaacctgaaggcccacgccagtgacccccacagcccccaggaccctgtggcctag

SEQ ID NO: 162731 - DNA, 387 bp, Artificial Sequence
  Description of Artificial Sequence: Synthetic coding sequence
atggcccctgtgaagaagctggtggtgaagggcggcaagaagaagaagcaggtgctgaagttcaccctggactgcacccaccctgtggaggatggcatcatggatgctgccaactttgagcagttcctgcaggagcgcatcaaggtgaatggcaaggccggcaacctgggcggcggcgtggtgaccatcgagaggagcaagagcaagatcaccgtgaccagcgaggtgcccttcagcaagcgctacctgaagtacctgaccaagaagtacctgaagaagaacaacctgcgggactggctgcgggtggtggccaacagcaaggagagctatgagctgcgctacttccagatcaaccaggatgaggaggaggaggaggatgaagattag

SEQ ID NO: 162732 - DNA, 975 bp, Artificial Sequence
  Description of Artificial Sequence: Synthetic coding sequence
atggagcccgcccccagcgctggagctgagctgcagccccccctgtttgccaatgccagtgatgcctaccccagcgcctgccccagcgctggggccaatgccagcggccccccaggggcccggagcgccagcagcctggccctggccatcgccatcacagccctgtacagcgctgtgtgtgctgtgggcctgctgggcaatgtgctggtgatgtttggcatcgtgcgctacaccaagatgaagacagccaccaacatctacatcttcaacctggccctggctgatgccctggccaccagcaccctgcccttccagagcgccaagtacctgatggagacctggccctttggagagctgctgtgcaaggctgtgctgagcattgactactacaacatgttcaccagcatcttcaccctgaccatgatgtctgtggaccgctacatcgctgtgtgccaccctgtgaaggccctggacttccgcaccccagccaaggccaagctgatcaacatctgcatctgggtgctggccagcggcgtgggcgtgcccatcatggtgatggctgtgacccggcccagagatggagctgtggtgtgcatgctgcagttccccagccccagctggtactgggacacagtgaccaagatctgtgtgttcctgtttgcctttgtggtgtgctgggcccccatccacatcttcgtcatcgtgtggaccctggtggacatcgacagaagagaccccctggtggtggccgccctgcacctgtgcatcgccctgggctacgccaacagcagcctgaaccctgtgctgtatgccttcctggatgagaacttcaagcgctgcttccggcagctgtgcaggaagccctgtggccgcccagaccccagcagcttcagccgggcccgggaggccacagcccgggagcgggtgacagcctgcacccccagtgatggccctgggggcggcgctgctgcctag

SEQ ID NO: 162733 - DNA, 1143 bp, Artificial Sequence
  Description of Artificial Sequence: Synthetic coding sequence
atggacagccccatccagatcttccggggggagcccggccccacctgtgcccccagcgcctgcctgccccccaacagcagcgcctggttccctggctgggccgagccagacagcaatggatctgctggctctgaagatgcccagctggagcccgcccacatcagccctgccatccctgtgatcatcacagctgtgtacagcgtggtgtttgtggtgggcctggtgggcaacagcctggtgatgtttgtgatcatccgctacaccaagatgaagacagccaccaacatctacatcttcaacctggccctggctgatgccctggtgaccaccaccatgcccttccagagcacagtgtacctgatgaacagctggccctttggagatgtgctgtgcaagatcgtcatcagcattgactactacaacatgttcaccagcatcttcaccctgaccatgatgtctgtggaccgctacatcgctgtgtgccaccctgtgaaggccctggacttccgcacccccctgaaggccaagatcatcaacatctgcatctggctgctgagcagctctgtgggcatcagcgccatcgtgctgggcggcaccaaggtgagagaagatgtggatgtgattgaatgttccctgcagttcccagatgatgactacagctggtgggacctcttcatgaagatctgtgtgttcatctttgcctttgtgattcctgtgctgatcatcatcgtgtgctacaccctgatgatcctgcggctgaagtctgtgcggctgctgagcggcagccgggagaaggacaggaacctgcggcgcatcacccggctggtgctggtggtggtggccgtgtttgtggtgtgctggacccccatccacatcttcatcctggtggaggccctgggcagcaccagccacagcacagctgccctgagcagctactacttctgcatcgccctgggctacaccaacagcagcctgaaccccatcctgtatgccttcctggatgagaacttcaagcgctgcttccgggacttctgcttccccctgaagatgaggatggagcggcagagcaccagccgggtgaggaacacagtgcaggaccctgcctacctgcgggacattgatggcatgaacaagcctgtgtag

SEQ ID NO: 162734 - DNA, 1101 bp, Artificial Sequence
  Description of Artificial Sequence: Synthetic coding sequence
atggacagccccatccagatcttccggggggagcccggccccacctgtgcccccagcgcctgcctgccccccaacagcagcgctggctctgaagatgcccagctggagcccgcccacatcagccctgccatccctgtgatcatcacagctgtgtacagcgtggtgtttgtggtgggcctggtgggcaacagcctggtgatgtttgtgatcatccgctacaccaagatgaagacagccaccaacatctacatcttcaacctggccctggctgatgccctggtgaccaccaccatgcccttccagagcacagtgtacctgatgaacagctggccctttggagatgtgctgtgcaagatcgtcatcagcattgactactacaacatgttcaccagcatcttcaccctgaccatgatgtctgtggaccgctacatcgctgtgtgccaccctgtgaaggccctggacttccgcacccccctgaaggccaagatcatcaacatctgcatctggctgctgagcagctctgtgggcatcagcgccatcgtgctgggcggcaccaaggtgagagaagatgtggatgtgattgaatgttccctgcagttcccagatgatgactacagctggtgggacctcttcatgaagatctgtgtgttcatctttgcctttgtgattcctgtgctgatcatcatcgtgtgctacaccctgatgatcctgcggctgaagtctgtgcggctgctgagcggcagccgggagaaggacaggaacctgcggcgcatcacccggctggtgctggtggtggtggccgtgtttgtggtgtgctggacccccatccacatcttcatcctggtggaggccctgggcagcaccagccacagcacagctgccctgagcagctactacttctgcatcgccctgggctacaccaacagcagcctgaaccccatcctgtatgccttcctggatgagaacttcaagcgctgcttccgggacttctgcttccccctgaagatgaggatggagcggcagagcaccagccgggtgaggaacacagtgcaggaccctgcctacctgcgggacattgatggcatgaacaagcctgtgtag

SEQ ID NO: 162735 - DNA, 1143 bp, Artificial Sequence; identical to SEQ ID NO: 162733
  Description of Artificial Sequence: Synthetic coding sequence

SEQ ID NO: 162736 - DNA, 1344 bp, Artificial Sequence
  Description of Artificial Sequence: Synthetic coding sequence
atgagcagaagaccctgcagctgtgccctgcggcccccacgctgcagctgcagcgccagccccagcgctgtgacagctgctggccggccccggcccagcgacagctgcaaggaggagagcagcaccctgtctgtgaagatgaagtgtgacttcaactgcaaccacgtgcacagcggcctgaagctggtgaagccagatgacatcggccgcctggtgtcctacaccccagcctacctggagggcagctgcaaggactgcatcaaggactatgaaaggctgagctgcatcggcagccccatcgtgagccccagaattgtgcagctggagacagagagcaagaggctgcacaacaaggagaaccagcacgtgcagcagaccctgaacagcaccaatgaaattgaggccctggagaccagccggctgtatgaagattctggctacagcagcttcagcctgcagagcggcctgtctgaacatgaggagggcagcctgctggaggagaactttggagacagcctgcagagctgcctgctgcagatccagagcccagaccagtaccccaacaagaacctgctgcctgtgctgcactttgagaaggtggtgtgcagcaccctgaagaagaatgccaagaggaaccccaaggtggaccgggagatgctgaaggagatcatcgcccggggcaacttccggctgcagaacatcattggaaggaagatgggcctggagtgtgtggacatcctgtctgagctgttccggcggggcctgcggcacgtgctggccaccatcctggcccagctgagtgacatggacctgatcaacgtgtccaaggtgtccaccacctggaagaagatcctggaggatgacaagggggccttccagctgtacagcaaggccatccagagggtgacagagaacaacaacaagttcagcccccacgccagcacccgggagtatgtgatgttccgcacccccctggcctctgtgcagaagtctgctgcccagaccagcctgaagaaggatgcccagaccaagctgagcaaccagggcgaccagaagggcagcacctacagccgccacaatgagttcagcgaggtggccaagaccctgaagaagaatgaaagcctgaaggcctgcatccgctgcaacagccctgccaagtatgactgctacctgcagagggccacctgcaagcgggagggctgcggctttgactactgcaccaagtgcctgtgcaactaccacaccaccaaggactgcagtgatggcaagctgctgaaggccagctgcaagattggccccctgcccggcaccaagaagagcaagaagaacctgcggcggctgtag

SEQ ID NO: 162737 - DNA, 1203 bp, Artificial Sequence
  Description of Artificial Sequence: Synthetic coding sequence
atggacagcagcgctgcccccaccaatgccagcaactgcacagatgccctggcctacagcagctgcagccctgcccccagccctggctcctgggtgaacctgagccacctggatggcaacctgagtgacccctgtggccccaacagaacagacctgggcggccgggacagcctgtgcccccccaccggcagccccagcatgatcacagccatcaccatcatggccctgtacagcatcgtgtgtgtggtgggcctgtttggaaacttcctggtgatgtatgtgattgtgcgctacaccaagatgaagacagccaccaacatctacatcttcaacctggccctggctgatgccctggccaccagcaccctgcccttccagagcgtgaactacctgatgggcacctggcccttcggcaccatcctgtgcaagatcgtcatcagcattgactactacaacatgttcaccagcatcttcaccctgtgcaccatgtctgtggaccgctacatcgctgtgtgccaccctgtgaaggccctggacttccgcaccccaagaaatgccaagatcatcaacgtgtgcaactggatcctgagcagcgccatcggcctgcctgtgatgttcatggccaccaccaagtaccggcagggcagcattgactgcaccctgaccttcagccaccccacctggtactgggagaacctgctgaagatctgtgtgttcatctttgccttcatcatgcctgtgctgatcatcaccgtgtgctacggcctgatgatcctgcggctgaagtctgtgaggatgctgagcggcagcaaggagaaggacaggaacctgcggcgcatcaccaggatggtgctggtggtggtggccgtgttcatcgtgtgctggacccccatccacatctacgtgatcatcaaggccctggtgaccatccctgagaccaccttccagacagtgtcctggcacttctgcatcgccctgggctacaccaacagctgcctgaaccctgtgctgtatgccttcctggatgagaacttcaagcgctgcttccgggagttctgcatccccaccagcagcaacatcgagcagcagaacagcacccgcatccggcagaacacccgggaccaccccagcacagccaacacagtggacaggaccaaccaccagctggagaacctggaggccgagacagcccccctgccctag

SEQ ID NO: 162738 - DNA, 1257 bp, Artificial Sequence
  Description of Artificial Sequence: Synthetic coding sequence
atggacagcagcgctgcccccaccaatgccagcaactgcacagatgccctggcctacagcagctgcagccctgcccccagccctggctcctgggtgaacctgagccacctggatggcaacctgagtgacccctgtggccccaacagaacagacctgggcggccgggacagcctgtgcccccccaccggcagccccagcatgatcacagccatcaccatcatggccctgtacagcatcgtgtgtgtggtgggcctgtttggaaacttcctggtgatgtatgtgattgtgcgctacaccaagatgaagacagccaccaacatctacatcttcaacctggccctggctgatgccctggccaccagcaccctgcccttccagagcgtgaactacctgatgggcacctggcccttcggcaccatcctgtgcaagatcgtcatcagcattgactactacaacatgttcaccagcatcttcaccctgtgcaccatgtctgtggaccgctacatcgctgtgtgccaccctgtgaaggccctggacttccgcaccccaagaaatgccaagatcatcaacgtgtgcaactggatcctgagcagcgccatcggcctgcctgtgatgttcatggccaccaccaagtaccggcagggcagcattgactgcaccctgaccttcagccaccccacctggtactgggagaacctgctgaagatctgtgtgttcatctttgccttcatcatgcctgtgctgatcatcaccgtgtgctacggcctgatgatcctgcggctgaagtctgtgaggatgctgagcggcagcaaggagaaggacaggaacctgcggcgcatcaccaggatggtgctggtggtggtggccgtgttcatcgtgtgctggacccccatccacatctacgtgatcatcaaggccctggtgaccatccctgagaccaccttccagacagtgtcctggcacttctgcatcgccctgggctacaccaacagctgcctgaaccctgtgctgtatgccttcctggatgagaacttcaagcgctgcttccgggagttctgcatccccaccagcagcaacatcgagcagcagaacagcacccgcatccggcagaacacccgggaccaccccagcacagccaacacagtggacaggaccaaccaccagccccccctggccgtgtccatggcccagatcttcacccgctaccccccacccacccaccgggagaagacctgcaatgactacatgaagaggtag

SEQ ID NO: 162739 - DNA, 1209 bp, Artificial Sequence
  Description of Artificial Sequence: Synthetic coding sequence
atggacagcagcgctgcccccaccaatgccagcaactgcacagatgccctggcctacagcagctgcagccctgcccccagccctggctcctgggtgaacctgagccacctggatggcaacctgagtgacccctgtggccccaacagaacagacctgggcggccgggacagcctgtgcccccccaccggcagccccagcatgatcacagccatcaccatcatggccctgtacagcatcgtgtgtgtggtgggcctgtttggaaacttcctggtgatgtatgtgattgtgcgctacaccaagatgaagacagccaccaacatctacatcttcaacctggccctggctgatgccctggccaccagcaccctgcccttccagagcgtgaactacctgatgggcacctggcccttcggcaccatcctgtgcaagatcgtcatcagcattgactactacaacatgttcaccagcatcttcaccctgtgcaccatgtctgtggaccgctacatcgctgtgtgccaccctgtgaaggccctggacttccgcaccccaagaaatgccaagatcatcaacgtgtgcaactggatcctgagcagcgccatcggcctgcctgtgatgttcatggccaccaccaagtaccggcagggcagcattgactgcaccctgaccttcagccaccccacctggtactgggagaacctgctgaagatctgtgtgttcatctttgccttcatcatgcctgtgctgatcatcaccgtgtgctacggcctgatgatcctgcggctgaagtctgtgaggatgctgagcggcagcaaggagaaggacaggaacctgcggcgcatcaccaggatggtgctggtggtggtggccgtgttcatcgtgtgctggacccccatccacatctacgtgatcatcaaggccctggtgaccatccctgagaccaccttccagacagtgtcctggcacttctgcatcgccctgggctacaccaacagctgcctgaaccctgtgctgtatgccttcctggatgagaacttcaagcgctgcttccgggagttctgcatccccaccagcagcaacatcgagcagcagaacagcacccgcatccggcagaacacccgggaccaccccagcacagccaacacagtggacaggaccaaccaccagatccgggaccccatcagcaacctgccccgggtgtctgtgttctag

SEQ ID NO: 162740 - DNA, 1212 bp, Artificial Sequence
  Description of Artificial Sequence: Synthetic coding sequence
atggacagcagcgctgcccccaccaatgccagcaactgcacagatgccctggcctacagcagctgcagccctgcccccagccctggctcctgggtgaacctgagccacctggatggcaacctgagtgacccctgtggccccaacagaacagacctgggcggccgggacagcctgtgcccccccaccggcagccccagcatgatcacagccatcaccatcatggccctgtacagcatcgtgtgtgtggtgggcctgtttggaaacttcctggtgatgtatgtgattgtgcgctacaccaagatgaagacagccaccaacatctacatcttcaacctggccctggctgatgccctggccaccagcaccctgcccttccagagcgtgaactacctgatgggcacctggcccttcggcaccatcctgtgcaagatcgtcatcagcattgactactacaacatgttcaccagcatcttcaccctgtgcaccatgtctgtggaccgctacatcgctgtgtgccaccctgtgaaggccctggacttccgcaccccaagaaatgccaagatcatcaacgtgtgcaactggatcctgagcagcgccatcggcctgcctgtgatgttcatggccaccaccaagtaccggcagggcagcattgactgcaccctgaccttcagccaccccacctggtactgggagaacctgctgaagatctgtgtgttcatctttgccttcatcatgcctgtgctgatcatcaccgtgtgctacggcctgatgatcctgcggctgaagtctgtgaggatgctgagcggcagcaaggagaaggacaggaacctgcggcgcatcaccaggatggtgctggtggtggtggccgtgttcatcgtgtgctggacccccatccacatctacgtgatcatcaaggccctggtgaccatccctgagaccaccttccagacagtgtcctggcacttctgcatcgccctgggctacaccaacagctgcctgaaccctgtgctgtatgccttcctggatgagaacttcaagcgctgcttccgggagttctgcatccccaccagcagcaacatcgagcagcagaacagcacccgcatccggcagaacacccgggaccaccccagcacagccaacacagtggacaggaccaaccaccagggccccccagccaagtttgtggccgaccagctggccggcagcagctag

SEQ ID NO: 162741 - DNA, 1263 bp, Artificial Sequence
  Description of Artificial Sequence: Synthetic coding sequence
atggacagcagcgctgcccccaccaatgccagcaactgcacagatgccctggcctacagcagctgcagccctgcccccagccctggctcctgggtgaacctgagccacctggatggcaacctgagtgacccctgtggccccaacagaacagacctgggcggccgggacagcctgtgcccccccaccggcagccccagcatgatcacagccatcaccatcatggccctgtacagcatcgtgtgtgtggtgggcctgtttggaaacttcctggtgatgtatgtgattgtgcgctacaccaagatgaagacagccaccaacatctacatcttcaacctggccctggctgatgccctggccaccagcaccctgcccttccagagcgtgaactacctgatgggcacctggcccttcggcaccatcctgtgcaagatcgtcatcagcattgactactacaacatgttcaccagcatcttcaccctgtgcaccatgtctgtggaccgctacatcgctgtgtgccaccctgtgaaggccctggacttccgcaccccaagaaatgccaagatcatcaacgtgtgcaactggatcctgagcagcgccatcggcctgcctgtgatgttcatggccaccaccaagtaccggcagggcagcattgactgcaccctgaccttcagccaccccacctggtactgggagaacctgctgaagatctgtgtgttcatctttgccttcatcatgcctgtgctgatcatcaccgtgtgctacggcctgatgatcctgcggctgaagtctgtgaggatgctgagcggcagcaaggagaaggacaggaacctgcggcgcatcaccaggatggtgctggtggtggtggccgtgttcatcgtgtgctggacccccatccacatctacgtgatcatcaaggccctggtgaccatccctgagaccaccttccagacagtgtcctggcacttctgcatcgccctgggctacaccaacagctgcctgaaccctgtgctgtatgccttcctggatgagaacttcaagcgctgcttccgggagttctgcatccccaccagcagcaacatcgagcagcagaacagcacccgcatccggcagaacacccgggaccaccccagcacagccaacacagtggacaggaccaaccaccaggtggagctgaacctggactgccactgtgaaaatgccaagccctggcccctgagctacaatgccggccagagccccttccccttccctggccgggtgtag

SEQ ID NO: 162742 - DNA, 1179 bp, Artificial Sequence
  Description of Artificial Sequence: Synthetic coding sequence
atggacagcagcgctgcccccaccaatgccagcaactgcacagatgccctggcctacagcagctgcagccctgcccccagccctggctcctgggtgaacctgagccacctggatggcaacctgagtgacccctgtggccccaacagaacagacctgggcggccgggacagcctgtgcccccccaccggcagccccagcatgatcacagccatcaccatcatggccctgtacagcatcgtgtgtgtggtgggcctgtttggaaacttcctggtgatgtatgtgattgtgcgctacaccaagatgaagacagccaccaacatctacatcttcaacctggccctggctgatgccctggccaccagcaccctgcccttccagagcgtgaactacctgatgggcacctggcccttcggcaccatcctgtgcaagatcgtcatcagcattgactactacaacatgttcaccagcatcttcaccctgtgcaccatgtctgtggaccgctacatcgctgtgtgccaccctgtgaaggccctggacttccgcaccccaagaaatgccaagatcatcaacgtgtgcaactggatcctgagcagcgccatcggcctgcctgtgatgttcatggccaccaccaagtaccggcagggcagcattgactgcaccctgaccttcagccaccccacctggtactgggagaacctgctgaagatctgtgtgttcatctttgccttcatcatgcctgtgctgatcatcaccgtgtgctacggcctgatgatcctgcggctgaagtctgtgaggatgctgagcggcagcaaggagaaggacaggaacctgcggcgcatcaccaggatggtgctggtggtggtggccgtgttcatcgtgtgctggacccccatccacatctacgtgatcatcaaggccctggtgaccatccctgagaccaccttccagacagtgtcctggcacttctgcatcgccctgggctacaccaacagctgcctgaaccctgtgctgtatgccttcctggatgagaacttcaagcgctgcttccgggagttctgcatccccaccagcagcaacatcgagcagcagaacagcacccgcatccggcagaacacccgggaccaccccagcacagccaacacagtggacaggaccaaccaccaggtgcgcagcctgtag

SEQ ID NO: 162743 - DNA, 1482 bp, Artificial Sequence
  Description of Artificial Sequence: Synthetic coding sequence
atgtgcctgcacagaagagtgcccagcgaggagacctacagcctggacagatttgcccagaaccccccactcttccccccacccagcctgcctgccagcgagagcaggatggcccacgcccccctgctgcagagatgtggggccgccaggacaggcttctgcaagaagcagcaggagctgtggcagaggaggaaggaggccgctgaggccctgggcaccaggaaggtgtctgtgctgctggccaccagccacagcggggcccggcctgctgtgtccaccatggacagcagcgctgcccccaccaatgccagcaactgcacagatgccctggcctacagcagctgcagccctgcccccagccctggctcctgggtgaacctgagccacctggatggcaacctgagtgacccctgtggccccaacagaacagacctgggcggccgggacagcctgtgccccccaacaggcagccccagcatgatcacagccatcaccatcatggccctgtacagcatcgtgtgtgtggtgggcctgtttggaaacttcctggtgatgtatgtgattgtgcgctacaccaagatgaagacagccaccaacatctacatcttcaacctggccctggctgatgccctggccaccagcaccctgcccttccagagcgtgaactacctgatgggcacctggcccttcggcaccatcctgtgcaagatcgtcatcagcattgactactacaacatgttcaccagcatcttcaccctgtgcaccatgtctgtggaccgctacatcgctgtgtgccaccctgtgaaggccctggacttccgcaccccaagaaatgccaagatcatcaacgtgtgcaactggatcctgagcagcgccatcggcctgcctgtgatgttcatggccaccaccaagtaccggcagggcagcattgactgcaccctgaccttcagccaccccacctggtactgggagaacctgctgaagatctgtgtgttcatctttgccttcatcatgcctgtgctgatcatcaccgtgtgctacggcctgatgatcctgcggctgaagtctgtgaggatgctgagcggcagcaaggagaaggacaggaacctgcggcgcatcaccaggatggtgctggtggtggtggccgtgttcatcgtgtgctggacccccatccacatctacgtgatcatcaaggccctggtgaccatccctgagaccaccttccagacagtgtcctggcacttctgcatcgccctgggctacaccaacagctgcctgaaccctgtgctgtatgccttcctggatgagaacttcaagcgctgcttccgggagttctgcatccccaccagcagcaacatcgagcagcagaacagcacccgcatccggcagaacacccgggaccaccccagcacagccaacacagtggacaggaccaaccaccagctggagaacctggaggccgagacagcccccctgccctag

SEQ ID NO: 162744 - DNA, 1194 bp, Artificial Sequence
  Description of Artificial Sequence: Synthetic coding sequence
atggacagcagcgctgcccccaccaatgccagcaactgcacagatgccctggcctacagcagctgcagccctgcccccagccctggctcctgggtgaacctgagccacctggatggcaacctgagtgacccctgtggccccaacagaacagacctgggcggccgggacagcctgtgcccccccaccggcagccccagcatgatcacagccatcaccatcatggccctgtacagcatcgtgtgtgtggtgggcctgtttggaaacttcctggtgatgtatgtgattgtgcgctacaccaagatgaagacagccaccaacatctacatcttcaacctggccctggctgatgccctggccaccagcaccctgcccttccagagcgtgaactacctgatgggcacctggcccttcggcaccatcctgtgcaagatcgtcatcagcattgactactacaacatgttcaccagcatcttcaccctgtgcaccatgtctgtggaccgctacatcgctgtgtgccaccctgtgaaggccctggacttccgcaccccaagaaatgccaagatcatcaacgtgtgcaactggatcctgagcagcgccatcggcctgcctgtgatgttcatggccaccaccaagtaccggcagggcagcattgactgcaccctgaccttcagccaccccacctggtactgggagaacctgctgaagatctgtgtgttcatctttgccttcatcatgcctgtgctgatcatcaccgtgtgctacggcctgatgatcctgcggctgaagtctgtgaggatgctgagcggcagcaaggagaaggacaggaacctgcggcgcatcaccaggatggtgctggtggtggtggccgtgttcatcgtgtgctggacccccatccacatctacgtgatcatcaaggccctggtgaccatccctgagaccaccttccagacagtgtcctggcacttctgcatcgccctgggctacaccaacagctgcctgaaccctgtgctgtatgccttcctggatgagaacttcaagcgctgcttccgggagttctgcatccccaccagcagcaacatcgagcagcagaacagcacccgcatccggcagaacacccgggaccaccccagcacagccaacacagtggacaggaccaaccaccagcgggagcggcggcagaagagtgactggtag

SEQ ID NO: 162745 - DNA, 1221 bp, Artificial Sequence
  Description of Artificial Sequence: Synthetic coding sequence
atggacagcagcgctgcccccaccaatgccagcaactgcacagatgccctggcctacagcagctgcagccctgcccccagccctggctcctgggtgaacctgagccacctggatggcaacctgagtgacccctgtggccccaacagaacagacctgggcggccgggacagcctgtgcccccccaccggcagccccagcatgatcacagccatcaccatcatggccctgtacagcatcgtgtgtgtggtgggcctgtttggaaacttcctggtgatgtatgtgattgtgcgctacaccaagatgaagacagccaccaacatctacatcttcaacctggccctggctgatgccctggccaccagcaccctgcccttccagagcgtgaactacctgatgggcacctggcccttcggcaccatcctgtgcaagatcgtcatcagcattgactactacaacatgttcaccagcatcttcaccctgtgcaccatgtctgtggaccgctacatcgctgtgtgccaccctgtgaaggccctggacttccgcaccccaagaaatgccaagatcatcaacgtgtgcaactggatcctgagcagcgccatcggcctgcctgtgatgttcatggccaccaccaagtaccggcagggcagcattgactgcaccctgaccttcagccaccccacctggtactgggagaacctgctgaagatctgtgtgttcatctttgccttcatcatgcctgtgctgatcatcaccgtgtgctacggcctgatgatcctgcggctgaagtctgtgaggatgctgagcggcagcaaggagaaggacaggaacctgcggcgcatcaccaggatggtgctggtggtggtggccgtgttcatcgtgtgctggacccccatccacatctacgtgatcatcaaggccctggtgaccatccctgagaccaccttccagacagtgtcctggcacttctgcatcgccctgggctacaccaacagctgcctgaaccctgtgctgtatgccttcctggatgagaacttcaagcgctgcttccgggagttctgcatccccaccagcagcaacatcgagcagcagaacagcacccgcatccggcagaacacccgggaccaccccagcacagccaacacagtggacaggaccaaccaccagaagattgacctcttccagaagagcagcctgctgaactgtgagcacaccaagggctag

SEQ ID NO: 162746 - DNA, 960 bp, Artificial Sequence
  Description of Artificial Sequence: Synthetic coding sequence
atgatgagggccaagagcatcagcaccaaggccggcaagcccagccgctacaccaagatgaagacagccaccaacatctacatcttcaacctggccctggctgatgccctggccaccagcaccctgcccttccagagcgtgaactacctgatgggcacctggcccttcggcaccatcctgtgcaagatcgtcatcagcattgactactacaacatgttcaccagcatcttcaccctgtgcaccatgtctgtggaccgctacatcgctgtgtgccaccctgtgaaggccctggacttccgcaccccaagaaatgccaagatcatcaacgtgtgcaactggatcctgagcagcgccatcggcctgcctgtgatgttcatggccaccaccaagtaccggcagggcagcattgactgcaccctgaccttcagccaccccacctggtactgggagaacctgctgaagatctgtgtgttcatctttgccttcatcatgcctgtgctgatcatcaccgtgtgctacggcctgatgatcctgcggctgaagtctgtgaggatgctgagcggcagcaaggagaaggacaggaacctgcggcgcatcaccaggatggtgctggtggtggtggccgtgttcatcgtgtgctggacccccatccacatctacgtgatcatcaaggccctggtgaccatccctgagaccaccttccagacagtgtcctggcacttctgcatcgccctgggctacaccaacagctgcctgaaccctgtgctgtatgccttcctggatgagaacttcaagcgctgcttccgggagttctgcatccccaccagcagcaacatcgagcagcagaacagcacccgcatccggcagaacacccgggaccaccccagcacagccaacacagtggacaggaccaaccaccagctggagaacctggaggccgagacagcccccctgccctag

SEQ ID NO: 162747 - DNA, 1209 bp, Artificial Sequence; identical to SEQ ID NO: 162739
  Description of Artificial Sequence: Synthetic coding sequence

SEQ ID NO: 162748 - DNA, 492 bp, Artificial Sequence
  Description of Artificial Sequence: Synthetic coding sequence
atggtgcaggccaggacaggcttctgcaagaagcagcaggagctgtggcagaggaggaaggaggccgctgaggccctgggcaccaggaaggtgtctgtgctgctggccaccagccacagcggggcccggcctgctgtgtccaccatggacagcagcgctgcccccaccaatgccagcaactgcacagatgccctggcctacagcagctgcagccctgcccccagccctggctcctgggtgaacctgagccacctggatggcaacctgagtgacccctgtggccccaacagaacagacctgggcggccgggacagcctgtgcccccccaccggcagccccagcatgatcacagccatcaccatcatggccctgtacagcatcgtgtgtgtggtgggcctgtttggaaacttcctggtgatgtatgtgattgtgcgctacaccaagatgaagacagccaccaacatctacatcttcaacctggccctggcctag

SEQ ID NO: 162749 - DNA, 903 bp, Artificial Sequence
  Description of Artificial Sequence: Synthetic coding sequence
atgaagacagccaccaacatctacatcttcaacctggccctggctgatgccctggccaccagcaccctgcccttccagagcgtgaactacctgatgggcacctggcccttcggcaccatcctgtgcaagatcgtcatcagcattgactactacaacatgttcaccagcatcttcaccctgtgcaccatgtctgtggaccgctacatcgctgtgtgccaccctgtgaaggccctggacttccgcaccccaagaaatgccaagatcatcaacgtgtgcaactggatcctgagcagcgccatcggcctgcctgtgatgttcatggccaccaccaagtaccggcagggcagcattgactgcaccctgaccttcagccaccccacctggtactgggagaacctgctgaagatctgtgtgttcatctttgccttcatcatgcctgtgctgatcatcaccgtgtgctacggcctgatgatcctgcggctgaagtctgtgaggatgctgagcggcagcaaggagaaggacaggaacctgcggcgcatcaccaggatggtgctggtggtggtggccgtgttcatcgtgtgctggacccccatccacatctacgtgatcatcaaggccctggtgaccatccctgagaccaccttccagacagtgtcctggcacttctgcatcgccctgggctacaccaacagctgcctgaaccctgtgctgtatgccttcctggatgagaacttcaagcgctgcttccgggagttctgcatccccaccagcagcaacatcgagcagcagaacagcacccgcatccggcagaacacccgggaccaccccagcacagccaacacagtggacaggaccaaccaccagctggagaacctggaggccgagacagcccccctgccctag

SEQ ID NO: 162750 - DNA, 903 bp, Artificial Sequence; identical to SEQ ID NO: 162749
  Description of Artificial Sequence: Synthetic coding sequence

SEQ ID NO: 162751 - DNA, 903 bp, Artificial Sequence; identical to SEQ ID NO: 162749
  Description of Artificial Sequence: Synthetic coding sequence

SEQ ID NO: 162752 - DNA, 1209 bp, Artificial Sequence; identical to SEQ ID NO: 162739
  Description of Artificial Sequence: Synthetic coding sequence

SEQ ID NO: 162753 - DNA, 561 bp, Artificial Sequence
  Description of Artificial Sequence: Synthetic coding sequence
atggacagcagcgctgcccccaccaatgccagcaactgcacagatgccctggcctacagcagctgcagccctgcccccagccctggctcctgggtgaacctgagccacctggatggcaacctgagtgacccctgtggccccaacagaacagacctgggcggccgggacagcctgtgcccccccaccggcagccccagcatgatcacagccatcaccatcatggccctgtacagcatcgtgtgtgtggtgggcctgtttggaaacttcctggtgatgtatgtgattgtgcgcttccaccggctgtacaccaacatcctgagcagcaacctggtgctgggcaagccagctgaggacctgtgcttccacctgcggctgcactacgccagcgcccaccactacagagtgctgtggacagatgacctggccccccaggagtgcccccacgccctgtggctgcagaggaagggccaggagagcagcaaggaccaccaggatggagctgggggcggcggctgtgtgcaccggctgctggacagccacagccacctgcggcaccactag

SEQ ID NO: 162754 - DNA, 1170 bp, Artificial Sequence
  Description of Artificial Sequence: Synthetic coding sequence
atggacagcagcgctgcccccaccaatgccagcaactgcacagatgccctggcctacagcagctgcagccctgcccccagccctggctcctgggtgaacctgagccacctggatggcaacctgagtgacccctgtggccccaacagaacagacctgggcggccgggacagcctgtgcccccccaccggcagccccagcatgatcacagccatcaccatcatggccctgtacagcatcgtgtgtgtggtgggcctgtttggaaacttcctggtgatgtatgtgattgtgcgctacaccaagatgaagacagccaccaacatctacatcttcaacctggccctggctgatgccctggccaccagcaccctgcccttccagagcgtgaactacctgatgggcacctggcccttcggcaccatcctgtgcaagatcgtcatcagcattgactactacaacatgttcaccagcatcttcaccctgtgcaccatgtctgtggaccgctacatcgctgtgtgccaccctgtgaaggccctggacttccgcaccccaagaaatgccaagatcatcaacgtgtgcaactggatcctgagcagcgccatcggcctgcctgtgatgttcatggccaccaccaagtaccggcagggcagcattgactgcaccctgaccttcagccaccccacctggtactgggagaacctgctgaagatctgtgtgttcatctttgccttcatcatgcctgtgctgatcatcaccgtgtgctacggcctgatgatcctgcggctgaagtctgtgaggatgctgagcggcagcaaggagaaggacaggaacctgcggcgcatcaccaggatggtgctggtggtggtggccgtgttcatcgtgtgctggacccccatccacatctacgtgatcatcaaggccctggtgaccatccctgagaccaccttccagacagtgtcctggcacttctgcatcgccctgggctacaccaacagctgcctgaaccctgtgctgtatgccttcctggatgagaacttcaagcgctgcttccgggagttctgcatccccaccagcagcaacatcgagcagcagaacagcacccgcatccggcagaacacccgggaccaccccagcacagccaacacagtggacaggaccaaccaccagagctag

SEQ ID NO: 162755 - DNA, 1095 bp, Artificial Sequence
  Description of Artificial Sequence: Synthetic coding sequence
atggcccagcagtggagcctgcagaggctggccggccgccacccccaggacagctatgaggacagcacccagagcagcatcttcacctacaccaacagcaacagcacccggggcccctttgagggccccaactaccacatcgccccccgctgggtgtaccacctgacctctgtgtggatgatctttgtggtgacagcctctgtgttcaccaacggcctggtgctggccgccaccatgaagttcaagaagctgcggcaccccctgaactggatcctggtgaacctggccgtggccgacctggccgagaccgtgattgccagcaccatcagcatcgtgaaccaggtgtctggctactttgtgctgggccaccccatgtgtgtgctggagggctacacagtgtccctgtgtggcatcaccggcctgtggagcctggccatcatctcctgggagcgctggctggtggtgtgcaagccctttggaaatgtgcgctttgatgccaagctggccatcgtgggcatcgccttctcctggatctggagcgctgtgtggacagccccacccatcttcggctggagccgctactggccccacggcctgaagaccagctgtggcccagatgtgttttctggcagcagctacccaggagtgcagagctacatgattgtgctgatggtgacctgctgcatcatccccctggccatcatcatgctgtgctacctgcaggtgtggctggccatccgggctgtggccaagcagcagaaggagagcgagagcacccagaaggccgagaaggaggtgaccaggatggtggtggtgatgatctttgcctactgtgtgtgctggggcccctacaccttctttgcctgctttgctgctgccaaccctggctacgccttccaccccctgatggccgccctgcctgcctactttgccaagagcgccaccatctacaaccctgtgatctacgtgttcatgaaccggcagttcaggaactgcatcctgcagctgtttgggaagaaggtggatgatggcagcgagctgagcagcgccagcaagacagaggtgtcctctgtgtcctctgtgtccccagcctag

SEQ ID NO: 162756 - DNA, 1095 bp, Artificial Sequence
  Description of Artificial Sequence: Synthetic coding sequence
atggcccagcagtggagcctgcagaggctggccggccgccacccccaggacagctatgaggacagcacccagagcagcatcttcacctacaccaacagcaacagcacccggggcccctttgagggccccaactaccacatcgccccccgctgggtgtaccacctgacctctgtgtggatgatctttgtggtgattgcctctgtgttcaccaacggcctggtgctggccgccaccatgaagttcaagaagctgcggcaccccctgaactggatcctggtgaacctggccgtggccgacctggccgagaccgtgattgccagcaccatctctgtggtgaaccaggtgtatggctactttgtgctgggccaccccatgtgtgtgctggagggctacacagtgtccctgtgtggcatcaccggcctgtggagcctggccatcatctcctgggagcgctggatggtggtgtgcaagccctttggaaatgtgcgctttgatgccaagctggccatcgtgggcatcgccttctcctggatctgggccgctgtgtggacagccccacccatcttcggctggagccgctactggccccacggcctgaagaccagctgtggcccagatgtgttttctggcagcagctacccaggagtgcagagctacatgattgtgctgatggtgacctgctgcatcacccccctgagcatcatcgtgctgtgctacctgcaggtgtggctggccatccgggctgtggccaagcagcagaaggagagcgagagcacccagaaggccgagaaggaggtgaccaggatggtggtggtgatggtgctggccttctgcttctgctggggcccctatgccttctttgcctgctttgctgctgccaaccctggctaccccttccaccccctgatggccgccctgcctgccttctttgccaagagcgccaccatctacaaccctgtgatctacgtgttcatgaaccggcagttcaggaactgcatcctgcagctgtttgggaagaaggtggatgatggcagcgagctgagcagcgccagcaagacagaggtgtcctctgtgtcctctgtgtccccagcctag

SEQ ID NO: 162757 - DNA, 1047 bp, Artificial Sequence
  Description of Artificial Sequence: Synthetic coding sequence
atgaggaagatgtctgaggaggagttctacctgttcaagaacatcagctctgtgggcccctgggatggcccccagtaccacatcgcccctgtgtgggccttctacctgcaggccgccttcatgggcaccgtcttcctgattggcttccccctgaatgccatggtgctggtggccaccctgcgctacaagaagctgcggcagcccctgaactacatcctggtgaatgtgtcctttggaggcttcctgctgtgcatcttctctgtgtttcctgtgtttgtggccagctgcaatggctactttgtgtttggaagacatgtgtgtgccctggagggcttcctgggcaccgtggccggcctggtgacaggctggagcctggccttcctggcctttgagcgctacatcgtcatctgcaagcccttcggcaacttccgcttcagcagcaagcacgccctgactgtggtgctggccacctggaccatcggcatcggcgtgtccatcccccccttcttcggctggagccgcttcatccctgagggcctgcagtgcagctgtggccctgactggtacacagtgggcaccaagtacagaagtgagagctacacctggttcctgttcatcttctgcttcatcgtgcccctgagcctcatctgcttctcctacacccagctgctgcgggccctgaaggctgtggccgcccagcagcaggagagcgccaccacccagaaggccgagcgggaggtgtccaggatggtggtggtgatggtgggcagcttctgtgtgtgctacgtgccctatgctgcctttgccatgtacatggtgaacaacagaaaccacggcctggacctgcggctggtgaccatccccagcttcttcagcaagagcgcctgcatctacaaccccatcatctactgcttcatgaacaagcagttccaggcctgcatcatgaagatggtgtgtgggaaggccatgacagatgaaagtgacacctgcagcagccagaagacagaggtgtccacagtgagcagcacccaggtgggccccaactag

SEQ ID NO: 162758 - DNA, 972 bp, Artificial Sequence
  Description of Artificial Sequence: Synthetic coding sequence
atgtacagcggcaacagaagtggcggccacggctactgggatggcggcggcgctgctggagctgagggccctgccccagctggcaccctgagccctgcccccctcttcagccctggcacctatgagcggctggccctgctgctgggcagcatcggcctgctgggcgtgggcaacaacctgctggtgctggtgctgtactacaagttccagaggctgcggacccccacccacctgctgctggtgaacatcagcctgagtgacctgctggtgtccctgtttggagtgaccttcacctttgtgtcctgcctgagaaatggctgggtgtgggacacagtgggctgtgtgtgggatggcttcagcggcagcctgtttggctggatcagccagctgcaggccgccacccgggaggcccgggcctccatgggccctgtgcagcagggcaccatctgcatgcagctgcgctgtgtggaggacctgcagaccatccaggtgatcaagatcctgaagtatgagaagaagctggccaagatgtgcttcctgatgatcttcaccttcctggtgtgctggatgccctacatcgtcatctgcttcctggtggtgaatggacatggccacctggtgacccccaccatcagcatcgtgtcctacctgtttgccaagagcaacacagtgtacaaccctgtgatctacgtgttcatgatcaggaagttccgccgcagcctgctgcagctgctgtgcctgcggctgctgcgctgccagaggcctgccaaggacctgcctgctgctggcagcgagatgcagatccggcccatcgtgatgagccagaaggatggagaccggcccaagaagaaggtgaccttcaacagcagcagcatcatcttcatcatcaccagtgatgagagcctgtctgtggatgacagcgacaagaccaacggcagcaaggtggatgtgatccaggtgcggcccctgtag

SEQ ID NO: 162759 - DNA, 1209 bp, Artificial Sequence
  Description of Artificial Sequence: Synthetic coding sequence
atgtacagcggcaacagaagtggcggccacggctactgggatggcggcggcgctgctggagctgagggccctgccccagctggcaccctgagccctgcccccctcttcagccctggcacctatgagcggctggccctgctgctgggcagcatcggcctgctgggcgtgggcaacaacctgctggtgctggtgctgtactacaagttccagaggctgcggacccccacccacctgctgctggtgaacatcagcctgagtgacctgctggtgtccctgtttggagtgaccttcacctttgtgtcctgcctgagaaatggctgggtgtgggacacagtgggctgtgtgtgggatggcttcagcggcagcctgtttggcatcgtgtccatcgccaccctgactgtgctggcctatgagcgctacatccgggtggtgcacgcccgggtcatcaacttctcctgggcctggagggccatcacctacatctggctgtacagcctggcctgggccggggcccccctgctgggctggaaccgctacatcctggatgtgcacggcctgggctgcaccgtggactggaagagcaaggatgccaatgacagcagctttgtgctcttcctgttcctgggctgcctggtggtgcccctgggcgtcatcgcccactgctacggccacatcctgtacagcatccgcatgctgcgctgtgtggaggacctgcagaccatccaggtgatcaagatcctgaagtatgagaagaagctggccaagatgtgcttcctgatgatcttcaccttcctggtgtgctggatgccctacatcgtcatctgcttcctggtggtgaatggccacggccacctggtgacccccaccatcagcatcgtgtcctacctgtttgccaagagcaacacagtgtacaaccctgtgatctacgtgttcatgatcaggaagttcagaagaagcctgctgcagctgctgtgcctgcggctgctgcgctgccagaggcctgccaaggacctgcctgctgctggcagcgagatgcagatccggcccatcgtgatgagccagaaggatggagaccggcccaagaagaaggtgaccttcaacagcagcagcatcatcttcatcatcaccagtgatgagagcctgtctgtggatgacagcgacaagaccaacggcagcaaggtggatgtgatccaggtgcggcccctgtag

SEQ ID NO: 162760 - DNA, 2886 bp, Artificial Sequence
  Description of Artificial Sequence: Synthetic coding sequence
atgtggaggctgcggcgggctgctgtggcctgtgaggtgtgccagagcctggtgaagcacagcagcggcatcaagggcagcctgcccctgcagaagctgcacctggtgagccgcagcatctaccacagccaccaccccaccctgaagctgcagaggccccagctgcggaccagcttccagcagttcagcagcctgaccaacctgcccctgaggaagctgaagttcagccccatcaagtatggctaccagcccaggaggaacttctggccagcccggctggccacccggctgctgaagctgcgctacctgatcctgggcagcgctgtgggcggcggctacacagccaagaagacctttgaccagtggaaggacatgatcccagacctgtctgagtacaagtggatcgtgcctgacatcgtgtgggagattgatgagtacatcgactttggcagccctgaggagacagccttccgggccacagaccggggcagcgagagtgacaagcacttcaggaagggcctgctgggggagctgatcctgctgcagcagcagatccaggagcacgaggaggaggccaggagagctgctggccagtacagcaccagctatgcccagcagaagaggaaggtgtctgacaaggagaagattgaccagctgcaggaggagctgctgcacacccagctgaagtaccagaggatcctggagcggctggagaaggagaacaaggagctgaggaagctggtgctgcagaaggatgacaagggcatccaccacaggaagctgaagaagagcctgattgacatgtacagcgaggtgctggatgtgctgagtgactatgatgccagctacaacacccaggaccacctgccccgggtggtggtggtgggggaccagagcgctgggaagacctctgtgctggagatgattgcccaggcccgcatcttcccccggggcagcggggagatgatgaccaggagccctgtgaaggtgaccctgtctgagggcccccaccacgtggccctcttcaaggacagcagccgggagtttgacctgaccaaggaggaggacctggccgccctgcggcatgaaattgagctgaggatgaggaagaatgtgaaggagggctgcaccgtgtccccagagaccatcagcctgaatgtgaagggccctggcctgcagaggatggtgctggtggacctgcccggggtcatcaacacagtgaccagcggcatggccccagacaccaaggagaccatcttcagcatcagcaaggcctacatgcagaaccccaatgccatcatcctgtgcatccaggacggctctgtggatgctgagaggagcatcgtgacagacctggtgtcccagatggacccccatggaagaaggaccatctttgtgctgaccaaggtggacctggccgagaagaatgtggccagccccagccgcatccagcagatcatcgagggcaagctgttccccatgaaggccctgggctactttgctgtggtgacaggcaagggcaacagcagcgagagcattgaggccatccgggagtatgaggaggagttcttccagaacagcaagctgctgaagacctccatgctgaaggcccaccaggtgaccaccaggaacctgagcctggccgtgtctgactgcttctggaagatggtgcgggagagcgtggagcagcaggccgacagcttcaaggccacccgcttcaacctggagacagagtggaagaacaactacccccggctgcgggagctggacagaaatgagctgtttgagaaggccaagaatgagatcctggatgaggtgatcagcctgagccaggtgacccccaagcactgggaggagatcctgcagcagagcctgtgggagcgggtgtccacccacgtgattgagaacatctacctgcctgctgcccagaccatgaacagcggcaccttcaacaccaccgtggacatcaagctgaagcagtggacagacaagcagctgcccaacaaggctgtggaggtggcctgggagaccctgcaggaggagttcagccgcttcatgacagagcccaagggcaaggagcatgatgacatctttgacaagctgaaggaggccgtgaaggaggagagcatcaagaggcacaagtggaatgactttgctgaggacagcctgcgggtcatccagcacaatgccctggaggacaggagcatcagtgacaagcagcagtgggatgctgccatctacttcatggaggaggccctgcaggcccggctgaaggacacagaaaatgccatcgagaacatggtgggccctgactggaagaagcgctggctgtactggaagaacagaacccaggagcagtgtgtgcacaatgagaccaagaatgagctggagaagatgctgaagtgcaatgaggagcacccagcctacctggccagtgatgagatcaccaccgtgaggaagaacctggagagccggggcgtggaggtggaccccagcctcatcaaggacacctggcaccaggtgtacagaagacacttcctgaagacagccctgaaccactgcaacctgtgccggcggggcttctactactaccagaggcactttgtggacagcgagctggagtgcaatgatgtggtgctcttctggaggatccagaggatgctggccatcacagccaacaccctgcggcagcagctgaccaacacagaggtgcggcggctggagaagaatgtgaaggaggtgctggaggactttgctgaagatggagagaagaagatcaagctgctgaccgggaagagggtgcagctggccgaggacctgaagaaggtgcgggagatccaggagaagctggatgccttcatcgaggccctgcaccaggagaagtag

SEQ ID NO: 162761 - DNA, 3048 bp, Artificial Sequence
  Description of Artificial Sequence: Synthetic coding sequence
atgtggaggctgcggcgggctgctgtggcctgtgaggtgtgccagagcctggtgaagcacagcagcggcatcaagggcagcctgcccctgcagaagctgcacctggtgagccgcagcatctaccacagccaccaccccaccctgaagctgcagaggccccagctgcggaccagcttccagcagttcagcagcctgaccaacctgcccctgaggaagctgaagttcagccccatcaagtatggctaccagcccaggaggaacttctggccagcccggctggccacccggctgctgaagctgcgctacctgatcctgggcagcgctgtgggcggcggctacacagccaagaagacctttgaccagtggaaggacatgatcccagacctgtctgagtacaagtggatcgtgcctgacatcgtgtgggagattgatgagtacatcgactttgagaagatcaggaaggccctgcccagcagcgaggacctggtgaagctggccccagactttgacaagatcgtggagagcctgagcctgctgaaggacttcttcaccagcggccacaagctggtgtctgaggtgattggagccagtgacctgctgctgctgctgggcagccctgaggagacagccttccgggccacagaccggggcagcgagagtgacaagcacttcaggaagggcctgctgggggagctgatcctgctgcagcagcagatccaggagcacgaggaggaggccaggagagctgctggccagtacagcaccagctatgcccagcagaagaggaaggtgtctgacaaggagaagattgaccagctgcaggaggagctgctgcacacccagctgaagtaccagaggatcctggagcggctggagaaggagaacaaggagctgaggaagctggtgctgcagaaggatgacaagggcatccaccacaggaagctgaagaagagcctgattgacatgtacagcgaggtgctggatgtgctgagtgactatgatgccagctacaacacccaggaccacctgccccgggtggtggtggtgggggaccagagcgctgggaagacctctgtgctggagatgattgcccaggcccgcatcttcccccggggcagcggggagatgatgaccaggagccctgtgaaggtgaccctgtctgagggcccccaccacgtggccctcttcaaggacagcagccgggagtttgacctgaccaaggaggaggacctggccgccctgcggcatgaaattgagctgaggatgaggaagaatgtgaaggagggctgcaccgtgtccccagagaccatcagcctgaatgtgaagggccctggcctgcagaggatggtgctggtggacctgcccggggtcatcaacacagtgaccagcggcatggccccagacaccaaggagaccatcttcagcatcagcaaggcctacatgcagaaccccaatgccatcatcctgtgcatccaggacggctctgtggatgctgagaggagcatcgtgacagacctggtgtcccagatggacccccatggaagaaggaccatctttgtgctgaccaaggtggacctggccgagaagaatgtggccagccccagccgcatccagcagatcatcgagggcaagctgttccccatgaaggccctgggctactttgctgtggtgacaggcaagggcaacagcagcgagagcattgaggccatccgggagtatgaggaggagttcttccagaacagcaagctgctgaagacctccatgctgaaggcccaccaggtgaccaccaggaacctgagcctggccgtgtctgactgcttctggaagatggtgcgggagagcgtggagcagcaggccgacagcttcaaggccacccgcttcaacctggagacagagtggaagaacaactacccccggctgcgggagctggacagaaatgagctgtttgagaaggccaagaatgagatcctggatgaggtgatcagcctgagccaggtgacccccaagcactgggaggagatcctgcagcagagcctgtgggagcgggtgtccacccacgtgattgagaacatctacctgcctgctgcccagaccatgaacagcggcaccttcaacaccaccgtggacatcaagctgaagcagtggacagacaagcagctgcccaacaaggctgtggaggtggcctgggagaccctgcaggaggagttcagccgcttcatgacagagcccaagggcaaggagcatgatgacatctttgacaagctgaaggaggccgtgaaggaggagagcatcaagaggcacaagtggaatgactttgctgaggacagcctgcgggtcatccagcacaatgccctggaggacaggagcatcagtgacaagcagcagtgggatgctgccatctacttcatggaggaggccctgcaggcccggctgaaggacacagaaaatgccatcgagaacatggtgggccctgactggaagaagcgctggctgtactggaagaacagaacccaggagcagtgtgtgcacaatgagaccaagaatgagctggagaagatgctgaagtgcaatgaggagcacccagcctacctggccagtgatgagatcaccaccgtgaggaagaacctggagagccggggcgtggaggtggaccccagcctcatcaaggacacctggcaccaggtgtacagaagacacttcctgaagacagccctgaaccactgcaacctgtgccggcggggcttctactactaccagaggcactttgtggacagcgagctggagtgcaatgatgtggtgctcttctggaggatccagaggatgctggccatcacagccaacaccctgcggcagcagctgaccaacacagaggtgcggcggctggagaagaatgtgaaggaggtgctggaggactttgctgaagatggagagaagaagatcaagctgctgaccgggaagagggtgcagctggccgaggacctgaagaaggtgcgggagatccaggagaagctggatgccttcatcgaggccctgcaccaggagaagtag

SEQ ID NO: 162762 - DNA, 2940 bp, Artificial Sequence
  Description of Artificial Sequence: Synthetic coding sequence
atgtggaggctgcggcgggctgctgtggcctgtgaggtgtgccagagcctggtgaagcacagcagcggcatcaagggcagcctgcccctgcagaagctgcacctggtgagccgcagcatctaccacagccaccaccccaccctgaagctgcagaggccccagctgcggaccagcttccagcagttcagcagcctgaccaacctgcccctgaggaagctgaagttcagccccatcaagtatggctaccagcccaggaggaacttctggccagcccggctggccacccggctgctgaagctgcgctacctgatcctgggcagcgctgtgggcggcggctacacagccaagaagacctttgaccagtggaaggacatgatcccagacctgtctgagtacaagtggatcgtgcctgacatcgtgtgggagattgatgagtacatcgactttggccacaagctggtgtctgaggtgattggagccagtgacctgctgctgctgctgggcagccctgaggagacagccttccgggccacagaccggggcagcgagagtgacaagcacttcaggaagggcctgctgggggagctgatcctgctgcagcagcagatccaggagcacgaggaggaggccaggagagctgctggccagtacagcaccagctatgcccagcagaagaggaaggtgtctgacaaggagaagattgaccagctgcaggaggagctgctgcacacccagctgaagtaccagaggatcctggagcggctggagaaggagaacaaggagctgaggaagctggtgctgcagaaggatgacaagggcatccaccacaggaagctgaagaagagcctgattgacatgtacagcgaggtgctggatgtgctgagtgactatgatgccagctacaacacccaggaccacctgccccgggtggtggtggtgggggaccagagcgctgggaagacctctgtgctggagatgattgcccaggcccgcatcttcccccggggcagcggggagatgatgaccaggagccctgtgaaggtgaccctgtctgagggcccccaccacgtggccctcttcaaggacagcagccgggagtttgacctgaccaaggaggaggacctggccgccctgcggcatgaaattgagctgaggatgaggaagaatgtgaaggagggctgcaccgtgtccccagagaccatcagcctgaatgtgaagggccctggcctgcagaggatggtgctggtggacctgcccggggtcatcaacacagtgaccagcggcatggccccagacaccaaggagaccatcttcagcatcagcaaggcctacatgcagaaccccaatgccatcatcctgtgcatccaggacggctctgtggatgctgagaggagcatcgtgacagacctggtgtcccagatggacccccatggaagaaggaccatctttgtgctgaccaaggtggacctggccgagaagaatgtggccagccccagccgcatccagcagatcatcgagggcaagctgttccccatgaaggccctgggctactttgctgtggtgacaggcaagggcaacagcagcgagagcattgaggccatccgggagtatgaggaggagttcttccagaacagcaagctgctgaagacctccatgctgaaggcccaccaggtgaccaccaggaacctgagcctggccgtgtctgactgcttctggaagatggtgcgggagagcgtggagcagcaggccgacagcttcaaggccacccgcttcaacctggagacagagtggaagaacaactacccccggctgcgggagctggacagaaatgagctgtttgagaaggccaagaatgagatcctggatgaggtgatcagcctgagccaggtgacccccaagcactgggaggagatcctgcagcagagcctgtgggagcgggtgtccacccacgtgattgagaacatctacctgcctgctgcccagaccatgaacagcggcaccttcaacaccaccgtggacatcaagctgaagcagtggacagacaagcagctgcccaacaaggctgtggaggtggcctgggagaccctgcaggaggagttcagccgcttcatgacagagcccaagggcaaggagcatgatgacatctttgacaagctgaaggaggccgtgaaggaggagagcatcaagaggcacaagtggaatgactttgctgaggacagcctgcgggtcatccagcacaatgccctggaggacaggagcatcagtgacaagcagcagtgggatgctgccatctacttcatggaggaggccctgcaggcccggctgaaggacacagaaaatgccatcgagaacatggtgggccctgactggaagaagcgctggctgtactggaagaacagaacccaggagcagtgtgtgcacaatgagaccaagaatgagctggagaagatgctgaagtgcaatgaggagcacccagcctacctggccagtgatgagatcaccaccgtgaggaagaacctggagagccggggcgtggaggtggaccccagcctcatcaaggacacctggcaccaggtgtacagaagacacttcctgaagacagccctgaaccactgcaacctgtgccggcggggcttctactactaccagaggcactttgtggacagcgagctggagtgcaatgatgtggtgctcttctggaggatccagaggatgctggccatcacagccaacaccctgcggcagcagctgaccaacacagaggtgcggcggctggagaagaatgtgaaggaggtgctggaggactttgctgaagatggagagaagaagatcaagctgctgaccgggaagagggtgcagctggccgaggacctgaagaaggtgcgggagatccaggagaagctggatgccttcatcgaggccctgcaccaggagaagtag

SEQ ID NO: 162763 - DNA, 2937 bp, Artificial Sequence
  Description of Artificial Sequence: Synthetic coding sequence
atgtggaggctgcggcgggctgctgtggcctgtgaggtgtgccagagcctggtgaagcacagcagcggcatcaagggcagcctgcccctgcagaagctgcacctggtgagccgcagcatctaccacagccaccaccccaccctgaagctgcagaggccccagctgcggaccagcttccagcagttcagcagcctgaccaacctgcccctgaggaagctgaagttcagccccatcaagtatggctaccagcccaggaggaacttctggccagcccggctggccacccggctgctgaagctgcgctacctgatcctgggcagcgctgtgggcggcggctacacagccaagaagacctttgaccagtggaaggacatgatcccagacctgtctgagtacaagtggatcgtgcctgacatcgtgtgggagattgatgagtacatcgactttgagaagatcaggaaggccctgcccagcagcgaggacctggtgaagctggccccagactttgacaagatcgtggagagcctgagcctgctgaaggacttcttcaccagcggccacaagctggtgtctgaggtgattggagccagtgacctgctgctgctgctgggcagccctgaggagacagccttccgggccacagaccggggcagcgagagtgacaagcacttcaggaaggtgtctgacaaggagaagattgaccagctgcaggaggagctgctgcacacccagctgaagtaccagaggatcctggagcggctggagaaggagaacaaggagctgaggaagctggtgctgcagaaggatgacaagggcatccaccacaggaagctgaagaagagcctgattgacatgtacagcgaggtgctggatgtgctgagtgactatgatgccagctacaacacccaggaccacctgccccgggtggtggtggtgggggaccagagcgctgggaagacctctgtgctggagatgattgcccaggcccgcatcttcccccggggcagcggggagatgatgaccaggagccctgtgaaggtgaccctgtctgagggcccccaccacgtggccctcttcaaggacagcagccgggagtttgacctgaccaaggaggaggacctggccgccctgcggcatgaaattgagctgaggatgaggaagaatgtgaaggagggctgcaccgtgtccccagagaccatcagcctgaatgtgaagggccctggcctgcagaggatggtgctggtggacctgcccggggtcatcaacacagtgaccagcggcatggccccagacaccaaggagaccatcttcagcatcagcaaggcctacatgcagaaccccaatgccatcatcctgtgcatccaggacggctctgtggatgctgagaggagcatcgtgacagacctggtgtcccagatggacccccacggccgccgcaccatctttgtgctgaccaaggtggacctggccgagaagaatgtggccagccccagccgcatccagcagatcatcgagggcaagctgttccccatgaaggccctgggctactttgctgtggtgactggaaaaggaaacagcagcgagagcattgaggccatccgggagtatgaggaggagttcttccagaacagcaagctgctgaagacctccatgctgaaggcccaccaggtgaccaccaggaacctgagcctggccgtgtctgactgcttctggaagatggtgcgggagagcgtggagcagcaggccgacagcttcaaggccacccgcttcaacctggagacagagtggaagaacaactacccccggctgcgggagctggacagaaatgagctgtttgagaaggccaagaatgagatcctggatgaagtcatcagcctgagccaggtgacccccaagcactgggaggagatcctgcagcagagcctgtgggagcgggtgtccacccacgtgattgagaacatctacctgcctgctgcccagaccatgaacagcggcaccttcaacaccaccgtggacatcaagctgaagcagtggacagacaagcagctgcccaacaaggctgtggaggtggcctgggagaccctgcaggaggagttcagccgcttcatgacagagcccaagggcaaggagcatgatgacatctttgacaagctgaaggaggccgtgaaggaggagagcatcaagaggcacaagtggaatgactttgctgaggacagcctgcgggtcatccagcacaatgccctggaggacaggagcatcagtgacaagcagcagtgggatgctgccatctacttcatggaggaggccctgcaggcccggctgaaggacacagaaaatgccatcgagaacatggtgggccctgactggaagaagcgctggctgtactggaagaacagaacccaggagcagtgtgtgcacaatgagaccaagaatgagctggagaagatgctgaagtgcaatgaggagcacccagcctacctggccagtgatgagatcaccaccgtgaggaagaacctggagagcagaggagtggaggtggaccccagcctcatcaaggacacctggcaccaggtgtaccgccgccacttcctgaagacagccctgaaccactgcaacctgtgcagaagaggcttctactactaccagaggcactttgtggacagcgagctggagtgcaatgatgtggtgctcttctggaggatccagaggatgctggccatcacagccaacaccctgcggcagcagctgaccaacacagaggtgcggcggctggagaagaatgtgaaggaggtgctggaggactttgctgaagatggagagaagaagatcaagctgctgaccgggaagagggtgcagctggccgaggacctgaagaaggtgcgggagatccaggagaagctggatgccttcatcgaggccctgcaccaggagaagtag

SEQ ID NO: 162764 - DNA, 2994 bp, Artificial Sequence
  Description of Artificial Sequence: Synthetic coding sequence
atgtggaggctgcggcgggctgctgtggcctgtgaggtgtgccagagcctggtgaagcacagcagcggcatcaagggcagcctgcccctgcagaagctgcacctggtgagccgcagcatctaccacagccaccaccccaccctgaagctgcagaggccccagctgcggaccagcttccagcagttcagcagcctgaccaacctgcccctgaggaagctgaagttcagccccatcaagtatggctaccagcccaggaggaacttctggccagcccggctggccacccggctgctgaagctgcgctacctgatcctgggcagcgctgtgggcggcggctacacagccaagaagacctttgaccagtggaaggacatgatcccagacctgtctgagtacaagtggatcgtgcctgacatcgtgtgggagattgatgagtacatcgactttgagaagatcaggaaggccctgcccagcagcgaggacctggtgaagctggccccagactttgacaagatcgtggagagcctgagcctgctgaaggacttcttcaccagcggcagccctgaggagacagccttccgggccacagaccggggcagcgagagtgacaagcacttcaggaagggcctgctgggggagctgatcctgctgcagcagcagatccaggagcacgaggaggaggccaggagagctgctggccagtacagcaccagctatgcccagcagaagaggaaggtgtctgacaaggagaagattgaccagctgcaggaggagctgctgcacacccagctgaagtaccagaggatcctggagcggctggagaaggagaacaaggagctgaggaagctggtgctgcagaaggatgacaagggcatccaccacaggaagctgaagaagagcctgattgacatgtacagcgaggtgctggatgtgctgagtgactatgatgccagctacaacacccaggaccacctgccccgggtggtggtggtgggggaccagagcgctgggaagacctctgtgctggagatgattgcccaggcccgcatcttcccccggggcagcggggagatgatgaccaggagccctgtgaaggtgaccctgtctgagggcccccaccacgtggccctcttcaaggacagcagccgggagtttgacctgaccaaggaggaggacctggccgccctgcggcatgaaattgagctgaggatgaggaagaatgtgaaggagggctgcaccgtgtccccagagaccatcagcctgaatgtgaagggccctggcctgcagaggatggtgctggtggacctgcccggggtcatcaacacagtgaccagcggcatggccccagacaccaaggagaccatcttcagcatcagcaaggcctacatgcagaaccccaatgccatcatcctgtgcatccaggacggctctgtggatgctgagaggagcatcgtgacagacctggtgtcccagatggacccccatggaagaaggaccatctttgtgctgaccaaggtggacctggccgagaagaatgtggccagccccagccgcatccagcagatcatcgagggcaagctgttccccatgaaggccctgggctactttgctgtggtgacaggcaagggcaacagcagcgagagcattgaggccatccgggagtatgaggaggagttcttccagaacagcaagctgctgaagacctccatgctgaaggcccaccaggtgaccaccaggaacctgagcctggccgtgtctgactgcttctggaagatggtgcgggagagcgtggagcagcaggccgacagcttcaaggccacccgcttcaacctggagacagagtggaagaacaactacccccggctgcgggagctggacagaaatgagctgtttgagaaggccaagaatgagatcctggatgaggtgatcagcctgagccaggtgacccccaagcactgggaggagatcctgcagcagagcctgtgggagcgggtgtccacccacgtgattgagaacatctacctgcctgctgcccagaccatgaacagcggcaccttcaacaccaccgtggacatcaagctgaagcagtggacagacaagcagctgcccaacaaggctgtggaggtggcctgggagaccctgcaggaggagttcagccgcttcatgacagagcccaagggcaaggagcatgatgacatctttgacaagctgaaggaggccgtgaaggaggagagcatcaagaggcacaagtggaatgactttgctgaggacagcctgcgggtcatccagcacaatgccctggaggacaggagcatcagtgacaagcagcagtgggatgctgccatctacttcatggaggaggccctgcaggcccggctgaaggacacagaaaatgccatcgagaacatggtgggccctgactggaagaagcgctggctgtactggaagaacagaacccaggagcagtgtgtgcacaatgagaccaagaatgagctggagaagatgctgaagtgcaatgaggagcacccagcctacctggccagtgatgagatcaccaccgtgaggaagaacctggagagccggggcgtggaggtggaccccagcctcatcaaggacacctggcaccaggtgtacagaagacacttcctgaagacagccctgaaccactgcaacctgtgccggcggggcttctactactaccagaggcactttgtggacagcgagctggagtgcaatgatgtggtgctcttctggaggatccagaggatgctggccatcacagccaacaccctgcggcagcagctgaccaacacagaggtgcggcggctggagaagaatgtgaaggaggtgctggaggactttgctgaagatggagagaagaagatcaagctgctgaccgggaagagggtgcagctggccgaggacctgaagaaggtgcgggagatccaggagaagctggatgccttcatcgaggccctgcaccaggagaagtag

SEQ ID NO: 162765 - DNA, 501 bp, Artificial Sequence
  Description of Artificial Sequence: Synthetic coding sequence
atgtggaggctgcggcgggctgctgtggcctgtgaggtgtgccagagcctggtgaagcacagcagcggcatcaagggcagcctgcccctgcagaagctgcacctggtgagccgcagcatctaccacagccaccaccccaccctgaagctgcagaggccccagctgcggaccagcttccagcagttcagcagcctgaccaacctgcccctgaggaagctgaagttcagccccatcaagtatggctaccagcccaggaggaacttctggccagcccggctggccacccggctgctgaagctgcgctacctgatcctgggcagcgctgtgggcggcggctacacagccaagaagacctttgaccagtggaaggacatgatcccagacctgtctgagtacaagtggatcgtgcctgacatcgtgtgggagattgatgagtacatcgactttggcagccctgaggagacagccttccgggccacagaccggggcagcgagagctag

SEQ ID NO: 162766 - DNA, 2883 bp, Artificial Sequence
  Description of Artificial Sequence: Synthetic coding sequence
atgtggaggctgcggcgggctgctgtggcctgtgaggtgtgccagagcctggtgaagcacagcagcggcatcaagggcagcctgcccctgcagaagctgcacctggtgagccgcagcatctaccacagccaccaccccaccctgaagctgcagaggccccagctgcggaccagcttccagcagttcagcagcctgaccaacctgcccctgaggaagctgaagttcagccccatcaagtatggctaccagcccaggaggaacttctggccagcccggctggccacccggctgctgaagctgcgctacctgatcctgggcagcgctgtgggcggcggctacacagccaagaagacctttgaccagtggaaggacatgatcccagacctgtctgagtacaagtggatcgtgcctgacatcgtgtgggagattgatgagtacatcgactttgagaagatcaggaaggccctgcccagcagcgaggacctggtgaagctggccccagactttgacaagatcgtggagagcctgagcctgctgaaggacttcttcaccagcggcagccctgaggagacagccttccgggccacagaccggggcagcgagagtgacaagcacttcaggaaggtgtctgacaaggagaagattgaccagctgcaggaggagctgctgcacacccagctgaagtaccagaggatcctggagcggctggagaaggagaacaaggagctgaggaagctggtgctgcagaaggatgacaagggcatccaccacaggaagctgaagaagagcctgattgacatgtacagcgaggtgctggatgtgctgagtgactatgatgccagctacaacacccaggaccacctgccccgggtggtggtggtgggggaccagagcgctgggaagacctctgtgctggagatgattgcccaggcccgcatcttcccccggggcagcggggagatgatgaccaggagccctgtgaaggtgaccctgtctgagggcccccaccacgtggccctcttcaaggacagcagccgggagtttgacctgaccaaggaggaggacctggccgccctgcggcatgaaattgagctgaggatgaggaagaatgtgaaggagggctgcaccgtgtccccagagaccatcagcctgaatgtgaagggccctggcctgcagaggatggtgctggtggacctgcccggggtcatcaacacagtgaccagcggcatggccccagacaccaaggagaccatcttcagcatcagcaaggcctacatgcagaaccccaatgccatcatcctgtgcatccaggacggctctgtggatgctgagaggagcatcgtgacagacctggtgtcccagatggacccccacggccgccgcaccatctttgtgctgaccaaggtggacctggccgagaagaatgtggccagccccagccgcatccagcagatcatcgagggcaagctgttccccatgaaggccctgggctactttgctgtggtgactggaaaaggaaacagcagcgagagcattgaggccatccgggagtatgaggaggagttcttccagaacagcaagctgctgaagacctccatgctgaaggcccaccaggtgaccaccaggaacctgagcctggccgtgtctgactgcttctggaagatggtgcgggagagcgtggagcagcaggccgacagcttcaaggccacccgcttcaacctggagacagagtggaagaacaactacccccggctgcgggagctggacagaaatgagctgtttgagaaggccaagaatgagatcctggatgaagtcatcagcctgagccaggtgacccccaagcactgggaggagatcctgcagcagagcctgtgggagcgggtgtccacccacgtgattgagaacatctacctgcctgctgcccagaccatgaacagcggcaccttcaacaccaccgtggacatcaagctgaagcagtggacagacaagcagctgcccaacaaggctgtggaggtggcctgggagaccctgcaggaggagttcagccgcttcatgacagagcccaagggcaaggagcatgatgacatctttgacaagctgaaggaggccgtgaaggaggagagcatcaagaggcacaagtggaatgactttgctgaggacagcctgcgggtcatccagcacaatgccctggaggacaggagcatcagtgacaagcagcagtgggatgctgccatctacttcatggaggaggccctgcaggcccggctgaaggacacagaaaatgccatcgagaacatggtgggccctgactggaagaagcgctggctgtactggaagaacagaacccaggagcagtgtgtgcacaatgagaccaagaatgagctggagaagatgctgaagtgcaatgaggagcacccagcctacctggccagtgatgagatcaccaccgtgaggaagaacctggagagcagaggagtggaggtggaccccagcctcatcaaggacacctggcaccaggtgtaccgccgccacttcctgaagacagccctgaaccactgcaacctgtgcagaagaggcttctactactaccagaggcactttgtggacagcgagctggagtgcaatgatgtggtgctcttctggaggatccagaggatgctggccatcacagccaacaccctgcggcagcagctgaccaacacagaggtgcggcggctggagaagaatgtgaaggaggtgctggaggactttgctgaagatggagagaagaagatcaagctgctgaccgggaagagggtgcagctggccgaggacctgaagaaggtgcgggagatccaggagaagctggatgccttcatcgaggccctgcaccaggagaagtag

SEQ ID NO: 162767 - DNA, 558 bp, Artificial Sequence
  Description of Artificial Sequence: Synthetic coding sequence
tgatatctcatcctgggcagcgctgtgggcggcggctacacagccaagaagacctttgaccagtggaaggacatgatcccagacctgtctgagtacaagtggatcgtgcctgacatcgtgtgggagattgatgagtacatcgactttgagaagatcaggaaggccctgcccagcagcgaggacctggtgaagctggccccagactttgacaagatcgtggagagcctgagcctgctgaaggacttcttcaccagcggccacaagctggtgtctgaggtgattggagccagtgacctgctgctgctgctgggcagccctgaggagacagccttccgggccacagaccggggcagcgagagtgacaagcacttcaggaaggtgtctgacaaggagaagattgaccagctgcaggaggagctgctgcacacccagctgaagtaccagaggatcctggagcggctggagaaggagaacaaggagctgaggaagctggtgctgcagaaggatgacaagggcatccaccacaggaagctgaagaagagcctgattgacatgtag

SEQ ID NO: 162768 - DNA, 540 bp, Artificial Sequence
  Description of Artificial Sequence: Synthetic coding sequence
atggtggtgggcgccttccccatggccaagctgctgtacctgggcatccggcaggtgtccaagcccctggccaaccgcatcaaggaggccgcccggcgctctgagttcttcaagacctacatctgcctgcccccagcccagctgtaccactgggtggagatgaggaccaagatgaggatcatgggcttccggggcaccgtcatcaagcccctgaatgaggaggccgctgctgagctgggcgctgagctgctgggggaggccaccatcttcatcgtgggcggcggctgcctggtgctggagtactggaggcaccaggcccagcagaggcacaaggaggaggagcagagagctgcctggaatgccctgagagatgaggtgggccacctggccctggccctggaggccctgcaggcccaggtgcaggccgccccaccccagggcgccctggaggagctgaggacagagctgcaggaggtgcgggcccagctgtgcaaccctggccgcagcgccagccatgctgtgcctgccagcaagaagtag

SEQ ID NO: 162769 - DNA, 543 bp, Artificial Sequence
  Description of Artificial Sequence: Synthetic coding sequence
atggtggtgggcgccttccccatggccaagctgctgtacctgggcatccggcaggtgtccaagcccctggccaaccgcatcaaggaggccgcccggcgctctgagttcttcaagacctacatctgcctgcccccagcccagctgtaccactggctggagatgaggaccaagatgaggatcatgggcttcaatgctgctgccatcaagcccctgaatgaaggagctgctgctgagctgggcgctgagctgctgggggagggcatcatcttcatcacagcctgcagctgcctgatgctggagtactggaggcaccagctgcagcagaggaggaaggagaaggagaggagagtggcccgggaggccctgcggggggaggtgggccacctgggcctggccctggaggagctgcaggcccaggtgcaggccaccagcacccagctggccctggaggagctgcgggcccagctgcaggaggtgcgggcccacctgtgcctgcgggaccccccaccagcccctcctgtggccccagccagcgagaagtag

SEQ ID NO: 162770 - DNA, 381 bp, Artificial Sequence
  Description of Artificial Sequence: Synthetic coding sequence
atgaggaccaagatgaggatcatgggcttccggggcaccgtcatcaagcccctgaatgaggaggccgctgctgagctgggcgctgagctgctgggggaggccaccatcttcatcgtgggcggcggctgcctggtgctggagtactggaggcaccaggcccagcagaggcacaaggaggaggagcagagagctgcctggaatgccctgagagatgaggtgggccacctggccctggccctggaggccctgcaggcccaggtgcaggccgccccaccccagggcgccctggaggagctgaggacagagctgcaggaggtgcgggcccagctgtgcaaccctggccgcagcgccagccatgctgtgcctgccagcaagaagtag

SEQ ID NO: 162771 - DNA, 1734 bp, Artificial Sequence
  Description of Artificial Sequence: Synthetic coding sequence
atgagccaccagcccctgagctgcctgacagagaaggaggacagccccagcgagagcactggaaatggccccccccacctggcccaccccaacctggacaccttcaccccagaggagctgctgcagcagatgaaggagctgctgacagagaaccaccagctgaaggaggccatgaagctgaacaaccaggccatgaagggccgctttgaggagctgagcgcctggacagagaagcagaaggaggagcggcagttctttgagatccagagcaaggaggccaaggagcggctgatggccctgagccatgaaaatgagaagctgaaggaggagctgggcaagctgaagggcaagtctgagaggagcagcgaggaccccacagatgacagccggctgcccagggctgaggccgagcaggagaaggaccagctgcggacccaggtggtgcggctgcaggccgagaaggctgacctgctgggcatcgtgtctgagctgcagctgaagctgaacagcagcggcagcagtgaagattcttttgtggagatccgcatggccgagggggaggccgagggctctgtgaaggagatcaagcacagccctggccccaccaggacagtgtccactggaacagccctgagcaagtaccgcagccgctctgcagatggagccaagaactactttgagcacgaggagctgactgtgtcccagctgctgctgtgcctgcgggagggcaaccagaaggtggagcggctggaggtggccctgaaggaggccaaggagcgggtgtctgactttgagaagaagaccagcaacagaagtgaaattgagacccagacagagggcagcacagagaaggaaaatgatgaggagaagggccctgagaccgtgggcagcgaggtggaggccctgaacctgcaggtgaccagcctcttcaaggagctgcaggaggcccacaccaagctgagcaaggccgagctgatgaagaagaggctgcaggagaagtgccaggccctggagaggaagaacagcgccatccccagcgagctgaatgagaagcaggagctggtgtacaccaacaagaagctggagctgcaggtggagagcatgctgtctgagatcaagatggagcaggccaagacagaagatgagaagagcaagctgactgtgctgcagatgacccacaacaagctgctgcaggagcacaacaatgccctgaagaccatcgaggagctgaccaggaaggagagcgagaaggtggacagagctgtgctgaaggagctgtctgagaagctggagctggccgagaaggccctggccagcaagcagctgcagatggatgagatgaagcagaccatcgccaagcaggaggaggacctggagaccatgaccatcctgcgggcccagatggaggtgtactgcagcgacttccacgccgagcgggccgcccgggagaagatccacgaggagaaggagcagctggccctgcagctggccgtgctgctgaaggaaaatgatgcctttgaagatggcggccggcagagcctgatggagatgcagagcagacatggagcccggaccagtgacagcgaccagcaggcctacctggtgcagagaggagctgaggaccgggactggaggcagcagaggaacatccccatccacagctgccccaagtgtggggaggtgctgcctgacatcgacaccctgcagatccacgtgatggactgcatcatctag

SEQ ID NO: 162772 - DNA, 1734 bp, Artificial Sequence; identical to SEQ ID NO: 162771
  Description of Artificial Sequence: Synthetic coding sequence

SEQ ID NO: 162773 - DNA, 1734 bp, Artificial Sequence; identical to SEQ ID NO: 162771
  Description of Artificial Sequence: Synthetic coding sequence

SEQ ID NO: 162774 - DNA, 1716 bp, Artificial Sequence
  Description of Artificial Sequence: Synthetic coding sequence
atgagccaccagcccctgagctgcctgacagagaaggaggacagccccagcgagagcactggaaatggccccccccacctggcccaccccaacctggacaccttcaccccagaggagctgctgcagcagatgaaggagctgctgacagagaaccaccagctgaaggaggccatgaagctgaacaaccaggccatgaagggccgctttgaggagctgagcgcctggacagagaagcagaaggaggagcggcagttctttgagatccagagcaaggaggccaaggagcggctgatggccctgagccatgaaaatgagaagctgaaggaggagctgggcaagctgaagggcaagtctgagaggagcagcgaggaccccacagatgacagccggctgcccagggctgaggccgagcaggagaaggaccagctgcggacccaggtggtgcggctgcaggccgagaaggctgacctgctgggcatcgtgtctgagctgcagctgaagctgaacagcagcggcagcagtgaagattcttttgtggagatccgcatggccgagggggaggccgagggctctgtgaaggagatcaagcacagccctggccccaccaggacagtgtccacaggcaccagccgctctgcagatggagccaagaactactttgagcacgaggagctgactgtgtcccagctgctgctgtgcctgcgggagggcaaccagaaggtggagcggctggaggtggccctgaaggaggccaaggagcgggtgtctgactttgagaagaagaccagcaacagaagtgaaattgagacccagacagagggcagcacagagaaggaaaatgatgaggagaagggccctgagaccgtgggcagcgaggtggaggccctgaacctgcaggtgaccagcctcttcaaggagctgcaggaggcccacaccaagctgagcaaggccgagctgatgaagaagaggctgcaggagaagtgccaggccctggagaggaagaacagcgccatccccagcgagctgaatgagaagcaggagctggtgtacaccaacaagaagctggagctgcaggtggagagcatgctgtctgagatcaagatggagcaggccaagacagaagatgagaagagcaagctgactgtgctgcagatgacccacaacaagctgctgcaggagcacaacaatgccctgaagaccatcgaggagctgaccaggaaggagagcgagaaggtggacagagctgtgctgaaggagctgtctgagaagctggagctggccgagaaggccctggccagcaagcagctgcagatggatgagatgaagcagaccatcgccaagcaggaggaggacctggagaccatgaccatcctgcgggcccagatggaggtgtactgcagcgacttccacgccgagcgggccgcccgggagaagatccacgaggagaaggagcagctggccctgcagctggccgtgctgctgaaggaaaatgatgcctttgaagatggcggccggcagagcctgatggagatgcagagcagacatggagcccggaccagtgacagcgaccagcaggcctacctggtgcagagaggagctgaggaccgggactggaggcagcagaggaacatccccatccacagctgccccaagtgtggggaggtgctgcctgacatcgacaccctgcagatccacgtgatggactgcatcatctag

SEQ ID NO: 162775 - DNA, 1734 bp, Artificial Sequence; identical to SEQ ID NO: 162771
  Description of Artificial Sequence: Synthetic coding sequence

SEQ ID NO: 162776 - DNA, 1716 bp, Artificial Sequence; identical to SEQ ID NO: 162774
  Description of Artificial Sequence: Synthetic coding sequence

SEQ ID NO: 162777 - DNA, 381 bp, Artificial Sequence
  Description of Artificial Sequence: Synthetic coding sequence
tgaggagaggccgagggctctgtgaaggagatcaagcacagccctggccccaccaggacagtgtccactggaacagccctgagcaagtaccgcagccgctctgcagatggagccaagaactactttgagcacgaggagctgactgtgtcccagctgctgctgtgcctgcgggagggcaaccagaaggtggagcggctggaggtggccctgaaggaggccaaggagcgggtgtctgactttgagaagaagaccagcaacagaagtgaaattgagacccagacagagggcagcacagagaaggaaaatgatgaggagaagggccctgagaccaccggcttccaccacgtgggccaggacggcctggacctgctgaccagctag

SEQ ID NO: 162778 - DNA, 444 bp, Artificial Sequence
  Description of Artificial Sequence: Synthetic coding sequence
atgaagctgaacaaccaggccatgaagggccgctttgaggagctgagcgcctggacagagaagcagaaggaggagcggcagttctttgagatccagagcaaggaggccaaggagcggctgatggccctgagccatgaaaatgagaagctgaaggaggagctgggcaagctgaagggcaagtctgagaggagcagcgaggaccccacagatgacagccggctgcccagggctgaggccgagcaggagaaggaccagctgcggacccaggtggtgcggctgcaggccgagaaggctgacctgctgggcatcgtgtctgagctgcagctgaagctgaacagcagcggcagcagcgaggacagctttgtggagatccgcatggccgagggggaggccgagggctctgtgaaggagatcaagcacagccctggccccaccaggacatag

SEQ ID NO: 162779 - DNA, 912 bp, Artificial Sequence
  Description of Artificial Sequence: Synthetic coding sequence
atgcaccctgagcccgcccccccacccagccgcagcagccctgagctgcccccatctgggggcagcaccaccagcggcagccgccgcagcagaagaagaagtggagatggagagcccccaggggcccctcctcctcctcctccacccagcgctgtgacctacccagactggattggccagagctacagcgaggtgatgagcctgaatgagcacagcatgcaggccctgtcctggaggaagctgtacctgagccgggccaagctgaaggccagcagcaggaccagcgccctgctgagcggctttgccatggtggccatggtggaggtgcagctggatgctgaccatgactacccacctggcctgctgattgccttcagcgcctgcaccaccgtgctggtggccgtgcacctgtttgccctgatgatcagcacctgcatcctgcccaacatcgaggccgtgtccaatgtgcacaacctgaacagcgtgaaggagagcccccatgagaggatgcaccgccacatcgagctggcctgggccttcagcaccgtcatcggcaccctgctcttcctggccgaggtggtgctgctgtgctgggtgaagttcctgcccctgaagaagcagcccggccagccccggcccaccagcaagcccccagccagcggggctgctgccaacgtgtccaccagcggcatcaccccaggccaggccgccgccatcgccagcaccaccatcatggtgcccttcggcctcatcttcatcgtgtttgctgtgcacttctaccgcagcctggtgagccacaagacagaccggcagttccaggagctgaatgagctggccgagtttgcccggctgcaggaccagctggaccacagaggagaccaccccctgaccccaggcagccactacgcctag

SEQ ID NO: 162780 - DNA, 765 bp, Artificial Sequence
  Description of Artificial Sequence: Synthetic coding sequence
atgtctgctgagctgaatgtgcccatcgaccccagcgccccagcctgcccagagcccggccacaagggcatggactacagagactgggtgagaagaagctacctggagctggtgaccagcaaccaccacagcgtgcaggccctgtcctggaggaagctgtacctgagccgggccaagctgaaggccagcagcaggaccagcgccctgctgagcggctttgccatggtggccatggtggaggtgcagctggagacccagtaccagtacccccggcccctgctgattgccttcagcgcctgcaccaccgtgctggtggccgtgcacctgtttgccctgctgatcagcacctgcatcctgcccaacgtggaggccgtgagcaacatccacaacctgaacagcatcagcgagagcccccatgagaggatgcacccctacatcgagctggcctggggcttcagcacagtgctgggcatcctgctcttcctggccgaggtggtgctgctgtgctggatcaagttcctgcctgtggatgcccggcggcagcccggccccccacctggccctggcagccacacaggctggcaggccgccctggtgtccaccatcatcatggtgcctgtgggcctcatctttgtggtgttcaccatccacttctaccgcagcctggtgcgccacaagacagagcggcacaaccgggagattgaggagctgcacaagctgaaggtgcagctggatggccacgagaggagcctgcaggtgctgtag

SEQ ID NO: 162781 - DNA, 765 bp, Artificial Sequence; identical to SEQ ID NO: 162780
  Description of Artificial Sequence: Synthetic coding sequence

SEQ ID NO: 162782 - DNA, 639 bp, Artificial Sequence
  Description of Artificial Sequence: Synthetic coding sequence
atgtctgctgagctgaatgtgcccatcgaccccagcgccccagcctgcccagagcccggccacaagggcatggactacagagactgggtgagaagaagctacctggagctggtgaccagcaaccaccacagcgtgcaggccctgtcctggaggaagctgtacctgagccgggccaagctgaaggccagcagcaggaccagcgccctgctgagcggctttgccatggtggccatggtggaggtgcagctggagacccagtaccagtacccccggcccctgctgattgccttcagcgcctgcaccaccgtgctggtggccgtgcacctgtttgccctgctgatcagcacctgcatcctgcccaacgtggaggccgtgagcaacatccacaacctgaacagcatcagcgagagcccccatgagaggatgcacccctacatcgagctggcctggggcttcagcacagtgctgggcatcctgctcttcctggccgaggtggtgctgctgtgctggatcaagttcctgcctgtggatgcccggcggcagcccggccccccacctggccctggcagccacacaggctggcaggccgccctggtgtccaccatcatcatggtgcctgtgggcctcatctttgtgtag

SEQ ID NO: 162783 - DNA, 765 bp, Artificial Sequence; identical to SEQ ID NO: 162780
  Description of Artificial Sequence: Synthetic coding sequence

SEQ ID NO: 162784 - DNA, 765 bp, Artificial Sequence; identical to SEQ ID NO: 162780
  Description of Artificial Sequence: Synthetic coding sequence

SEQ ID NO: 162785 - DNA, 93 bp, Artificial Sequence
  Description of Artificial Sequence: Synthetic coding sequence
atgtctgctgagctgaatgtgcccatcgaccccagcgccccagcctgcccagagcccggccacaagggcatggactacagagactgggtgtag

SEQ ID NO: 162786 - DNA, 690 bp, Artificial Sequence
  Description of Artificial Sequence: Synthetic coding sequence
atgtctgctgagctgaatgtgcccatcgaccccagcgccccagcctgcccagagcccggccacaagggcatggactacagagactgggtgagaagaagctacctggagctggtgaccagcaaccaccacagcgtgcaggccctgtcctggaggaagctgtacctgagccgggccaagctgaaggccagcagcaggaccagcgccctgctgagcggctttgccatggtggccatggtggaggtgcagctggagacccagtaccagtacccccggcccctgctgattgccttcagcgcctgcaccaccgtgctggtggccgtgcacctgtttgccctgctgatcagcacctgcatcctgcccaacgtggaggccgtgagcaacatccacaacctgaacagcatcagcgagagcccccatgagaggatgcacccctacatcgagctggcctggggcttcagcacagtgctgggcatcctgctcttcctggccgaggtggtgctgctgtgctggatcaagttcctgcctgtggatgcccggcggcagcccggccccccacctggccctggcagccacacaggctggcaggccgccctggtgtccaccatcatcatggtgcctgtgggcctcatctttgtggtgttcaccatccacttctaccgcagcctggtgcgccacaagacagaaagatag

SEQ ID NO: 162787 - DNA, 294 bp, Artificial Sequence
  Description of Artificial Sequence: Synthetic coding sequence
atgtctgctgagctgaatgtgcccatcgaccccagcgccccagcctgcccagagcccggccacaagggcatggactacagagactgggtgagaagaagctacctggagctggtgaccagcaaccaccacagcgtgcaggccctgtcctggaggaagctgtacctgagccgggccaagctgaaggccagcagcaggaccagcgccctgctgagcggctttgccatggtggccatggtggaggtgcagctggagacccagtaccagtacccccggcccctgctgattgccttctag

SEQ ID NO: 162788 - DNA, 888 bp, Artificial Sequence
  Description of Artificial Sequence: Synthetic coding sequence
atgaagggcggggagggagatgctggggagcaggcccccctgaaccctgagggggagagccctgctggcagcgccacctaccgggagtttgtgcaccggggctacctggacctgatgggcgccagccagcacagcctgcgggccctgtcctggaggcggctgtacctgagccgggccaagctgaaggccagcagcaggaccagcgccctgctgagcggctttgccatggtggccatggtggaggtgcagctggagagtgaccacgagtacccacctggcctgctggtggccttcagcgcctgcaccaccgtgctggtggccgtgcacctgtttgccctgatggtgtccacctgcctgctgccccacattgaagctgtgagcaacatccacaacctgaacagcgtgcaccagagcccccaccagaggctgcaccgctacgtggagctggcctggggcttcagcacagccctgggcaccttcctgttcctggccgaggtggtgctggtgggctgggtgaagtttgtgcccatcggggcccccctggacacccccacccccatggtgcccaccagccgggtgcccggcaccctggcccctgtggccaccagcctgagccctgccagcaacctgcccaggagcagcgccagcgctgcccccagccaggccgagcccgcctgccccccccggcaggcctgtggcggcggcggggcccacggccctggctggcaggccgccatggccagcacagccatcatggtgcctgtgggcctggtgtttgtggcctttgccctgcacttctaccgcagcctggtggcccacaagacagaccgctacaagcaggagctggaggagctgaaccggctgcagggcgagctgcaggccgtgtag

SEQ ID NO: 162789 - DNA, 822 bp, Artificial Sequence
  Description of Artificial Sequence: Synthetic coding sequence
atgaagggcggggagggagatgctggggagcaggcccccctgaaccctgagggggagagccctgctggcagcgccacctaccgggagtttgtgcaccggggctacctggacctgatgggcgccagccagcacagcctgcgggccctgtcctggaggcggctgtacctgagccgggccaagctgaaggccagcagcaggaccagcgccctgctgagcggctttgccatggtggccatggtggaggtgcagctggagagtgaccacgagtacccacctggcctgctggtggccttcagcgcctgcaccaccgtgctggtggccgtgcacctgtttgccctgatggtgtccacctgcctgctgccccacattgaagctgtgagcaacatccacaacctgaacagcgtgcaccagagcccccaccagaggctgcaccgctacgtggagctggcctggggcttcagcacagccctgggcaccttcctgttcctggccgaggtggtgctggtgggctgggtgaagtttgtgcccatcggggcccccctggacacccccacccccatggtgcccaccagccgggtgcccggcaccctggcccctgtggccaccagcctgagccctgccagcaacctgcccaggagcagcgccagcgctgcccccagccaggccgagcccgcctgccccccccggcaggcctgtggcggcggcggggcccacggccctggctggcaggccgccatggccagcaccttccctggcatcttccccatcagcctgagcctgggcttctgcaagctgctgtgcacctgggccggcctgtcctag

SEQ ID NO: 162790 - DNA, 414 bp, Artificial Sequence
  Description of Artificial Sequence: Synthetic coding sequence
atggccggcagccaggacatctttgatgccatcgtgatggctgatgagcgcttccatggagagggctaccgggagggctatgaggagggcagcagcctgggcgtgatggagggccggcagcacggcaccctgcatggagccaagattggcagcgagatcggctgctaccagggctttgcctttgcctggaagtgcctgctgcacagctgcaccacagagaaggacagcaggaagatgaaggtgctggagagcctcatcggcatgatccagaagttcccctatgatgaccccacctatgacaagctgcacgaggacctggacaagatccggggcaagttcaagcagttctgcagcctgctgaatgtgcagcctgacttcaagatctctgctgagggcagcggcctgtccttctag

SEQ ID NO: 162791 - DNA, 666 bp, Artificial Sequence
  Description of Artificial Sequence: Synthetic coding sequence
atggccggcagccaggacatctttgatgccatcgtgatggctgatgagcgcttccatggagagggctaccgggagggctatgaggagggcagcagcctgggcgtgatggagggccggcagcacggcaccctgcatggagccaagattggcagcgagatcggctgctaccagggctttgcctttgcctggaagtgcctgctgcacagctgcaccacagagaaggacagcaggaagatgaaggtgctggagagcctcatcggcatgatccagaagttcccctatgatgaccccacctatgacaagctgcacgaggacctggacaagatccggggcaagttcaagcagacaggcctgagccccagcgctgtgatggtgcggcccccatcctatgtggagctgcctgtgacctgctggtgctgggaggccccccgctgcaaccagaagtgcacagatcctgctgcccggcggccagacccccagacctgtgccagccaggaccggctgcgctgtgccccctgcacctgccaccagcccctggccagccgctacacccagcaccctggcctggtgcccctgccccaccacgaccggcagagcgtgccccagggcccccgggtggtgcagacagatgctgctgccaggatggtggagcagcagaccatgtag

SEQ ID NO: 162792 - DNA, 414 bp, Artificial Sequence; identical to SEQ ID NO: 162790
  Description of Artificial Sequence: Synthetic coding sequence

SEQ ID NO: 162793 - DNA, 237 bp, Artificial Sequence
  Description of Artificial Sequence: Synthetic coding sequence
atggccggcagccaggacatctttgatgccatcgtgatggctgatgagagcaggaagatgaaggtgctggagagcctgattggcatgatccagaagttcccctatgatgaccccacctatgacaagctgcacgaggacctggacaagatccggggcaagttcaagcagttctgcagcctgctgaatgtgcagcctgacttcaagatctctgctgagggcagcggcctgtccttctag

SEQ ID NO: 162794 - DNA, 3039 bp, Artificial Sequence
  Description of Artificial Sequence: Synthetic coding sequence
atgatggcccagagcaacatgttcaccgtggctgatgtgctgagccaggatgagctgaggaagaagctgtaccagaccttcaaggaccggggcatcctggacaccctgaagacccagctgaggaaccagctgatccacgagctgatgcaccctgtgctgagcggggagctgcagcccaggagcatctctgtggagggcagcagcctgctgattggagccagcaacagcctggtggccgaccacctgcagagatgtggctatgagtacagcctgagcgtcttcttccctgagagcggcctggccaaggagaaggtgttcaccatgcaggacctgctgcagctgatcaagatcaaccccaccagcagcctgtacaagagcctggtgtctggcagtgacaaggagaaccagaagggcttcctgatgcacttcctgaaggagctggccgagtaccaccaggccaaggagagctgcaacatggagacccagaccagcagcaccttcaacagagacagcctggccgagaagctgcagctgattgatgaccagtttgctgatgcctacccccagaggatcaagtttgagagcctggagatcaagctgaatgagtacaagcgggagattgaggagcagctgcgggcagagatgtgccagaagctgaagttcttcaaggacacagaaattgccaagatcaagatggaggccaagaagaagtatgagaaggagctgaccatgttccagaatgactttgagaaggcctgccaggccaagtctgaggccctggtgctgcgggagaagagcaccctggagcgcatccacaagcaccaggagattgagaccaaggagatctatgcccagaggcagctgctgctgaaggacatggacctgctgcggggccgggaggccgagctgaagcagagggtggaggcctttgagctgaaccagaagctgcaggaggagaagcacaagagcatcacagaggccctgcggcggcaggagcagaacatcaagagctttgaggagacctatgacaggaagctgaagaatgagctgctgaagtaccagctggagctgaaggatgactacatcatccgcaccaaccggctgattgaagatgagaggaagaacaaggagaaggctgtgcacctgcaggaggagctgattgccatcaacagcaagaaggaggagctgaaccagagcgtgaacagagtgaaggagctggagctggagctggagagcgtgaaggcccagagcctggccatcaccaagcagaaccacatgctgaatgagaaggtgaaggagatgtctgactacagcctgctgaaggaggagaagctggagctgctggcccagaacaagctgctgaagcagcagctggaggagagcagaaatgaaaacctgcggctgctgaaccggctggcccagcctgcccctgagctggccgtgttccagaaggagctgaggaaggccgagaaggccatcgtggtggagcacgaggagtttgagagctgccggcaggccctgcacaagcagctgcaggatgaaattgagcacagcgcccagctgaaggcccagatcctgggctacaaggcctctgtgaagagcctgaccacccaggtggccgacctgaagctgcagctgaagcagacccagacagccctggagaatgaggtgtactgcaaccccaagcagagcgtcatcgacagatctgtgaatggcctcatcaatggaaatgtggtgccctgcaatggagagatcagcggggacttcctgaacaaccccttcaagcaggagaatgtgctggccaggatggtggccagccgcatcaccaactaccccacagcctgggtggagggcagcagcccagacagcgacctggagtttgtggccaacaccaaggcccgggtgaaggagctgcagcaggaggccgagcggctggagaaggccttccgcagctaccaccggcgggtcatcaagaacagcgccaagagccccctggccgccaagagcccccccagcctgcacctgctggaggccttcaagaacatcaccagcagcagccctgagcggcacatctttggagaggacagagtggtgtctgagcagccccaggtgggcaccctggaggagagaaatgatgtggtggaggccctgaccggcagcgctgccagccggctgcggggcggcaccagcagccggcggctgagcagcacccccctgcccaaggccaagaggagcctggagagcgagatgtacctggagggcctgggccgcagccacatcgccagccccagcccctgcccagacaggatgcccctgcccagccccacagagagccgccacagcctgagcatcccccctgtgagcagccccccagagcagaaggtgggcctgtaccgccggcagacagagctgcaggacaagtctgagttcagtgatgtggacaagctggccttcaaggacaatgaggagtttgagagcagctttgagagcgctggcaacatgccccggcagctggagatgggcggcctgagccctgctggggacatgagccacgtggatgctgctgctgctgctgtgcccctgagctaccagcaccccagcgtggaccagaagcagatcgaggagcagaaggaggaggagaagatccgggagcagcaggtgaaggagcggcggcagcgggaggagcggcggcagagcaacctgcaggaggtgctggagcgggagcggcgggagctggagaagctgtaccaggagaggaagatgattgaggagagcctgaagatcaagatcaagaaggagctggagatggagaatgagctggagatgagcaaccaggagatcaaggacaagagcgcccacagcgagaaccccctggagaagtacatgaagatcatccagcaggagcaggaccaggagagcgctgacaagagcagcaagaagatggtgcaggagggcagcctggtggacaccctgcagagcagtgacaaggtggagagcctgaccggcttcagccatgaggagctggatgacagctggtag

SEQ ID NO: 162795 - DNA, 2919 bp, Artificial Sequence
  Description of Artificial Sequence: Synthetic coding sequence
atgatggcccagagcaacatgttcaccgtggctgatgtgctgagccaggatgagctgaggaagaagctgtaccagaccttcaaggaccggggcatcctggacaccctgaagacccagctgaggaaccagctgatccacgagctgatgcaccctgtgctgagcggggagctgcagcccaggagcatctctgtggagggcagcagcctgctgattggagccagcaacagcctggtggccgaccacctgcagagatgtggctatgagtacagcctgagcgtcttcttccctgagagcggcctggccaaggagaaggtgttcaccatgcaggacctgctgcagctgatcaagatcaaccccaccagcagcctgtacaagagcctggtgtctggcagtgacaaggagaaccagaagggcttcctgatgcacttcctgaaggagctggccgagtaccaccaggccaaggagagctgcaacatggagacccagaccagcagcaccttcaacagagacagcctggccgagaagctgcagctgattgatgaccagtttgctgatgcctacccccagaggatcaagtttgagagcctggagatcaagctgaatgagtacaagcgggagattgaggagcagctgcgggcagagatgtgccagaagctgaagttcttcaaggacacagaaattgccaagatcaagatggaggccaagaagaagtatgagaaggagctgaccatgttccagaatgactttgagaaggcctgccaggccaagtctgaggccctggtgctgcgggagaagagcaccctggagcgcatccacaagcaccaggagattgagaccaaggagatctatgcccagaggcagctgctgctgaaggacatggacctgctgcggggccgggaggccgagctgaagcagagggtggaggcctttgagctgtaccagctggagctgaaggatgactacatcatccgcaccaaccggctgattgaagatgagaggaagaacaaggagaaggctgtgcacctgcaggaggagctgattgccatcaacagcaagaaggaggagctgaaccagagcgtgaacagagtgaaggagctggagctggagctggagagcgtgaaggcccagagcctggccatcaccaagcagaaccacatgctgaatgagaaggtgaaggagatgtctgactacagcctgctgaaggaggagaagctggagctgctggcccagaacaagctgctgaagcagcagctggaggagagcagaaatgaaaacctgcggctgctgaaccggctggcccagcctgcccctgagctggccgtgttccagaaggagctgaggaaggccgagaaggccatcgtggtggagcacgaggagtttgagagctgccggcaggccctgcacaagcagctgcaggatgaaattgagcacagcgcccagctgaaggcccagatcctgggctacaaggcctctgtgaagagcctgaccacccaggtggccgacctgaagctgcagctgaagcagacccagacagccctggagaatgaggtgtactgcaaccccaagcagagcgtcatcgacagatctgtgaatggcctcatcaatggaaatgtggtgccctgcaatggagagatcagcggggacttcctgaacaaccccttcaagcaggagaatgtgctggccaggatggtggccagccgcatcaccaactaccccacagcctgggtggagggcagcagcccagacagcgacctggagtttgtggccaacaccaaggcccgggtgaaggagctgcagcaggaggccgagcggctggagaaggccttccgcagctaccaccggcgggtcatcaagaacagcgccaagagccccctggccgccaagagcccccccagcctgcacctgctggaggccttcaagaacatcaccagcagcagccctgagcggcacatctttggagaggacagagtggtgtctgagcagccccaggtgggcaccctggaggagagaaatgatgtggtggaggccctgaccggcagcgctgccagccggctgcggggcggcaccagcagccggcggctgagcagcacccccctgcccaaggccaagaggagcctggagagcgagatgtacctggagggcctgggccgcagccacatcgccagccccagcccctgcccagacaggatgcccctgcccagccccacagagagccgccacagcctgagcatcccccctgtgagcagccccccagagcagaaggtgggcctgtaccgccggcagacagagctgcaggacaagtctgagttcagtgatgtggacaagctggccttcaaggacaatgaggagtttgagagcagctttgagagcgctggcaacatgccccggcagctggagatgggcggcctgagccctgctggggacatgagccacgtggatgctgctgctgctgctgtgcccctgagctaccagcaccccagcgtggaccagaagcagatcgaggagcagaaggaggaggagaagatccgggagcagcaggtgaaggagcggcggcagcgggaggagcggcggcagagcaacctgcaggaggtgctggagcgggagcggcgggagctggagaagctgtaccaggagaggaagatgattgaggagagcctgaagatcaagatcaagaaggagctggagatggagaatgagctggagatgagcaaccaggagatcaaggacaagagcgcccacagcgagaaccccctggagaagtacatgaagatcatccagcaggagcaggaccaggagagcgctgacaagagcagcaagaagatggtgcaggagggcagcctggtggacaccctgcagagcagtgacaaggtggagagcctgaccggcttcagccatgaggagctggatgacagctggtag

SEQ ID NO: 162796 - DNA, 2619 bp, Artificial Sequence
  Description of Artificial Sequence: Synthetic coding sequence
atgcacttcctgaaggagctggccgagtaccaccaggccaaggagagctgcaacatggagacccagaccagcagcaccttcaacagagacagcctggccgagaagctgcagctgattgatgaccagtttgctgatgcctacccccagaggatcaagtttgagagcctggagatcaagctgaatgagtacaagcgggagattgaggagcagctgcgggcagagatgtgccagaagctgaagttcttcaaggacacagaaattgccaagatcaagatggaggccaagaagaagtatgagaaggagctgaccatgttccagaatgactttgagaaggcctgccaggccaagtctgaggccctggtgctgcgggagaagagcaccctggagcgcatccacaagcaccaggagattgagaccaaggagatctatgcccagaggcagctgctgctgaaggacatggacctgctgcggggccgggaggccgagctgaagcagagggtggaggcctttgagctgaaccagaagctgcaggaggagaagcacaagagcatcacagaggccctgcggcggcaggagcagaacatcaagagctttgaggagacctatgacaggaagctgaagaatgagctgctgaagtaccagctggagctgaaggatgactacatcatccgcaccaaccggctgattgaagatgagaggaagaacaaggagaaggctgtgcacctgcaggaggagctgattgccatcaacagcaagaaggaggagctgaaccagagcgtgaacagagtgaaggagctggagctggagctggagagcgtgaaggcccagagcctggccatcaccaagcagaaccacatgctgaatgagaaggtgaaggagatgtctgactacagcctgctgaaggaggagaagctggagctgctggcccagaacaagctgctgaagcagcagctggaggagagcagaaatgaaaacctgcggctgctgaaccggctggcccagcctgcccctgagctggccgtgttccagaaggagctgaggaaggccgagaaggccatcgtggtggagcacgaggagtttgagagctgccggcaggccctgcacaagcagctgcaggatgaaattgagcacagcgcccagctgaaggcccagatcctgggctacaaggcctctgtgaagagcctgaccacccaggtggccgacctgaagctgcagctgaagcagacccagacagccctggagaatgaggtgtactgcaaccccaagcagagcgtcatcgacagatctgtgaatggcctcatcaatggaaatgtggtgccctgcaatggagagatcagcggggacttcctgaacaaccccttcaagcaggagaatgtgctggccaggatggtggccagccgcatcaccaactaccccacagcctgggtggagggcagcagcccagacagcgacctggagtttgtggccaacaccaaggcccgggtgaaggagctgcagcaggaggccgagcggctggagaaggccttccgcagctaccaccggcgggtcatcaagaacagcgccaagagccccctggccgccaagagcccccccagcctgcacctgctggaggccttcaagaacatcaccagcagcagccctgagcggcacatctttggagaggacagagtggtgtctgagcagccccaggtgggcaccctggaggagagaaatgatgtggtggaggccctgaccggcagcgctgccagccggctgcggggcggcaccagcagccggcggctgagcagcacccccctgcccaaggccaagaggagcctggagagcgagatgtacctggagggcctgggccgcagccacatcgccagccccagcccctgcccagacaggatgcccctgcccagccccacagagagccgccacagcctgagcatcccccctgtgagcagccccccagagcagaaggtgggcctgtaccgccggcagacagagctgcaggacaagtctgagttcagtgatgtggacaagctggccttcaaggacaatgaggagtttgagagcagctttgagagcgctggcaacatgccccggcagctggagatgggcggcctgagccctgctggggacatgagccacgtggatgctgctgctgctgctgtgcccctgagctaccagcaccccagcgtggaccagaagcagatcgaggagcagaaggaggaggagaagatccgggagcagcaggtgaaggagcggcggcagcgggaggagcggcggcagagcaacctgcaggaggtgctggagcgggagcggcgggagctggagaagctgtaccaggagaggaagatgattgaggagagcctgaagatcaagatcaagaaggagctggagatggagaatgagctggagatgagcaaccaggagatcaaggacaagagcgcccacagcgagaaccccctggagaagtacatgaagatcatccagcaggagcaggaccaggagagcgctgacaagagcagcaagaagatggtgcaggagggcagcctggtggacaccctgcagagcagtgacaaggtggagagcctgaccggcttcagccatgaggagctggatgacagctggtag

SEQ ID NO: 162797 - DNA, 1104 bp, Artificial Sequence
  Description of Artificial Sequence: Synthetic coding sequence
atgatggcccagagcaacatgttcaccgtggctgatgtgctgagccaggatgagctgaggaagaagctgtaccagaccttcaaggaccggggcatcctggacaccctgaagacccagctgaggaaccagctgatccacgagctgatgcaccctgtgctgagcggggagctgcagcccaggagcatctctgtggagggcagcagcctgctgattggagccagcaacagcctggtggccgaccacctgcagagatgtggctatgagtacagcctgagcgtcttcttccctgagagcggcctggccaaggagaaggtgttcaccatgcaggacctgctgcagctgatcaagatcaaccccaccagcagcctgtacaagagcctggtgtctggcagtgacaaggagaaccagaagggcttcctgatgcacttcctgaaggagctggccgagtaccaccaggccaaggagagctgcaacatggagacccagaccagcagcaccttcaacagagacagcctggccgagaagctgcagctgattgatgaccagtttgctgatgcctacccccagaggatcaagtttgagagcctggagatcaagctgaatgagtacaagcgggagattgaggagcagctgcgggcagagatgtgccagaagctgaagttcttcaaggacacagaaattgccaagatcaagatggaggccaagaagaagtatgagaaggagctgaccatgttccagaatgactttgagaaggcctgccaggccaagtctgaggccctggtgctgcgggagaagagcaccctggagcgcatccacaagcaccaggagattgagaccaaggagatctatgcccagaggcagctgctgctgaaggacatggacctgctgcggggccgggaggccgagctgaagcagagggtggaggcctttgagctgaaccagaagctgcaggaggagaagcacaagagcatcacagaggccctgcggcggcaggagcagaacatcaagagctttgaggagacctatgacaggaagctgaagaatgagctgctgaacttccaccggctgcatggagtgtgcctggccctgggcatcctgatctag

SEQ ID NO: 162798 - DNA, 1017 bp, Artificial Sequence
  Description of Artificial Sequence: Synthetic coding sequence
atggtgttcctgtgcatcttcaaggagctggccgagtaccaccaggccaaggagagctgcaacatggagacccagaccagcagcaccttcaacagagacagcctggccgagaagctgcagctgattgatgaccagtttgctgatgcctacccccagaggatcaagtttgagagcctggagatcaagctgaatgagtacaagcgggagattgaggagcagctgcgggcagagatgtgccagaagctgaagttcttcaaggacacagagatcgccaagatcaagatggaggccaagaagaagtatgagaaggagctgaccatgttccagaatgactttgagaaggcctgccaggccaagtctgaggccctggtgctgcgggagaagagcaccctggagcgcatccacaagcaccaggagattgagaccaaggagatctatgcccagaggcagctgctgctgaaggacatggacctgctgcggggccgggaggccgagctgaagcagagggtggaggcctttgagctgtaccagctggagctgaaggatgactacatcatccgcaccaaccggctgattgaagatgagaggaagaacaaggagaaggctgtgcacctgcaggaggagctgattgccatcaacagcaagaaggaggagctgaaccagagcgtgaacagagtgaaggagctggagctggagctggagagcgtgaaggcccagagcctggccatcaccaagcagaaccacatgctgaatgagaaggtgaaggagatgtctgactacagcctgctgaaggaggagaagctggagctgctggcccagaacaagctgctgaagcagcagctggaggagagcagaaatgaaaacctgcggctgctgaaccggctggcccagcctgcccctgagctggccgtgttccagaaggagctgaggaaggccgagaaggccatcgtggtggagcacgaggagtttgagagctgccggcaggccctgcacaagcagctgcaggatgagccctag

SEQ ID NO: 162799 - DNA, 2586 bp, Artificial Sequence
  Description of Artificial Sequence: Synthetic coding sequence
atggcccactaccccacccggctgaagaccaggaagacctacagctgggtgggccggcccctgctggacaggaagctgcactaccagacctaccgggagatgtgtgtgaagacagagggctgcagcacagagatccacatccagatcggccagtttgtgctgattgaaggagatgatgatgagaacccctacgtggccaagctgctggagctgtttgaagatgacagcgaccccccacccaagaagagggcccgggtgcagtggtttgtgcgcttctgtgaggtgcctgcctgcaagaggcacctgctgggcaggaagccaggggcccaggagatcttctggtatgactacccagcctgtgacagcaacatcaatgctgagaccatcatcggcctggtgcgggtcatccccctggcccccaaggatgtggtgcccaccaacctgaagaatgagaagaccctgtttgtgaagctgtcctggaatgagaagaagttccggcccctgagcagcgagctgtttgctgagctgaacaagccccaggagagcgctgccaagtgccagaagcctgtgcgggccaagagcaagtctgctgagagccccagctggaccccagctgagcacgtggccaagagaattgagagccgccacagcgccagcaagagccggcagacccccacccaccccctgaccccccgggccaggaagaggctggagctgggcaacctgggcaacccccagatgagccagcagaccagctgtgccagcctggacagccctggccgcatcaagaggaaggtggccttcagcgagatcaccagccccagcaagaggagccagcctgacaagctgcagaccctgagccctgccctgaaggcccctgagaagacccgggagaccggcctgagctacacagaagatgacaagaaggccagccctgagcaccgcatcatcctgcggaccagaattgctgccagcaagaccatcgacatccgggaggagaggaccctgacccccatcagcggcggccagaggagctctgtggtgcccagcgtcatcctgaagccagagaacatcaagaagagagatgccaaggaggccaaggcccagaatgaggccaccagcaccccccaccgcatccggaggaagagctctgtgctgaccatgaaccgcatccggcagcagctgcgcttcctgggcaacagcaagagtgaccaggaggagaaggagatcctgcctgctgctgagatcagtgacagcagcagtgatgaggaggaggccagcaccccacccctgccccggcgggcccccaggacagtgtccaggaacctgcggagcagcctgaagagcagcctgcacaccctgaccaaggtgcccaagaagagcctgaagcccaggaccccccgctgtgccgccccccagatccgcagccgcagcctggccgcccaggagcccgcctctgtgctggaggaggcccggctgcggctgcacgtgtctgctgtgcctgagagcctgccctgccgggagcaggagttccaggacatctacaactttgtggagagcaagctgctggaccacactggaggctgcatgtacatctctggagtgcccggcaccgggaagacagccaccgtgcatgaagtcatccgctgcctgcagcaggccgcccaggccaatgatgtgccccccttccagtacatcgaggtgaatggcatgaagctgacagagccccaccaggtgtatgtgcagatcctgcagaagctgaccggccagaaggccacagccaaccacgccgctgagctgctggccaagcagttctgcacccggggcagcccccaggagaccaccgtgctgctggtggatgagctggacctgctgtggacccacaagcaggacatcatgtacaacctgtttgactggcccacccacaaggaggcccggctggtggtgctggccatcgccaacaccatggacctgcctgagcgcatcatgatgaacagagtgagcagccggctgggcctgaccaggatgtgcttccagccctacacctacagccagctgcagcagatcctgcggagccggctgaagcacctgaaggcctttgaagatgatgccatccagctggtggccaggaaggtggccgccctgtctggagatgcccggcgctgcctggacatctgcagaagagccacagagatctgtgagttcagccagcagaagccagacagccctggcctggtgaccatcgcccacagcatggaggccgtggatgagatgttcagcagcagctacatcacagccatcaagaacagctctgtgctggagcagagcttcctgcgggccatcctggccgagttccgccgcagcggcctggaggaggccaccttccagcagatctacagccagcacgtggccctgtgcaggatggagggcctgccctaccccaccatgtctgagaccatggctgtgtgcagccacctgggcagctgccgcctgctgctggtggagcccagcagaaatgacctgctgctgcgggtgcggctgaatgtgtcccaggatgatgtgctgtatgccctgaaggatgaatag

SEQ ID NO: 162800 - DNA, 2586 bp, Artificial Sequence; identical to SEQ ID NO: 162799
  Description of Artificial Sequence: Synthetic coding sequence

SEQ ID NO: 162801 - DNA, 1599 bp, Artificial Sequence
  Description of Artificial Sequence: Synthetic coding sequence
atggagaagagcaatgagaccaacggctacctggacagcgcccaggccggccctgctgctggccctggggcccctggaacagctgctggccgggcccggcgctgtgccggcttcctgcggcggcaggccctggtgctgctgactgtgtctggagtgctggccggggccggcctgggcgccgccctgcggggcctgagcctgagcaggacccaggtgacctacctggccttccctggagagatgctgctgaggatgctgaggatgatcatcctgcccctggtggtgtgcagcctggtgtctggggccgccagcctggatgccagctgcctgggccgcctgggcggcattgctgtggcctacttcggcctgaccaccctgagcgccagcgccctggccgtggccctggccttcatcatcaagccaggcagcggggcccagaccctgcagagcagtgacctgggcctggaggacagcggccccccacctgtgcccaaggagaccgtggacagcttcctggacctggccaggaacctcttccccagcaacctggtggtggccgccttccgcacctacgccacagactacaaggtggtgacccagaacagcagcagtggaaatgtgacccatgagaagatccccatcggcacagaaattgagggcatgaacatcctgggcctggtgctgtttgccctggtgctgggcgtggccctgaagaagctgggctctgaaggagaagatctcatccgcttcttcaacagcctgaatgaggccaccatggtgctggtgtcctggatcatgtggtacgtgcctgtgggcatcatgttcctggtgggcagcaagatcgtggagatgaaggacatcatcgtgctggtgaccagcctgggcaagtacatctttgccagcatcctgggccacgtgatccacggcggcatcgtgctgcccctcatctactttgtgttcaccaggaagaaccccttccgcttcctgctgggcctgctggccccctttgccacagcctttgccacctgcagcagcagcgccaccctgcccagcatgatgaagtgcatcgaggagaacaacggggtggacaagaggatcagccgcttcatcctgcccatcggggccaccgtgaacatggatggagctgccatcttccagtgtgtggccgctgtgttcatcgcccagctgaacaacgtggagctgaatgccggccagatcttcaccatcctggtgacagccacagccagctctgtgggcgctgctggggtgcctgctggaggagtgctgaccatcgccatcatcctggaggccatcggcctgcccacccatgacctgcccctcatcctggccgtggactggatcgtggacaggaccaccaccgtggtgaatgtggagggagatgccctgggcgccggcatcctgcaccacctgaaccagaaggccaccaagaagggggagcaggagctggccgaggtgaaggtggaggccatccccaactgcaagtctgaggaggagaccagccccctggtgacccaccagaacccagctggccctgtggccagcgcccctgagctggagagcaaggagagcgtgctgtag

SEQ ID NO: 162802 - DNA, 330 bp, Artificial Sequence
  Description of Artificial Sequence: Synthetic coding sequence
atgagcaagccagagctgaaggaggacaagatgctggaggtgcactttgtgggagatgatgatgtgctgaaccacatcctggaccgggagggcggggccaagctgaagaaggagcgggcccagctgctggtgaaccccaagaagatcatcaagaagccagaatatgacctggaggaggatgaccaggaggtgctgaaggaccagaactacgtggagatcatgggcagagatgtgcaggagagcctgaagaatggcagcgccaccggcggcggcaacaaggtgtacagcttccagaacaggaagcacagcgagaagatggccaagctgtag

SEQ ID NO: 162803 - DNA, 219 bp, Artificial Sequence
  Description of Artificial Sequence: Synthetic coding sequence
atgagcaagccagagctgaaggaggacaagatgctggaggtgcactttgtgggagatgatgatgtgctgaaccacatcctggaccgggagggcggggccaagctgaagaaggagcgggcccagctgctggtgaaccccaagaagatcatcaagaagccagaatatgacctggaggaggatgaccaggaggtgctgaaggaccagaactacgtggagtag

SEQ ID NO: 162804 - DNA, 2139 bp, Artificial Sequence
  Description of Artificial Sequence: Synthetic coding sequence
atggccaccagctccatgagcaagggctgctttgtgttcaagcccaacagcaagaagaggaagatcagcctgcccatcgaggactacttcaacaagggcaagaatgaacctgaggacagcaagctgcgctttgagacctaccagctgatctggcagcagatgaagtcagaaaatgaaaggctgcaggaggagctgaacaagaacctgtttgacaacctgattgagttcctgcagaagagccacagcggcttccagaagaacagccgggacctgggcggccagatcaagctgcgggagatccccacagctgccctggtgctgggcgtgaatgtgacagaccatgacctgaccttcggcagcctgacagaggccctgcagaacaacgtgaccccctacgtggtgtccctgcaggccaaggactgcccagacatgaagcacttcctgcagaagctgatcagccagctgatggactgctgcgtggacatcaagagcaaggaggaggagagcgtgcacgtgacccagaggaagacccactacagcatggacagcctgagctcctggtacatgacagtgacccagaagacagaccccaagatgctgagcaagaagaggaccaccagcagccagtggcagagcccccctgtggtggtgatcctgaaggacatggagagctttgccaccaaggtgctgcaggacttcatcatcatcagcagccagcacctgcacgagttccccctcatcctgatcttcggcatcgccaccagccccatcatcatccaccggctgctgccccatgctgtgagcagcctgctgtgcatcgagctgttccagagcctgagctgcaaggagcacctgaccaccgtgctggacaagctgctgctgaccacccagttccccttcaagatcaatgagaaggtgctgcaggtgctgaccaacatcttcctgtaccatgacttctctgtgcagaacttcatcaagggcctgcagctgagcctgctggagcacttctacagccagcccctgtctgtgctgtgctgcaacctgcctgaggccaagaggcgcatcaacttcctgagcaacaaccagtgtgagaacatccggcggctgcccagcttcagaagatatgtggagaagcaggccagcgagaagcaggtggccctgctgaccaatgaaagatacctgaaggaggagacccagctgctgctggagaacctgcacgtgtaccacatgaactacttcctggtgctgcgctgcctgcacaagttcaccagcagcctgcccaagtaccccctgggccggcagatccgggagctgtactgcacctgcctggagaagaacatctgggacagcgaggagtatgcctctgtgctgcagctgctgaggatgctggccaaggatgagctgatgaccatcctggagaagtgcttcaaggtgttcaagagctactgtgagaaccacctgggcagcacagccaagagaattgaggagttcctggcccagttccagagcctggatgctgagaccaaggaggaggaggatgccagcggcagccagcccaagggcctgcagaagacagacctgtaccacctgcagaagagcctgctggagatgaaggagctgcggcgcagcaagaagcagaccaagtttgaggtgctgcgggagaatgtggtgaacttcatcgactgcctggtgcgggagtacctgctgcccccagagacccagcccctgcacgaggtggtgtacttctctgctgcccacgccctgcgggagcacctgaatgctgccccccgcatcgccctgcacacagccctgaacaacccctactactacctgaagaatgaggccctgaagtctgaggagggctgcatccccaacatcgccccagacatctgcatcgcctacaagctgcacctggagtgcagccgcctcatcaacctggtggactggagcgaggcctttgccaccgtggtgacagctgctgagaagatggatgccaacagcgccaccagcgaggagatgaatgagatcatccacgcccgcttcatccgggctgtgtctgagctggagctgctgggcttcatcaagcccaccaagcagaagacagaccacgtggcccggctgacctggggcggctgctag

SEQ ID NO: 162805 - DNA, 2136 bp, Artificial Sequence
  Description of Artificial Sequence: Synthetic coding sequence
atggccaccagctccatgagcaagggctgctttgtgttcaagcccaacagcaagaagaggaagatcagcctgcccatcgaggactacttcaacaagggcaagaatgaacctgaggacagcaagctgcgctttgagacctaccagctgatctggcagcagatgaagtcagaaaatgaaaggctgcaggaggagctgaacaagaacctgtttgacaacctgattgagttcctgcagaagagccacagcggcttccagaagaacagccgggacctgggcggccagatcaagctgcgggagatccccacagctgccctggtgctgggcgtgaatgtgacagaccatgacctgaccttcggcagcctgacagaggccctgcagaacaacgtgaccccctacgtggtgtccctgcaggccaaggactgcccagacatgaagcacttcctgcagaagctgatcagccagctgatggactgctgcgtggacatcaagagcaaggaggaggagagcgtgcacgtgacccagaggaagacccactacagcatggacagcctgagctcctggtacatgacagtgacccagaagacagaccccaagatgctgagcaagaagaggaccaccagcagccagtggcagagcccccctgtggtggtgatcctgaaggacatggagagctttgccaccaaggtgctgcaggacttcatcatcatcagcagccagcacctgcacgagttccccctcatcctgatcttcggcatcgccaccagccccatcatcatccaccggctgctgccccatgctgtgagcagcctgctgtgcatcgagctgttccagagcctgagctgcaaggagcacctgaccaccgtgctggacaagctgctgctgaccacccagttccccttcaagatcaatgagaaggtgctgcaggtgctgaccaacatcttcctgtaccatgacttctctgtgcagaacttcatcaagggcctgcagctgagcctgctggagcacttctacagccagcccctgtctgtgctgtgctgcaacctgcctgaggccaagaggcgcatcaacttcctgagcaacaaccagtgtgagaacatccggcggctgcccagcttcagaagatatgtggagaagcaggccagcgagaagcaggtggccctgctgaccaatgaaagatacctgaaggaggagacccagctgctgctggagaacctgcacgtgtaccacatgaactacttcctggtgctgcgctgcctgcacaagttcaccagcagcctgcccaagtaccccctgggccggcagatccgggagctgtactgcacctgcctggagaagaacatctgggacagcgaggagtatgcctctgtgctgcagctgctgaggatgctggccaaggatgagctgatgaccatcctggagaagtgcttcaaggtgttcaagagctactgtgagaaccacctgggcagcacagccaagagaattgaggagttcctggcccagttccagagcctggatgagaccaaggaggaggaggatgccagcggcagccagcccaagggcctgcagaagacagacctgtaccacctgcagaagagcctgctggagatgaaggagctgcggcgcagcaagaagcagaccaagtttgaggtgctgagagaaaatgtggtgaacttcatcgactgcctggtgcgggagtacctgctgcccccagagacccagcccctgcacgaggtggtgtacttctctgctgcccacgccctgcgggagcacctgaatgctgcccccagaattgccctgcacacagccctgaacaacccctactactacctgaagaatgaggccctgaagtctgaggagggctgcatccccaacatcgccccagacatctgcatcgcctacaagctgcacctggagtgcagccgcctcatcaacctggtggactggagcgaggcctttgccaccgtggtgacagctgctgagaagatggatgccaacagcgccaccagcgaggagatgaatgagatcatccacgcccgcttcatccgggctgtgtctgagctggagctgctgggcttcatcaagcccaccaagcagaagacagaccacgtggcccggctgacctggggcggctgctag

SEQ ID NO: 162806 - DNA, 1335 bp, Artificial Sequence
  Description of Artificial Sequence: Synthetic coding sequence
atgaagtcagaaaatgaaaggctgcaggaggagctgaacaagaacctgtttgacaacctgattgagttcctgcagaagagccacagcggcttccagaagaacagccgggacctgggcggccagatcaagctgcgggagatccccacagctgccctggtgctgggcgtgaatgtgacagaccatgacctgaccttcggcagcctgacagaggccctgcagaacaacgtgaccccctacgtggtgtccctgcaggccaaggactgcccagacatgaagcacttcctgcagaagctgatcagccagctgatggactgctgcgtggacatcaagagcaaggaggaggagagcgtgcacgtgacccagaggaagacccactacagcatggacagcctgagctcctggtacatgacagtgacccagaagacagaccccaagatgctgagcaagaagaggaccaccagcagccagtggcagagcccccctgtggtggtgatcctgaaggacatggagagctttgccaccaaggtgctgcaggacttcatcatcatcagcagccagcacctgcacgagttccccctcatcctgatctttggaattgccaccagccccatcatcatccaccggctgctgccccatgctgtgagcagcctgctgtgcatcgagctgttccagagcctgagctgcaaggagcacctgaccaccgtgctggacaagctgctgctgaccacccagttccccttcaagatcaatgagaaggtgctgcaggtgctgaccaacatcttcctgtaccatgacttctctgtgcagaacttcatcaagggcctgcagctgagcctgctggagcacttctacagccagcccctgtctgtgctgtgctgcaacctgcctgaggccaagaggcgcatcaacttcctgagcaacaaccagtgtgagaacatccggcggctgcccagcttccgccgctacgtggagaagcaggccagcgagaagcaggtggccctgctgaccaatgaaagatacctgaaggaggagacccagctgctgctggagaacctgcacgtgtaccacatgaactacttcctggtgctgcgctgcctgcacaagttcaccagcagcctgcccaagtaccccctgggccggcagatccgggagctgtactgcacctgcctggagaagaacatctgggacagcgaggagtatgcctctgtgctgcagctgctgcggctgggcctggccttcctggacatccagctgtttggagcccagagcggccaggagctgctgctgcccctgtcctgggaggccaaccccagccacgccgccaacctgggctag

SEQ ID NO: 162807 - DNA, 1707 bp, Artificial Sequence
  Description of Artificial Sequence: Synthetic coding sequence
atgaagcacttcctgcagaagctgatcagccagctgatggactgctgcgtggacatcaagagcaaggaggaggagagcgtgcacgtgacccagaggaagacccactacagcatggacagcctgagctcctggtacatgacagtgacccagaagacagaccccaagatgctgagcaagaagaggaccaccagcagccagtggcagagcccccctgtggtggtgatcctgaaggacatggagagctttgccaccaaggtgctgcaggacttcatcatcatcagcagccagcacctgcacgagttccccctcatcctgatctttggaattgccaccagccccatcatcatccaccggctgctgccccatgctgtgagcagcctgctgtgcatcgagctgttccagagcctgagctgcaaggagcacctgaccaccgtgctggacaagctgctgctgaccacccagttccccttcaagatcaatgagaaggtgctgcaggtgctgaccaacatcttcctgtaccatgacttctctgtgcagaacttcatcaagggcctgcagctgagcctgctggagcacttctacagccagcccctgtctgtgctgtgctgcaacctgcctgaggccaagaggcgcatcaacttcctgagcaacaaccagtgtgagaacatccggcggctgcccagcttccgccgctacgtggagaagcaggccagcgagaagcaggtggccctgctgaccaatgaaagatacctgaaggaggagacccagctgctgctggagaacctgcacgtgtaccacatgaactacttcctggtgctgcgctgcctgcacaagttcaccagcagcctgcccaagtaccccctgggccggcagatccgggagctgtactgcacctgcctggagaagaacatctgggacagcgaggagtatgcctctgtgctgcagctgctgaggatgctggccaaggatgagctgatgaccatcctggagaagtgcttcaaggtgttcaagagctactgtgagaaccacctgggcagcacagccaagagaattgaggagttcctggcccagttccagagcctggatgagaccaaggaggaggaggatgccagcggcagccagcccaagggcctgcagaagacagacctgtaccacctgcagaagagcctgctggagatgaaggagctgcggcgcagcaagaagcagaccaagtttgaggtgctgcgggagaatgtggtgaacttcatcgactgcctggtgcgggagtacctgctgcccccagagacccagcccctgcacgaggtggtgtacttctctgctgcccacgccctgcgggagcacctgaatgctgccccccgcatcgccctgcacacagccctgaacaacccctactactacctgaagaatgaggccctgaagtctgaggagggctgcatccccaacatcgccccagacatctgcatcgcctacaagctgcacctggagtgcagccgcctcatcaacctggtggactggagcgaggcctttgccaccgtggtgacagctgctgagaagatggatgccaacagcgccaccagcgaggagatgaatgagatcatccacgcccgcttcatccgggctgtgtctgagctggagctgctgggcttcatcaagcccaccaagcagaagacagaccacgtggcccggctgacctggggcggctgctag

SEQ ID NO: 162808 - DNA, 1311 bp, Artificial Sequence
  Description of Artificial Sequence: Synthetic coding sequence
atgagcagcaggaagagcaagagcaacagcctcatccacacagaatgtctgagccaggtgcagaggatcctgcgggagcgcttctgccggcagagcccccacagcaacctgtttggagtgcaggtgcagtacaagcacctgtctgagctgctgaagaggacagccctgcatggagagagcaacagcgtgctgatcatcggcccccggggcagcggcaagaccatgctgatcaaccacgccctgaaggagctgatggagattgaggaggtgtctgaaaatgtgctgcaggtgcacctgaatggcctgctgcagatcaatgacaagatcgccctgaaggagatcacccggcagctgaacctggagaatgtggtgggggacaaggtgtttggcagctttgctgagaacctgtccttcctgctggaggccctgaagaagggggacaggaccagcagctgccctgtgatcttcatcctggatgaatttgacctgtttgcccaccacaagaaccagaccctgctgtacaacctgtttgacatcagccagagcgcccagacccccatcgccgtcatcggcctgacctgccgcctggacatcctggagctgctggagaagagggtgaagagccgcttcagccaccggcagatccacctgatgaacagctttggcttcccccagtatgtgaagatcttcaaggagcagctgagcctgcctgctgagttcccagacaaggtgtttgctgagaagtggaatgaaaatgtgcagtacctgtctgaggacagatctgtgcaggaggtgctgcagaagcacttcaacatcagcaagaacctgcggagcctgcacatgctgctgatgctggccctgaacagagtgacagccagccaccccttcatgacagctgtggacctgatggaggccagccagctgtgcagcatggacagcaaggccaacatcgtgcacggcctgtctgtgctggagatctgcctgatcatcgccatgaagcacctgaatgacatctatgaggaggagcccttcaacttccagatggtgtacaatgagttccagaagtttgtgcagaggaaggcccacagcgtgtacaactttgagaagcctgtggtgatgaaggcctttgagcacctgcagcagctggagctgatcaagcccatggagaggaccagcggcaacagccagcgggagtaccagctgatgaagctgctgctggacaacacccagatcatgaatgccctgcagaagtaccccaactgccccacagatgtgcggcagtgggccaccagcagcctgtcctggctgtag

SEQ ID NO: 162809 - DNA, 1311 bp, Artificial Sequence; identical to SEQ ID NO: 162808
  Description of Artificial Sequence: Synthetic coding sequence

SEQ ID NO: 162810 - DNA, 1311 bp, Artificial Sequence; identical to SEQ ID NO: 162808
  Description of Artificial Sequence: Synthetic coding sequence

SEQ ID NO: 162811 - DNA, 438 bp, Artificial Sequence
  Description of Artificial Sequence: Synthetic coding sequence
atgagcagcaggaagagcaagagcaacagcctcatccacacagaatgtctgagccaggtgcagaggatcctgcgggagcgcttctgccggcagagcccccacagcaacctgtttggagtgcaggtgcagtacaagcacctgtctgagctgctgaagaggacagccctgcatggagagagcaacagcgtgctgatcatcggcccccggggcagcggcaagaccatgctgatcaaccacgccctgaaggagctgatggagattgaggaggtgtctgaaaatgtgctgcaggtgcacctgaatggcctgctgcagatcaatgacaagatcgccctgaaggagatcacccggcagctgaacctggagaatgtggtgggggacaaggtgtttggcagctttgctgagaacctgtccttcctgctggaggccctgaagaagtag

SEQ ID NO: 162812 - DNA, 384 bp, Artificial Sequence
  Description of Artificial Sequence: Synthetic coding sequence
atgagcagcaggaagagcaagagcaacagcctcatccacacagaatgtctgagccaggtgcagaggatcctgcgggagcgcttctgccggcagagcccccacagcaacctgtttggagtgcaggtgcagtacaagcacctgtctgagctgctgaagaggacagccctgcatggagagagcaacagcgtgctgatcatcggcccccggggcagcggcaagaccatgctgatcaaccacgccctgaaggagctgatggagattgaggaggtgtctgaaaatgtgctgcaggtgcacctgaatggcctgctgcagatcaatgacaagatcgccctgaaggagatcacccggcagctgaacctggagaatgtggtgggggacaagtag

SEQ ID NO: 162813 - DNA, 387 bp, Artificial Sequence
  Description of Artificial Sequence: Synthetic coding sequence
atgagcagcaggaagagcaagagcaacagcctcatccacacagaatgtctgagccaggtgcagaggatcctgcgggagcgcttctgccggcagagcccccacagcaacctgtttggagtgcaggtgcagtacaagcacctgtctgagctgctgaagaggacagccctgcatggagagagcaacagcgtgctgatcatcggcccccggggcagcggcaagaccatgctgatcaaccacgccctgaaggagctgatggagattgaggaggtgtctgaaaatgtgctgcaggtgcacctgaatggcctgctgcagatcaatgacaagatcgccctgaaggagatcacccggcagctgaacctggagaatgtggtgggggacaaggtgtag

SEQ ID NO: 162814 - DNA, 1311 bp, Artificial Sequence; identical to SEQ ID NO: 162808
  Description of Artificial Sequence: Synthetic coding sequence

SEQ ID NO: 162815 - DNA, 1059 bp, Artificial Sequence
  Description of Artificial Sequence: Synthetic coding sequence
atggagattgaggaggtgtctgaaaatgtgctgcaggtgcacctgaatggcctgctgcagatcaatgacaagatcgccctgaaggagatcacccggcagctgaacctggagaatgtggtgggggacaaggtgtttggcagctttgctgagaacctgtccttcctgctggaggccctgaagaagggggacaggaccagcagctgccctgtgatcttcatcctggatgaatttgacctgtttgcccaccacaagaaccagaccctgctgtacaacctgtttgacatcagccagagcgcccagacccccatcgccgtcatcggcctgacctgccgcctggacatcctggagctgctggagaagagggtgaagagccgcttcagccaccggcagatccacctgatgaacagctttggcttcccccagtatgtgaagatcttcaaggagcagctgagcctgcctgctgagttcccagacaaggtgtttgctgagaagtggaatgaaaatgtgcagtacctgtctgaggacagatctgtgcaggaggtgctgcagaagcacttcaacatcagcaagaacctgcggagcctgcacatgctgctgatgctggccctgaacagagtgacagccagccaccccttcatgacagctgtggacctgatggaggccagccagctgtgcagcatggacagcaaggccaacatcgtgcacggcctgtctgtgctggagatctgcctgatcatcgccatgaagcacctgaatgacatctatgaggaggagcccttcaacttccagatggtgtacaatgagttccagaagtttgtgcagaggaaggcccacagcgtgtacaactttgagaagcctgtggtgatgaaggcctttgagcacctgcagcagctggagctgatcaagcccatggagaggaccagcggcaacagccagcgggagtaccagctgatgaagctgctgctggacaacacccagatcatgaatgccctgcagaagtaccccaactgccccacagatgtgcggcagtgggccaccagcagcctgtcctggctgtag

SEQ ID NO: 162816 - DNA, 1089 bp, Artificial Sequence
  Description of Artificial Sequence: Synthetic coding sequence
atgctgatcaaccacgccctgaaggagctgatggagattgaggaggtgtctgaaaatgtgctgcaggtgcacctgaatggcctgctgcagatcaatgacaagatcgccctgaaggagatcacccggcagctgaacctggagaatgtggtgggggacaaggtgtttggcagctttgctgagaacctgtccttcctgctggaggccctgaagaagggggacaggaccagcagctgccctgtgatcttcatcctggatgaatttgacctgtttgcccaccacaagaaccagaccctgctgtacaacctgtttgacatcagccagagcgcccagacccccatcgccgtcatcggcctgacctgccgcctggacatcctggagctgctggagaagagggtgaagagccgcttcagccaccggcagatccacctgatgaacagctttggcttcccccagtatgtgaagatcttcaaggagcagctgagcctgcctgctgagttcccagacaaggtgtttgctgagaagtggaatgaaaatgtgcagtacctgtctgaggacagatctgtgcaggaggtgctgcagaagcacttcaacatcagcaagaacctgcggagcctgcacatgctgctgatgctggccctgaacagagtgacagccagccaccccttcatgacagctgtggacctgatggaggccagccagctgtgcagcatggacagcaaggccaacatcgtgcacggcctgtctgtgctggagatctgcctgatcatcgccatgaagcacctgaatgacatctatgaggaggagcccttcaacttccagatggtgtacaatgagttccagaagtttgtgcagaggaaggcccacagcgtgtacaactttgagaagcctgtggtgatgaaggcctttgagcacctgcagcagctggagctgatcaagcccatggagaggaccagcggcaacagccagcgggagtaccagctgatgaagctgctgctggacaacacccagatcatgaatgccctgcagaagtaccccaactgccccacagatgtgcggcagtgggccaccagcagcctgtcctggctgtag

SEQ ID NO: 162817 - DNA, 660 bp, Artificial Sequence
  Description of Artificial Sequence: Synthetic coding sequence
atgaacagctttggcttcccccagtatgtgaagatcttcaaggagcagctgagcctgcctgctgagttcccagacaaggtgtttgctgagaagtggaatgaaaatgtgcagtacctgtctgaagatagatctgtgcaggaggtgctgcagaagcacttcaacatcagcaagaacctgcggagcctgcacatgctgctgatgctggccctgaacagagtgacagccagccaccccttcatgacagctgtggacctgatggaggccagccagctgtgcagcatggacagcaaggccaacatcgtgcacggcctgtctgtgctggagatctgcctgatcatcgccatgaagcacctgaatgacatctatgaggaggagcccttcaacttccagatggtgtacaatgagttccagaagtttgtgcagaggaaggcccacagcgtgtacaactttgagaagcctgtggtgatgaaggcctttgagcacctgcagcagctggagctgatcaagcccatggagaggaccagcggcaacagccagcgggagtaccagctgatgaagctgctgctggacaacacccagatcatgaatgccctgcagaagtaccccaactgccccacagatgtgcggcagtgggccaccagcagcctgtcctggctgtag

SEQ ID NO: 162818 - DNA, 1308 bp, Artificial Sequence
  Description of Artificial Sequence: Synthetic coding sequence
atgccccacctggagaatgtggtgctgtgccgggagagccaggtgtccatcctgcagagcctgtttggagagcggcaccacttctccttccccagcatcttcatctacggccacacagccagcggcaagacctacgtgacccagaccctgctgaagaccctggagctgccccacgtgtttgtgaactgtgtggagtgcttcaccctgcggctgctgctggagcagatcctgaacaagctgaaccacctgagcagcagtgaagatggctgcagcacagagatcacctgtgagaccttcaatgactttgtgcggctcttcaagcaggtgaccacagctgagaacctgaaggaccagacagtgtacatcgtgctggacaaggccgagtacctgcgggacatggaggccaacctgctgcccggcttcctgcggctgcaggagctggccgacagaaatgtgacagtgctcttcctgtctgagatcgtgtgggagaagttccggcccaacacaggctgctttgagccctttgtgctgtacttcccagactacagcatcggcaacctgcagaagatcctgagccatgaccaccccccagagtacagcgctgacttctatgctgcctacatcaacatcctgctgggcgtcttctacacagtgtgccgggacctgaaggagctgcggcacctggccgtgctgaacttccccaagtactgtgagcctgtggtgaagggggaggccagcgagcgggacaccaggaagctgtggagaaatattgagccccacctgaagaaggccatgcagacagtgtacctgcgggagatcagcagcagccagtgggagaagctgcagaaggatgacacagaccccggccagctgaagggcctgagcgcccacacccacgtggagctgccctactacagcaagttcatcctgattgctgcctacctggccagctacaacccagccaggacagacaagcgcttcttcctgaagcaccacggcaagatcaagaagaccaacttcctgaagaagcatgagaagaccagcaaccacctgctgggccccaagcccttccccctggaccggctgctggccatcctgtacagcatcgtggacagccgggtggcccccacagccaacatcttcagccagatcaccagcctggtgaccctgcagctgctgaccctggtgggccatgatgaccagctggatggccccaagtacaagtgcaccgtgtccctggacttcatccgggccatcgccaggacagtgaactttgacatcatcaagtacctgtatgacttcctgtag

SEQ ID NO: 162819 - DNA, 975 bp, Artificial Sequence
  Description of Artificial Sequence: Synthetic coding sequence
atgccccacctggagaatgtggtgctgtgccgggagagccaggtgtccatcctgcagagcctgtttggagagcggcaccacttctccttccccagcatcttcatctacggccacacagccagcggcaagacctacgtgacccagaccctgctgaagaccctggagctgccccacgtgtttgtgaactgtgtggagtgcttcaccctgcggctgctgctggagcagatcctgaacaagctgaaccacctgagcagcagtgaagatggctgcagcacagagatcacctgtgagaccttcaatgactttgtgcggctcttcaagcaggtgaccacagctgagaacctgaaggaccagacagtgtacatcgtgctggacaaggccgagtacctgcgggacatggaggccaacctgctgcccggcttcctgcggctgcaggagctggccgacagaaatgtgacagtgctcttcctgtctgagatcgtgtgggagaagttccggcccaacacaggctgctttgagccctttgtgctgtacttcccagactacagcatcggcaacctgcagaagatcctgagccatgaccaccccccagagtacagcgctgacttctatgctgcctacatcaacatcctgctgggcgtcttctacacagtgtgccgggacctgaaggagctgcggcacctggccgtgctgaacttccccaagtactgtgagcctgtggtgaagggggaggccagcgagcgggacaccaggaagctgtggagaaatattgagccccacctgaagaaggccatgcagacagtgtacctgcgggagatcagcagcagccagtgggagaagctgcagaaggatgacacagaccccggccagctgaagggcatccggggcagcattgagaccgtgactggagacaccagcagcgccaactaccaggacaccaaggtgaacaccaaggagcacagcgtgaggaagtag

SEQ ID NO: 162820 - DNA, 912 bp, Artificial Sequence
  Description of Artificial Sequence: Synthetic coding sequence
atggaggccaacctgctgcccggcttcctgcggctgcaggagctggccgacagaaatgtgacagtgctcttcctgtctgagatcgtgtgggagaagttccggcccaacacaggctgctttgagccctttgtgctgtacttcccagactacagcatcggcaacctgcagaagatcctgagccatgaccaccccccagagtacagcgctgacttctatgctgcctacatcaacatcctgctgggcgtcttctacacagtgtgccgggacctgaaggagctgcggcacctggccgtgctgaacttccccaagtactgtgagcctgtggtgaagggggaggccagcgagcgggacaccaggaagctgtggagaaatattgagccccacctgaagaaggccatgcagacagtgtacctgcgggagatcagcagcagccagtgggagaagctgcagaaggatgacacagaccccggccagctgaagggcctgagcgcccacacccacgtggagctgccctactacagcaagttcatcctgattgctgcctacctggccagctacaacccagccaggacagacaagcgcttcttcctgaagcaccacggcaagatcaagaagaccaacttcctgaagaagcatgagaagaccagcaaccacctgctgggccccaagcccttccccctggaccggctgctggccatcctgtacagcatcgtggacagccgggtggcccccacagccaacatcttcagccagatcaccagcctggtgaccctgcagctgctgaccctggtgggccatgatgaccagctggatggccccaagtacaagtgcaccgtgtccctggacttcatccgggccatcgccaggacagtgaactttgacatcatcaagtacctgtatgacttcctgtag

SEQ ID NO: 162821 - DNA, 1665 bp, Artificial Sequence
  Description of Artificial Sequence: Synthetic coding sequence
atgtctgcagatggcggcggcatccaggacacccaggacaaggagaccccacctgaggtgcctgaccggggccacccccaccaggagatgcccagcaagctgggggaggccgtgcccagcggggacacccaggagagcctgcacatcaagatggagcctgaggagccccacagcgagggcgccagccaggaggatggagcccagggcgcctggggctgggcccccctgagccacggcagcaaggagaaggccctcttcctgcccggcggggccctgcccagcccccgcatccctgtgctgagccgggagggccgcacccgggaccggcagatggctgctgccctgctgacagcctggagccagatgcctgtgacctttgaagatgtggccctgtacctgagccgggaggagtggggccgcctggaccacacccagcagaacttctacagagatgtgctgcagaagaagaatggcctgagcctgggcttccccttcagccggcccttctgggccccccaggcccatggaaaaggagaggccagcggcagcagccggcaggccggagatgagaaggagtggaggggggcctgcaccggggctgtggaggtgggccagagggtgcagaccagctctgtggccgccctgggcaatgtgaagcccttccgcaccagggctggccgggtgcagtggggcgtgccccagtgtgcccaggaggccgcctgtggccgcagcagcggccctgccaaggacagcggccagcctgctgagccagacaggaccccagatgctgcccccccagaccccagccccacagagccccaggagtacagagtgcctgagaagcccaatgaggaggagaagggggcccctgagagcggggaggagggcctggccccagattctgaggtgggcaggaagagctaccgctgtgagcagtgtgggaagggcttctcctggcacagccacctggtgacccacaggaggacccacactggagagaagccctatgcctgcacagactgtgggaagagatttggccgcagcagccacctgatccagcaccagatcatccacactggagagaagccctacacctgcccagcctgcaggaagagcttcagccaccacagcaccctcatccagcaccagaggatccacactggagagaagccctacgtgtgtgacagatgtgccaagcgcttcaccaggagaagtgacctggtgacccaccagggcacccacactggagccaagccccacaagtgccccatctgtgccaagtgcttcacccagagcagcgccctggtgacccaccagaggacccacactggagtgaagccctacccctgcccagaatgtgggaagtgcttcagccagaggagcaacctgattgcccacaacagaacccacactggagagaagccctaccactgcctggactgtgggaagagcttcagccacagcagccacctgacagcccaccagaggacccaccggggcgtgcggccctatgcctgccccctgtgtgggaagagcttcagcagaagaagcaacctgcacagacatgagaagatccacaccaccggccccaaggccctggccatgctgatgctgggcgctgctgctgctggggccctggccaccccacctccagcccccacctag

SEQ ID NO: 162822 - DNA, 462 bp, Artificial Sequence
  Description of Artificial Sequence: Synthetic coding sequence
atgaatgtgggcgtggcccacagcgaggtgaaccccaacaccagggtgatgaacagccggggcatgtggctgacctacgccctgggcgtgggcctgctgcacatcgtgctgctgagcatccccttcttctctgtgcctgtggcctggaccctgaccaacatcatccacaacctgggcatgtatgtgttcctgcatgctgtgaagggcaccccatttgagaccccagaccagggcaaggcccggctgctgacccactgggagcagctggactatggagtgcagttcaccagcagcaggaagttcttcaccatcagccccatcatcctgtacttcctggccagcttctacaccaagtatgaccccacccacttcatcctgaacacagccagcctgctgtctgtgctgatccccaagatgccccagctgcatggagtgcgcatcttcggcatcaacaagtactag

SEQ ID NO: 162823 - DNA, 462 bp, Artificial Sequence; identical to SEQ ID NO: 162822
  Description of Artificial Sequence: Synthetic coding sequence

SEQ ID NO: 162824 - DNA, 462 bp, Artificial Sequence; identical to SEQ ID NO: 162822
  Description of Artificial Sequence: Synthetic coding sequence

SEQ ID NO: 162825 - DNA, 330 bp, Artificial Sequence
  Description of Artificial Sequence: Synthetic coding sequence
atgaatgtgggcgtggcccacagcgaggtgaaccccaacaccagggtgatgaacagccggggcatgtggctgacctacgccctgggcgtgggcctgctgcacatcgtgctgctgagcatccccttcttctctgtgcctgtggcctggaccctgaccaacatcatccacaacctgggcatgtatgtgttcctgcatgctgtgaagggcaccccatttgagaccccagaccagggcaaggcccggctgctgacccactgggagcagctggactatggagtgcagttcaccagcagcaggaagttcttcaccatcagccccatcatcctgtag

SEQ ID NO: 162826 - DNA, 330 bp, Artificial Sequence; identical to SEQ ID NO: 162825
  Description of Artificial Sequence: Synthetic coding sequence

SEQ ID NO: 162827 - DNA, 462 bp, Artificial Sequence
  Description of Artificial Sequence: Synthetic coding sequence
atgaatgtgggcgtggcccacagcgaggtgaaccccaacaccagggtgatgaacagccggggcatctggctggcctacatcatcctggtgggcctgctgcacatggtgctgctgagcatccccttcttcagcatccctgtggtgtggaccctgaccaacgtcatccacaacctggccacctacgtgttcctgcacacagtgaagggcaccccatttgagaccccagaccagggcaaggcccggctgctgacccactgggagcagatggactatggcctgcagttcaccagcagcaggaagttcctgagcatcagccccatcgtgctgtacctgctggccagcttctacaccaagtatgatgctgcccacttcctgatcaacacagccagcctgctgtctgtgctgctgcccaagctgccccagttccatggagtgcgggtgtttggcatcaacaagtactag

SEQ ID NO: 162828 - DNA, 462 bp, Artificial Sequence; identical to SEQ ID NO: 162827
  Description of Artificial Sequence: Synthetic coding sequence

SEQ ID NO: 162829 - DNA, 462 bp, Artificial Sequence
  Description of Artificial Sequence: Synthetic coding sequence
atgaatgtgggcacagcccacagcgaggtgaaccccaacaccagggtgatgaacagccggggcatctggctgtcctatgtgctggccatcggcctgctgcacatcgtgctgctgagcatcccctttgtgtctgtgcctgtggtgtggaccctgaccaacctgatccacaacatgggcatgtacatcttcctgcacacagtgaagggcaccccatttgagaccccagaccagggcaaggcccggctgctgacccactgggagcagatggactatggagtgcagttcaccgccagcaggaagttcctgaccatcacccccatcgtgctgtacttcctgaccagcttctacaccaagtatgaccagatccactttgtgctgaacacagtgtccctgatgtctgtgctgatccccaagctgccccagctgcatggagtgcgcatcttcggcatcaacaagtactag

SEQ ID NO: 162830 - DNA, 462 bp, Artificial Sequence; identical to SEQ ID NO: 162829
  Description of Artificial Sequence: Synthetic coding sequence

SEQ ID NO: 162831 - DNA, 1320 bp, Artificial Sequence
  Description of Artificial Sequence: Synthetic coding sequence
atgttcagcaagctggcccacctgcagagatttgctgtgctgagcagaggagtgcacagctctgtggccagcgccacctctgtggccaccaagaagacagtgcagggcccccccaccagtgatgacatctttgagcgggagtacaagtacggggcccacaactaccaccccctgcctgtggccctggagcggggcaagggcatctacctgtgggatgtggagggcaggaagtactttgacttcctgagcagctacagcgctgtgaaccagggccactgccaccccaagatcgtgaatgccctgaagagccaggtggacaagctgaccctgaccagccgggccttctacaacaacgtgctgggggagtatgaggagtacatcaccaagctgttcaactaccacaaggtgctgcccatgaacacaggagtggaggccggggagacagcctgcaagctggccaggaagtggggctacacagtgaagggcatccagaagtacaaggccaagatcgtgtttgctgctggcaacttctggggccgcaccctgagcgccatcagcagcagcacagaccccaccagctatgatggcttcggccccttcatgcctggctttgacatcatcccctacaatgacctgcctgccctggagcgggccctgcaggaccccaacgtggccgccttcatggtggagcccatccagggcgaggccggcgtggtggtgcctgaccccggctacctgatgggcgtgcgggagctgtgcaccaggcaccaggtgctcttcatcgcagatgagatccagacaggcctggccaggacaggccgctggctggccgtggactatgaaaatgtgcggccagacatcgtgctgctgggcaaggccctgagcggcggcctgtaccctgtgtctgctgtgctgtgtgatgatgacatcatgctgaccatcaagccaggagaacatggcagcacctatggaggcaaccccctgggctgccgggtggccatcgccgccctggaggtgctggaggaggagaacctggctgaaaatgctgacaagctgggcatcatcctgagaaatgagctgatgaagctgcccagtgatgtggtgacagctgtgcggggcaagggcctgctgaatgccatcgtcatcaaggagaccaaggactgggatgcctggaaggtgtgcctgcggctgcgggacaatggcctgctggccaagcccacccacggggacatcatccgctttgccccacccctggtgatcaaggaggatgagctgcgggagagcattgagatcatcaacaagaccatcctgtccttctag

SEQ ID NO: 162832 - DNA, 906 bp, Artificial Sequence
  Description of Artificial Sequence: Synthetic coding sequence
atgaacacaggagtggaggccggggagacagcctgcaagctggccaggaagtggggctacacagtgaagggcatccagaagtacaaggccaagatcgtgtttgctgctggcaacttctggggccgcaccctgagcgccatcagcagcagcacagaccccaccagctatgatggcttcggccccttcatgcctggctttgacatcatcccctacaatgacctgcctgccctggagcgggccctgcaggaccccaacgtggccgccttcatggtggagcccatccagggcgaggccggcgtggtggtgcctgaccccggctacctgatgggcgtgcgggagctgtgcaccaggcaccaggtgctcttcatcgcagatgagatccagacaggcctggccaggacaggccgctggctggccgtggactatgaaaatgtgcggccagacatcgtgctgctgggcaaggccctgagcggcggcctgtaccctgtgtctgctgtgctgtgtgatgatgacatcatgctgaccatcaagccaggagaacatggcagcacctatggaggcaaccccctgggctgccgggtggccatcgccgccctggaggtgctggaggaggagaacctggctgaaaatgctgacaagctgggcatcatcctgagaaatgagctgatgaagctgcccagtgatgtggtgacagctgtgcggggcaagggcctgctgaatgccatcgtcatcaaggagaccaaggactgggatgcctggaaggtgtgcctgcggctgcgggacaatggcctgctggccaagcccacccacggggacatcatccgctttgccccacccctggtgatcaaggaggatgagctgcgggagagcattgagatcatcaacaagaccatcctgtccttctag

SEQ ID NO: 162833 - DNA, 405 bp, Artificial Sequence; identical to SEQ ID NO: 155947
  Description of Artificial Sequence: Synthetic coding sequence

SEQ ID NO: 162834 - DNA, 1386 bp, Artificial Sequence
  Description of Artificial Sequence: Synthetic coding sequence
atgaacaactttggaaatgaggagtttgactgccacttcctggatgagggcttcaccgccaaggacatcctggaccagaagatcaatgaggtgagcagcagtgatgacaaggatgccttctacgtggccgacctgggggacatcctgaagaagcacctgcgctggctgaaggccctgccccgggtgacccccttctatgctgtgaagtgcaatgacagcaaggccatcgtgaagaccctggccgccactggaactggatttgactgtgccagcaagacagagatccagctggtgcagagcctgggcgtgcccccagagcgcatcatctatgccaacccctgcaagcaggtgtcccagatcaagtatgctgccaacaacggggtgcagatgatgacctttgattctgaggtggagctgatgaaggtggcccgggcccaccccaaggccaagctggtgctgagaattgccacagatgacagcaaggctgtgtgccgcctgtctgtgaagtttggagccaccctgcggaccagccggctgctgctggagcgggccaaggagctgaacattgatgtggtgggcgtgtccttccacgtgggcagcggctgcacagatcctgagacctttgtgcaggccatcagtgatgcccgctgtgtgtttgacatgggcgctgaggtgggcttctccatgtacctgctggacatcggcggcggcttccctggctctgaagatgtgaagctgaagtttgaggagatcaccggggtcatcaacccagccctggacaagtacttccccagcgacagcggcgtgcgcatcatcgccgagcccggccgctactacgtggccagcgccttcaccctggccgtgaacatcatcgccaagaagatcgtgctgaaggagcagacaggcagtgatgatgaagatgagagcagcgagcagaccttcatgtactacgtgaatgatggagtgtatggcagcttcaactgcatcctgtatgaccacgcccacgtgaagcccctgctgcagaagaggcccaagccagatgagaagtactacagcagcagcatctggggccccacctgtgatggcctggaccgcatcgtggagcgctgtgacctgcctgagatgcacgtgggggactggatgctgtttgagaacatgggcgcctacacagtggccgccgccagcaccttcaacggcttccagaggcccaccatctactacgtgatgagcggccctgcctggcagctgatgcagcagttccagaacccagacttccccccagaggtggaggagcaggatgccagcaccctgcctgtgtcctgtgcctgggagagcggcatgaagaggcaccgggccgcctgtgccagcgccagcatcaacgtgtag

SEQ ID NO: 162835 - DNA, 207 bp, Artificial Sequence
  Description of Artificial Sequence: Synthetic coding sequence
atgaacaactttggaaatgaggagtttgactgccacttcctggatgagggcttcaccgccaaggacatcctggaccagaagatcaatgaggtgagcagcagtgatgacaaggatgccttctacgtggccgacctgggggacatcctgaagaagcacctgcgctggctgaaggccctgccccgggtgacccccttctatgctgtgtag

SEQ ID NO: 162836 - DNA, 927 bp, Artificial Sequence
  Description of Artificial Sequence: Synthetic coding sequence
atgatgacctttgacagcgaggtggagctgatgaaggtggcccgggcccaccccaaggccaagctggtgctgcgcatcgccacagatgacagcaaggctgtgtgccgcctgtctgtgaagtttggagccaccctgcggaccagccggctgctgctggagcgggccaaggagctgaacattgatgtggtgggcgtgtccttccacgtgggcagcggctgcacagatcctgagacctttgtgcaggccatcagtgatgcccgctgtgtgtttgacatgggcgctgaggtgggcttctccatgtacctgctggacattggaggcggcttccctggctctgaagatgtgaagctgaagtttgaggagatcactggagtcatcaacccagccctggacaagtacttccccagcgacagcggcgtgcgcatcatcgccgagcccggccgctactacgtggccagcgccttcaccctggccgtgaacatcatcgccaagaagatcgtgctgaaggagcagacaggcagtgatgatgaagatgagagcagcgagcagaccttcatgtactacgtgaatgatggagtgtatggcagcttcaactgcatcctgtatgaccacgcccacgtgaagcccctgctgcagaagaggcccaagccagatgagaagtactacagcagcagcatctggggccccacctgtgatggcctggacagaattgtggagcgctgtgacctgcctgagatgcacgtgggggactggatgctgtttgagaacatgggcgcctacacagtggccgccgccagcaccttcaacggcttccagaggcccaccatctactacgtgatgagcggccctgcctggcagctgatgcagcagttccagaacccagacttccccccctgcctgtgcctggtgcccggccgggtgggctag

SEQ ID NO: 162837 - DNA, 684 bp, Artificial Sequence
  Description of Artificial Sequence: Synthetic coding sequence
atggtgaagagcagcctgcagaggatcctgaacagccactgctttgcccgggagaaggagggggacaagcccagcgccaccatccacgccagcaggaccatgcccctgctgagcctgcacagcagaggaggcagcagcagcgagagcagccgggtgtccctgcactgctgcagcaaccctggccctggcccccgctggtgtgatgccccccacccccccctgaagatccctgggggccggggcaacagccagagggaccacaacctgagcgccaacctcttctacagtgatgaccggctgaatgtgacagaggagctgaccagcaatgacaagacccgcatcctgaatgtgcagagccggctgacagatgccaagaggatcaactggaggacagtgctgagcggcggcagcctgtacatcgagatccctggaggagccctgcctgagggcagcaaggacagctttgctgtgctgctggagtttgctgaggagcagctgcgggctgaccacgtgttcatctgcttccacaagaaccgggaggacagagctgccctgctgcggaccttctccttcctgggctttgagatcgtgcggcccggccaccccctggtgcccaagaggccagatgcctgcttcatggcctacacctttgagcgggagagcagcggggaggaggaggagtag

SEQ ID NO: 162838 - DNA, 831 bp, Artificial Sequence
  Description of Artificial Sequence: Synthetic coding sequence
atgtggatcaccagcctcatcaccatgaaggatgaggacatctttgacctggccggggacccccaggacagcctcatccctggccccagccccacccccaagcagaaccctgtgtgcaatgaggccttcttcggccaccagaccttcagcctgcgggagaccggcctgaagtctgtgcactgccagggccaggaggccgagaacatggagcgggagaagttccagcagaaggccctgaagcagaccaagcagaagaagagcaagtctgctgagttcctgatggtgaaggaggaccgggaggccacagagggcactggaaatcctgccttcaacatgagcagcccagacctgagcgcctgccagacagctgagaagaaggtgatcagacatgacatgccagacaggaccctggccgcccaccagcagaagttccggctgcctgccagcgctgagcccaagggaaatgaatatggaagaaactactttgaccccctgatggatgaggagatcaacccccggcagtgtgccacagaggtgtcccgggaggatgaaagtggccgggaggagaccctgaacagcgaggcccctggcagcagcaacaagagccatgagatccacaaggaggccagcgaggccaccacagcccacctggaggagttccagaggagccagaagaccatcatcctgctgggcagcagccccctggagcaggagatccgcagcaccagcctgcactgcatggaggatgagatgagccacccctggatcctgctgctgaaggtgacagctgtgatccgcagccgccgctactaccgggagcagcgcttctag

SEQ ID NO: 162839 - DNA, 1443 bp, Artificial Sequence
  Description of Artificial Sequence: Synthetic coding sequence
atggagcgggagaagttccagcagaaggccctgaagcagaccaagcagaagaagagcaagtctgctgagttcctgatggtgaaggaggaccgggaggccacagagggcactggaaatcctgccttcaacatgagcagcccagacctgagcgcctgccagacagctgagaagaaggtgatcagacatgacatgccagacaggaccctggccgcccaccagcagaagttccggctgcctgccagcgctgagcccaagggaaatgaatatggaagaaactactttgaccccctgatggatgaggagatcaacccccggcagtgtgccacagaggtgtcccgggaggtgtgcctgatggccaagggggagaaggccgagagcggcgtggacaacacagctggcctgtctgagaaggagacccagaagaacccccgggcccccatggatgaagcagatgtgaagtctgctgcccacagcagccagggcagcatccccaagaagattggcccctgcagcatggactatgaccccaacctgctggaggaggatgatgagctgcacagccagggcgacagcctgacagaccacagcgtgaagggcaagagcacagtgtggagaattggagaggccgaggactacagccaggacatctcctacctggaggagctggaggagcaccgcttctctgtgtgctgcagctctgtggccgacagccgctatggagacttcttcaagcacctgcactttgtgctggtgtctgccagcagcgagctgcagctgagccagtggcagagccagggcttctggtacatcatcctgctgatgttcttcctgtggttcctgcggctgtacctgcactacctgggccagtggctgttcctgcaggccatcagcacccctgtgaccaagttccacttcagcctgcacatcgtggagctgtgctaccccaccagcagcctgcacatcggggaggagctgcctgtggtggtgatgggccccctgatgctgaatgccatcctgctgctgctggtgctgatccgctggggctgccagctgctgtttgccagctgcccagatgtgctgagcaagctgatcatcaccatgggcctgtggaccatcctggaccccctggccgtgttcatcctggacaccctgctgggccgcctgacagacaatgaggagacccctgtggctgatgctgccaagctgtactggatgtttgtgaggacagtgcagcccggcatcctgggcgtggtgatcaccgtgctgctgtacatcctgctcttcgtcatcagcagcctcatcctgtacctgtactgcctgcggctgcacaatgacagctggatcctggatgccttccagaggatccacagcgaggagaccaagttcttcatcccctatgacctggagatcagcaaccaggagctgagctacatcgtgaagtag

SEQ ID NO: 162840 - DNA, 606 bp, Artificial Sequence
  Description of Artificial Sequence: Synthetic coding sequence
atggccctgtcctgggtgctgactgtgctgagcctgctgcccctgctggaggcccagatccccctgtgtgccaacctggtgcctgtgcccatcaccaatgccaccctggaccgcatcaccgggaagtggttctacatcgccagcgccttcagaaatgaggagtacaacaagtctgtgcaggagatccaggccaccttcttctacttcacccccaacaagacagaggacaccatcttcctgcgggagtaccagacccggcaggaccagtgcatctacaacaccacctacctgaatgtgcagcgggagaatggcaccatcagccgctacgtgggcggccaggagcactttgcccacctgctgatcctgcgggacaccaagacctacatgctggcctttgatgtgaatgatgagaagaactggggcctgtctgtgtatgctgacaagccagagaccaccaaggagcagctgggggagttctatgaggccctggactgcctgcgcatccccaagagtgatgtggtgtacacagactggaagaaggacaagtgtgagcccctggagaagcagcacgagaaggagaggaagcaggaggagggggagagctag

SEQ ID NO: 162841 - DNA, 585 bp, Artificial Sequence
  Description of Artificial Sequence: Synthetic coding sequence
atggccctgtcctgggtgctgactgtgctgagcctgctgcccctgctggaggcccagatccccctgtgtgccaacctggtgcctgtgcccatcaccaatgccaccctggacagagtgtctgcctgggccagccctgtgctgagcacctgggccgccgccagcctgctgtgggccagcctgagcctgctggccgtggtgggcccccccctgcctgccctgcccttcagcctgctgggcccccagggcgagatcctgaccagccctggggacagcggcggcaccccctgcctgcagacccagaagccccactgccgggtgctgcacggcggccgcttctgtgccggccctgggggcgccgcctggggcgccatgacagacccccagggcgagctgctgcacgcccactgccccccaggggccagcagcccccacctgcagaaccagggcgagatctgcctgagcctgctgcctgctgacagccagcgcttcagcatcaagccacccagccctgcccccaccttctccccagaccactggcaggtggtgctgtaccgcatcggcctgagcaagaggggcgtgcagtag

SEQ ID NO: 162842 - DNA, 585 bp, Artificial Sequence
  Description of Artificial Sequence: Synthetic coding sequence
atggccctgtcctgggtgctgactgtgctgagcctgctgcccctgctggaggcccagatccccctgtgtgccaacctggtgcctgtgcccatcaccaatgccaccctggacagagtgtctgcctgggccagccctgtgctgagcacctgggccgccgccagcctgctgtgggccagcctgtacctgctggccgtggtggccccacccctgcctgccctgcccttcagcctgctgggcccccagggcgagatcctgaccagccctggggacagcggcggcaccccctgcctgcagacccagaagccccactgccgggtgctgcacggcggccgcttctgtgccggccctgggggcgccgcctggggcgccatgacagacccccagggcgagctgctgcacgcccactgccccccaggggccagcagcccccacctgcagaaccagggcgagatctgcctgagcctgctgcctgctgacagccagcgcttcagcatcaagccacccagccctgccccacccttctccccagaccactggcaggtggtgctgtaccgcatcggcctgagcaagaggggcgtgcagtag

SEQ ID NO: 162843 - DNA, 606 bp, Artificial Sequence
  Description of Artificial Sequence: Synthetic coding sequence
atggccctgtcctgggtgctgactgtgctgagcctgctgcccctgctggaggcccagatccccctgtgtgccaacctggtgcctgtgcccatcaccaatgccaccctggaccgcatcaccgggaagtggttctacatcgccagcgccttcagaaatgaggagtacaacaagtctgtgcaggagatccaggccaccttcttctacttcacccccaacaagacagaggacaccatcttcctgcgggagtaccagacccggcagaaccagtgcttctacaacagcagctacctgaatgtgcagcgggagaatggaacagtgagccgctatgaaggaggccgggagcacgtggcccacctgctcttcctgcgggacaccaagaccctgatgtttggcagctacctggatgatgagaagaactggggcctgtccttctacgccgacaagccagagaccaccaaggagcagctgggggagttctatgaggccctggactgcctgtgcatccccaggagtgatgtgatgtacacagactggaagaaggacaagtgtgagcccctggagaagcagcacgagaaggagaggaagcaggaggagggggagagctag

SEQ ID NO: 162844 - DNA, 1065 bp, Artificial Sequence
  Description of Artificial Sequence: Synthetic coding sequence
atgatgagctacctgaagcagcccccctacggcatgaatggcctgggcctggccggccctgccatggacctgctgcaccccagcgtgggctacccagccacccccaggaagcagaggcgggagaggaccaccttcaccaggagccagctggatgtgctggaggccctgtttgccaagacccgctacccagacatcttcatgagggaggaggtggccctgaagatcaacctgcctgagagccgggtgcaggtgtggttcaagaacagaagagccaagtgccggcagcagcagcagagcggcagcggcaccaagagcaggcctgccaagaagaagagcagccctgtgcgggagagcagcggcagcgagagcagcggccagttcaccccacctgctgtgagcagcagcgccagcagcagcagcagcgccagcagcagcagcgccaacccagctgctgctgctgctgctggcctgggcggcaaccctgtggccgccgccagcagcctgagcaccccagctgccagcagcatctggagccctgccagcatcagccctggcagcgccccagcctctgtgtctgtgcctgagcccctggccgcccccagcaacaccagctgcatgcagaggtctgtggccgccggggccgccacagctgctgccagctaccccatgtcctatggccagggcggcagctatggccagggctaccccacccccagcagcagctactttggaggagtggactgcagcagctacctggcccccatgcacagccaccaccacccccaccagctgagccccatggcccccagctccatggccggccaccaccaccaccacccccacgcccaccaccccctgagccagagcagcggccaccaccaccaccaccaccaccaccaccaccagggctacggcggcagcggcctggccttcaacagcgctgactgcctggactacaaggagcccggggctgctgctgccagcagcgcctggaagctgaacttcaacagcccagactgcctggactacaaggaccaggcctcctggaggttccaggtgctgtag

SEQ ID NO: 162845 - DNA, 1065 bp, Artificial Sequence; identical to SEQ ID NO: 162844
  Description of Artificial Sequence: Synthetic coding sequence

SEQ ID NO: 162846 - DNA, 894 bp, Artificial Sequence
  Description of Artificial Sequence: Synthetic coding sequence
atgatgagctacctgaagcagcccccctatgctgtgaatggcctgagcctgaccaccagcggcatggacctgctgcaccccagcgtgggctacccaggcccctgggccagctgcccagctgccacccccaggaagcagaggcgggagaggaccaccttcacccgggcccagctggatgtgctggaggccctgtttgccaagacccgctacccagacatcttcatgagggaggaggtggccctgaagatcaacctgcctgagagccgggtgcaggtgtggttcaagaacagaagagccaagtgccggcagcagcagcagcagcagcagaatggaggccagaacaaggtgcggcctgccaagaagaagaccagccctgcccgggaggtgtcctctgagagcggcaccagcggccagttcaccccacccagcagcacctctgtgcccaccatcgccagcagcagcgcccctgtgtccatctggagccctgccagcatcagccccctgagtgaccccctgagcaccagcagcagctgcatgcagaggagctaccccatgacctacacccaggccagcggctacagccagggctacgccggcagcaccagctactttggaggcatggactgtggcagctacctgacccccatgcaccaccagctgcccggccctggggccaccctgagccccatgggcaccaatgctgtgaccagccacctgaaccagagccctgccagcctgagcacccagggctatggagccagcagcctgggcttcaacagcaccacagactgcctggactacaaggaccagacagcctcctggaagctgaacttcaatgctgactgcctggactacaaggaccagaccagctcctggaagttccaggtgctgtag

SEQ ID NO: 162847 - DNA, 870 bp, Artificial Sequence
  Description of Artificial Sequence: Synthetic coding sequence
atgatgagctacctgaagcagcccccctatgctgtgaatggcctgagcctgaccaccagcggcatggacctgctgcaccccagcgtgggctacccagccacccccaggaagcagaggcgggagaggaccaccttcacccgggcccagctggatgtgctggaggccctgtttgccaagacccgctacccagacatcttcatgagggaggaggtggccctgaagatcaacctgcctgagagccgggtgcaggtgtggttcaagaacagaagagccaagtgccggcagcagcagcagcagcagcagaatggaggccagaacaaggtgcggcctgccaagaagaagaccagccctgcccgggaggtgtcctctgagagcggcaccagcggccagttcaccccacccagcagcacctctgtgcccaccatcgccagcagcagcgcccctgtgtccatctggagccctgccagcatcagccccctgagtgaccccctgagcaccagcagcagctgcatgcagaggagctaccccatgacctacacccaggccagcggctacagccagggctacgccggcagcaccagctactttggaggcatggactgtggcagctacctgacccccatgcaccaccagctgcccggccctggggccaccctgagccccatgggcaccaatgctgtgaccagccacctgaaccagagccctgccagcctgagcacccagggctatggagccagcagcctgggcttcaacagcaccacagactgcctggactacaaggaccagacagcctcctggaagctgaacttcaatgctgactgcctggactacaaggaccagaccagctcctggaagttccaggtgctgtag

SEQ ID NO: 162848 - DNA, 720 bp, Artificial Sequence
  Description of Artificial Sequence: Synthetic coding sequence
atgatgagctacctgaagcagcccccctatgctgtgaatggcctgagcctgaccaccagcggcatggacctgctgcaccccagcgtgggctacccaggcccctgggccagctgcccagctgccacccccaggaagcagaggcgggagaggaccaccttcacccgggcccagctggatgtgctggaggccctgtttgccaagacccgctacccagacatcttcatgagggaggaggtggccctgaagatcaacctgcctgagagccgggtgcaggtgtggttcaagaacagaagagccaagtgccggcagcagcagcagcagcagcagaatggaggccagaacaaggtgcggcctgccaagaagaagaccagccctgcccgggaggtgtcctctgagagcggcaccagcggccagttcaccccacccagcagcacctctgtgcccaccatcgccagcagcagcgcccctgtgtccatctggagccctgccagcatcagccccctgagtgaccccctgagcaccagcagcagctgcatgcagaggagctaccccatgacctacacccaggccagcggctacagccagggctacgccggcagcaccagctactttggaggcatggactgtggcagctacctgacccccatgcaccaccagctgcccggccctggggccaccctgagccccatgggcaccaatgctgtgaccagccacctgtag

SEQ ID NO: 162849 - DNA, 870 bp, Artificial Sequence; identical to SEQ ID NO: 162847
  Description of Artificial Sequence: Synthetic coding sequence

SEQ ID NO: 162850 - DNA, 492 bp, Artificial Sequence
  Description of Artificial Sequence: Synthetic coding sequence
atgatgagctacctgaagcagcccccctatgctgtgaatggcctgagcctgaccaccagcggcatggacctgctgcaccccagcgtgggctacccagccacccccaggaagcagaggcgggagaggaccaccttcacccgggcccagctggatgtgctggaggccctgtttgccaagacccgctacccagacatcttcatgagggaggaggtggccctgaagatcaacctgcctgagagccgggtgcaggtgtggttcaagaacagaagagccaagtgccggcagcagcagcagcagcagcagaatggaggccagaacaaggtgcggcctgccaagaagaagaccagccctgcccgggaggtgtcctctgagagcggcaccagcggccagttcaccccacccagcagcacctctgtgcccaccatcgccagcagcagcgcccctgtgtccatctggagccctgccagcatcagccccctgagtgacccctag

SEQ ID NO: 162851 - DNA, 978 bp, Artificial Sequence
  Description of Artificial Sequence: Synthetic coding sequence
atgctgagccatgctgacctgctggatgcccggctgggcatgaaggatgctgctgagctgctgggccaccgggaggccgtgaagtgccgcctgggcgtgggcggcagtgaccccggcggccaccctggggacctggcccccaacagcgaccctgtggagggcgccaccctgctgcctggagaggacatcaccaccgtgggcagcaccccagccagcctggccgtgtctgccaaggaccctgacaagcagcccggcccccagggcggccccaaccccagccaggccggccagcagcagggccagcagaagcagaagaggcacaggacccgcttcaccccagcccagctgaatgagctggagaggagctttgccaagacccactacccagacatcttcatgagggaggagctggccctgagaattggcctgacagagagccgggtgcaggtgtggttccagaacagaagagccaagtggaagaagaggaagaagaccaccaacgtgttccgggcccctggcaccctgctgcccaccccaggcctgccccagttccccagcgctgctgctgctgctgctgctgccatgggagacagcctgtgcagcttccacgccaatgacacccgctgggccgccgccgccatgcctggggtgtcccagctgcccctgcccccagccctgggccggcagcaggccatggcccagagcctgagccagtgcagcctggccgccggccccccacccaacagcatgggcctgagcaacagcctggccggcagcaatggagctggcctgcagagccacctgtaccagcctgccttccctggcatggtgcctgccagcctgcccggccccagcaatgtgtctggcagcccccagctgtgcagcagcccagacagcagtgatgtgtggaggggcaccagcatcgccagcctgcggaggaaggccctggagcacacagtgtccatgtccttcacctag

SEQ ID NO: 162852 - DNA, 912 bp, Artificial Sequence
  Description of Artificial Sequence: Synthetic coding sequence
atgggcatcgtgcagatctgcaagggggagtacttctggctggagcccaagaatgcctttgagaacttccaggagccagacatcggcctggtggccctggccttcctgcagggcagctttgcctacggcggctggaacttcctgaactacgtgacagaggagctggtggacccctacaagaacctgccccgggccatcttcatcagcatccccctggtgacctttgtgtatgtgtttgccaacgtggcctacgtgacagccatgagcccccaggagctgctggccagcaatgctgtggccgtgacctttggagagaagctgctgggcgtgatggcctggatcatgcccatctctgtggccctgagcaccttcggcggcgtgaatggcagcctcttcaccagcagccgcctcttctttgctggggcccgggagggccacctgcccagcgtgctggccatgattcatgtgaagcgctgcacccccatcccagccctgctcttcacctgcatcagcaccctgctgatgctggtgaccagtgacatgtacaccctcatcaactacgtgggcttcatcaactacctgttctacggcgtgacagtggccggccagatcgtgctgcgctggaagaagccagacatcccccggcccatcaagatcaacctgctcttccccatcatctacctgctcttctgggccttcctgctggtgttcagcctgtggagcgagcctgtggtgtgtggcatcggcctggccatcatgctgactggagtgcctgtgtacttcctgggcgtgtactggcagcacaagcccaagtgcttcagtgacttcatcgagctgctgaccctggtgtcccagaagatgtgtgtggtggtgtacccagaggtggagggcctgcgggaccggggcggctag

SEQ ID NO: 162853 - DNA, 861 bp, Artificial Sequence
  Description of Artificial Sequence: Synthetic coding sequence
atggccctggtgctgatcctgcagctgctgaccctgtggcccctgtgccacacagacatcaccccatctgtggccatcatcgtgcccccagccagctaccaccccaagccctggctgggcgcccagcctgccaccgtggtgaccccaggagtgaatgtgaccctgcgctgccgggccccccagcctgcctggaggtttggcctcttcaagccaggagagatcgcccccctgctcttcagagatgtgagcagcgagctggccgagttcttcctggaggaggtgaccccagcccagggcggcatctaccgctgctgctacagaagaccagactggggccctggggtgtggagccagcccagtgatgtgctggagctgctggtgacagaggagctgccccggcccagcctggtggccctgcccggccctgtggtgggccctggggccaacgtgtccctgcgctgtgccggccgcctgaggaacatgagctttgtgctgtaccgggagggcgtggccgcccccctgcagtaccgccacagcgcccagccctgggccgacttcaccctgctgggcgcccgggcccctggcacctacagctgctactaccacaccccatctgccccctacgtgctgagccagaggtctgaggtgctggtgatctcctgggagggggagggccctgaggcccggcctgccagcagcgcccctggcatgcaggcccctggccccccacccagcgaccccggggcccaggcccccagcctgagcagcttccggccccggggcctggtgctgcagcccctgctgccccagacccaggacagctgggaccctgcccccccacccagcgaccccggggtgtag

SEQ ID NO: 162854 - DNA, 849 bp, Artificial Sequence
  Description of Artificial Sequence: Synthetic coding sequence
atggccctggtgctgatcctgcagctgctgaccctgtggcccctgtgccacacagacatcaccccatctgtgcccccagccagctaccaccccaagccctggctgggcgcccagcctgccaccgtggtgaccccaggagtgaatgtgaccctgcgctgccgggccccccagcctgcctggaggtttggcctcttcaagccaggagagatcgcccccctgctcttcagagatgtgagcagcgagctggccgagttcttcctggaggaggtgaccccagcccagggcggcatctaccgctgctgctacagaagaccagactggggccctggggtgtggagccagcccagtgatgtgctggagctgctggtgacagaggagctgccccggcccagcctggtggccctgcccggccctgtggtgggccctggggccaacgtgtccctgcgctgtgccggccgcctgaggaacatgagctttgtgctgtaccgggagggcgtggccgcccccctgcagtaccgccacagcgcccagccctgggccgacttcaccctgctgggcgcccgggcccctggcacctacagctgctactaccacaccccatctgccccctacgtgctgagccagaggtctgaggtgctggtgatctcctgggagggggagggccctgaggcccggcctgccagcagcgcccctggcatgcaggcccctggccccccacccagcgaccccggggcccaggcccccagcctgagcagcttccggccccggggcctggtgctgcagcccctgctgccccagacccaggacagctgggaccctgcccccccacccagcgaccccggggtgtag

SEQ ID NO: 162855 - DNA, 759 bp, Artificial Sequence
  Description of Artificial Sequence: Synthetic coding sequence
atggccctggtgctgatcctgcagctgctgaccctcttccccccagccagctaccaccccaagccctggctgggcgcccagcctgccaccgtggtgaccccaggagtgaatgtgaccctgcgctgccgggccccccagcctgcctggaggtttggcctcttcaagccaggagaaattgcccccctgctcttcagagatgtgtcctctgagctggccgagttcttcctggaggaggtgaccccagcccagggcggcatctaccgctgctgctacagaagaccagactggggccctggggtgtggagccagcccagtgatgtgctggagctgctggtgacagaggagctgccccggcccagcctggtggccctgcccggccctgtggtgggccctggggccaacgtgtccctgcgctgtgccggccgcctgaggaacatgagctttgtgctgtaccgggagggcgtggccgcccccctgcagtaccgccacagcgcccagccctgggccgacttcaccctgctgggcgcccgggcccctggcacctacagctgctactaccacacccccagcgccccctacgtgctgagccagaggtctgaggtgctggtgatctcctgggaggacagcggcagcagtgactacacccggggcaacctggtgcggctgggcctggccggcctggtgctgatcagcctgggcgccctggtgacctttgactggaggagccagaacagagccccagctggcatccggccctag

SEQ ID NO: 162856 - DNA, 804 bp, Artificial Sequence
  Description of Artificial Sequence: Synthetic coding sequence
atggccctggtgctgatcctgcagctgctgaccctgtggcccctgtgccacacagacatcaccccatctgtggccatcatcgtgcccccagccagctaccaccccaagccctggctgggcgcccagcctgccaccgtggtgaccccaggagtgaatgtgaccctgcgctgccgggccccccagcctgcctggaggtttggcctcttcaagccaggagagatcgcccccctgctcttcagagatgtgagcagcgagctggccgagttcttcctggaggaggtgaccccagcccagggcggcatctaccgctgctgctacagaagaccagactggggccctggggtgtggagccagcccagtgatgtgctggagctgctggtgacagaggagctgccccggcccagcctggtggccctgcccggccctgtggtgggccctggggccaacgtgtccctgcgctgtgccggccgcctgaggaacatgagctttgtgctgtaccgggagggcgtggccgcccccctgcagtaccgccacagcgcccagccctgggccgacttcaccctgctgggcgcccgggcccctggcacctacagctgctactaccacaccccatctgccccctacgtgctgagccagaggtctgaggtgctggtgatctcctgggaggacagcggcagcagtgactacacccggggcaacctggtgcggctgggcctggccggcctggtgctgatcagcctgggcgccctggtgacctttgactggaggagccagaacagagccccagctggcatccggccctag

SEQ ID NO: 162857 - DNA, 792 bp, Artificial Sequence
  Description of Artificial Sequence: Synthetic coding sequence
atggccctggtgctgatcctgcagctgctgaccctgtggcccctgtgccacacagacatcaccccatctgtgcccccagccagctaccaccccaagccctggctgggcgcccagcctgccaccgtggtgaccccaggagtgaatgtgaccctgcgctgccgggccccccagcctgcctggaggtttggcctcttcaagccaggagagatcgcccccctgctcttcagagatgtgagcagcgagctggccgagttcttcctggaggaggtgaccccagcccagggcggcatctaccgctgctgctacagaagaccagactggggccctggggtgtggagccagcccagtgatgtgctggagctgctggtgacagaggagctgccccggcccagcctggtggccctgcccggccctgtggtgggccctggggccaacgtgtccctgcgctgtgccggccgcctgaggaacatgagctttgtgctgtaccgggagggcgtggccgcccccctgcagtaccgccacagcgcccagccctgggccgacttcaccctgctgggcgcccgggcccctggcacctacagctgctactaccacaccccatctgccccctacgtgctgagccagaggtctgaggtgctggtgatctcctgggaggacagcggcagcagtgactacacccggggcaacctggtgcggctgggcctggccggcctggtgctgatcagcctgggcgccctggtgacctttgactggaggagccagaacagagccccagctggcatccggccctag

SEQ ID NO: 162858 - DNA, 645 bp, Artificial Sequence
  Description of Artificial Sequence: Synthetic coding sequence
atgagcaagcccccacccaagcctgtgaagccaggccaggtgaaggtgttccgggccctgtacacctttgagcccaggaccccagatgagctgtactttgaggagggggacatcatctacatcacagacatgtctgacaccaactggtggaagggcaccagcaaaggaagaacaggcctcatccccagcaactacgtggccgagcaggccgagagcattgacaaccccctgcacgaggccgccaagaggggcaacctgtcctggctgagagaatgtctggacaacagagtgggcgtgaatggcctggacaaggccggcagcacagccctgtactgggcctgccacggcggccacaaggacatcgtggagatgctgttcacccagcccaacatcgagctgaaccagcagaacaagctgggggacacagccctgcacgccgccgcctggaagggctatgctgacatcgtgcagctgctgctggccaagggggccaggacagacctgagaaatattgagaagaagctggcctttgacatggccaccaatgctgcctgtgccagcctgctgaagaagaagcagggcacagatgctgtgaggaccctgagcaatgctgaggactacctggatgatgaagattctgactag

SEQ ID NO: 162859 - DNA, 897 bp, Artificial Sequence
  Description of Artificial Sequence: Synthetic coding sequence
atgaagaccctgcagagcaccctgctgctgctgctgctggtgcccctcatcaagccagccccacccacccagcaggacagccgcatcatctatgactatggaacagacaactttgaggagagcatcttcagccaggactatgaggacaagtacctggatggcaagaacatcaaggagaaggagaccgtcatcatccccaatgagaagagcctgcagctgcagaaggatgaggccatcacccccctgccccccaagaaggaaaatgatgagatgcccacctgcctgctgtgtgtgtgcctgagcggctctgtgtactgtgaggaggtggacattgatgctgtgccccccctgcccaaggagagcgcctacctgtatgcccgcttcaacaagatcaagaagctgacagccaaggactttgctgacatccccaacctgcggcggctggacttcaccggcaacctgattgaggacattgaagatggcaccttcagcaagctgagcctgctggaggagctgagcctggccgagaaccagctgctgaagctgcctgtgctgccccccaagctgaccctcttcaatgccaagtacaacaagatcaagagccggggcatcaaggccaatgccttcaagaagctgaacaacctgaccttcctgtacctggaccacaatgccctggagagcgtgcccctgaacctgcctgagagcctgcgggtcatccacctgcagttcaacaacatcgccagcatcacagatgacaccttctgcaaggccaatgacaccagctacatccgggacagaattgaggagatccggctggagggcaaccccatcgtgctgggcaagcaccccaacagcttcatctgcctgaagaggctgcccatcggcagctacttctag

SEQ ID NO: 162860 - DNA, 897 bp, Artificial Sequence; identical to SEQ ID NO: 162859
  Description of Artificial Sequence: Synthetic coding sequence

SEQ ID NO: 162861 - DNA, 807 bp, Artificial Sequence
  Description of Artificial Sequence: Synthetic coding sequence
atgctggccaagatcagcaccacctggaagctgttcctgaagctgctgggccctgagatcctgctgagcagcctgaagagccgccacagcttcagccacagccccagccacctgggcctgatgcacagacatgagcacctgctgaggaagaccaccaagaacttcaagacagccaccaccaccctgcagagcaccctgctgctgctgctgctggtgcccctcatcaagccagccccacccacccagcaggacagccgcatcatctatgactatggaacagacaactttgaggagagcatcttcagccaggactatgaggacaagtacctggatggcaagaacatcaaggagaaggagaccgtcatcatccccaatgagaagagcctgcagctgcagaaggatgaggccatcacccccctgccccccaagaaggaaaatgatgagatgcccacctgcctgctgtgtgtgtgcctgagcggctctgtgtactgtgaggaggtggacattgatgctgtgccccccctgcccaaggagagcgcctacctgtatgcccgcttcaacaagatcaagaagctgacagccaaggactttgctgacatccccaacctgcggcggctggacttcaccggcaacctgattgaggacattgaagatggcaccttcagcaagctgagcctgctggaggagctgagcctggccgagaaccagctgctgaagctgcctgtgctgccccccaagctgaccctcttcaatgccaagtacaacaagatcaagagccggggcatcaaggccaatgccttcaagtag

SEQ ID NO: 162862 - DNA, 1842 bp, Artificial Sequence
  Description of Artificial Sequence: Synthetic coding sequence
atggctgctgagaccctgctgagcagcctgctgggcctgctgctgctgggcctgctgctgcctgccagcctgactggaggagtgggcagcctgaacctggaggagctgtctgagatgagatatggaattgagatcctgcccctgcctgtgatgggcggccagagccagagcagtgatgtggtgattgtgagcagcaagtacaagcagagatatgagtgccgcctgcctgctggggccatccacttccagcgggagcgggaggaggagaccccagcctaccagggccctggcatccctgagctgctgagccccatgagagatgccccctgcctgctgaagaccaaggactggtggacctatgagttctgctacggccgccacatccagcagtaccacatggaggacagcgagatcaagggggaggtgctgtacctgggctactaccagagcgcctttgactgggatgatgaaacagccaaggccagcaagcagcaccggctgaagcgctaccacagccagacctatggaaatggcagcaaatgtgacctgaatggccggccccgggaggccgaggtgcgcttcctgtgtgatgaaggagctggcatcagcggggactacatcgacagagtggatgagcccctgagctgcagctatgtgctgaccatccgcaccccccggctgtgcccccaccccctgctgcggcccccacccagcgctgccccccaggccatcctgtgccaccccagcctgcagcctgaggagtacatggcctacgtgcagaggcaggccgtggacagcaagcagtatggagacaagatcatcgaggagctgcaggacctgggcccccaggtgtggagcgagaccaagagcggcgtggccccccagaagatggccggggccagccccaccaaggatgacagcaaggacagcgacttctggaagatgctgaatgaacctgaggaccaggcccctggaggagaggaggtgcctgctgaggagcaggaccccagccctgaggccgctgacagcgccagcggggccccaaatgacttccagaacaacgtgcaggtgaaggtgatccgcagccctgctgacctgatccgcttcatcgaggagctgaagggcggcaccaagaagggcaagcccaacatcggccaggagcagcctgtggatgatgctgctgaggtgccccagcgggagcctgagaaggagcggggggaccctgagcggcagcgggagatggaggaggaggaggatgaagatgaagatgaagatgaagatgaagatgagcggcagctgctgggggagtttgagaaggagctggagggcatcctgctgcccagcgaccgggaccggctgcggtctgaggtgaaggccggcatggagcgggagctggagaacatcatccaggagacagagaaggagctggaccctgatggcctgaagaaggagagcgagcgggaccgggccatgctggccctgaccagcaccctgaacaagctgatcaagaggctggaggagaagcagagccctgagctggtgaagaagcacaagaagaagagggtggtgcccaagaagcccccacccagcccccagcccaccgggaagattgagatcaagatcgtgcggccctgggccgagggcacagaggagggcgcccgctggctgacagatgaggacaccaggaacctgaaggagatcttcttcaacatcctggtgcctggagctgaggaggcccagaaggagcggcagaggcagaaggagctggagagcaactaccgccgggtgtggggcagccctggaggagagggcactggagacctggatgaatttgacttctag

SEQ ID NO: 162863 - DNA, 1959 bp, Artificial Sequence
  Description of Artificial Sequence: Synthetic coding sequence
atggctgctgagaccctgctgagcagcctgctgggcctgctgctgctgggcctgctgctgcctgccagcctgactggaggagtgggcagcctgaacctggaggagctgtctgagatgagatatggaattgagatcctgcccctgcctgtgatgggcggccagagccagagcagtgatgtggtgattgtgagcagcaagtacaagcagagatatgagtgccgcctgcctgctggggccatccacttccagcgggagcgggaggaggagaccccagcctaccagggccctggcatccctgagctgctgagccccatgagagatgccccctgcctgctgaagaccaaggactggtggacctatgagttctgctacggccgccacatccagcagtaccacatggaggacagcgagatcaagggggaggtgctgtacctgggctactaccagagcgcctttgactgggatgatgaaacagccaaggccagcaagcagcaccggctgaagcgctaccacagccagacctatggaaatggcagcaaatgtgacctgaatggccggccccgggaggccgaggtgcgcttcctgtgtgatgaaggagctggcatcagcggggactacatcgacagagtggatgagcccctgagctgcagctatgtgctgaccatccgcaccccccggctgtgcccccaccccctgctgcggcccccacccagcgctgccccccaggccatcctgtgccaccccagcctgcagcctgaggagtacatggcctacgtgcagaggcaggccgacagcaagcagtacggggacaagatcatcgaggagctgcaggacctgggcccccaggtgtggagcgagaccaagtctggagtggccccccagaagatggccggggccagccccaccaaggatgacagcaaggacagcgacttctggaagatgctgaatgaacctgaggaccaggcccctggaggagaggaggtgcctgctgaggagcaggaccccagccctgaggccgctgacagcgccagcggggccccaaatgacttccagaacaacgtgcaggtgaaggtgatccgcagccctgctgacctgatccgcttcatcgaggagctgaagggcggcaccaagaagggcaagcccaacatcggccaggagcagcctgtggatgatgctgctgaggtgccccagcgggagcctgagaaggagcggggggaccctgagcggcagcgggagatggaggaggaggaggatgaagatgaagatgaagatgaagatgaagatgagcggcagctgctgggggagtttgagaaggagctggagggcatcctgctgcccagcgaccgggaccggctgcggagtgaaacagagaaggagctggaccctgatggcctgaagaaggagagcgagcgggaccgggccatgctggccctgaccagcaccctgaacaagctgatcaagaggctggaggagaagcagagccctgagctggtgaagaagcacaagaagaagagggtggtgcccaagaagcccccacccagcccccagcccacagaggaggaccctgagcaccgggtgcgggtgcgggtgaccaagctgcggctgggcggccccaaccaggacctgactgtgctggagatgaagcgggagaacccccagctgaagcagatcgagggcctggtgaaggagctgctggagcgggagggcctgacagctgctgggaagattgagatcaagatcgtgcggccctgggccgagggcacagaggagggcgcccgctggctgacagatgaggacaccaggaacctgaaggagatcttcttcaacatcctggtgcctggagctgaggaggcccagaaggagcggcagaggcagaaggagctggagagcaactacagaagagtgtggggcagccctggaggagagggcaccggggacctggatgaatttgacttctag

SEQ ID NO: 162864 - DNA, 1683 bp, Artificial Sequence
  Description of Artificial Sequence: Synthetic coding sequence
atggctgctgagaccctgctgagcagcctgctgggcctgctgctgctgggcctgctgctgcctgccagcctgactggaggagtgggcagcctgaacctggaggagctgtctgagatgagatatggaattgagatcctgcccctgcctgtgatgggcggccagagccagagcagtgatgtggtgattgtgagcagcaagtacaagcagagatatgagtgccgcctgcctgctggggccatccacttccagcgggagcgggaggaggagaccccagcctaccagggccctggcatccctgagctgctgagccccatgagagatgccccctgcctgctgaagaccaaggactggtggacctatgagttctgctacggccgccacatccagcagtaccacatggaggacagcgagatcaagggggagttcctgtgtgatgaaggagctggcatcagcggggactacatcgacagagtggatgagcccctgagctgcagctatgtgctgaccatccgcaccccccggctgtgcccccaccccctgctgcggcccccacccagcgctgccccccaggccatcctgtgccaccccagcctgcagcctgaggagtacatggcctacgtgcagaggcaggccgacagcaagcagtacggggacaagatcatcgaggagctgcaggacctgggcccccaggtgtggagcgagaccaagtctggagtggccccccagaagatggccggggccagccccaccaaggatgacagcaaggacagcgacttctggaagatgctgaatgaacctgaggaccaggcccctggaggagaggaggtgcctgctgaggagcaggaccccagccctgaggccgctgacagcgccagcggggccccaaatgacttccagaacaacgtgcaggtgaaggtgatccgcagccctgctgacctgatccgcttcatcgaggagctgaagggcggcaccaagaagggcaagcccaacatcggccaggagcagcctgtggatgatgctgctgaggtgccccagcgggagcctgagaaggagcggggggaccctgagcggcagcgggagatggaggaggaggaggatgaagatgaagatgaagatgaagatgaagatgagcggcagctgctgggggagtttgagaaggagctggagggcatcctgctgcccagcgaccgggaccggctgcggtctgaggtgaaggccggcatggagcgggagctggagaacatcatccaggagacagagaaggagctggaccctgatggcctgaagaaggagagcgagcgggaccgggccatgctggccctgaccagcaccctgaacaagctgatcaagaggctggaggagaagcagagccctgagctggtgaagaagcacaagaagaagagggtggtgcccaagaagcccccacccagcccccagcccaccgggaagattgagatcaagatcgtgcggccctgggccgagggcacagaggagggcgcccgctggctgacagatgaggacaccaggaacctgaaggagatcttcttcaacatcctggtgcctggagctgaggaggcccagaaggagcggcagaggcagaaggagctggagagcaactacagaagagtgtggggcagccctggaggagagggcaccggggacctggatgaatttgacttctag

SEQ ID NO: 162865 - DNA, 1743 bp, Artificial Sequence
  Description of Artificial Sequence: Synthetic coding sequence
atggctgctgagaccctgctgagcagcctgctgggcctgctgctgctgggcctgctgctgcctgccagcctgactggaggagtgggcagcctgaacctggaggagctgtctgagatgagatatggaattgagatcctgcccctgcctgtgatgggcggccagagccagagcagtgatgtggtgattgtgagcagcaagtacaagcagagatatgagtgccgcctgcctgctggggccatccacttccagcgggagcgggaggaggagaccccagcctaccagggccctggcatccctgagctgctgagccccatgagagatgccccctgcctgctgaagaccaaggactggtggacctatgagttctgctacggccgccacatccagcagtaccacatggaggacagcgagatcaagggggaggtgctgtacctgggctactaccagagcgcctttgactgggatgatgaaacagccaagttcctgtgtgatgagggcgccggcatcagcggggactacatcgacagagtggatgagcccctgagctgcagctatgtgctgaccatccgcaccccccggctgtgcccccaccccctgctgcggcccccaccttctgctgccccccaggccatcctgtgccaccccagcctgcagcctgaggagtacatggcctacgtgcagaggcaggccgtggacagcaagcagtacggggacaagatcatcgaggagctgcaggacctgggcccccaggtgtggagcgagaccaagtctggagtggccccccagaagatggccggggccagccccaccaaggatgacagcaaggacagcgacttctggaagatgctgaatgaacctgaggaccaggcccctggaggagaggaggtgcctgctgaggagcaggaccccagccctgaggccgctgacagcgccagcggggccccaaatgacttccagaacaacgtgcaggtgaaggtgatccgcagccctgctgacctgatccgcttcatcgaggagctgaagggcggcaccaagaagggcaagcccaacatcggccaggagcagcctgtggatgatgctgctgaggtgccccagcgggagcctgagaaggagcggggggaccctgagcggcagcgggagatggaggaggaggaggatgaagatgaagatgaagatgaagatgaagatgagcggcagctgctgggggagtttgagaaggagctggagggcatcctgctgcccagcgaccgggaccggctgcggtctgaggtgaaggccggcatggagcgggagctggagaacatcatccaggagacagagaaggagctggaccctgatggcctgaagaaggagagcgagcgggaccgggccatgctggccctgaccagcaccctgaacaagctgatcaagaggctggaggagaagcagagccctgagctggtgaagaagcacaagaagaagagggtggtgcccaagaagcccccacccagcccccagcccaccgggaagattgagatcaagatcgtgcggccctgggccgagggcacagaggagggcgcccgctggctgacagatgaggacaccaggaacctgaaggagatcttcttcaacatcctggtgcctggagctgaggaggcccagaaggagcggcagaggcagaaggagctggagagcaactacagaagagtgtggggcagccctggaggagagggcaccggggacctggatgaatttgacttctag

SEQ ID NO: 162866 - DNA, 2004 bp, Artificial Sequence
  Description of Artificial Sequence: Synthetic coding sequence
atggctgctgagaccctgctgagcagcctgctgggcctgctgctgctgggcctgctgctgcctgccagcctgactggaggagtgggcagcctgaacctggaggagctgtctgagatgagatatggaattgagatcctgcccctgcctgtgatgggcggccagagccagagcagtgatgtggtgattgtgagcagcaagtacaagcagagatatgagtgccgcctgcctgctggggccatccacttccagcgggagcgggaggaggagaccccagcctaccagggccctggcatccctgagctgctgagccccatgagagatgccccctgcctgctgaagaccaaggactggtggacctatgagttctgctacggccgccacatccagcagtaccacatggaggacagcgagatcaagggggaggtgctgtacctgggctactaccagagcgcctttgactgggatgatgaaacagccaaggccagcaagcagcaccggctgaagcgctaccacagccagacctatggaaatggcagcaaatgtgacctgaatggccggccccgggaggccgaggtgcgcttcctgtgtgatgaaggagctggcatcagcggggactacatcgacagagtggatgagcccctgagctgcagctatgtgctgaccatccgcaccccccggctgtgcccccaccccctgctgcggcccccacccagcgctgccccccaggccatcctgtgccaccccagcctgcagcctgaggagtacatggcctacgtgcagaggcaggccgacagcaagcagtacggggacaagatcatcgaggagctgcaggacctgggcccccaggtgtggagcgagaccaagtctggagtggccccccagaagatggccggggccagccccaccaaggatgacagcaaggacagcgacttctggaagatgctgaatgaacctgaggaccaggcccctggaggagaggaggtgcctgctgaggagcaggaccccagccctgaggccgctgacagcgccagcggggccccaaatgacttccagaacaacgtgcaggtgaaggtgatccgcagccctgctgacctgatccgcttcatcgaggagctgaagggcggcaccaagaagggcaagcccaacatcggccaggagcagcctgtggatgatgctgctgaggtgccccagcgggagcctgagaaggagcggggggaccctgagcggcagcgggagatggaggaggaggaggatgaagatgaagatgaagatgaagatgaagatgagcggcagctgctgggggagtttgagaaggagctggagggcatcctgctgcccagcgaccgggaccggctgcggtctgaggtgaaggccggcatggagcgggagctggagaacatcatccaggagacagagaaggagctggaccctgatggcctgaagaaggagagcgagcgggaccgggccatgctggccctgaccagcaccctgaacaagctgatcaagaggctggaggagaagcagagccctgagctggtgaagaagcacaagaagaagagggtggtgcccaagaagcccccacccagcccccagcccacagaagaagatcctgagcaccgggtgcgggtgcgggtgaccaagctgcggctgggcggccccaaccaggacctgactgtgctggagatgaagcgggagaacccccagctgaagcagatcgagggcctggtgaaggagctgctggagcgggagggcctgacagctgctgggaagattgagatcaagatcgtgcggccctgggccgagggcacagaggagggcgcccgctggctgacagatgaggacaccaggaacctgaaggagatcttcttcaacatcctggtgcctggagctgaggaggcccagaaggagcggcagaggcagaaggagctggagagcaactaccgccgggtgtggggcagccctggaggagagggcactggagacctggatgaatttgacttctag

SEQ ID NO: 162867 - DNA, 1794 bp, Artificial Sequence
  Description of Artificial Sequence: Synthetic coding sequence
atggctgctgagaccctgctgagcagcctgctgggcctgctgctgctgggcctgctgctgcctgccagcctgactggaggagtgggcagcctgaacctggaggagctgtctgagatgagatatggaattgagatcctgcccctgcctgtgatgggcggccagagccagagcagtgatgtggtgattgtgagcagcaagtacaagcagagatatgagtgccgcctgcctgctggggccatccacttccagcgggagcgggaggaggagaccccagcctaccagggccctggcatccctgagctgctgagccccatgagagatgccccctgcctgctgaagaccaaggactggtggacctatgagttctgctacggccgccacatccagcagtaccacatggaggacagcgagatcaagggggaggtgctgtacctgggctactaccagagcgcctttgactgggatgatgaaacagccaaggccagcaagcagcaccggctgaagcgctaccacagccagacctatggaaatggcagcaaatgtgacctgaatggccggccccgggaggccgaggtgcgcttcctgtgtgatgaaggagctggcatcagcggggactacatcgacagagtggatgagcccctgagctgcagctatgtgctgaccatccgcaccccccggctgtgcccccaccccctgctgcggcccccacccagcgctgccccccaggccatcctgtgccaccccagcctgcagcctgaggagtacatggcctacgtgcagaggcaggccgacagcaagcagtacggggacaagatcatcgaggagctgcaggacctgggcccccaggtgtggagcgagaccaagtctggagtggccccccagaagatggccggggccagccccaccaaggatgacagcaaggacagcgacttctggaagatgctgaatgaacctgaggaccaggcccctggaggagaggaggtgcctgctgaggagcaggaccccagccctgaggccgctgacagcgccagcggggccccaaatgacttccagaacaacgtgcaggtgaaggtgatccgcagccctgctgacctgatccgcttcatcgaggagctgaagggcggcaccaagaagggcaagcccaacatcggccaggagcagcctgtggatgatgctgctgaggtgccccagcgggagcctgagaaggagcggggggaccctgagcggcagcgggagatggaggaggaggaggatgaagatgaagatgaagatgaagatgaagatgagcggcagctgctgggggagtttgagaaggagctggagggcatcctgctgcccagcgaccgggaccggctgcggagtgaaacagagaaggagctggaccctgatggcctgaagaaggagagcgagcgggaccgggccatgctggccctgaccagcaccctgaacaagctgatcaagaggctggaggagaagcagagccctgagctggtgaagaagcacaagaagaagagggtggtgcccaagaagcccccacccagcccccagcccaccgggaagattgagatcaagatcgtgcggccctgggccgagggcacagaggagggcgcccgctggctgacagatgaggacaccaggaacctgaaggagatcttcttcaacatcctggtgcctggagctgaggaggcccagaaggagcggcagaggcagaaggagctggagagcaactaccgccgggtgtggggcagccctggaggagagggcactggagacctggatgaatttgacttctag

SEQ ID NO: 162868 - DNA, 1839 bp, Artificial Sequence
  Description of Artificial Sequence: Synthetic coding sequence
atggctgctgagaccctgctgagcagcctgctgggcctgctgctgctgggcctgctgctgcctgccagcctgactggaggagtgggcagcctgaacctggaggagctgtctgagatgagatatggaattgagatcctgcccctgcctgtgatgggcggccagagccagagcagtgatgtggtgattgtgagcagcaagtacaagcagagatatgagtgccgcctgcctgctggggccatccacttccagcgggagcgggaggaggagaccccagcctaccagggccctggcatccctgagctgctgagccccatgagagatgccccctgcctgctgaagaccaaggactggtggacctatgagttctgctacggccgccacatccagcagtaccacatggaggacagcgagatcaagggggaggtgctgtacctgggctactaccagagcgcctttgactgggatgatgaaacagccaaggccagcaagcagcaccggctgaagcgctaccacagccagacctatggaaatggcagcaaatgtgacctgaatggccggccccgggaggccgaggtgcgcttcctgtgtgatgaaggagctggcatcagcggggactacatcgacagagtggatgagcccctgagctgcagctatgtgctgaccatccgcaccccccggctgtgcccccaccccctgctgcggcccccacccagcgctgccccccaggccatcctgtgccaccccagcctgcagcctgaggagtacatggcctacgtgcagaggcaggccgacagcaagcagtacggggacaagatcatcgaggagctgcaggacctgggcccccaggtgtggagcgagaccaagtctggagtggccccccagaagatggccggggccagccccaccaaggatgacagcaaggacagcgacttctggaagatgctgaatgaacctgaggaccaggcccctggaggagaggaggtgcctgctgaggagcaggaccccagccctgaggccgctgacagcgccagcggggccccaaatgacttccagaacaacgtgcaggtgaaggtgatccgcagccctgctgacctgatccgcttcatcgaggagctgaagggcggcaccaagaagggcaagcccaacatcggccaggagcagcctgtggatgatgctgctgaggtgccccagcgggagcctgagaaggagcggggggaccctgagcggcagcgggagatggaggaggaggaggatgaagatgaagatgaagatgaagatgaagatgagcggcagctgctgggggagtttgagaaggagctggagggcatcctgctgcccagcgaccgggaccggctgcggtctgaggtgaaggccggcatggagcgggagctggagaacatcatccaggagacagagaaggagctggaccctgatggcctgaagaaggagagcgagcgggaccgggccatgctggccctgaccagcaccctgaacaagctgatcaagaggctggaggagaagcagagccctgagctggtgaagaagcacaagaagaagagggtggtgcccaagaagcccccacccagcccccagcccaccgggaagattgagatcaagatcgtgcggccctgggccgagggcacagaggagggcgcccgctggctgacagatgaggacaccaggaacctgaaggagatcttcttcaacatcctggtgcctggagctgaggaggcccagaaggagcggcagaggcagaaggagctggagagcaactacagaagagtgtggggcagccctggaggagagggcaccggggacctggatgaatttgacttctag

SEQ ID NO: 162869 - DNA, 3462 bp, Artificial Sequence
  Description of Artificial Sequence: Synthetic coding sequence
atgagccaggagcccaccacctacagcctcttcctgttcctgttcctgagccacggcgtgagcagctacacagtgcccaacagccggcaggacctgcaccccctgctgcagaacatggccgaggagatcattgatggcagctacctgaatgccctgctggacctgatccagttccagagcagccacgtgtggacagatgacctgagccaccgggtgctggcctacctgaacagcagaaatgtggccttcaccatccccagcctgcaggccgctgtggagaaccacctggagcagaggctgcaccagccccagaagctgctggaggacctgaggaagacagatgcccagcagttcagaacagccatgaagtgcctgctggaggacaagaaggatggcctggacctgaaggacatcatcatcgacctgggggagatccgggagcgggccctgcagagccctggggtgaacagaagcctcttcctgatcaccctggagcgctgcttccagatgctgaacagcctggagtgtgtggagatcctgggcaaggtgctgcggggcagcagcggcagcttcctgcagcctgacatcacagagcggctgccccgggacctgcgggaggatgccttcaagaacctgtctgctgtgttcaaggacctgtatgacaagaccagcgcccacagccagagggccctgtacagctggatgacaggcatcctgcagaccagcagcaatgccacagatgattctgcctcctgggtgtctgctgagcacctgtgggtgctgggccgctacatggtgcacctgagctttgaggagatcaccaagatcagccccattgaaattggcctcttcatctcctatgacaatgccaccaagcagctggacatggtgtatgacatcaccccagagctggcccaggccttcctggagcgcatcagcagcagcaacttcaacatgaggaacaccagcaccatccaccggcaggcccacgagctgtgggccctggagcccttccccaagatgctgggcctgctggtgtgcttctacaatgacctggagctgctggatgccaccgtggcccaggtgctgctgtaccagatgatcaagtgcagccacctgcggggcttccaggccggcgtgcagaagctgaaggccgagctgctggacatcgccatggagaaccagaccctgaatgagaccctgggcagcctgagtgatgctgtggtgggcctgacctacagccagctggagagcctgagccctgaggccgtgcatggagccatcagcaccctgaaccaggtgtctggctgggccaagagccaggtgatcatcctgagcgccaagtacctggcccacgagaaggtgctgtccttctacaacgtgtcccagatgggcgccctgctggccggcgtgtccacccaggccttctgcagcatgaagaggaaggacatcagccaggtgctgcggtctgctgtgtcccagtatgtgtctgacctgagccctgcccagcagcagggcatcctgagcaagatggtgcaggccgaggacacagcccctggcatcgtggagatccagggcgccttcttcaaggaggtgtccctgtttgacctgcggcggcagcccggcttcaacagcacagtgctgaaggacaaggagctgggccgcagccaggccctcttcctgtatgagctgctgctgaagaccacccggcggcctgaggagctgctgtctgctggccagctggtgaagggcgtgacctgcagccacattgatgccatgagcacagacttcttcctggcccacttccaggacttccagaacaactttgccctgctgagcccctaccaggtgaactgcctggcctggaagtactgggaggtgtcccggctgtccatgccacccttcctgctggccgccctgcctgcccgctacctggcctctgtgcctgccagccagtgtgtgcccttcctgatcagcctgggcaagtcctggctggacagcctggtgctggacagccacaagaagacctctgtgctgaggaaggtgcagcagtgcctggatgacagcattgctgatgagtacacagtggacatcatgggcaacctgctgtgccacctgcctgctgccatcatcgaccggggcatcagcccccgggcctgggccacagccctgcacggcctgcgggactgcccagacctgaaccctgagcagaaggctgctgtgcggctgaagctgctgggccagtatggcctgccccagcactggacagctgagaccaccaaggacctgggccccttcctggtgctcttctctggagatgagctgagcagcatcgccaccaagtttcctgagatcctgctgcaggccgccagcaagatggcccggaccctgcccaccaaggagttcctgtgggccgtgttccagagcgtgaggaacagcagtgacaagatccccagctatgaccccatgcctggctgccacggcgtggtggcccccagcagtgatgacatcttcaagctggccgaggccaatgcctgctgggccctggaggacctgcgctgcatggaggaggacaccttcatcagaacagtggagctgctgggcgctgtgcagggcttcagccggccccagctgatgaccctgaaggagaaggccatccaggtgtgggacatgcccagctactggagggagcaccacatcgtgtccctgggccgcatcgccctggccctgaatgaaagtgagctggagcagctggacctgagcagcattgacacagtggccagcctgtcctggcagacagagtggaccccaggccaggccgagagcatcctgcagggctacctggatgattctggctacagcatccaggacctgaagagcttccacctggtgggcctgggcgccaccctgtgtgccatcaacatcacagagatccccctcatcaagatcagcgagttccgggtggtggtggccagaattggcaccctgctgtgcagcacccacgtgctggccgagttcaagaggaaggccgaggtggtgtttggagaccccacagagtggaccagctctgtgctgcaggagctgggcaccatcgctgctggcctgaccaaggccgagctgaggatgctggacaaggacctgatgccctacttccagcccagcgccatcaagtgcctgcctgatgagatcttcaaggagctgtctgctgagcagatcgccagcctgggcccagaaaatgctgctgctgtgacccacgcccagaggcggcggctgagccccctgcagctgcagagcctgcagcaggccctggatggagccaagacccacagctggcaggatgccccagccagcgctggccccaccaggaccagcagcagccgcagccctgctggggccctgcagagctggggcctgtggctgggctgccccctgctggtgctgatggccaagctgctgtggtag

SEQ ID NO: 162870 - DNA, 1647 bp, Artificial Sequence
  Description of Artificial Sequence: Synthetic coding sequence
cccagggctgtgtgggtggaggcccggggcggggcccagcaccccaccatgagaagaacagcccccctgcaccggggcacctggagcaagatgagcatcatcctgcgggcccgctacctggcctctgtgcctgccagccagtgtgtgcccttcctgatcagcctgggcaagtcctggctggacagcctggtgctggacagccacaagaagacctctgtgctgaggaaggtgcagcagtgcctggatgacagcattgctgatgagtacacagtggacatcatgggcaacctgctgtgccacctgcctgctgccatcatcgaccggggcatcagcccccgggcctgggccacagccctgcacggcctgcgggactgcccagacctgaaccctgagcagaaggctgctgtgcggctgaagctgctgggccagtatggcctgccccagcactggacagctgagaccaccaaggacctgggccccttcctggtgctcttctctggagatgagctgagcagcatcgccaccaagtttcctgagatcctgctgcaggccgccagcaagatggcccggaccctgcccaccaaggagttcctgtgggccgtgttccagagcgtgaggaacagcagtgacaagatccccagctatgaccccatgcctggctgccacggcgtggtggcccccagcagtgatgacatcttcaagctggccgaggccaatgcctgctgggccctggaggacctgcgctgcatggaggaggacaccttcatcagaacagtggagctgctgggcgctgtgcagggcttcagccggccccagctgatgaccctgaaggagaaggccatccaggtgtgggacatgcccagctactggagggagcaccacatcgtgtccctgggcagaattgccctggccctgaatgaaagtgagctggagcagctggacctgagcagcattgacacagtggccagcctgtcctggcagacagagtggaccccaggccaggccgagagcatcctgcagggctacctggatgacagcggctacagcatccaggacctgaagagcttccacctggtgggcctgggcgccaccctgtgtgccatcaacatcacagagatccccctcatcaagatcagcgagttccgggtggtggtggcccgcatcggcaccctgctgtgcagcacccacgtgctggccgagttcaagaggaaggccgaggtggtgtttggagaccccacagagtggaccagctctgtgctgcaggagctgggcaccatcgccgccggcctgaccaaggccgagctgaggatgctggacaaggacctgatgccctacttccagcccagcgccatcaagtgcctgcctgatgagatcttcaaggagctgtctgctgagcagatcgccagcctgggcccagaaaatgctgctgctgtgacccacgcccagaggcggcggctgagccccctgcagctgcagagcctgcagcaggccctggatggagccaagacccacagctggcaggatgccccagccagcgctggccccaccaggaccagcagcagccgcagccctgctggggccctgcagagctggggcctgtggctgggctgccccctgctggtgctgatggccaagctgctgtggtag

SEQ ID NO: 162871 - DNA, 3183 bp, Artificial Sequence
  Description of Artificial Sequence: Synthetic coding sequence
atgggcaacagcatcacctacagagaccaggccgctgtggagaaccacctggagcagaggctgcaccagccccagaagctgctggaggacctgaggaagacagatgcccagcagttcagaacagccatgaagtgcctgctggaggacaagaaggatggcctggacctgaaggacatcatcatcgacctgggggagatccgggagcgggccctgcagagccctggggtgaacagaagcctcttcctgatcaccctggagcgctgcttccagatgctgaacagcctggagtgtgtggagatcctgggcaaggtgctgcggggcagcagcggcagcttcctgcagcctgacatcacagagcggctgccccgggacctgagagaagatgccttcaagaacctgtctgctgtgttcaaggacctgtatgacaagaccagcgcccacagccagagggccctgtacagctggatgacaggcatcctgcagaccagcagcaatgccacagatgacagcgcctcctgggtgtctgctgagcacctgtgggtgctgggccgctacatggtgcacctgagctttgaggagatcaccaagatcagccccatcgagatcggcctcttcatctcctatgacaatgccaccaagcagctggacatggtgtatgacatcaccccagagctggcccaggccttcctggagcgcatcagcagcagcaacttcaacatgaggaacaccagcaccatccaccggctgggcctgctggtgtgcttctacaatgacctggagctgctggatgccaccgtggcccaggtgctgctgtaccagatgatcaagtgcagccacctgcggggcttccaggccggcgtgcagaagctgaaggccgagctgctggacatcgccatggagaaccagaccctgaatgagaccctgggcagcctgagtgatgctgtggtgggcctgacctacagccagctggagagcctgagccctgaggccgtgcacggggccatcagcaccctgaaccaggtgtctggctgggccaagagccaggtgatcatcctgagcgccaagtacctggcccacgagaaggtgctgtccttctacaacgtgtcccagatgggcgccctgctggccggcgtgtccacccaggccttctgcagcatgaagaggaaggacatcagccaggtgctgcggtctgctgtgtcccagtatgtgtctgacctgagccctgcccagcagcagggcatcctgagcaagatggtgcaggccgaggacacagcccctggcatcgtggagatccagggcgccttcttcaaggaggtgtccctgtttgacctgcggcggcagcccggcttcaacagcacagtgctgaaggacaaggagctgggccgcagccaggccctcttcctgtatgagctgctgctgaagaccaccaggaggcctgaggagctgctgtctgctggccagctggtgaagggcgtgacctgcagccacattgatgccatgagcacagacttcttcctggcccacttccaggacttccagaacaactttgccctgctgagcccctaccaggtgaactgcctggcctggaagtactgggaggtgtcccggctgtccatgccacccttcctgctggccgccctgcctgcccgctacctggcctctgtgcctgccagccagtgtgtgcccttcctgatcagcctgggcaagtcctggctggacagcctggtgctggacagccacaagaagacctctgtgctgaggaaggtgcagcagtgcctggatgacagcattgctgatgagtacacagtggacatcatgggcaacctgctgtgccacctgcctgctgccatcatcgaccggggcatcagcccccgggcctgggccacagccctgcacggcctgcgggactgcccagacctgaaccctgagcagaaggctgctgtgcggctgaagctgctgggccagtatggcctgccccagcactggacagctgagaccaccaaggacctgggccccttcctggtgctcttctctggagatgagctgagcagcatcgccaccaagtttcctgagatcctgctgcaggccgccagcaagatggcccggaccctgcccaccaaggagttcctgtgggccgtgttccagagcgtgaggaacagcagtgacaagatccccagctatgaccccatgcctggctgccacggcgtggtggcccccagcagtgatgacatcttcaagctggccgaggccaatgcctgctgggccctggaggacctgcgctgcatggaggaggacaccttcatcagaacagtggagctgctgggcgctgtgcagggcttcagccggccccagctgatgaccctgaaggagaaggccatccaggtgtgggacatgcccagctactggagggagcaccacatcgtgtccctgggcagaattgccctggccctgaatgaaagtgagctggagcagctggacctgagcagcattgacacagtggccagcctgtcctggcagacagagtggaccccaggccaggccgagagcatcctgcagggctacctggatgacagcggctacagcatccaggacctgaagagcttccacctggtgggcctgggcgccaccctgtgtgccatcaacatcacagagatccccctcatcaagatcagcgagttccgggtggtggtggcccgcatcggcaccctgctgtgcagcacccacgtgctggccgagttcaagaggaaggccgaggtggtgtttggagaccccacagagtggaccagctctgtgctgcaggagctgggcaccatcgccgccggcctgaccaaggccgagctgaggatgctggacaaggacctgatgccctacttccagcccagcgccatcaagtgcctgcctgatgagatcttcaaggagctgtctgctgagcagatcgccagcctgggcccagaaaatgctgctgctgtgacccacgcccagaggcggcggctgagccccctgcagctgcagagcctgcagcaggccctggatggagccaagacccacagctggcaggatgccccagccagcgctggccccaccaggaccagcagcagccgcagccctgctggggccctgcagagctggggcctgtggctgggctgccccctgctggtgctgatggccaagctgctgtggtag

SEQ ID NO: 162872 - DNA, 2448 bp, Artificial Sequence
  Description of Artificial Sequence: Synthetic coding sequence
atgttccggctgggcctgctggtgtgcttctacaatgacctggagctgctggatgccaccgtggcccaggtgctgctgtaccagatgatcaagtgcagccacctgcggggcttccaggccggcgtgcagaagctgaaggccgagctgctggacatcgccatggagaaccagaccctgaatgagaccctgggcagcctgagtgatgctgtggtgggcctgacctacagccagctggagagcctgagccctgaggccgtgcatggagccatcagcaccctgaaccaggtgtctggctgggccaagagccaggtgatcatcctgagcgccaagtacctggcccacgagaaggtgctgtccttctacaacgtgtcccagatgggcgccctgctggccggcgtgtccacccaggccttctgcagcatgaagaggaaggacatcagccaggtgctgcggtctgctgtgtcccagtatgtgtctgacctgagccctgcccagcagcagggcatcctgagcaagatggtgcaggccgaggacacagcccctggcatcgtggagatccagggcgccttcttcaaggaggtgtccctgtttgacctgcggcggcagcccggcttcaacagcacagtgctgaaggacaaggagctgggccgcagccaggccctcttcctgtatgagctgctgctgaagaccacccggcggcctgaggagctgctgtctgctggccagctggtgaagggcgtgacctgcagccacattgatgccatgagcacagacttcttcctggcccacttccaggacttccagaacaactttgccctgctgagcccctaccaggtgaactgcctggcctggaagtactgggaggtgtcccggctgtccatgccacccttcctgctggccgccctgcctgcccgctacctggcctctgtgcctgccagccagtgtgtgcccttcctgatcagcctgggcaagtcctggctggacagcctggtgctggacagccacaagaagacctctgtgctgaggaaggtgcagcagtgcctggatgacagcattgctgatgagtacacagtggacatcatgggcaacctgctgtgccacctgcctgctgccatcatcgaccggggcatcagcccccgggcctgggccacagccctgcacggcctgcgggactgcccagacctgaaccctgagcagaaggctgctgtgcggctgaagctgctgggccagtatggcctgccccagcactggacagctgagaccaccaaggacctgggccccttcctggtgctcttctctggagatgagctgagcagcatcgccaccaagtttcctgagatcctgctgcaggccgccagcaagatggcccggaccctgcccaccaaggagttcctgtgggccgtgttccagagcgtgaggaacagcagtgacaagatccccagctatgaccccatgcctggctgccacggcgtggtggcccccagcagtgatgacatcttcaagctggccgaggccaatgcctgctgggccctggaggacctgcgctgcatggaggaggacaccttcatcagaacagtggagctgctgggcgctgtgcagggcttcagccggccccagctgatgaccctgaaggagaaggccatccaggtgtgggacatgcccagctactggagggagcaccacatcgtgtccctgggccgcatcgccctggccctgaatgaaagtgagctggagcagctggacctgagcagcattgacacagtggccagcctgtcctggcagacagagtggaccccaggccaggccgagagcatcctgcagggctacctggatgattctggctacagcatccaggacctgaagagcttccacctggtgggcctgggcgccaccctgtgtgccatcaacatcacagagatccccctcatcaagatcagcgagttccgggtggtggtggccagaattggcaccctgctgtgcagcacccacgtgctggccgagttcaagaggaaggccgaggtggtgtttggagaccccacagagtggaccagctctgtgctgcaggagctgggcaccatcgctgctggcctgaccaaggccgagctgaggatgctggacaaggacctgatgccctacttccagcccagcgccatcaagtgcctgcctgatgagatcttcaaggagctgtctgctgagcagatcgccagcctgggcccagaaaatgctgctgctgtgacccacgcccagaggcggcggctgagccccctgcagctgcagagcctgcagcaggccctggatggagccaagacccacagctggcaggatgccccagccagcgctggccccaccaggaccagcagcagccgcagccctgctggggccctgcagagctggggcctgtggctgggctgccccctgctggtgctgatggccaagctgctgtggtag

SEQ ID NO: 162873 - DNA, 3420 bp, Artificial Sequence
  Description of Artificial Sequence: Synthetic coding sequence
atgagccaggagcccaccacctacagcctcttcctgttcctgttcctgagccacggcgtgagcagctacacagtgcccaacagccggcaggacctgcaccccctgctgcagaacatggccgaggagatcattgatggcagctacctgaatgccctgctggacctgatccagttccagagcagccacgtgtggacagatgacctgagccaccgggtgctggcctacctgaacagcagaaatgtggccttcaccatccccagcctgcaggccgctgtggagaaccacctggagcagaggctgcaccagccccagaagctgctggaggacctgaggaagacagatgcccagcagttcagaacagccatgaagtgcctgctggaggacaagaaggatggcctggacctgaaggacatcatcatcgacctgggggagatccgggagcgggccctgcagagccctggggtgaacagaagcctcttcctgatcaccctggagcgctgcttccagatgctgaacagcctggagtgtgtggagatcctgggcaaggtgctgcggggcagcagcggcagcttcctgcagcctgacatcacagagcggctgccccgggacctgcgggaggatgccttcaagaacctgtctgctgtgttcaaggacctgtatgacaagaccagcgcccacagccagagggccctgtacagctggatgacaggcatcctgcagaccagcagcaatgccacagatgattctgcctcctgggtgtctgctgagcacctgtgggtgctgggccgctacatggtgcacctgagctttgaggagatcaccaagatcagccccattgaaattggcctcttcatctcctatgacaatgccaccaagcagctggacatggtgtatgacatcaccccagagctggcccaggccttcctggagcgcatcagcagcagcaacttcaacatgaggaacaccagcaccatccaccggctgggcctgctggtgtgcttctacaatgacctggagctgctggatgccaccgtggcccaggtgctgctgtaccagatgatcaagtgcagccacctgcggggcttccaggccggcgtgcagaagctgaaggccgagctgctggacatcgccatggagaaccagaccctgaatgagaccctgggcagcctgagtgatgctgtggtgggcctgacctacagccagctggagagcctgagccctgaggccgtgcatggagccatcagcaccctgaaccaggtgtctggctgggccaagagccaggtgatcatcctgagcgccaagtacctggcccacgagaaggtgctgtccttctacaacgtgtcccagatgggcgccctgctggccggcgtgtccacccaggccttctgcagcatgaagaggaaggacatcagccaggtgctgcggtctgctgtgtcccagtatgtgtctgacctgagccctgcccagcagcagggcatcctgagcaagatggtgcaggccgaggacacagcccctggcatcgtggagatccagggcgccttcttcaaggaggtgtccctgtttgacctgcggcggcagcccggcttcaacagcacagtgctgaaggacaaggagctgggccgcagccaggccctcttcctgtatgagctgctgctgaagaccacccggcggcctgaggagctgctgtctgctggccagctggtgaagggcgtgacctgcagccacattgatgccatgagcacagacttcttcctggcccacttccaggacttccagaacaactttgccctgctgagcccctaccaggtgaactgcctggcctggaagtactgggaggtgtcccggctgtccatgccacccttcctgctggccgccctgcctgcccgctacctggcctctgtgcctgccagccagtgtgtgcccttcctgatcagcctgggcaagtcctggctggacagcctggtgctggacagccacaagaagacctctgtgctgaggaaggtgcagcagtgcctggatgacagcattgctgatgagtacacagtggacatcatgggcaacctgctgtgccacctgcctgctgccatcatcgaccggggcatcagcccccgggcctgggccacagccctgcacggcctgcgggactgcccagacctgaaccctgagcagaaggctgctgtgcggctgaagctgctgggccagtatggcctgccccagcactggacagctgagaccaccaaggacctgggccccttcctggtgctcttctctggagatgagctgagcagcatcgccaccaagtttcctgagatcctgctgcaggccgccagcaagatggcccggaccctgcccaccaaggagttcctgtgggccgtgttccagagcgtgaggaacagcagtgacaagatccccagctatgaccccatgcctggctgccacggcgtggtggcccccagcagtgatgacatcttcaagctggccgaggccaatgcctgctgggccctggaggacctgcgctgcatggaggaggacaccttcatcagaacagtggagctgctgggcgctgtgcagggcttcagccggccccagctgatgaccctgaaggagaaggccatccaggtgtgggacatgcccagctactggagggagcaccacatcgtgtccctgggccgcatcgccctggccctgaatgaaagtgagctggagcagctggacctgagcagcattgacacagtggccagcctgtcctggcagacagagtggaccccaggccaggccgagagcatcctgcagggctacctggatgattctggctacagcatccaggacctgaagagcttccacctggtgggcctgggcgccaccctgtgtgccatcaacatcacagagatccccctcatcaagatcagcgagttccgggtggtggtggccagaattggcaccctgctgtgcagcacccacgtgctggccgagttcaagaggaaggccgaggtggtgtttggagaccccacagagtggaccagctctgtgctgcaggagctgggcaccatcgctgctggcctgaccaaggccgagctgaggatgctggacaaggacctgatgccctacttccagcccagcgccatcaagtgcctgcctgatgagatcttcaaggagctgtctgctgagcagatcgccagcctgggcccagaaaatgctgctgctgtgacccacgcccagaggcggcggctgagccccctgcagctgcagagcctgcagcaggccctggatggagccaagacccacagctggcaggatgccccagccagcgctggccccaccaggaccagcagcagccgcagccctgctggggccctgcagagctggggcctgtggctgggctgccccctgctggtgctgatggccaagctgctgtggtag

SEQ ID NO: 162874 - DNA, 1434 bp, Artificial Sequence
  Description of Artificial Sequence: Synthetic coding sequence
atgattgccttcctgctgacctctgtgctgatgatcccccatgctgggggccaccccctggacaccccccacctgccccaggagctgcccccaggcctgcccaacaacatcaacatcaccttcttcagcggcatgttcaagaatgtggagagcgtggccgagatctttgactgcctgggcccccacttcacctggctgcaggccgtgttcaccaacttccctgtgctgatccagtttgtgaatggcatgaagtgtgtggccggcctgtgcccccgggactttgaagattatggctgcacctgccgctttgagatggagggcctgcctgtggatgaaagtgacagctgctgcttccagcaccggcgctgctatgaggaggccgctgagatggactgcctgcaggaccctgccaagctgagcacagaggtgaactgtgtgtccaagaagatcatctgtgagagcaaggacaactgtgagcacctgctgtgcacctgtgacaaggccgccattgaatgtctggcccggagcagcctgaacagcagcctgaacctgctggacaccagcttctgcctggcccagaccccagagaccaccatcaaggaggacctgaccaccctgctgccccgggtggtgcctgtggagcccacagacaccagcctgacagccctgagcggggaggaggccggccatgaccaggagggcgtgggcgccgcccgggccaccagccccccaggcagcgctgagatcgtggccaccagggtgacagccaagatcgtgaccctggtgcctgctggcatcaagagcctgggcctggccgtgtcctctgtggagaatgaccctgaggagaccacagagaaggcctgtgaccgcttcaccttcctgcacctgggcagcggggacaacatgcaggtgatgccccagctgggggagatgctgttctgcctgaccagccgctgcccagaggagtttgagagctatggctgctactgcggccaggagggccgcggggagcccagagatgacctggaccgctgctgcctgagccaccactgctgcctggagcaggtgcggcggctgggctgcctgctggagcggctgccctggagccctgtggtgtgtgtggaccacacccccaagtgtggcggccagagcctgtgtgagaagctgctgtgtgcctgtgaccagacagctgctgagtgcatgaccagcgccagcttcaaccagagcctgaagagccccagccggctgggctgccccggccagcctgctgcctgtgaggacagcctgcaccctgtgcctgctgcccccaccctgggcagcagcagcgaggaggacagcgaggaggaccccccccaggaggacctgggccgggccaagcgcttcctgaggaagagcctgggccccctgggcatcggccccctgcatggaagatag

SEQ ID NO: 162875 - DNA, 1482 bp, Artificial Sequence
  Description of Artificial Sequence: Synthetic coding sequence
atgattgccttcctgctgacctctgtgctgatgatcccccatgctgggggccaccccctggacaccccccacctgccccaggagctgcccccaggcctgcccaacaacatcaacatcaccttcttcagcggcatgttcaagaatgtggagagcgtggccgagatctttgactgcctgggcccccacttcacctggctgcaggccgtgttcaccaacttccctgtgctgatccagtttgtgaatggcatgaagtgtgtggccggcctgtgcccccgggactttgaagattatggctgcacctgccgctttgagatggagggcctgcctgtggatgaaagtgacagctgctgcttccagcaccggcgctgctatgaggaggccgctgagatggactgcctgcaggaccctgccaagctgagcacagaggtgaactgtgtgtccaagaagatcatctgtgagagcaaggacaactgtgagcacctgctgtgcacctgtgacaaggccgccattgaatgtctggcccggagcagcctgaacagcagcctgaacctgctggacaccagcttctgcctggcccagaccccagagaccaccatcaaggaggacctgaccaccctgctgccccgggtggtgcctgtggagcccacagacaccagcctgacagccctgagcggggaggtggccgctgagacagaagctgacaggctcatcaccctgagcaagaagaaggccggccatgaccaggagggcgtgggcgccgcccgggccaccagccccccaggcagcgctgagatcgtggccaccagggtgacagccaagatcgtgaccctggtgcctgctggcatcaagagcctgggcctggccgtgtcctctgtggagaatgaccctgaggagaccacagagaaggcctgtgaccgcttcaccttcctgcacctgggcagcggggacaacatgcaggtgatgccccagctgggggagatgctgttctgcctgaccagccgctgcccagaggagtttgagagctatggctgctactgcggccaggagggccgcggggagcccagagatgacctggaccgctgctgcctgagccaccactgctgcctggagcaggtgcggcggctgggctgcctgctggagcggctgccctggagccctgtggtgtgtgtggaccacacccccaagtgtggcggccagagcctgtgtgagaagctgctgtgtgcctgtgaccagacagctgctgagtgcatgaccagcgccagcttcaaccagagcctgaagagccccagccggctgggctgccccggccagcctgctgcctgtgaggacagcctgcaccctgtgcctgctgcccccaccctgggcagcagcagcgaggaggacagcgaggaggaccccccccaggaggacctgggccgggccaagcgcttcctgaggaagagcctgggccccctgggcatcggccccctgcatggaagatag

SEQ ID NO: 162876 - DNA, 5994 bp, Artificial Sequence
  Description of Artificial Sequence: Synthetic coding sequence
atggccctgctgatccacctgaagacagtgtctgagctgcggggccgcggggaccgcatcgccaaggtgaccttccggggccagagcttctacagccgggtgctggagaactgtgaagatgtggccgactttgatgagaccttccgctggcctgtggccagcagcattgacagaaatgagatgctggagatccaggtgttcaactacagcaaggtgttcagcaacaagctgattggcaccttcaggatggtgctgcagaaggtggtggaggagagccacgtggaggtgacagacaccctgattgatgacaacaatgccatcatcaagaccagcctgtgtgtggaggtgcgctaccaggccacagatggcaccgtgggctcctgggatgatggagacttcctgggagatgagagcctgcaggaggaggagaaggacagccaggagacagatggcctgctgcccggcagccggcccagcagccggcccccaggagagaagagcttcagaagagctggccgcagcgtcttcagcgccatgaagctgggcaagaacagaagccacaaggaggagccccagaggccagatgagcctgctgtgctggagatggaggacctggaccacctggccatccggctgggagatggcctggaccctgacagcgtgtccctggcctctgtgacagccctgaccaccaacgtgagcaacaagaggagcaagccagacatcaagatggagcccagcgctggccggcccatggactaccaggtgtccatcaccgtgattgaggcccggcagctggtgggcctgaacatggaccctgtggtgtgtgtggaggtgggagatgacaagaagtacacctccatgaaggagagcaccaactgcccctactacaatgagtactttgtgtttgacttccacgtgtccccagatgtgatgtttgacaagatcatcaagatcagcgtcatccacagcaagaacctgctgcggagcggcaccctggtgggcagcttcaagatggatgtgggcaccgtgtacagccagcctgagcaccagttccaccacaagtgggccatcctgagtgaccctgatgacatcagcagcggcctgaagggctacgtgaagtgtgatgtggccgtggtgggcaagggggacaacatcaagaccccccacaaggccaatgaaacagatgaagatgacatcgagggcaacctgctgctgcctgagggcgtgcccccagagcggcagtgggcccgcttctacgtgaagatctacagagctgagggcctgcccaggatgaacaccagcctgatggccaacgtgaagaaggccttcatcggggagaacaaggacctggtggacccctacgtgcaggtgttctttgctggccagaagggcaagacctctgtgcagaagagcagctatgagcccctgtggaatgagcaggtggtgttcacagacctcttcccccccctgtgcaagaggatgaaggtgcagatccgggacagcgacaaggtgaatgatgtggccatcggcacccacttcatcgacctgaggaagatcagcaatgatggagacaagggcttcctgcccaccctgggccctgcctgggtgaacatgtatggcagcaccaggaactacaccctgctggatgagcaccaggacctgaatgaaggcctgggggagggcgtgtccttccgggcccggctgctgctgggcctggccgtggagatcgtggacaccagcaaccctgagctgaccagcagcacagaggtgcaggtggagcaggccacccccatcagcgagagctgtgccggcaagatggaggagttcttcctgtttggagccttcctggaggcctccatgattgacagaagaaatggagacaagcccatcacctttgaggtgaccatcggcaactatggaaatgaggtggatggcctgagccggccccagaggccccggcccaggaaggagcctggagatgaggaggaggtggacctgatccagaatgccagtgatgatgaggccggagatgctggggacctggcctctgtgagcagcaccccacccatgaggccccaggtgacagacaggaactacttccacctgccctacctggagaggaagccctgcatctacatcaagtcctggtggccagaccagaggagaagactctacaatgccaacatcatggaccacatcgctgacaagctggaggagggcctgaatgacatccaggagatgatcaagacagagaagagctacccagagcggcggctgcggggcgtgctggaggagctgagctgtggctgctgccgcttcctgagcctggccgacaaggaccagggccacagcagcaggacccggctggaccgggagcggctgaagagctgcatgagggagctggagaacatgggccagcaggccaggatgctgcgggcccaggtgaagaggcacacagtgcgggacaagctgcggctgtgccagaacttcctgcagaagctgcgcttcctggctgatgagccccagcacagcatcccagacatcttcatctggatgatgagcaacaacaagagggtggcctatgcccgggtgcccagcaaggacctgctcttcagcatcgtggaggaggagaccgggaaggactgtgccaaggtgaagaccctcttcctgaagctgcccgggaagaggggctttggatctgctggctggacagtgcaggccaaggtggagctgtacctgtggctgggcctgagcaagcagaggaaggagttcctgtgtggcctgccctgtggcttccaggaggtgaaggccgcccagggcctgggcctgcacgccttcccccctgtgtccctggtgtacaccaagaagcaggccttccagctgcgggcccacatgtaccaggcccggagcctgtttgctgctgacagcagcggcctgagtgacccctttgcccgggtcttcttcatcaaccagagccagtgcacagaggtgctgaatgagaccctgtgccccacctgggaccagatgctggtgtttgacaacctggagctgtatggagaggcccacgagctgagagatgatcctcccatcatcgtcatcgagatctatgaccaggacagcatgggcaaggctgacttcatgggccgcacctttgccaagcccctggtgaagatggctgatgaggcctactgccccccacgcttccccccccagctggagtactaccagatctacagaggaaatgccacagctggggacctgctggccgcctttgagctgctgcagatcggccctgctgggaaggctgacctgccccccatcaatggacctgtggatgtggaccggggccccatcatgcctgtgcccatgggcatccggcctgtgctgagcaagtacagagtggaggtgctcttctggggcctgcgggacctgaagagggtgaacctggcccaggtggaccggccccgggtggacattgaatgtgccgggaaaggagtgcagagcagcctcatccacaactacaagaagaaccccaacttcaacaccctggtgaagtggtttgaggtggacctgcctgaaaatgagctgctgcacccccccctgaacatccgggtggtggactgccgggccttcggccgctacaccctggtgggcagccatgctgtgagcagcctgcggcgcttcatctacagacctccagacagaagtgcccccagctggaacaccaccgtgcggctgctgcggcgctgccgggtgctgtgcaatggaggcagcagcagccacagcactggagaggtggtggtgaccatggagcctgaggtgcccatcaagaagctggagaccatggtgaagctggatgccaccagcgaggccgtggtgaaggtggatgtggccgaggaggagaaggagaagaagaagaagaagaagggcacagctgaggagcctgaggaggaggagccagatgagagcatgctggactggtggagcaagtactttgccagcattgacaccatgaaggagcagctgcggcagcaggagcccagcggcatcgacctggaggagaaggaggaggtggacaacacagagggcctgaagggctccatgaagggcaaggagaaggcccgggccgccaaggaggagaagaagaagaagacccagagcagcggcagcggccagggcagcgaggcccctgagaagaagaagcccaagattgatgagctgaaggtgtaccccaaggagctggagagcgagtttgacaactttgaggactggctgcacaccttcaacctgctgcggggcaagacaggagatgatgaagatggcagcacagaggaggagagaattgtgggccgcttcaagggcagcctgtgtgtgtacaaggtgcccctgcctgaagatgtgtcccgggaggccggctatgacagcacctacggcatgttccagggcatccccagcaatgaccccatcaacgtgctggtgcgggtgtatgtggtgcgggccacagacctgcaccctgctgacatcaacgggaaggctgacccctacatcgccatccggctgggcaagacagacatccgggacaaggagaactacatcagcaagcagctgaaccctgtgtttgggaagagctttgatattgaggccagcttccccatggagagcatgctgactgtggccgtgtatgactgggacctggtgggcacagatgacctgattggagagaccaagattgacctggagaaccgcttctacagcaagcaccgggccacctgtggcatcgcccagacctacagcacccacggctacaacatctggagggaccccatgaagcccagccagatcctgacccggctgtgcaaggatggcaaggtggatggcccccacttcggccccccaggccgggtgaaggtggccaacagagtcttcaccggccccagcgagattgaagatgaaaatggccagaggaagcccacagatgagcacgtggccctgctggccctgcggcactgggaggacatccccagggctggctgccgcctggtgcctgagcacgtggagacccggcccctgctgaacccagacaagccaggcatcgagcagggccgcctggagctgtgggtggacatgttccccatggacatgcctgcccctggcacccccctggacatcagccccaggaagcccaagaagtatgagctgcgggtcatcatctggaacacagatgaggtggtgctggaggatgatgacttcttcaccggggagaagagcagtgacatctttgtgcggggctggctgaagggccagcaggaggacaagcaggacacagatgtgcactaccacagcctgaccggggagggcaacttcaactggagatacctgttcccctttgactacctggccgctgaggagaagatcgtcatcagcaagaaggagagcatgttctcctgggatgaaacagagtacaagatcccagcccggctgaccctgcagatctgggatgctgaccacttcagcgcagatgacttcctgggcgccatcgagctggacctgaaccgcttccccaggggggccaagacagccaagcagtgcaccatggagatggccaccggggaggtggatgtgcccctggtgtccatcttcaagcagaagagggtgaagggctggtggcccctgctggccagaaatgaaaatgatgaatttgagctgaccgggaaggtggaggccgagctgcacctgctgacagctgaggaggccgagaagaaccctgtgggcctggccagaaatgaaccagaccccctggagaagcccaacagaccagacaccagcttcatctggttcctgaaccccctgaagagcgcccgctacttcctgtggcacacctaccgctggctgctgctgaagctgctgctgctgctgctgctgctgctgctgctggccctcttcctgtacagcgtgcccggctacctggtgaagaagatcctgggcgcctag

SEQ ID NO: 162877 - DNA, 3693 bp, Artificial Sequence
  Description of Artificial Sequence: Synthetic coding sequence
atgatcaagacagagaagagctacccagagcggcggctgcggggcgtgctggaggagctgagctgtggctgctgccgcttcctgagcctggccgacaaggaccagggccacagcagcaggacccggctggaccgggagcggctgaagagctgcatgagggagctggagaacatgggccagcaggccaggatgctgcgggcccaggtgaagaggcacacagtgcgggacaagctgcggctgtgccagaacttcctgcagaagctgcgcttcctggctgatgagccccagcacagcatcccagacatcttcatctggatgatgagcaacaacaagagggtggcctatgcccgggtgcccagcaaggacctgctcttcagcatcgtggaggaggagaccgggaaggactgtgccaaggtgaagaccctcttcctgaagctgcccgggaagaggggcttcggcagcgctggctggacagtgcaggccaaggtggagctgtacctgtggctgggcctgagcaagcagaggaaggagttcctgtgtggcctgccctgtggcttccaggaggtgaaggccgcccagggcctgggcctgcacgccttcccccctgtgtccctggtgtacaccaagaagcaggccttccagctgcgggcccacatgtaccaggcccggagcctgtttgctgctgacagcagcggcctgagtgacccctttgcccgggtcttcttcatcaaccagagccagtgcacagaggtgctgaatgagaccctgtgccccacctgggaccagatgctggtgtttgacaacctggagctgtatggagaggcccacgagctgagagatgacccccccatcatcgtgattgagatctatgaccaggacagcatgggcaaggctgacttcatgggccgcacctttgccaagcccctggtgaagatggctgatgaggcctactgccccccacgcttccccccccagctggagtactaccagatctacagaggaaatgccacagctggggacctgctggccgcctttgagctgctgcagatcggccctgctgggaaggctgacctgccccccatcaatggacctgtggatgtggaccggggccccatcatgcctgtgcccatgggcatccggcctgtgctgagcaagtacagagtggaggtgctcttctggggcctgcgggacctgaagagggtgaacctggcccaggtggaccggccccgggtggacattgaatgtgccggcaagggcgtgcagagcagcctcatccacaactacaagaagaaccccaacttcaacaccctggtgaagtggtttgaggtggacctgcctgaaaatgagctgctgcacccccccctgaacatccgggtggtggactgccgggccttcggccgctacaccctggtgggcagccatgctgtgagcagcctgcggcgcttcatctaccggcccccagacagaagtgcccccagctggaacaccactggagaggtggtggtgaccatggagcctgaggtgcccatcaagaagctggagaccatggtgaagctggatgccaccagcgaggccgtggtgaaggtggatgtggccgaggaggagaaggagaagaagaagaagaagaagggcacagctgaggagcctgaggaggaggagccagatgagagcatgctggactggtggagcaagtactttgccagcattgacaccatgaaggagcagctgcggcagcaggagcccagcggcatcgacctggaggagaaggaggaggtggacaacacagagggcctgaagggctccatgaagggcaaggagaaggcccgggccgccaaggaggagaagaagaagaagacccagagcagcggcagcggccagggcagcgaggcccctgagaagaagaagcccaagattgatgagctgaaggtgtaccccaaggagctggagagcgagtttgacaactttgaggactggctgcacaccttcaacctgctgcggggcaagacaggagatgatgaagatggcagcacagaggaggagcgcatcgtgggccgcttcaagggcagcctgtgtgtgtacaaggtgcccctgcctgaagatgtgtcccgggaggccggctatgacagcacctacggcatgttccagggcatccccagcaatgaccccatcaacgtgctggtgcgggtgtatgtggtgcgggccacagacctgcaccctgctgacatcaatggcaaggctgacccctacatcgccatccggctgggcaagacagacatccgggacaaggagaactacatcagcaagcagctgaaccctgtgtttgggaagagctttgacatcgaggccagcttccccatggagagcatgctgactgtggccgtgtatgactgggacctggtgggcacagatgacctgattggagagaccaagattgacctggagaaccgcttctacagcaagcaccgggccacctgtggcatcgcccagacctacagcacccacggctacaacatctggagggaccccatgaagcccagccagatcctgacccggctgtgcaaggatggcaaggtggatggcccccactttggacctcctggccgggtgaaggtggccaacagagtcttcaccggccccagcgagattgaagatgaaaatggccagaggaagcccacagatgaacatgtggccctgctggccctgcggcactgggaggacatcccccgggccggctgccgcctggtgcctgagcacgtggagacccggcccctgctgaacccagacaagccaggcatcgagcagggccgcctggagctgtgggtggacatgttccccatggacatgcctgcccctggcacccccctggacatcagccccaggaagcccaagaagtatgagctgcgggtcatcatctggaacacagatgaggtggtgctggaggatgatgacttcttcaccggggagaagagcagtgacatctttgtgcggggctggctgaagggccagcaggaggacaagcaggacacagatgtgcactaccacagcctgactggagagggcaacttcaactggagatacctgttcccctttgactacctggccgctgaggagaagatcgtcatcagcaagaaggagagcatgttctcctgggatgaaacagagtacaagatcccagcccggctgaccctgcagatctgggatgctgaccacttcagcgcagatgacttcctgggcgccatcgagctggacctgaaccgcttccccaggggggccaagacagccaagcagtgcaccatggagatggccactggagaggtggatgtgcccctggtgtccatcttcaagcagaagagggtgaagggctggtggcccctgctggccagaaatgaaaatgatgaatttgagctgaccgggaaggtggaggccgagctgcacctgctgacagctgaggaggccgagaagaaccctgtgggcctggccagaaatgaaccagaccccctggagaagcccaacagaccagacaccagcttcatctggttcctgaaccccctgaagagcgcccgctacttcctgtggcacacctaccgctggctgctgctgaagctgctgctgctgctgctgctgctgctgctgctggccctcttcctgtacagcgtgcccggctacctggtgaagaagatcctgggcgcctag

SEQ ID NO: 162878 - DNA, 3693 bp, Artificial Sequence
  Description of Artificial Sequence: Synthetic coding sequence
atgatcaagacagagaagagctacccagagcggcggctgcggggcgtgctggaggagctgagctgtggctgctgccgcttcctgagcctggccgacaaggaccagggccacagcagcaggacccggctggaccgggagcggctgaagagctgcatgagggagctggagaacatgggccagcaggccaggatgctgcgggcccaggtgaagaggcacacagtgcgggacaagctgcggctgtgccagaacttcctgcagaagctgcgcttcctggctgatgagccccagcacagcatcccagacatcttcatctggatgatgagcaacaacaagagggtggcctatgcccgggtgcccagcaaggacctgctcttcagcatcgtggaggaggagaccgggaaggactgtgccaaggtgaagaccctcttcctgaagctgcccgggaagaggggcttcggcagcgctggctggacagtgcaggccaaggtggagctgtacctgtggctgggcctgagcaagcagaggaaggagttcctgtgtggcctgccctgtggcttccaggaggtgaaggccgcccagggcctgggcctgcacgccttcccccctgtgtccctggtgtacaccaagaagcaggccttccagctgcgggcccacatgtaccaggcccggagcctgtttgctgctgacagcagcggcctgagtgacccctttgcccgggtcttcttcatcaaccagagccagtgcacagaggtgctgaatgagaccctgtgccccacctgggaccagatgctggtgtttgacaacctggagctgtatggagaggcccacgagctgagagatgacccccccatcatcgtgattgagatctatgaccaggacagcatgggcaaggctgacttcatgggccgcacctttgccaagcccctggtgaagatggctgatgaggcctactgccccccacgcttccccccccagctggagtactaccagatctacagaggaaatgccacagctggggacctgctggccgcctttgagctgctgcagatcggccctgctgggaaggctgacctgccccccatcaatggacctgtggatgtggaccggggccccatcatgcctgtgcccatgggcatccggcctgtgctgagcaagtacagagtggaggtgctcttctggggcctgcgggacctgaagagggtgaacctggcccaggtggaccggccccgggtggacattgaatgtgccggcaagggcgtgcagagcagcctcatccacaactacaagaagaaccccaacttcaacaccctggtgaagtggtttgaggtggacctgcctgaaaatgagctgctgcacccccccctgaacatccgggtggtggactgccgggccttcggccgctacaccctggtgggcagccatgctgtgagcagcctgcggcgcttcatctaccggcccccagacagaagtgcccccagctggaacaccactggagaggtggtggtgaccatggagcctgaggtgcccatcaagaagctggagaccatggtgaagctggatgccaccagcgaggccgtggtgaaggtggatgtggccgaggaggagaaggagaagaagaagaagaagaagggcacagctgaggagcctgaggaggaggagccagatgagagcatgctggactggtggagcaagtactttgccagcattgacaccatgaaggagcagctgcggcagcaggagcccagcggcatcgacctggaggagaaggaggaggtggacaacacagagggcctgaagggctccatgaagggcaaggagaaggcccgggccgccaaggaggagaagaagaagaagacccagagcagcggcagcggccagggcagcgaggcccctgagaagaagaagcccaagattgatgagctgaaggtgtaccccaaggagctggagagcgagtttgacaactttgaggactggctgcacaccttcaacctgctgcggggcaagacaggagatgatgaagatggcagcacagaggaggagcgcatcgtgggccgcttcaagggcagcctgtgtgtgtacaaggtgcccctgcctgaagatgtgtcccgggaggccggctatgacagcacctacggcatgttccagggcatccccagcaatgaccccatcaacgtgctggtgcgggtgtatgtggtgcgggccacagacctgcaccctgctgacatcaatggcaaggctgacccctacatcgccatccggctgggcaagacagacatccgggacaaggagaactacatcagcaagcagctgaaccctgtgtttgggaagagctttgacatcgaggccagcttccccatggagagcatgctgactgtggccgtgtatgactgggacctggtgggcacagatgacctgattggagagaccaagattgacctggagaaccgcttctacagcaagcaccgggccacctgtggcatcgcccagacctacagcacccacggctacaacatctggagggaccccatgaagcccagccagatcctgacccggctgtgcaaggatggcaaggtggatggcccccactttggacctcctggccgggtgaaggtggccaacagagtcttcaccggccccagcgagattgaagatgaaaatggccagaggaagcccacagatgaacatgtggccctgctggccctgcggcactgggaggacatcccccgggccggctgccgcctggtgcctgagcacgtggagacccggcccctgctgaacccagacaagccaggcatcgagcagggccgcctggagctgtgggtggacatgttccccatggacatgcctgcccctggcacccccctggacatcagccccaggaagcccaagaagtatgagctgcgggtcatcatctggaacacagatgaggtggtgctggaggatgatgacttcttcaccggggagaagagcagtgacatctttgtgcggggctggctgaagggccagcaggaggacaagcaggacacagatgtgcactaccacagcctgactggagagggcaacttcaactggagatacctgttcccctttgactacctggccgctgaggagaagatcgtcatcagcaagaaggagagcatgttctcctgggatgaaacagagtacaagatcccagcccggctgaccctgcagatctgggatgctgaccacttcagcgcagatgacttcctgggcgccatcgagctggacctgaaccgcttccccaggggggccaagacagccaagcagtgcaccatggagatggccactggagaggtggatgtgcccctggtgtccatcttcaagcagaagagggtgaagggctggtggcccctgctggccagaaatgaaaatgatgaatttgagctgaccgggaaggtggaggccgagctgcacctgctgacagctgaggaggccgagaagaaccctgtgggcctggccagaaatgaaccagaccccctggagaagcccaacagaccagacacagcctttgtgtggttcctgaaccccctgaagagcatcaagtacctgatctgcacccgctacaagtggctgatcatcaagatcgtgctggccctgctgggcctgctgatgctgggcctcttcctgtacagcctgcccggctacatggtgaagaagctgctgggcgcctag

SEQ ID NO: 162879 - DNA, 234 bp, Artificial Sequence
  Description of Artificial Sequence: Synthetic coding sequence
gaggccgagaagaaccctgtgggcctggccagaaatgaaccagaccccctggagaagcccaacagaccagacacagcctttgtgtggttcctgaaccccctgaagagcatcaagtacctgatctgcacccgctacaagtggctgatcatcaagatcgtgctggccctgggctgcagctgctggggccccctgcagcccccctggctgcacggccagaaggccccctggggctag

SEQ ID NO: 162880 - DNA, 342 bp, Artificial Sequence
  Description of Artificial Sequence: Synthetic coding sequence
gacttcctgggagatgagagcctgcaggaggaggagaaggacagccaggagacagatggcctgctgcccggcagccggcccagcagcaggcctcctggagagaagagcttccgcagcaagggccgggagaagaccaagggcggcagagatgatgagcacaaggccggccgcagcgtcttcagcgccatgaagctgggcaagaacagaagccacaaggaggagccccagaggccagatgagcctgctgtgctggagatggaggacctggaccacctggccatccggctgggagatggcctggaccctgacagcgtgtccctggcctctgtgacagccctgtag

SEQ ID NO: 162881 - DNA, 3924 bp, Artificial Sequence
  Description of Artificial Sequence: Synthetic coding sequence
atgatgacagacacccaggacggccccagcgagagcagccagatcatgaggagcctgacccccctcatcaaccgggaggaggcctttggagaggccggggaggccggcctgtggcccagcatcacccacaccccagacagccaggaggagggcctgaatgacatccaggagatgatcaagacagagaagagctacccagagcggcggctgcggggcgtgctggaggagctgagctgtggctgctgccgcttcctgagcctggccgacaaggaccagggccacagcagcaggacccggctggaccgggagcggctgaagagctgcatgagggagctggagaacatgggccagcaggccaggatgctgcgggcccaggtgaagaggcacacagtgcgggacaagctgcggctgtgccagaacttcctgcagaagctgcgcttcctggctgatgagccccagcacagcatcccagacatcttcatctggatgatgagcaacaacaagagggtggcctatgcccgggtgcccagcaaggacctgctcttcagcatcgtggaggaggagaccgggaaggactgtgccaaggtgaagaccctcttcctgaagctgcccgggaagaggggctttggatctgctggctggacagtgcaggccaaggtggagctgtacctgtggctgggcctgagcaagcagaggaaggagttcctgtgtggcctgccctgtggcttccaggaggtgaaggccgcccagggcctgggcctgcacgccttcccccctgtgtccctggtgtacaccaagaagcaggccttccagctgcgggcccacatgtaccaggcccggagcctgtttgctgctgacagcagcggcctgagtgacccctttgcccgggtcttcttcatcaaccagagccagtgcacagaggtgctgaatgagaccctgtgccccacctgggaccagatgctggtgtttgacaacctggagctgtatggagaggcccacgagctgagagatgatcctcccatcatcgtcatcgagatctatgaccaggacagcatgggcaaggctgacttcatgggccgcacctttgccaagcccctggtgaagatggctgatgaggcctactgccccccacgcttccccccccagctggagtactaccagatctacagaggaaatgccacagctggggacctgctggccgcctttgagctgctgcagatcggccctgctgggaaggctgacctgccccccatcaatggacctgtggatgtggaccggggccccatcatgcctgtgcccatgggcatccggcctgtgctgagcaagtacagagtggaggtgctcttctggggcctgcgggacctgaagagggtgaacctggcccaggtggaccggccccgggtggacattgaatgtgccgggaaaggagtgcagagcagcctcatccacaactacaagaagaaccccaacttcaacaccctggtgaagtggtttgaggtggacctgcctgaaaatgagctgctgcacccccccctgaacatccgggtggtggactgccgggccttcggccgctacaccctggtgggcagccatgctgtgagcagcctgcggcgcttcatctacagacctccagacagaagtgcccccagctggaacaccaccgtgcggctgctgcggcgctgccgggtgctgtgcaatggaggcagcagcagccacagcactggagaggtggtggtgaccatggagcctgaggtgcccatcaagaagctggagaccatggtgaagctggatgccaccagcgaggccgtggtgaaggtggatgtggccgaggaggagaaggagaagaagaagaagaagaagggcacagctgaggagcctgaggaggaggagccagatgagagcatgctggactggtggagcaagtactttgccagcattgacaccatgaaggagcagctgcggcagcaggagcccagcggcatcgacctggaggagaaggaggaggtggacaacacagagggcctgaagggctccatgaagggcaaggagaaggcccgggccgccaaggaggagaagaagaagaagacccagagcagcggcagcggccagggcagcgaggcccctgagaagaagaagcccaagattgatgagctgaaggtgtaccccaaggagctggagagcgagtttgacaactttgaggactggctgcacaccttcaacctgctgcggggcaagacaggagatgatgaagatggcagcacagaggaggagagaattgtgggccgcttcaagggcagcctgtgtgtgtacaaggtgcccctgcctgaagatgtgtcccgggaggccggctatgacagcacctacggcatgttccagggcatccccagcaatgaccccatcaacgtgctggtgcgggtgtatgtggtgcgggccacagacctgcaccctgctgacatcaacgggaaggctgacccctacatcgccatccggctgggcaagacagacatccgggacaaggagaactacatcagcaagcagctgaaccctgtgtttgggaagagctttgatattgaggccagcttccccatggagagcatgctgactgtggccgtgtatgactgggacctggtgggcacagatgacctgattggagagaccaagattgacctggagaaccgcttctacagcaagcaccgggccacctgtggcatcgcccagacctacagcacccacggctacaacatctggagggaccccatgaagcccagccagatcctgacccggctgtgcaaggatggcaaggtggatggcccccacttcggccccccaggccgggtgaaggtggccaacagagtcttcaccggccccagcgagattgaagatgaaaatggccagaggaagcccacagatgagcacgtggccctgctggccctgcggcactgggaggacatccccagggctggctgccgcctggtgcctgagcacgtggagacccggcccctgctgaacccagacaagccaggcatcgagcagggccgcctggagctgtgggtggacatgttccccatggacatgcctgcccctggcacccccctggacatcagccccaggaagcccaagaagtatgagctgcgggtcatcatctggaacacagatgaggtggtgctggaggatgatgacttcttcaccggggagaagagcagtgacatctttgtgcggggctggctgaagggccagcaggaggacaagcaggacacagatgtgcactaccacagcctgaccggggagggcaacttcaactggagatacctgttcccctttgactacctggccgctgaggagaagatcgtcatcagcaagaaggagagcatgttctcctgggatgaaacagagtacaagatcccagcccggctgaccctgcagatctgggatgctgaccacttcagcgcagatgacttcctgggcgccatcgagctggacctgaaccgcttccccaggggggccaagacagccaagcagtgcaccatggagatggccaccggggaggtggatgtgcccctggtgtccatcttcaagcagaagagggtgaagggctggtggcccctgctggccagaaatgaaaatgatgaatttgagctgaccgggaaggtggaggccgagctgcacctgctgacagctgaggaggccgagaagaaccctgtgggcctggccagaaatgaaccagaccccctggagaagcccaacagaccagacaccagcttcatctggttcctgaaccccctgaagagcgcccgctacttcctgtggcacacctaccgctggctgctgctgaagctgctgctgctgctgctgctgctgctgctgctggccctcttcctgtacagcgtgcccggctacctggtgaagaagatcctgggcgcctag

SEQ ID NO: 162882 - DNA, 4527 bp, Artificial Sequence
  Description of Artificial Sequence: Synthetic coding sequence
atgtttcctgcccggggcgtgcccctgcacctggagggggagggcgtcttcccctggggccctggagatgtgtccctgccctacctgagcaccagtgatgtgtccttctctgtgattgtggagaatgtgaactgctacagcagcggcatgatctgcaggaagttcatcagcatcaacgtgggcaacagcctgattgtgtttgatgatgattctggcaaccccagccctgagagcttcctggatgacaagcaggaggtgcacacctggagggtgggcttcttcaccctggtgcacttcccccaggagcacatcaccctgctgtgggaccagaggaccaccgtgcacgtgcaggccggcccccagtggcagggccagctggccggcctgtgtggcaactttgacctgaagaccatcaatgagatgaggaccccagagaacctggagctgaccaacccccaggagtttggcagctcctgggccgctgtggagtgcccagacaccctggacccccgggacatgtgtgtgctgaaccccctgcgggagccctttgccaagaaggaatgttccatcctgctgtctgaggtgtttgagatctgccaccctgtggtggatgtgacctggttctacagcaactgcctgacagacacctgtggctgcagccagggcggggactgtgagtgcttctgtgcctctgtgtctgcctatgcccaccagtgctgccagcacggcgtggccgtggactggaggaccccccggctgtgcctgctgggcaagggcccctaccagctgagcagcctggccgccggcggggccctggtgggcatgaaggctgtgggagatgacatcgtgctggtgaggacagaagatgtggccccagctgacatcgtgtccttcctgctgacagctgccctgtacaaggccaaggcccatgaccctgatgtggtgtccctggaggccgctgaccggcccaacttcttcctgcacgtgacagccaacggcagcctggagctggccaagtggcagggccgggacaccttccagcagcacgccagcttcctgctgcaccggggcacccggcaggccggcctggtggccctggagagcctggccaagcccagcagcttcctgtatgtgtctggagctgtgctggccctgcggctgtatgagcacacagaggtgttcagaagaggcaccctcttccggctgctggatgccaagcccagcggggccgcctaccccatctgtgagtggaggtatgatgcctgtgccagcccctgcttccagacctgccgggaccccagggctgccagctgcagagatgtgccccgggtggagggctgtgtgcctgtgtgccccaccccccaggtgctggatgaggtgacccagagatgtgtgtacctggaggactgtgtggagcctgctgtgtgggtgcccacagaggccctgggcaatgagaccctgccccccagccagggcctgcccacccccagtgatgaggagccccagctgagccaggagagccccaggacccccacccacaggcctgccctgaccccagctgcccccctgaccacagccctgaacccccctgtgacagccacagaggagcctgtggtgtccccaggccccacccagaccaccctgcagcagcccctggagctgacagccagccagctgcctgctggccccacagagagccctgccagcaagggcgtgacagccagcctgctggccatcccccacaccccagagagcagcagcctgcctgtggccctgcagacccccaccccaggcatggtgtctggggccatggagaccaccagggtgaccgtcatctttgctggcagccccaacatcaccgtgagcagccgcagccccccagccccccgcttccccctgatgaccaaggctgtgacagtgcggggccacggcagcctgcctgtgaggaccaccccaccccagcccagcctgacagccagccccagcagcaggcctgtggccagccctggggccatcagccgcagccccaccagcagcggcagccacaaggctgtgctgaccccagctgtgaccaaggtgatcagcaggactggagtgccccagcccacccaggcccagagcgccagcagccccagcacccccctgactgtggccggcacagctgctgagcaggtgcctgtgagccccctggccaccaggagcctggagatcgtgctgagcacagagaagggggaggccggccacagccagcccatgggcagccctgccagcccccagccccaccccctgcccagcgccccacccaggcctgcccagcacaccaccatggccaccaggagccctgccctgcccccagagaccccagctgctgccagcctgagcacagccacagatggcctggccgccacccccttcatgagcctggagagcacccggcccagccagctgctgagcggcctgcccccagacaccagcctgcccctggccaaggtgggcaccagcgcccctgtggccaccccaggccccaaggccagcgtcatcaccacccccctgcagccccaggccaccaccctgcctgcccagaccctgagccctgtgctgcccttcaccccagctgccatgacccaggcccacccccccacccacatcgcccctcctgctgctggaacagcccctggcctgctgctgggcgccaccctgcccaccagcggcgtgctgcctgtggccgagggcacagcctccatggtgtctgtggtgcccaggaagagcaccaccgggaaggtggccatcctgagcaagcaggtgtccctgcccacctccatgtatggcagcgctgagggcggccccacagagctgaccccagccaccagccaccccctgacccccctggtggccgagcctgagggcgcccaggccggcacagccctgcctgtgcccaccagctatgccctgagccgggtgtctgccaggacagccccccaggacagcatgctggtgctgctgccccagctggccgaggcccacggcaccagcgctggcccccacctggccgctgagcctgtggatgaggccaccacagagcccagcggccgcagcgccccagccctgagcatcgtggagggcctggccgaggccctggccaccaccacagaggccaacaccagcaccacctgtgtgcccatcgccgagcaggactgtgtgcgccacatctgcctggagggccagctgatccgggtgaaccagagccagcactgcccccagggcgccgccccaccccgctgtggcatcctgggcctggccgtgcgggtgggcggggaccgctgctgccccctgtgggagtgtgcctgccgctgcagcatcttcccagacctgagctttgtgacctttgatggcagccacgtggccctcttcaaggaggccatctacatcctgagccagagcccagatgagatgctgactgtgcacgtgctggactgcaagagcgccaacctgggccacctgaactggccacccttctgcctggtgatgctgaacatgacccacctggcccaccaggtgaccatcgaccgcttcaacaggaaggtgacagtggacctgcagcctgtgtggccccctgtgagccgctatggcttcagaattgaggacaccggccacatgtacatgatcctgacccccagcgacatccagatccagtggctgcacagcagcggcctgatgattgtggaggccagcaagaccagcaaggcccagggccacggcctgtgtggcatctgtgatggagatgctgccaatgacctgaccctgaaggatggctctgtggtgggcggcgctgaggaccctgcccccttcctggacagctggcaggtgcccagcagcctgacctctgtgggccagacccgcttccggccagacagctgtgccaccacagactgcagcccctgcctgaggatggtgagcaacagaaccttcagcgcctgccacagatttgtgcccccagagagcttctgtgagctgtggatccgggacaccaagtatgtgcagcagccctgtgtggccctgactgtgtatgtggccatgtgccacaagttccacgtgtgcatcgagtggaggagaagtgactactgccccttcctgtgcagcagtgacagcacctaccaggcctgtgtgacagcctgtgagccccccaagacctgccaggacggcatcctgggccccctggaccctgagcactgccaggtgctgggggagggctgtgtgtgcagcgagggcaccatcctgcaccggcggcacagcgccctgtgcatccctgaggccaagtgtgcctgtggggactgcccagacagcatccctgagtgccaggagggggaggccctgactgtgcacaggaacaccacagagctgtgctgccccctgtaccagtgtgtgtgtgagaacttccgctgcccccaggtgcagtgtggcctgggcacagccctggtggaggtgtggagcccagaccgctgctgcccctacaagagctgtggctag

SEQ ID NO: 162883 - DNA, 8778 bp, Artificial Sequence
  Description of Artificial Sequence: Synthetic coding sequence
atgggcgtgctggccagcgccctgtgctggctgctgtgtgtgtggctgccctggggcgagcaggccgctgagagcctgcgggtgcagaggctgggggagcgggtggtggacagcggccgcagcggggcccggggcatgagaaatgtgaagggcatgagaaatggacctgcccagaccagggtgagcagcagcagcagccaccaggaggccaccctggccatgggagacaaggccaccgtggtgggcggccagcaggccgaggccccagattctgtggccatgagctcctgggagcggcggctgcaccgggccaagtgtgcccccagctacctgttcagctgcttcaatggaggagaatgtgtgcacccagccttctgtgactgccgccgcttcaatgccaccggcccccgctgccagatggtgtacaatgccggccctgagcgggacagcatctgccgggcctggggccagcaccacgtggagacctttgatggcctgtactactacctgagcggcaagggcagctacaccctggtgggcagacatgagcctgagggccagagcttcagcatccaggtgcacaatgacccccagtgtggcagcagcccctacacctgcagcagagctgtgtccctcttctttgtgggggagcaggagatccacctggccaaggaggtgacccacggcggcatgagggtgcagctgccccacgtgatgggcagcgcccggctgcagcagctggccggctacgtgattgtgcgccaccagagcgccttcaccctggcctgggatggagccagcgctgtgtacatcaagatgagccctgagctgctgggctggacccacggcctgtgtggcaacaacaatgctgaccccaaggatgacctggtgaccagcagcggcaagctgacagatgatgtggtggagtttgtgcacagctggcaggagcaggcccccaaccagcccccaggccccaccaccagcagcctgcccaggcctccctgcctgcagcagaaccctggcaccatgcagggcgtgtatgagcagtgtgaggccctgctgcggcccccatttgatgcctgccacgcctacgtgagccccctgcccttcaccgccagctgcaccagtgacctgtgccagagcatgggagatgtggccacctggtgccgggccctggccgagtatgcccgggcctgtgcccaggccggccggcccctgcagggctggaggacccagctgcggcagtgcaccgtgcactgcaaggagaaggccttcacctacaatgaatgtattgcctgctgcccagccagctgccacccccgggccagctgtgtggacagcgagatcgcctgtgtggatggctgctactgccccaacggcctcatctttgaagatggcggctgtgtggccccagcagaatgtccctgtgagttccacggcaccctgtacccacctggctctgtggtgaaggaggactgcaacacctgcacctgcaccagcggcaagtgggagtgcagcacagctgtgtgcccagcagaatgttctgtgactggagacatccacttcaccacctttgatggccgccgctacaccttccctgccacctgccagtacatcctggccaagagccgcagcagcggcaccttcaccgtgaccctgcagaatgccccctgtggcctgaaccaggatggagcctgtgtgcagagcgtgtctgtcatcctgcaccaggacccccggcggcaggtgaccctgacccaggccggagatgtgctgctgtttgaccagtacaagatcatccccccctacacagatgatgcctttgagatccggcggctgagcagcgtcttcctgcgggtgaggaccaacgtgggcgtgcgggtgctgtatgaccgggagggcctgcggctgtacctgcaggtggaccagcgctgggtggaggacacagtgggcctgtgtggcaccttcaacggcaacacccaggatgacttcctgagccctgtgggcgtgcctgagagcaccccccagctgtttggaaacagctggaagaccctgagcgcctgcagccccctggtgtctggcagccccctggacccctgtgatgtgcacctgcaggccgccagctacagcgtgcaggcctgcagcgtgctgactggagagatgtttgccccctgcagcgccttcctgagccctgtgccctactttgagcagtgcagaagagatgcctgccgctgtggccagccctgcctgtgtgccaccctggcccactacgcccacctgtgcagaagacatggcctgcctgtggacttccgggcccggctgcctgcctgtgccctgagctgtgaggccagcaaggagtacagcccctgtgtggccccctgtggccgcacctgccaggacctggccagccctgaggcctgtggggtggatggaggagatgacctgagcagagatgaatgtgtggagggctgtgcctgccccccagacacctacctggacacccaggccgacctgtgtgtgcccaggaaccagtgcagctgccacttccagggcgtggactacccacctggggacagcgacatccccagcctgggccactgccactgcaaggatggagtgatgagctgtgacagccgggccccagctgctgcctgcccagctggccaggtgtttgtgaactgcagcgacctgcacacagacctggagctgagccgggagaggacctgtgagcagcagctgctgaacctgtctgtgtctgcccggggcccctgcctgagcggctgtgcctgcccccagggcctgctgcggcatggagatgcctgcttcctgcctgaagaatgtccctgcacctggaagggcaaggagtacttccctggggaccaggtgatgagcccctgccacacctgtgtgtgccagaggggcagcttccagtgcaccctgcacccctgtgccagcacctgcacagcctatggagacagacactaccgcacctttgatggcctgccctttgattttgtgggcgcctgcaaggtgcacctggtgaagagcaccagtgatgtgtccttcagcgtcatcgtggagaatgtgaactgctacagcagcggcatgatctgcaggaagttcatcagcatcaacgtgggcaacagcctcatcgtgtttgatgatgacagcggcaaccccagccctgagagcttcctggatgacaagcaggaggtgcacacctggagggtgggcttcttcaccctggtgcacttcccccaggagcacatcaccctgctgtgggaccagaggaccaccgtgcacgtgcaggccggcccccagtggcagggccagctggccggcctgtgtggcaactttgacctgaagaccatcaatgagatgaggaccccagagaacctggagctgaccaacccccaggagtttggcagctcctgggccgctgtggagtgcccagacaccctggacccccgggacatgtgtgtgctgaaccccctgcgggagccctttgccaagaaggagtgcagcatcctgctgtctgaggtgtttgagatctgccaccctgtggtggatgtgacctggttctacagcaactgcctgacagacacctgtggctgcagccagggcggggactgtgagtgcttctgtgcctctgtgtctgcctatgcccaccagtgctgccagcacggcgtggccgtggactggaggaccccccggctgtgcccctatgactgtgacttcttcaacaaggtgctgggcaagggcccctaccagctgagcagcctggccgccggcggggccctggtgggcatgaaggctgtgggagatgacatcgtgctggtgaggacagaagatgtggccccagctgacatcgtgtccttcctgctgacagctgccctgtacaaggccaaggcccatgaccctgatgtggtgtccctggaggccgctgaccggcccaacttcttcctgcacgtgacagccaacggcagcctggagctggccaagtggcagggccgggacaccttccagcagcacgccagcttcctgctgcaccggggcacccggcaggccggcctggtggccctggagagcctggccaagcccagcagcttcctgtatgtgtctggagctgtgctggccctgcggctgtatgagcacacagaggtgttcagaagaggcaccctcttccggctgctggatgccaagcccagcggggccgcctaccccatctgtgagtggaggtatgatgcctgtgccagcccctgcttccagacctgccgggaccccagggctgccagctgcagagatgtgccccgggtggagggctgtgtgcctgtgtgccccaccccccaggtgctggatgaggtgacccagagatgtgtgtacctggaggactgtgtggagcctgctgtgtgggtgcccacagaggccctgggcaatgagaccctgccccccagccagggcctgcccacccccagtgatgaggagccccagctgagccaggagagccccaggacccccacccacaggcctgccctgaccccagctgcccccctgaccacagccctgaacccccctgtgacagccacagaggagcctgtggtgtccccaggccccacccagaccaccctgcagcagcccctggagctgacagccagccagctgcctgctggccccacagagagccctgccagcaagggcgtgacagccagcctgctggccatcccccacaccccagagagcagcagcctgcctgtggccctgcagacccccaccccaggcatggtgtctggggccatggagaccaccagggtgaccgtcatctttgctggcagccccaacatcaccgtgagcagccgcagccccccagccccccgcttccccctgatgaccaaggctgtgacagtgcggggccacggcagcctgcctgtgaggaccaccccaccccagcccagcctgacagccagccccagcagcaggcctgtggccagccctggggccatcagccgcagccccaccagcagcggcagccacaaggctgtgctgaccccagctgtgaccaaggtgatcagcaggactggagtgccccagcccacccaggcccagagcgccagcagccccagcacccccctgactgtggccggcacagctgctgagcaggtgcctgtgagccccctggccaccaggagcctggagatcgtgctgagcacagagaagggggaggccggccacagccagcccatgggcagccctgccagcccccagccccaccccctgcccagcgccccacccaggcctgcccagcacaccaccatggccaccaggagccctgccctgcccccagagaccccagctgctgccagcctgagcacagccacagatggcctggccgccacccccttcatgagcctggagagcacccggcccagccagctgctgagcggcctgcccccagacaccagcctgcccctggccaaggtgggcaccagcgcccctgtggccaccccaggccccaaggccagcgtcatcaccacccccctgcagccccaggccaccaccctgcctgcccagaccctgagccctgtgctgcccttcaccccagctgccatgacccaggcccacccccccacccacatcgcccctcctgctgctggaacagcccctggcctgctgctgggcgccaccctgcccaccagcggcgtgctgcctgtggccgagggcacagcctccatggtgtctgtggtgcccaggaagagcaccaccgggaaggtggccatcctgagcaagcaggtgtccctgcccacctccatgtatggcagcgctgagggcggccccacagagctgaccccagccaccagccaccccctgacccccctggtggccgagcctgagggcgcccaggccggcacagccctgcctgtgcccaccagctatgccctgagccgggtgtctgccaggacagccccccaggacagcatgctggtgctgctgccccagctggccgaggcccacggcaccagcgctggcccccacctggccgctgagcctgtggatgaggccaccacagagcccagcggccgcagcgccccagccctgagcatcgtggagggcctggccgaggccctggccaccaccacagaggccaacaccagcaccacctgtgtgcccatcgccgagcaggactgtgtgcgccacatctgcctggagggccagctgatccgggtgaaccagagccagcactgcccccagggcgccgccccaccccgctgtggcatcctgggcctggccgtgcgggtgggcggggaccgctgctgccccctgtgggagtgtgcctgccgctgcagcatcttcccagacctgagctttgtgacctttgatggcagccacgtggccctcttcaaggaggccatctacatcctgagccagagcccagatgagatgctgactgtgcacgtgctggactgcaagagcgccaacctgggccacctgaactggccacccttctgcctggtgatgctgaacatgacccacctggcccaccaggtgaccatcgaccgcttcaacaggaaggtgacagtggacctgcagcctgtgtggccccctgtgagccgctatggcttcagaattgaggacaccggccacatgtacatgatcctgacccccagcgacatccagatccagtggctgcacagcagcggcctgatgattgtggaggccagcaagaccagcaaggcccagggccacggcctgtgtggcatctgtgatggagatgctgccaatgacctgaccctgaaggatggctctgtggtgggcggcgctgaggaccctgcccccttcctggacagctggcaggtgcccagcagcctgacctctgtgggccagacccgcttccggccagacagctgtgccaccacagactgcagcccctgcctgaggatggtgagcaacagaaccttcagcgcctgccacagatttgtgcccccagagagcttctgtgagctgtggatccgggacaccaagtatgtgcagcagccctgtgtggccctgactgtgtatgtggccatgtgccacaagttccacgtgtgcatcgagtggaggagaagtgactactgccccttcctgtgcagcagtgacagcacctaccaggcctgtgtgacagcctgtgagccccccaagacctgccaggacggcatcctgggccccctggaccctgagcactgccaggtgctgggggagggctgtgtgtgcagcgagggcaccatcctgcaccggcggcacagcgccctgtgcatccctgaggccaagtgtgcctgcacagacagcatgggcgtgccccgggccctgggggagacctggaacagcagcctgagcggctgctgccagcaccagtgccaggccccagacaccatcgtgcctgtggacctgggctgccccagccccaggcctgagagctgcctgcgctttggagaggtggccctgctgctgcccaccaaggacccctgctgcctgggcaccgtgtgtgtgtgcaaccagaccctgtgtgagggcctggcccccacctgcaggcctggccaccggctgctgacccacttccaggaggacagctgctgccccagctacagctgtgaatgtgaccctgacctgtgtgaggccgagctggtgcccagctgccggcaggaccagatcctgatcaccggccgcctgggggacagctgctgcaccagctacttctgtgcctgtggggactgcccagacagcatccctgagtgccaggagggggaggccctgactgtgcacaggaacaccacagagctgtgctgccccctgtaccagtgtgtgtgtgagaacttccgctgcccccaggtgcagtgtggcctgggcacagccctggtggaggtgtggagcccagaccgctgctgcccctacaagagctgtgaatgtgactgtgacaccatccctgtgccccgctgccacctgtgggagaagagccagctggatgaggagttcatgcacagcgtggagaatgtgtgtggctgtgccaagtatgaatgtgtgaaggcccctgtgtgcctgagccgggagctgggcgtgatgcagcccggccagacagtggtggagctgtctgcagatggagtgtgccacaccagccgctgcaccaccgtgctggaccccctgaccaacttctaccagatcaacaccacctctgtgctgtgtgacatccactgtgaggccaaccaggagtatgagcacccccgggacctggccgcctgctgcggcagctgcagaaatgtgtcctgcctcttcaccttccccaacggcaccaccagcctcttcctgcccggggcctcctggattgctgactgtgcccggcaccactgcagcagcacccccctgggcgctgtgctggtgcgcagccccatcagctgcccccccctgaatgaaacagaatgtgccaaggtgggcggctctgtggtgcccagcctggagggctgctgcaggacctgcaaggaggatggccgcagctgcaagaaggtgaccatccgcatgaccatcaggaagaatgaatgtcgcagcagcacccctgtgaacctggtgtcctgtgatggccgctgccccagcgccagcatctacaactacaacatcaacacctacgcccgcttctgcaagtgctgccgggaggtgggcctgcagaggagatctgtgcagctgttctgtgccaccaatgccacctgggtgccctacacagtgcaggagcccacagactgtgcctgccagtggagctag

SEQ ID NO: 162884 - DNA, 387 bp, Artificial Sequence
  Description of Artificial Sequence: Synthetic coding sequence
atggcccgcatcctgctgctcttcctgcccggcctggtggccgtgtgtgctgtgcacggcatcttcatggaccggctggccagcaagaagctgtgtgctgatgatgaatgtgtgtacaccatcagcctggccagcgcccaggaggactacaatgccccagactgccgcttcatcaacgtgaagaagggccagcagatctacgtgtacagcaagctggtgaaggaaaatggagctggggagttctgggccggctctgtgtatggagatggccaggatgagatgggcgtggtgggctacttccccaggaacctggtgaaggagcagagggtgtaccaggaggccaccaaggaggtgcccaccacagacatcgacttcttctgtgagtag

SEQ ID NO: 162885 - DNA, 1446 bp, Artificial Sequence
  Description of Artificial Sequence: Synthetic coding sequence
atgcagctgtacagctctgtgtgcacccactacccagctggggcccctggccccacagctgctgccccagcccctcctgctgctgccacccccttcaaggtgtccctgcagcccccaggagctgctggggccgcccctgagcctgagaccggggagtgccagcctgctgctgctgctgagcaccgggaggccgctgctgtgcctgctgccaagatgcctgccttcagcagctgctttgaggtggtgtctggagctgctgccccagccagcgctgctgctggccccccaggggccagctgcaagccacccctgcccccccactacaccagcacagcccagatcaccgtgcgggccctgggcgctgaccggctgctgctgcacggccctgaccctgtgcctggagctgctggcagcgctgctgccccccggggccgctgcctgctgctggccccagccccagctgcccctgtgcccccccggcggggcagcagcgcctggctgctggaggagctgctgcggccagactgcccagagcccgccggcctggatgccacccgggagggccctgacaggaacttccggctgtctgagcaccggcaggccctggccgccgccaagcaccggggccctgctgccaccccaggcagcccagaccccggccctggcccctggggcgaggagcacctggccgagcggggcccccggggctgggagcggggcggggacagatgtgatgcccctggaggagatgctgcccggcggccagaccctgaggccgaggcccccccagctggcagcattgaagctgcccccagcagcgctgctgagcctgtgattgtgtccagaagtgaccccagagatgagaagctggccctgtacctggccgaggtggagaagcaggacaagtacctgcggcagaggaacaagtaccgcttccacatcatcccagatggcaactgcctgtacagagctgtgtccaagacagtgtatggagaccagagcctgcaccgggagctgcgggagcagacagtgcactacatcgctgaccacctggaccacttcagccccctcatcgagggagatgtgggggagttcatcatcgctgctgcccaggatggagcctgggccggctacccagagctgctggccatgggccagatgctgaatgtgaacatccacctgaccaccggcggccgcctggagagccccaccgtgtccaccatgatccactacctgggccctgaggacagcctgcggcccagcatctggctgtcctggctgagcaatggccactatgatgctgtgtttgaccacagctaccccaacccagaatatgacaactggtgcaagcagacccaggtgcagaggaagagagatgaggagctggccaagtccatggccatcagcctgagcaagatgtacatcgagcagaatgcctgcagctag

SEQ ID NO: 162886 - DNA, 1197 bp, Artificial Sequence
  Description of Artificial Sequence: Synthetic coding sequence
atgagcaggaagcaggccgccaagagcaggcctggcagcggcagcaggaaggccgaggccgagaggaagagagatgagcgggccgcccggcgggccctggccaaggagaggaggaacagacctgagagcggcggcggcggcggctgtgaggaggagtttgtgtcctttgccaaccagctgcaggccctgggcctgaagctgcgggaggtgcctggagatggcaactgcctcttccgggccctgggggaccagctggagggccacagcaggaaccacctgaagcaccggcaggagaccgtggactacatgatcaagcagcgggaggactttgagccctttgtggaggatgacatcccctttgagaagcacgtggccagcctggccaagccaggcacctttgctggaaatgatgccatcgtggcctttgccaggaaccaccagctgaatgtggtgatccaccagctgaatgcccccctgtggcagatccggggcacagagaagagctctgtgcgggagctgcacatcgcctaccgctatggagagcactatgattctgtgcggcgcatcaatgacaacagcgaggccccagcccacctgcagacagacttccagatgctgcaccaggatgagagcaacaagcgggagaagatcaagaccaagggcatggacagtgaagatgacctgagagatgaggtggaggatgctgtgcagaaggtgtgcaatgccaccggctgcagcgacttcaacctgattgtgcagaacctggaggccgagaactacaacatcgagagcgccatcatcgctgtgctgaggatgaaccagggcaagagaaataatgctgaggagaacctggagcccagcggccgggtgctgaagcagtgtggccccctgtgggaggagggcggcagcggggcccgcatcttcggcaaccagggcctgaatgaaggaagaacagagaacaacaaggcccaggccagccccagcgaggagaacaaggccaacaagaaccagctggccaaggtgaccaacaagcagaggcgggagcagcagtggatggagaagaagaagaggcaggaggagcggcaccgccacaaggccctggagagccggggcagccaccgggacaacaacagaagtgaagctgaggccaacacccaggtgaccctggtgaagacctttgctgccctgaacatctag

SEQ ID NO: 162887 - DNA, 438 bp, Artificial Sequence
  Description of Artificial Sequence: Synthetic coding sequence
atggcctgcatccactacctgagagaaaatcgggagaagtttgaggccttcatcgagggcagctttgaggagtacctgaagaggctggagaacccccaggagtgggtgggccaggtggagatcagcgccctgagcctgatgtacaggaaggacttcatcatctaccgggagcccaacgtgagccccagccaggtgacagagaacaacttccctgagaaggtgctgctgtgcttcagcaatggaaaccactatgacatcgtgtaccccatcaagtacaaggagagcagcgccatgtgccagagcctgctgtatgagctgctgtatgagaaggtgttcaagacagatgtgtccaagatcgtgatggagctggacaccctggaggtggctgatgaggacaacagcgagatcagtgacagtgaagatgacagctgcaagtag

SEQ ID NO: 162888 - DNA, 3345 bp, Artificial Sequence
  Description of Artificial Sequence: Synthetic coding sequence
atggaggccgctgtgggcgtgcctgatggaggagaccagggcggggccggcccccgggaggatgccacccccatggatgcctacctgaggaagctgggcctgtacaggaagctggtggccaaggatggcagctgcctcttccgggctgtggccgagcaggtgctgcacagccagagcagacatgtggaggtgaggatggcctgcatccactacctgcgggagaaccgggagaagtttgaggccttcatcgagggcagctttgaggagtacctgaagaggctggagaacccccaggagtgggtgggccaggtggagatcagcgccctgagcctgatgtacaggaaggacttcatcatctaccgggagcccaacgtgagccccagccaggtgacagagaacaacttccctgagaaggtgctgctgtgcttcagcaatggaaaccactatgacatcgtgtaccccatcaagtacaaggagagcagcgccatgtgccagagcctgctgtatgagctgctgtatgagaaggtgttcaagacagatgtgtccaagatcgtgatggagctggacaccctggaggtggctgatgaggacaacagcgagatcagtgacagtgaagatgacagctgcaagagcaagacagctgctgctgctgctgatgtgaatggcttcaagcccctgtctggaaatgagcagctgaagaacaatggaaacagcaccagcctgcccctgagcaggaaggtgctgaagagcctgaacccagctgtgtacagaaatgtggagtatgagatctggctgaagagcaagcaggcccagcagaagagggactacagcattgctgctggcctgcagtatgaggtgggggacaagtgccaggtgcggctggaccacaacgggaagttcctgaatgctgatgtgcagggcatccacagtgaaaatggacctgtgctggtggaggagctgggcaagaagcacaccagcaagaacctgaaggcccctcctcctgagagctggaacacagtgtctgggaagaagatgaagaagcccagcaccagcggccagaacttccacagtgatgtggactaccggggccccaagaaccccagcaagcccatcaaggcccccagcgccctgcccccccggctgcagcaccccagcggcgtgcggcagcacgccttcagcagccacagcagcggcagccagagccagaagttcagcagcgagcacaagaacctgagcaggacccccagccagatcatcaggaagccagaccgggagcgggtggaggactttgaccacaccagccgggagagcaactacttcggcctgagccctgaggagcggcgggagaagcaggccatcgaggagagccggctgctgtatgagatccagaacagagatgagcaggccttccctgccctgagcagcagctctgtgaaccagagcgccagccagagcagcaacccctgtgtgcagaggaagagcagccacgtgggggacaggaagggcagcagaagaaggatggacacagaggagaggaaggacaaggacagcatccacggccacagccagctggacaagaggcctgagcccagcaccctggagaacatcacagatgacaagtatgccaccgtgagcagccccagcaagagcaagaagctggagtgccccagccctgctgagcagaagccagctgagcacgtgtccctgagcaacccagcccccctgctggtgtccccagaggtgcacctgaccccagctgtgcccagcctgcctgccaccgtgcctgcctggcccagcgagcccaccaccttcggccccactggagtgcctgcccccatccctgtgctgtctgtgacccagaccctgaccaccggccctgacagcgctgtgtcccaggcccacctgacccccagccctgtgcctgtgtccatccaggccgtgaaccagcccctgatgcccctgccccagaccctgagcctgtaccaggaccccctgtacccaggcttcccctgcaatgagaagggggaccgggccatcgtgcccccctacagcctgtgccagacaggagaggacctgcccaaggacaagaacatcctgcgcttcttcttcaacctgggcgtgaaggcctacagctgccccatgtgggccccccacagctacctgtaccccctgcaccaggcctacctggccgcctgcaggatgtaccccaaggtgcctgtgcctgtgtacccccacaacccctggttccaggaggccccagctgcccagaatgaaagtgactgcacctgcacagatgcccacttccccatgcagacagaggcctctgtgaatggccagatgccccagcctgagatcggcccccccaccttcagcagccccctggtgattcctcccagccaggtgtctgagagccacggccagctgagctaccaggccgacctggagagcgagaccccaggccagctgctgcatgctgactatgaggagagcctgagcggcaagaacatgttcccccagcccagctttggccccaaccccttcctgggccctgtgcccatcgccccacccttcttcccccacgtgtggtacggctaccccttccagggcttcatcgagaaccctgtgatgaggcagaacatcgtgctgcccagtgatgagaagggggagctggacctgagcctggagaacctggacctgagcaaggactgtggctctgtgtccacagtggatgagttccctgaggcccggggggagcacgtgcacagcctgcctgaggcctctgtgagcagcaagccagatgagggccgcacagagcagagcagccagaccaggaaggctgacacagccctggccagcatcccccctgtggccgagggcaaggcccacccccccacccagatcctgaaccgggagcgggagaccgtgcctgtggagctggagcccaagaggaccatccagagcctgaaggagaagacagagaaggtgaaggaccccaagacagctgctgatgtggtgtcccctggggccaacagcgtggacagccgggtgcagaggcccaaggaggagagcagtgaagatgaaaatgaggtgagcaacatcctgcggagcggccgcagcaagcagttctacaaccagacctacggcagcaggaagtacaagagtgactggggctacagcggccggggcggctaccagcacgtgcgctctgaggagagctggaagggccagcccagccgcagcagagatgagggctaccagtaccacagaaatgtgcggggccggcccttccggggggacagaagaagaagtggcatgggagatggccaccggggccagcacacctag

SEQ ID NO: 162889 - DNA, 3150 bp, Artificial Sequence
  Description of Artificial Sequence: Synthetic coding sequence
atggcctgcatccactacctgagagaaaatcgggagaagtttgaggccttcatcgagggcagctttgaggagtacctgaagaggctggagaacccccaggagtgggtgggccaggtggagatcagcgccctgagcctgatgtacaggaaggacttcatcatctaccgggagcccaacgtgagccccagccaggtgacagagaacaacttccctgagaaggtgctgctgtgcttcagcaatggaaaccactatgacatcgtgtaccccatcaagtacaaggagagcagcgccatgtgccagagcctgctgtatgagctgctgtatgagaaggtgttcaagacagatgtgtccaagatcgtgatggagctggacaccctggaggtggctgatgaggacaacagcgagatcagtgacagtgaagatgacagctgcaagagcaagacagctgctgctgctgctgatgtgaatggcttcaagcccctgtctggaaatgagcagctgaagaacaacggcaacagcaccagcctgcccctgagcaggaaggtgctgaagagcctgaacccagctgtgtacagaaatgtggagtatgagatctggctgaagagcaagcaggcccagcagaagagggactacagcattgctgctggcctgcagtatgaggtgggggacaagtgccaggtgcggctggaccacaacgggaagttcctgaatgctgatgtgcagggcatccacagtgaaaatggacctgtgctggtggaggagctgggcaagaagcacaccagcaagaacctgaaggcccctcctcctgagagctggaacacagtgtctgggaagaagatgaagaagcccagcaccagcggccagaacttccacagtgatgtggactaccggggccccaagaaccccagcaagcccatcaaggcccccagcgccctgcccccccggctgcagcaccccagcggcgtgcggcagcacgccttcagcagccacagcagcggcagccagagccagaagttcagcagcgagcacaagaacctgagcaggacccccagccagatcatcaggaagccagaccgggagcgggtggaggactttgaccacaccagccgggagagcaactacttcggcctgagccctgaggagcggcgggagaagcaggccatcgaggagagccggctgctgtatgagatccagaacagagatgagcaggccttccctgccctgagcagcagctctgtgaaccagagcgccagccagagcagcaacccctgtgtgcagaggaagagcagccacgtgggggacaggaagggcagcagaagaaggatggacacagaggagaggaaggacaaggacagcatccacggccacagccagctggacaagaggcctgagcccagcaccctggagaacatcacagatgacaagtatgccaccgtgagcagccccagcaagagcaagaagctggagtgccccagccctgctgagcagaagccagctgagcacgtgtccctgagcaacccagcccccctgctggtgtccccagaggtgcacctgaccccagctgtgcccagcctgcctgccaccgtgcctgcctggcccagcgagcccaccaccttcggccccaccggggtgcctgcccccatccctgtgctgtctgtgacccagaccctgaccactggaccagattctgctgtgtcccaggcccacctgacccccagccctgtgcctgtgtccatccaggccgtgaaccagcccctgatgcccctgccccagaccctgagcctgtaccaggaccccctgtacccaggcttcccctgcaatgaaaaaggagaccgggccatcgtgcccccctacagcctgtgccagacaggagaggacctgcccaaggacaagaacatcctgcgcttcttcttcaacctgggcgtgaaggcctacagctgccccatgtgggccccccacagctacctgtaccccctgcaccaggcctacctggccgcctgcaggatgtaccccaaggtgcctgtgcctgtgtacccccacaacccctggttccaggaggccccagctgcccagaatgaaagtgactgcacctgcacagatgcccacttccccatgcagacagaggcctctgtgaatggccagatgccccagcctgagatcggcccccccaccttcagcagccccctggtgatcccccccagccaggtgtctgagagccacggccagctgagctaccaggccgacctggagagcgagaccccaggccagctgctgcacgccgactatgaggagagcctgagcggcaagaacatgttcccccagcccagctttggccccaaccccttcctgggccctgtgcccatcgccccacccttcttcccccacgtgtggtacggctaccccttccagggcttcattgaaaatcctgtgatgaggcagaacatcgtgctgcccagtgatgagaagggggagctggacctgagcctggagaacctggacctgagcaaggactgtggctctgtgtccacagtggatgagttccctgaggcccggggggagcacgtgcacagcctgcctgaggcctctgtgagcagcaagccagatgagggccgcacagagcagagcagccagaccaggaaggctgacacagccctggccagcatcccccctgtggccgagggcaaggcccacccccccacccagatcctgaaccgggagcgggagaccgtgcctgtggagctggagcccaagaggaccatccagagcctgaaggagaagacagagaaggtgaaggaccccaagacagctgctgatgtggtgtcccctggggccaacagcgtggacagccgggtgcagaggcccaaggaggagagcagtgaagatgaaaatgaggtgagcaacatcctgcggagcggccgcagcaagcagttctacaaccagacctacggcagcaggaagtacaagagtgactggggctacagcggccggggcggctaccagcacgtgcgctctgaggagagctggaagggccagcccagccgcagcagagatgagggctaccagtaccacagaaatgtgcggggccggcccttccggggggacagaagaagaagtggcatgggagatggccaccggggccagcacacctag

SEQ ID NO: 162890 - DNA, 420 bp, Artificial Sequence
  Description of Artificial Sequence: Synthetic coding sequence
atggcctgcatccactacctgagagaaaatcgggagaagtttgaggccttcatcgagggcagctttgaggagtacctgaagaggctggagaacccccaggagtgggtgggccaggtggagatcagcgccctgagcctgatgtacaggaaggacttcatcatctaccgggagcccaacgtgagccccagccaggtgacagagaacaacttccctgagaaggtgctgctgtgcttcagcaatggaaaccactatgacatcgtgtaccccatcaagtacaaggagagcagcgccatgtgccagagcctgctgtatgagctgctgtatgagaaggtgttcaagacagatgtgtccaagatcgtgatggagctggacaccctggaggtggctgatgaggacaacagcgagatcagtgacagctag

SEQ ID NO: 162891 - DNA, 438 bp, Artificial Sequence; identical to SEQ ID NO: 162887
  Description of Artificial Sequence: Synthetic coding sequence

SEQ ID NO: 162892 - DNA, 1716 bp, Artificial Sequence
  Description of Artificial Sequence: Synthetic coding sequence
atgaccatcctgcccaagaagaagcccccacctccagatgctgaccctgccaatgagcccccacctcctggccccatgcccccagcccccaggagaggaggaggagtgggcgtgggcggcggcggcactggagtgggcggcggggaccgggaccgggacagcggcgtggtgggcgcccggccccgggccagccccccaccccagggccccctgcccggccccccaggggccctgcaccgctgggccctggccgtgcccccaggagctgtggccggcccccggccccagcaggccagccccccaccctgtggcggccctgggggccctgggggcggccctggagatgccctgggcgctgctgctgctggggtgggcgctgctggggtggtggtgggcgtgggcggcgctgtgggcgtgggcggctgctgcagcggccctggccacagcaagagaagacggcaggcccctggggtgggcgctgtgggcggcggcagccctgagcgggaggaggtgggcgccggctacaacagtgaagatgaatatgaagctgctgctgcccgcatcgaggccatggaccctgccaccgtggagcagcaggagcactggtttgagaaggccctgcgggacaagaagggcttcatcatcaagcagatgaaggaggatggagcctgcctcttccgggctgtggccgaccaggtgtatggagaccaggacatgcatgaggtggtgaggaagcactgcatggactacctgatgaagaatgctgactacttcagcaactacgtgacagaggacttcaccacctacatcaacaggaagaggaagaacaactgccacggcaaccacatcgagatgcaggccatggccgagatgtacaacagacctgtggaggtgtaccagtacagcacaggcaccagcgctgtggagcccatcaacaccttccacggcatccaccagaatgaagatgagcccatccgggtgtcctaccacaggaacatccactacaacagcgtggtgaaccccaacaaggccaccatcggcgtgggcctgggcctgcccagcttcaagccaggctttgctgagcagagcctgatgaagaatgccatcaagaccagcgaggagagctggattgagcagcagatgctggaggacaagaagagggccacagactgggaggccaccaatgaggccatcgaggagcaggtggcccgggagagctacctgcagtggctgcgggaccaggagaagcaggcccggcaggtgcggggccccagccagcccaggaaggccagcgccacctgcagcagcgccacagctgctgccagcagcggcctggaggagtggaccagccgcagcccccggcagaggagcagcgccagcagccctgagcaccctgagctgcatgctgagctgggcatgaagccacccagccctggcaccgtgctggccctggccaagccacccagcccctgtgcccctggcaccagcagccagttctctgctggagctgaccgggccaccagccccctggtgtccctgtacccagccctggagtgccgggccctgatccagcagatgagccccagcgccttcggcctgaatgactgggatgatgatgagatcctggcctctgtgctggccgtgtcccagcaggagtacctggacagcatgaagaagaacaaggtgcaccgggaccccccaccagacaagagctag

SEQ ID NO: 162893 - DNA, 1701 bp, Artificial Sequence
  Description of Artificial Sequence: Synthetic coding sequence
atgaccatcctgcccaagaagaagcccccacctccagatgctgaccctgccaatgagcccccacctcctggccccatgcccccagcccccaggagaggaggaggagtgggcgtgggcggcggcggcactggagtgggcggcggggaccgggaccgggacagcggcgtggtgggcgcccggccccgggccagccccccaccccagggccccctgcccggccccccaggggccctgcaccgctgggccctggccgtgcccccaggagctgtggccggcccccggccccagcaggccagccccccaccctgtggcggccctgggggccctgggggcggccctggagatgccctgggcgctgctgctgctggggtgggcgctgctggggtggtggtgggcgtgggcggcgctgtgggcgtgggcggctgctgcagcggccctggccacagcaagagaagacggcaggcccctggggtgggcgctgtgggcggcggcagccctgagcgggaggaggtgggcgccggctacaacagtgaagatgaatatgaagctgctgctgcccgcatcgaggccatggaccctgccaccgtggagcagcaggagcactggtttgagaaggccctgcgggacaagaagggcttcatcatcaagcagatgaaggaggatggagcctgcctcttccgggctgtggccgaccaggtgtatggagaccaggacatgcatgaggtggtgaggaagcactgcatggactacctgatgaagaatgctgactacttcagcaactacgtgacagaggacttcaccacctacatcaacaggaagaggaagaacaactgccacggcaaccacatcgagatgcaggccatggccgagatgtacaacagacctgtggaggtgtaccagtacagcacagagcccatcaacaccttccacggcatccaccagaatgaagatgagcccatccgggtgtcctaccacaggaacatccactacaacagcgtggtgaaccccaacaaggccaccatcggcgtgggcctgggcctgcccagcttcaagccaggctttgctgagcagagcctgatgaagaatgccatcaagaccagcgaggagagctggattgagcagcagatgctggaggacaagaagagggccacagactgggaggccaccaatgaggccatcgaggagcaggtggcccgggagagctacctgcagtggctgcgggaccaggagaagcaggcccggcaggtgcggggccccagccagcccaggaaggccagcgccacctgcagcagcgccacagctgctgccagcagcggcctggaggagtggaccagccgcagcccccggcagaggagcagcgccagcagccctgagcaccctgagctgcacgccgagctgggcatgaagccacccagccctggcaccgtgctggccctggccaagccacccagcccctgtgcccctggcaccagcagccagttctctgctggagctgaccgggccaccagccccctggtgtccctgtacccagccctggagtgccgggccctgatccagcagatgagccccagcgccttcggcctgaatgactgggatgatgatgagatcctggcctctgtgctggccgtgtcccagcaggagtacctggacagcatgaagaagaacaaggtgcaccgggaccccccaccagacaagagctag

SEQ ID NO: 162894 - DNA, 1701 bp, Artificial Sequence; identical to SEQ ID NO: 162893
  Description of Artificial Sequence: Synthetic coding sequence

SEQ ID NO: 162895 - DNA, 1050 bp, Artificial Sequence
  Description of Artificial Sequence: Synthetic coding sequence
atgaaggaggatggagcctgcctcttccgggctgtggccgaccaggtgtatggagaccaggacatgcatgaggtggtgaggaagcactgcatggactacctgatgaagaatgctgactacttcagcaactacgtgacagaggacttcaccacctacatcaacaggaagaggaagaacaactgccacggcaaccacatcgagatgcaggccatggccgagatgtacaacagacctgtggaggtgtaccagtacagcacagagcccatcaacaccttccacggcatccaccagaatgaagatgagcccatccgggtgtcctaccacaggaacatccactacaacagcgtggtgaaccccaacaaggccaccatcggcgtgggcctgggcctgcccagcttcaagccaggctttgctgagcagagcctgatgaagaatgccatcaagaccagcgaggagagctggattgagcagcagatgctggaggacaagaagagggccacagactgggaggccaccaatgaggccatcgaggagcaggtggcccgggagagctacctgcagtggctgcgggaccaggagaagcaggcccggcaggtgcggggccccagccagcccaggaaggccagcgccacctgcagcagcgccacagctgctgccagcagcggcctggaggagtggaccagccgcagcccccggcagaggagcagcgccagcagccctgagcaccctgagctgcatgctgagctgggcatgaagccacccagccctggcaccgtgctggccctggccaagccacccagcccctgtgcccctggcaccagcagccagttctctgctggagctgaccgggccaccagccccctggtgtccctgtacccagccctggagtgccgggccctgatccagcagatgagccccagcgccttcggcctgaatgactgggatgatgatgagatcctggcctctgtgctggccgtgtcccagcaggagtacctggacagcatgaagaagaacaaggtgcaccgggaccccccaccagacaagagctag

SEQ ID NO: 162896 - DNA, 1629 bp, Artificial Sequence
  Description of Artificial Sequence: Synthetic coding sequence
atgaccatcctgcccaagaagaagcccccacctccagatgctgaccccggcggcactggagtgggcggcggggaccgggaccgggacagcggcgtggtgggcgcccggccccgggccagccccccaccccagggccccctgcccggccccccaggggccctgcaccgctgggccctggccgtgcccccaggagctgtggccggcccccggccccagcaggccagccccccaccctgtggcggccctgggggccctgggggcggccctggagatgccctgggcgctgctgctgctggggtgggcgctgctggggtggtggtgggcgtgggcggcgctgtgggcgtgggcggctgctgcagcggccctggccacagcaagagaagacggcaggcccctggggtgggcgctgtgggcggcggcagccctgagcgggaggaggtgggcgccggctacaacagtgaagatgaatatgaagctgctgctgcccgcatcgaggccatggaccctgccaccgtggagcagcaggagcactggtttgagaaggccctgcgggacaagaagggcttcatcatcaagcagatgaaggaggatggagcctgcctcttccgggctgtggccgaccaggtgtatggagaccaggacatgcatgaggtggtgaggaagcactgcatggactacctgatgaagaatgctgactacttcagcaactacgtgacagaggacttcaccacctacatcaacaggaagaggaagaacaactgccacggcaaccacatcgagatgcaggccatggccgagatgtacaacagacctgtggaggtgtaccagtacagcacagagcccatcaacaccttccacggcatccaccagaatgaagatgagcccatccgggtgtcctaccacaggaacatccactacaacagcgtggtgaaccccaacaaggccaccatcggcgtgggcctgggcctgcccagcttcaagccaggctttgctgagcagagcctgatgaagaatgccatcaagaccagcgaggagagctggattgagcagcagatgctggaggacaagaagagggccacagactgggaggccaccaatgaggccatcgaggagcaggtggcccgggagagctacctgcagtggctgcgggaccaggagaagcaggcccggcaggtgcggggccccagccagcccaggaaggccagcgccacctgcagcagcgccacagctgctgccagcagcggcctggaggagtggaccagccgcagcccccggcagaggagcagcgccagcagccctgagcaccctgagctgcacgccgagctgggcatgaagccacccagccctggcaccgtgctggccctggccaagccacccagcccctgtgcccctggcaccagcagccagttctctgctggagctgaccgggccaccagccccctggtgtccctgtacccagccctggagtgccgggccctgatccagcagatgagccccagcgccttcggcctgaatgactgggatgatgatgagatcctggcctctgtgctggccgtgtcccagcaggagtacctggacagcatgaagaagaacaaggtgcaccgggaccccccaccagacaagagctag

SEQ ID NO: 162897 - DNA, 1335 bp, Artificial Sequence
  Description of Artificial Sequence: Synthetic coding sequence
ggtgtggtggtgggcgtgggcggcgctgtgggcgtgggcggctgctgcagcggccctggccacagcaagagaagacggcaggcccctggggtgggcgctgtgggcggcggcagccctgagcgggaggaggtgggcgccggctacaacagtgaagatgaatatgaggccgccgccgccagaattgaggccatggaccctgccaccgtggagcagcaggagcactggtttgagaaggccctgcgggacaagaagggcttcatcatcaagcagatgaaggaggatggagcctgcctcttccgggctgtggccgaccaggtgtatggagaccaggacatgcatgaggtggtgaggaagcactgcatggactacctgatgaagaatgctgactacttcagcaactacgtgacagaggacttcaccacctacatcaacaggaagaggaagaacaactgccacggcaaccacatcgagatgcaggccatggccgagatgtacaacagacctgtggaggtgtaccagtacagcacaggcaccagcgctgtggagcccatcaacaccttccacggcatccaccagaatgaagatgagcccatccgggtgtcctaccacaggaacatccactacaacagcgtggtgaaccccaacaaggccaccatcggcgtgggcctgggcctgcccagcttcaagccaggctttgctgagcagagcctgatgaagaatgccatcaagaccagcgaggagagctggattgagcagcagatgctggaggacaagaagagggccacagactgggaggccaccaatgaggccatcgaggagcaggtggcccgggagagctacctgcagtggctgcgggaccaggagaagcaggcccggcaggtgcggggccccagccagcccaggaaggccagcgccacctgcagcagcgccacagctgctgccagcagcggcctggaggagtggaccagccgcagcccccggcagaggagcagcgccagcagccctgagcaccctgagctgcacgccgagctgggcatgaagccacccagccctggcaccgtgctggccctggccaagccacccagcccctgtgcccctggcaccagcagccagttctctgctggagctgaccgggccaccagccccctggtgtccctgtacccagccctggagtgccgggccctgatccagcagatgagccccagcgccttcggcctgaatgactgggatgatgatgagatcctggcctctgtgctggccgtgtcccagcaggagtacctggacagcatgaagaagaacaaggtgcaccgggaccccccaccagacaagagctag

SEQ ID NO: 162898 - DNA, 867 bp, Artificial Sequence
  Description of Artificial Sequence: Synthetic coding sequence
atggatgaccccaagtctgagcagcagaggatcctgcggcggcaccagcgggagcggcaggagctgcaggcccagatccgcagcctgaagaacagcgtgcccaagacagacaagaccaagaggaagcagctgctgcaggatgtggccaggatggaggccgagatggcccagaagcaccggcaggagctggagaagttccaggatgacagcagcattgagagcgtggtggaggacctggccaagatgaacctggagaaccggccccccaggagcagcaaggcccacaggaagcgggagaggatggagagcgaggagcgggagcggcaggagagcatcttccaggccgagatgtctgagcacctggccggcttcaagcgggaggaggaggagaagctggccgccatcctgggcgcccggggcctggagatgaaggccatcccagcagatggccactgcatgtaccgggccatccaggaccagctggtgttttctgtgtctgtggagatgctgcgctgcaggacagccagctacatgaagaagcacgtggatgagttcctgcccttcttcagcaaccctgagaccagtgacagctttggctatgatgacttcatgatctactgtgacaacatcgtgaggaccacagcctggggcggccagctggagctgcgggccctgagccacgtgctgaagacccccattgaagtcatccaggccgacagccccaccctcatcattggagaggagtatgtgaagaagcccatcatcctggtgtacctgcgctatgcctacagcctgggggagcactacaacagcgtgacccccctggaggccggggccgccggcggcgtgctgccccggctgctgtag

SEQ ID NO: 162899 - DNA, 972 bp, Artificial Sequence
  Description of Artificial Sequence: Synthetic coding sequence
atggagccccgggtgcgggtggagggctggaaggtgcccaccagccgctgccgcttcctgctggcccgggtgctgggctacctggtggtgatggaggccgtgctgacagaggagctggatgaggaggagcagctgctgcggcggcacaggaaggagaagaaggagctgcaggccaagatccagggcatgaagaatgctgtgcccaagaatgacaagaagaggaggaagcagctgacagaagatgtggccaagctggagaaggagatggagcagaagcaccgggaggagctggagcagctgaagctgaccaccaaggagaacaagattgattctgtggccgtgaacatcagcaacctggtgctggagaaccagcccccacgcatcagcaaggcccagaagaggcgggagaagaaggccgccctggagaaggagcgggaggagagaattgctgaggccgagattgagaacctgaccggggcccggcacatggagagcgagaagctggcccagatcctggccgcccggcagctggagatcaagcagatccccagtgatggccactgcatgtacaaggccatcgaggaccagctgaaggagaaggactgtgccctgactgtggtggccctgcggagccagacagctgagtacatgcagagccacgtggaggacttcctgcccttcctgaccaaccccaacacaggagacatgtacaccccagaggagttccagaagtactgtgaagatattgtgaacacagctgcctggggcggccagctggagctgcgggccctgagccacatcctgcagacccccatcgagatcatccaggccgacagcccccccatcatcgtgggggaggagtacagcaagaagcccctcatcctggtgtacatgagacatgcctacggcctgggggagcactacaacagcgtgacccggctggtgaacatcgtgacagagaactgcagctag

SEQ ID NO: 162900 - DNA, 579 bp, Artificial Sequence
  Description of Artificial Sequence: Synthetic coding sequence
atgatcagcaaggagaagaaggccgccctggagaaggagcgggaggagagaattgctgaggccgagattgagaacctgactggagcccggcacatggagagcgagaagctggcccagatcctggccgcccggcagctggagatcaagcagatccccagtgatggccactgcatgtacaaggccatcgaggaccagctgaaggagaaggactgtgccctgactgtggtggccctgcggagccagacagctgagtacatgcagagccacgtggaggacttcctgcccttcctgaccaaccccaacacaggagacatgtacaccccagaggagttccagaagtactgtgaggacatcgtgaacacagctgcctggggcggccagctggagctgcgggccctgagccacatcctgcagacccccatcgagatcatccaggccgacagcccccccatcatcgtgggggaggagtacagcaagaagcccctcatcctggtgtacatgagacatgcctacggcctgggggagcactacaacagcgtgacccggctggtgaacatcgtgacagagaactgcagctag

SEQ ID NO: 162901 - DNA, 2781 bp, Artificial Sequence
  Description of Artificial Sequence: Synthetic coding sequence
atggtgtcctctgtgctgcccaaccccaccagcgctgagtgctgggccgccctgctgcatgaccccatgaccctggacatggatgctgtgctgagtgactttgtgcgcagcactggagctgagcccggcctggcccgggacctgctggagggcaagaactgggacctgacagctgccctgagtgactatgagcagctgcggcaggtgcacacagccaacctgccccacgtgttcaatgaaggccggggccccaagcagcctgagcgggagccccagcccggccacaaggtggagcggccctgcctgcagaggcaggatgacatcgcccaggagaagaggctgagccggggcatcagccacgccagcagcgccatcgtgtccctggcccggagccacgtggccagcgagtgcaacaatgagcagttccccctggagatgcccatctacaccttccagctgcctgacctgtctgtgtacagcgaggacttccgctccttcatcgagcgggacctgattgagcaggccaccatggtggccctggagcaggccggccgcctgaactggtggagcacagtgtgcaccagctgcaagaggctgctgcccctggccaccactggagatggcaactgcctgctgcacgccgccagcctgggcatgtggggcttccatgaccgggacctggtgctgaggaaggccctgtacaccatgatgaggactggagctgagcgggaggccctgaagaggcgctggcgctggcagcagacccagcagaacaaggaggaggagtgggagcgggagtggacagagctgctgaagctggccagcagcgagcccaggacccacttcagcaagaatggaggcaccggcggcggcgtggacaacagcgaggaccctgtgtatgagagcctggaggagttccacgtgtttgtgctggcccacatcctgcggcggcccatcgtggtggtggccgacaccatgctgcgggacagcggcggggaggcctttgcccccatcccctttggaggcatctacctgcccctggaggtgccccccaaccgctgccactgcagccccctggtgctggcctatgaccaggcccacttcagcgccctggtgtccatggagcagagggaccagcagcgggagcaggccgtcatccccctgacagattctgagcacaagctgctgcccctgcactttgctgtggaccccgggaaggactgggagtggggcaaggatgacaatgacaatgcccggctggcccacctgatcctgagcctggaggccaagctgaacctgctgcacagctacatgaatgtgacctggatccgcatccccagcgagacccgggcccccctggcccagcctgagagccccacagccagcgctggagaagatgtgcagagcctggccgacagcctggacagcgaccgggacagcgtgtgcagcaacagcaacagcaacaacgggaagaatggcaaggacaaggagaaggagaagcagaggaaggagaaggacaagaccagggctgacagcgtggccaacaagctgggcagcttcagcaagaccctgggcatcaagctgaagaagaacatgggcggcctgggcggcctggtgcacggcaagatgggccgggccaacagcgccaacgggaagaatggagacagcgctgagcggggcaaggagaagaaggccaagagcaggaagggcagcaaggaggagagcggggccagcgccagcaccagccccagcgagaagaccacccccagccccacagacaaggccgccggggccagccctgctgagaagggcggcggccccagaggagatgcctggaagtacagcacagatgtgaagctgagcctgaacatcctgcgggccgccatgcagggcgagaggaagttcatctttgctggcctgctgctgaccagccaccgccaccagttccacgaggagatgattggctactacctgaccagcgcccaggagcgcttctctgctgagcaggagcagaggagaagagatgctgccacagctgctgctgctgctgctgctgctgctgctgccacagccaagaggcctccccggcggcctgagacagagggcgtgcctgtgcctgagcgggccagccctggcccccccacccagctggtgctgaagctgaaggagcggcccagccctggccctgctgctggccgggccgcccgggctgctgctgggggcacagccagccctgggggcggggcccggcgggccagcgccagcggccctgtgcccggccgcagccccccagccccagcccggcagagcgtcatccacgtgcaggccagcggggccagagatgaggcctgtgccccagctgtgggcgccctgcggccctgtgccacctacccccagcagaacagaagcctgagcagccagagctacagccctgcccgggctgctgccctgaggacagtgaacacagtggagagcctggcccgggctgtgcctggggccctgcctggagctgctggaacagctggagctgctgagcacaagagccagacctacaccaatggatttggagccctgagagatggcctggagtttgctgatgctgatgcccccacagcccggagcaatggagaatgtggccggggcggccctggccctgtgcagaggcgctgccagcgggagaactgtgccttctacggccgggcagagacagagcactactgcagctactgctaccgggaggagctgcggcggcggcgggaggcccggggggcccggccctag

SEQ ID NO: 162902 - DNA, 2802 bp, Artificial Sequence
  Description of Artificial Sequence: Synthetic coding sequence
atggtgtcctctgtgctgcccaaccccaccagcgctgagtgctgggccgccctgctgcatgaccccatgaccctggacatggatgctgtgctgagtgactttgtgcgcagcactggagctgagcccggcctggcccgggacctgctggagggcaagaactgggacctgacagctgccctgagtgactatgagcagctgcggcaggtgcacacagccaacctgccccacgtgttcaatgaaggccggggccccaagcagcctgagcgggagccccagcccggccacaaggtggagcggccctgcctgcagaggcaggatgacatcgcccaggagaagaggctgagccggggcatcagccacgccagcagcgccatcgtgtccctggcccggagccacgtggccagcgagtgcaacaatgagcagttccccctggagatgcccatctacaccttccagctgcctgacctgtctgtgtacagcgaggacttccgctccttcatcgagcgggacctgattgagcaggccaccatggtggccctggagcaggccggccgcctgaactggtggagcacagtgtgcaccagctgcaagaggctgctgcccctggccaccactggagatggcaactgcctgctgcacgccgccagcctgggcatgtggggcttccatgaccgggacctggtgctgaggaaggccctgtacaccatgatgaggactggagctgagcgggaggccctgaagaggcgctggcgctggcagcagacccagcagaacaaggagagcggcctggtgtacacagaggaggagtgggagcgggagtggacagagctgctgaagctggccagcagcgagcccaggacccacttcagcaagaatggaggcactggaggcggcgtggacaacagtgaagatcctgtgtatgagagcctggaggagttccacgtgtttgtgctggcccacatcctgcggcggcccatcgtggtggtggccgacaccatgctgcgggacagcggcggggaggcctttgcccccatcccctttggaggcatctacctgcccctggaggtgccccccaaccgctgccactgcagccccctggtgctggcctatgaccaggcccacttcagcgccctggtgtccatggagcagagggaccagcagcgggagcaggccgtcatccccctgacagacagcgagcacaagctgctgcccctgcactttgctgtggaccccgggaaggactgggagtggggcaaggatgacaatgacaatgcccggctggcccacctgatcctgagcctggaggccaagctgaacctgctgcacagctacatgaatgtgacctggatccgcatccccagcgagacccgggcccccctggcccagcctgagagccccacagccagcgctggggaggatgtgcagagcctggccgacagcctggacagcgaccgggacagcgtgtgcagcaacagcaacagcaacaacgggaagaatggcaaggacaaggagaaggagaagcagaggaaggagaaggacaagaccagggctgacagcgtggccaacaagctgggcagcttcagcaagaccctgggcatcaagctgaagaagaacatgggcggcctgggcggcctggtgcacggcaagatgggccgggccaacagcgccaacgggaagaatggagacagcgctgagcggggcaaggagaagaaggccaagagcaggaagggcagcaaggaggagagcggggccagcgccagcaccagccccagcgagaagaccacccccagccccacagacaaggctgctggggccagccctgctgagaagggcggcggccccagaggagatgcctggaagtacagcacagatgtgaagctgagcctgaacatcctgcgggccgccatgcagggcgagaggaagttcatctttgctggcctgctgctgaccagccaccgccaccagttccacgaggagatgattggctactacctgaccagcgcccaggagcgcttctctgctgagcaggagcagaggagaagagatgctgccacagctgctgctgctgctgctgctgctgctgctgccacagccaagaggcccccaagaagacctgagacagaaggagtgcctgtgcctgagcgggccagccctggcccccccacccagctggtgctgaagctgaaggagcggcccagccctggccctgctgctggccgggccgcccgggctgctgctgggggcacagccagccctgggggcggggcccggcgggccagcgccagcggccctgtgcccggccgcagccccccagccccagcccggcagagcgtcatccacgtgcaggccagcggggccagagatgaggcctgtgccccagctgtgggcgccctgcggccctgtgccacctacccccagcagaacagaagcctgagcagccagagctacagccctgcccgggccgccgccctgaggacagtgaacacagtggagagcctggcccgggctgtgcctggggccctgcccggggctgctggaacagctggagctgctgagcacaagagccagacctacaccaacggctttggagccctgagagatggcctggagtttgctgatgctgatgcccccacagcccggagcaatggagaatgtggccggggcggccctggccctgtgcagaggcgctgccagcgggagaactgtgccttctacggccgggcagagacagagcactactgcagctactgctaccgggaggagctgcggaggagaagagaggcccggggggcccggccctag

SEQ ID NO: 162903 - DNA, 333 bp, Artificial Sequence
  Description of Artificial Sequence: Synthetic coding sequence
atggtgtcctctgtgctgcccaaccccaccagcgctgagtgctgggccgccctgctgcatgaccccatgaccctggacatggatgctgtgctgagtgactttgtgcgcagcactggagctgagcccggcctggcccgggacctgctggagggcaagaactgggacctgacagctgccctgagtgactatgagcagctgcggcaggtgcacacagccaacctgccccacgtgttcaatgaaggccggggccccaagcagcctgagcgggagccccagcccggccacaaggtggagcggccctgcctgcagaggcaggatgacatcgcccagtag

SEQ ID NO: 162904 - DNA, 2532 bp, Artificial Sequence
  Description of Artificial Sequence: Synthetic coding sequence
atgaccctggacatggatgctgtgctgagtgactttgtgcgcagcactggagctgagcccggcctggcccgggacctgctggagggcaagaactgggatgtgaatgctgccctgagtgactttgagcagctgcggcaggtgcatgctggcaacctgcccccatccttcagcgagggcagcggcggcagcaggaccccagagaagggcttcagtgaccgggagcccacccggcccccccggcccatcctgcagaggcaggatgacatcgtgcaggagaagaggctgagccggggcatcagccacgccagcagcagcatcgtgtccctggcccggagccacgtgagcagcaatggaggcggcggcggcagcaatgagcaccccctggagatgcccatctgtgccttccagctgcctgacctgactgtgtacaatgaagacttccgctccttcatcgagcgggacctgattgagcagagcatgctggtggccctggagcaggccggccgcctgaactggtgggtgtctgtggaccccaccagccagaggctgctgcccctggccaccactggagatggcaactgcctgctgcacgccgccagcctgggcatgtggggcttccatgaccgggacctgatgctgaggaaggccctgtatgccctgatggagaagggcgtggagaaggaggccctgaagaggcgctggcgctggcagcagacccagcagaacaaggagagcggcctggtgtacacagaagatgagtggcagaaggagtggaatgaactcatcaagctggccagcagcgagcccaggatgcacctgggcaccaacggggccaactgtggcggcgtggagagcagcgaggagcctgtgtatgagagcctggaggagttccacgtgtttgtgctggcccacgtgctgcggcggcccatcgtggtggtggccgacaccatgctgcgggacagcggcggggaggcctttgcccccatcccctttggaggcatctacctgcccctggaggtgcctgccagccagtgccacaggagccccctggtgctggcctatgaccaggcccacttcagcgccctggtgtccatggagcagaaggagaacaccaaggagcaggccgtcatccccctgacagacagcgagtacaagctgctgcccctgcactttgctgtggaccccgggaagggctgggagtggggcaaggatgacagcgacaacgtgcggctggccagcgtcatcctgagcctggaggtgaagctgcacctgctgcacagctacatgaatgtgaagtggatccccctgagcagtgatgcccaggcccccctggcccagcctgagagccccacagccagcgctggagatgagcccaggagcaccccagagagcggggacagcgacaaggagagcgtgggcagcagcagcaccagcaatgaaggaggaagaaggaaggagaagagcaagagggaccgggagaaggacaagaagagagctgacagcgtggccaacaagctgggcagctttgggaagaccctgggcagcaagctgaagaagaacatgggcggcctgatgcacagcaagggcagcaagccaggcggcgtgggcaccggcctgggcggcagcagcggcacagagaccctggagaagaagaagaagaacagcctgaagtcctggaagggcggcaaggaggaggccgctggagatggccctgtgtctgagaagcccccagctgagagcgtgggcaatggaggcagcaagtacagccaggaggtgatgcagagcctgagcatcctgaggacagccatgcagggcgagggcaagttcatctttgtgggcaccctgaagatgggccaccgccaccagtaccaggaggagatgatccagcgctacctgagtgatgctgaggagcgcttcctggccgagcagaagcagaaggaggccgagaggaagatcatgaatggaggcattggaggcggccccccaccagccaagaagccagagccagatgcccgggaggagcagcccactggacctcctgctgagagccgggccatggccttcagcacaggctacccaggggacttcaccatcccccggcccagcggcggcggcgtgcactgccaggagccccggcggcagctggccggcggcccctgtgtgggcggcctgcccccctatgccaccttcccccggcagtgccccccaggccggccctacccccaccaggacagcatccccagcctggagcccggcagccacagcaaggatggcctgcacagaggagccctgctgcccccaccctacagagtggccgacagctacagcaatggctaccgggagcccccagagccagatggctgggccggcggcctgcggggcctgccccccacccagaccaagtgcaagcagcccaactgcagcttctacggccaccctgagaccaacaacttctgcagctgctgctaccgggaggagctgcggcggcgggagcgggagccagatggagagctgctggtgcaccgcttctag

SEQ ID NO: 162905 - DNA, 1284 bp, Artificial Sequence
  Description of Artificial Sequence: Synthetic coding sequence
atgaccctggacatggatgctgtgctgagtgactttgtgcgcagcactggagctgagcccggcctggcccgggacctgctggagggcaagaactgggatgtgaatgctgccctgagtgactttgagcagctgcggcaggtgcatgctggcaacctgcccccatccttcagcgagggcagcggcggcagcaggaccccagagaagggcttcagtgaccgggagcccacccggcccccccggcccatcctgcagaggcaggatgacatcgtgcaggagaagaggctgagccggggcatcagccacgccagcagcagcatcgtgtccctggcccggagccacgtgagcagcaatggaggcggcggcggcagcaatgagcaccccctggagatgcccatctgtgccttccagctgcctgacctgactgtgtacaatgaagacttccgctccttcatcgagcgggacctgattgagcagagcatgctggtggccctggagcaggccggccgcctgaactggtgggtgtctgtggaccccaccagccagaggctgctgcccctggccaccactggagatggcaactgcctgctgcacgccgccagcctgggcatgtggggcttccatgaccgggacctgatgctgaggaaggccctgtatgccctgatggagaagggcgtggagaaggaggccctgaagaggcgctggcgctggcagcagacccagcagaacaaggagagcggcctggtgtacacagaagatgagtggcagaaggagtggaatgaactcatcaagctggccagcagcgagcccaggatgcacctgggcaccaacggggccaactgtggcggcgtggagagcagcgaggagcctgtgtatgagagcctggaggagttccacgtgtttgtgctggcccacgtgctgcggcggcccatcgtggtggtggccgacaccatgctgcgggacagcggcggggaggcctttgcccccatcccctttggaggcatctacctgcccctggaggtgcctgccagccagtgccacaggagccccctggtgctggcctatgaccaggcccacttcagcgccctggtgtccatggagcagaaggagaacaccaaggagcaggccgtcatccccctgacagacagcgagtacaagctgctgcccctgcactttgctgtggaccccgggaagggctgggagtggggcaaggatgacagcgacaacgtgcggctggccagcgtcatcctgagcctggaggtgaagctgcacctgctgcacagctag

SEQ ID NO: 162906 - DNA, 2445 bp, Artificial Sequence
  Description of Artificial Sequence: Synthetic coding sequence
atgaccctggacatggatgctgtgctgagtgactttgtgcgcagcactggagctgagcccggcctggcccgggacctgctggagggcaagaactgggatgtgaatgctgccctgagtgactttgagcagctgcggcaggtgcatgctggcaacctgcccccatccttcagcgagggcagcggcggcagcaggaccccagagaagggcttcagtgaccgggagcccacccggcccccccggcccatcctgcagaggcaggatgacatcgtgcaggagaagaggctgagccggggcatcagccacgccagcagcagcatcgtgtccctggcccggagccacgtgagcagcaatggaggcggcggcggcagcaatgagcaccccctggagatgcccatctgtgccttccagctgcctgacctgactgtgtacaatgaagacttccgctccttcatcgagcgggacctgattgagcagagcatgctggtggccctggagcaggccggccgcctgaactggtgggtgtctgtggaccccaccagccagaggctgctgcccctggccaccactggagatggcaactgcctgctgcacgccgccagcctgggcatgtggggcttccatgaccgggacctgatgctgaggaaggccctgtatgccctgatggagaagggcgtggagaaggaggccctgaagaggcgctggcgctggcagcagacccagcagaacaaggagagcggcctggtgtacacagaagatgagtggcagaaggagtggaatgaactcatcaagctggccagcagcgagcccaggatgcacctgggcaccaacggggccaactgtggcggcgtggagagcagcgaggagcctgtgtatgagagcctggaggagttccacgtgtttgtgctggcccacgtgctgcggcggcccatcgtggtggtggccgacaccatgctgcgggacagcggcggggaggcctttgcccccatcccctttggaggcatctacctgcccctggaggtgcctgccagccagtgccacaggagccccctggtgctggcctatgaccaggcccacttcagcgccctggtgtccatggagcagaaggagaacaccaaggagcaggccgtcatccccctgacagacagcgagtacaagctgctgcccctgcactttgctgtggaccccgggaagggctgggagtggggcaaggatgacagcgacaacgtgcggctggccagcgtcatcctgagcctggaggtgaagctgcacctgctgcacagctacatgaatgtgaagtggatccccctgagcagtgatgcccaggcccccctggcccagcctgagagccccacagccagcgctggagatgagcccaggagcaccccagagagcggggacagcgacaaggagagcgtgggcagcagcagcaccagcaatgaaggaggaagaaggaaggagaagagcaagagggaccgggagaaggacaagaagagagctgacagcgtggccaacaagctgggcagctttgggaagaccctgggcagcaagctgaagaagaacatgggcggcctgatgcacagcaagggcagcaagccaggcggcgtgggcaccggcctgggcggcagcagcggcacagagaccctggagaagaagaagaagaacagcctgaagtcctggaagggcggcaaggaggaggccgctggagatggccctgtgtctgagaagcccccagctgagagcgtgggcaatggaggcagcaagtacagccaggaggtgatgcagagcctgagcatcctgaggacagccatgcagggcgagggcaagttcatctttgtgggcaccctgaagatgggccaccgccaccagtaccaggaggagatgatccagcgctacctgagtgatgctgaggagcgcttcctggccgagcagaagcagaaggaggccgagaggaagatcatgaatggaggcattggaggcggccccccaccagccaagaagccagagccagatgcccgggaggagcagcccactggacctcctgctgagagccgggccatggccttcagcacaggctacccaggggacttcaccatcccccggcccagcggcggcggcgtgcactgccaggagccccggcggcagctggccggcggcccctgtgtgggcggcctgcccccctatgccaccttcccccggcagtgccccccaggccggccctacccccaccaggacagcatccccagcctggagcccggcagccacagcaaggatggcctgcacagaggagccctgctgcccccaccctacagagtggccgacagctacagcaatggctaccgggagcccccagagccagatggctgggccggcggcctgcggggcctgccccccacccagaccaagtgcaagcagccagatggagagctgctggtgcaccgcttctag

SEQ ID NO: 162907 - DNA, 927 bp, Artificial Sequence
  Description of Artificial Sequence: Synthetic coding sequence
atgtgtggggtggagggctgctgccagggcggggccacccggcggggcagcctgcccggcggccggcagctggccaccaggaagaggtctgtggtgcggcgctgcctgaagatggctgctgaggagccccagcagcagaagcaggagcccctgggcagtgacagcgagggcgtgaactgcctggcctatgatgaggccatcatggcccagcaggaccgcatccagcaggagattgctgtgcagaaccccctggtgtctgagcggctggagctgtctgtgctgtacaaggagtatgcagaagatgacaacatctaccagcagaagatcaaggacctgcacaagaagtacagctacatcaggaagaccaggccagatggcaactgcttctaccgggccttcggcttcagccacctggaggccctgctggatgacagcaaggagctgcagcgcttcaaggctgtgtctgccaagagcaaggaggacctggtgtcccagggcttcacagagttcaccatcgaggacttccacaacaccttcatggacctgattgagcaggtggagaagcagacctctgtggccgacctgctggccagcttcaatgaccagagcaccagtgactacctggtggtgtacctgcggctgctgaccagcggctacctgcagcgggagagcaagttctttgagcacttcattgaaggaggccgcacagtgaaggagttctgccagcaggaggtggagcccatgtgcaaggagagtgaccacatccacatcatcgccctggcccaggccctgtctgtgtccatccaggtggagtacatggacagaggagagggcggcaccaccaacccccacatcttccctgagggcagcgagcccaaggtgtacctgctgtaccggcccggccactatgacatcctgtacaagtag

SEQ ID NO: 162908 - DNA, 816 bp, Artificial Sequence
  Description of Artificial Sequence: Synthetic coding sequence
atggctgctgaggagccccagcagcagaagcaggagcccctgggcagtgacagcgagggcgtgaactgcctggcctatgatgaggccatcatggcccagcaggaccgcatccagcaggagattgctgtgcagaaccccctggtgtctgagcggctggagctgtctgtgctgtacaaggagtatgcagaagatgacaacatctaccagcagaagatcaaggacctgcacaagaagtacagctacatcaggaagaccaggccagatggcaactgcttctaccgggccttcggcttcagccacctggaggccctgctggatgacagcaaggagctgcagcgcttcaaggctgtgtctgccaagagcaaagaagacctggtgtcccagggcttcacagagttcaccatcgaggacttccacaacaccttcatggacctgattgagcaggtggagaagcagacctctgtggccgacctgctggccagcttcaatgaccagagcaccagtgactacctggtggtgtacctgcggctgctgaccagcggctacctgcagcgggagagcaagttctttgagcacttcatcgagggcggccgcacagtgaaggagttctgccagcaggaggtggagcccatgtgcaaggagagtgaccacatccacatcatcgccctggcccaggccctgtctgtgtccatccaggtggagtacatggacagaggagagggcggcaccaccaacccccacatcttccctgagggcagcgagcccaaggtgtacctgctgtacagacctggccactatgacatcctgtacaagtag

SEQ ID NO: 162909 - DNA, 816 bp, Artificial Sequence; identical to SEQ ID NO: 162908
  Description of Artificial Sequence: Synthetic coding sequence

SEQ ID NO: 162910 - DNA, 843 bp, Artificial Sequence
  Description of Artificial Sequence: Synthetic coding sequence
atggctgctgaggagccccagcagcagaagcaggagcccctgggcagtgacagcgagggcgtgaactgcctggcctatgatgaggccatcatggcccagcaggaccgcatccagcaggaggacatgacagacccctgcctgctgcagattgctgtgcagaaccccctggtgtctgagcggctggagctgtctgtgctgtacaaggagtatgcagaagatgacaacatctaccagcagaagatcaaggacctgcacaagaagtacagctacatcaggaagaccaggccagatggcaactgcttctaccgggccttcggcttcagccacctggaggccctgctggatgacagcaaggagctgcagcgcttcaaggctgtgtctgccaagagcaaggaggacctggtgtcccagggcttcacagagttcaccatcgaggacttccacaacaccttcatggacctgattgagcaggtggagaagcagacctctgtggccgacctgctggccagcttcaatgaccagagcaccagtgactacctggtggtgtacctgcggctgctgaccagcggctacctgcagcgggagagcaagttctttgagcacttcattgaaggaggccgcacagtgaaggagttctgccagcaggaggtggagcccatgtgcaaggagagtgaccacatccacatcatcgccctggcccaggccctgtctgtgtccatccaggtggagtacatggacagaggagagggcggcaccaccaacccccacatcttccctgagggcagcgagcccaaggtgtacctgctgtaccggcccggccactatgacatcctgtacaagtag

SEQ ID NO: 162911 - DNA, 705 bp, Artificial Sequence
  Description of Artificial Sequence: Synthetic coding sequence
atgtctgagaccagcttcaacctgatcagcgagaagtgtgacatcctgagcatcctgcgggaccaccctgagaaccgcatctacagaaggaagattgaggagctgagcaagcgcttcaccgccatcaggaagaccaagggagatggcaactgcttctaccgggccctgggctacagctacctggagagcctgctgggcaagagccgggagatcttcaagttcaaggagcgggtgctgcagaccccaaatgacctgctggccgccggctttgaggagcacaagttcaggaacttcttcaatgccttctacagcgtggtggagctggtggagaaggatggctctgtgagcagcctgctgaaggtgttcaatgaccagagcgccagtgaccacatcgtgcagttcctgcggctgctgaccagcgccttcatccggaacagagctgacttcttccgccacttcattgatgaggagatggacatcaaggacttctgcacccatgaggtggagcccatggccacagaatgtgaccacatccagatcacagccctgagccaggccctgagcatcgccctgcaggtggagtatgtggatgagatggacacagccctgaaccaccacgtgtttcctgaggccgccaccccatctgtgtacctgctgtacaagaccagccactacaacatcctgtatgctgctgacaagcactag

SEQ ID NO: 162912 - DNA, 222 bp, Artificial Sequence
  Description of Artificial Sequence: Synthetic coding sequence
atgtctgagaccagcttcaacctgatcagcgagaagtgtgacatcctgagcatcctgcgggaccaccctgagaaccgcatctacagaaggaagattgaggagctgagcaagcgcttcaccgccatcaggaagaccaagggagatggcaactgcttctaccgggccctgggctacagctacctggagagcctgctgggcaagagccgggagatcttcaagtag

SEQ ID NO: 162913 - DNA, 753 bp, Artificial Sequence
  Description of Artificial Sequence: Synthetic coding sequence
atggccgccctgagctgcctgctggacagcgtgcggcgggacatcaagaaggtggaccgggagctgcggcagctgcgctgcattgatgagttcagcacccgctgcctgtgtgacctgtacatgcacccctactgctgctgtgacctgcacccctacccctactgcctgtgctacagcaagaggagccgcagctgtggcctgtgtgacctgtacccctgctgcctgtgtgactacaagctgtactgcctgcggcccagcctgcggagcctggagaggaaggccatccgggccattgaagatgagaagcgggagctggccaagctgcggaggaccaccaaccgcatcctggccagcagctgctgcagcagcaacatcctgggctctgtgaatgtgtgtggctttgagccagaccaggtgaaggtgcgggtgaaggatggcaaggtgtgtgtgtctgctgagagagaaaatagatatgactgcctgggcagcaagaagtacagctacatgaacatctgcaaggagttcagcctgcccccctgtgtggatgagaaggatgtgacctacagctatggcctgggcagctgtgtgaagattgagagcccctgctacccctgcaccagcccctgcagcccctgcagcccctgcagcccctgcaacccctgcagcccctgcaacccctgcagcccctatgacccctgcaacccctgctacccctgtggcagccgcttcagctgcaggaagatgatcctgtag

SEQ ID NO: 162914 - DNA, 2418 bp, Artificial Sequence
  Description of Artificial Sequence: Synthetic coding sequence
atgaaggacaggagcagcaccccacccctgcacgtgcacgtggatgagaacacccctgtgcacgtgcacatcaagaagctgcccaagcccagcgccaccagcagccagaagagccacaagaggggcatgaagggggacacagtgaatgtgagaagatctgtgcgggtgaagaccaagaaccccccccactgcctggagatcaccccacccagcagcgagaagctggtgtctgtgatgaggctgagtgacctgagcacagaagatgatgattctggccactgcaagatgaacagatatgacaagaagattgacagcctgatgaatgctgtgggctgcctgaagtctgaggtgaagatgcagaagggggagcggcagatggccaagcgcttcctggaggagaggaaggaggagctggaggaggtggcccacgagctggccgagacagaacatgaaaatacagtgctgcggcacaacattgaaagaatgaaggaggagaaggacttcaccatcctgcagaagaagcacctgcagcaggagaaggaatgtctgatgagcaagctggtggaggccgagatggatggagctgctgctgccaagcaggtgatggccctgaaggacaccatcggcaagctgaagacagagaagcagatgacctgcacagacatcaacaccctgacccggcagaaggagctgctgctgcagaagctgagcacctttgaggagaccaacagaaccctgcgggacctgctgcgggagcagcactgcaaggaggacagcgagcggctgatggagcagcagggcgccctgctgaagaggctggccgaggccgacagcgagaaggcccggctgctgctgctgctgcaggacaaggacaaggaggtggaggagctgctgcaggagatccagtgtgagaaggcccaggccaagacagccagcgagctgagcaagtccatggagagcatgaggggccacctgcaggcccagctgcggagcaaggaggccgagaacagccggctgtgcatgcagatcaagaacctggagaggagcggcaaccagcacaaggccgaggtggaggccatcatggagcagctgaaggagctgaagcagaagggggaccgggacaaggagagcctgaagaaggccatccgggcccagaaggagagagctgagaagtctgaggagtatgcagagcagctgcacgtgcagctggccgacaaggacctgtatgtggccgaggccctgagcaccctggagagctggaggagccgctacaaccaggtggtgaaggagaagggggacctggagctggagatcatcgtgctgaatgacagagtgacagacctggtgaaccagcagcagaccctggaggagaagatgagagaagatcgggacagcctggtggagcggctgcaccggcagacagctgagtacagcgccttcaagctggagaatgaaaggctgaaggccagctttgcccccatggaggacaagctgaaccaggcccacctggaggtgcagcagctgaaggcctctgtgaagaactatgagggcatgattgacaactacaagagccaggtgatgaagacccggctggaggctgatgaggtggccgcccagctggagcgctgtgacaaggagaacaagatcctgaaggatgagatgaacaaggagattgaggccgcccggcggcagttccagagccagctggccgacctgcagcagctgcctgacatcctgaagatcacagaggccaagctggccgagtgccaggaccagctgcagggctatgaaaggaagaacatcgacctgacagccatcatcagtgacctgcggagccgcatcgagcaccagggcgacaagctggagatggcccgggagaagcaccaggccagccagaaggagaacaagcagctgagcctgaaggtggatgagctggagaggaagctggaggccaccagcgcccagaacatcgagttcctgcaggtgattgccaagcgggaggaggccatccaccagagccagctgcggctggaggagaagaccagagaatgtggcaccctggcccggcagctggagagcgccattgaagatgcccggcggcaggtggagcagaccaaggagcacgccctgagcaaggagagagctgcccagaacaagatcctggacctggagacccagctgagcaggaccaagacagagctgagccagctgcggcgcagcagagatgatgctgaccggcgctaccagagccggctgcaggacctgaaggaccggctggagcagagcgagagcaccaacagatccatgcagaactacgtgcagttcctgaagagcagctatgccaacgtgtttggagatggcccctacagcaccttcctgaccagcagccccatccgcagccgcagccccccagcctag

SEQ ID NO: 162915 - DNA, 2475 bp, Artificial Sequence
  Description of Artificial Sequence: Synthetic coding sequence
atgaaggacaggagcagcaccccacccctgcacgtgcacgtggatgagaacacccctgtgcacgtgcacatcaagaagctgcccaagcccagcgccaccagcagccagaagagccacaagaggggcatgaagggggacacagtgaatgtgagaagatctgtgcgggtgaagaccaaggtgccctggatgcctcctgggaagagcagcgcccggcctgtgggctgcaagtgggagaaccccccccactgcctggagatcaccccacccagcagcgagaagctggtgtctgtgatgaggctgagtgacctgagcacagaagatgatgacagcggccactgcaagatgaacagatatgacaagaagattgacagcctgatgaatgctgtgggctgcctgaagtctgaggtgaagatgcagaagggggagcggcagatggccaagcgcttcctggaggagaggaaggaggagctggaggaggtggcccacgagctggccgagacagaacatgagaacacagtgctgcggcacaacatcgagaggatgaaggaggagaaggacttcaccatcctgcagaagaagcacctgcagcaggagaaggagtgcctgatgagcaagctggtggaggccgagatggatggagctgctgctgccaagcaggtgatggccctgaaggacaccatcggcaagctgaagacagagaagcagatgacctgcacagacatcaacaccctgacccggcagaaggagctgctgctgcagaagctgagcacctttgaggagaccaacagaaccctgcgggacctgctgcgggagcagcactgcaaggaggacagcgagcggctgatggagcagcagggcgccctgctgaagaggctggccgaggccgacagcgagaaggcccggctgctgctgctgctgcaggacaaggacaaggaggtggaggagctgctgcaggagatccagtgtgagaaggcccaggccaagacagccagcgagctgagcaagtccatggagagcatgaggggccacctgcaggcccagctgcggagcaaggaggccgagaacagccggctgtgcatgcagatcaagaacctggagaggagcggcaaccagcacaaggccgaggtggaggccatcatggagcagctgaaggagctgaagcagaagggggaccgggacaaggagagcctgaagaaggccatccgggcccagaaggagcgggcagagaagtctgaggagtatgcagagcagctgcacgtgcagctggccgacaaggacctgtatgtggccgaggccctgagcaccctggagagctggaggagccgctacaaccaggtggtgaaggagaagggggacctggagctggagatcatcgtgctgaatgacagagtgacagacctggtgaaccagcagcagaccctggaggagaagatgagggaggaccgggacagcctggtggagcggctgcaccggcagacagctgagtacagcgccttcaagctggagaatgaaaggctgaaggccagctttgcccccatggaggacaagctgaaccaggcccacctggaggtgcagcagctgaaggcctctgtgaagaactatgagggcatgattgacaactacaagagccaggtgatgaagacccggctggaggctgatgaggtggccgcccagctggagcgctgtgacaaggagaacaagatcctgaaggatgagatgaacaaggagattgaagctgcccggcggcagttccagagccagctggccgacctgcagcagctgcctgacatcctgaagatcacagaggccaagctggccgagtgccaggaccagctgcagggctatgaaaggaagaacatcgacctgacagccatcatcagtgacctgcggagcagaattgagcaccagggcgacaagctggagatggcccgggagaagcaccaggccagccagaaggagaacaagcagctgagcctgaaggtggatgagctggagaggaagctggaggccaccagcgcccagaacatcgagttcctgcaggtgattgccaagcgggaggaggccatccaccagagccagctgcggctggaggagaagacccgggagtgtggcaccctggcccggcagctggagagcgccattgaagatgcccggcggcaggtggagcagaccaaggagcacgccctgagcaaggagcgggccgcccagaacaagatcctggacctggagacccagctgagcaggaccaagacagagctgagccagctgcggcgcagcagagatgatgctgaccggcgctaccagagccggctgcaggacctgaaggaccggctggagcagagcgagagcaccaacagatccatgcagaactacgtgcagttcctgaagagcagctatgccaacgtgtttggagatggcccctacagcaccttcctgaccagcagccccatccgcagccgcagccccccagcctag

SEQ ID NO: 162916 - DNA, 1917 bp, Artificial Sequence
  Description of Artificial Sequence: Synthetic coding sequence
atgtctgccagcagcagcggcggcagcccccgcttccccagctgtgggaagaatggagtgaccagcctgacccagaagaaggtgctgcgggccccctgtggggcccccagcgtgacagtgaccaagagccacaagaggggcatgaagggggacacagtgaatgtgcggcgctctgtgcgggtgaagaccaagaaccccccccactgcctggagatcaccccacccagcagcgagaagctggtgtctgtgatgaggctgagtgacctgagcacagaagatgatgacagcggccactgcaagatgaacagatatgacaagaagattgacagcctgatgaatgctgtgggctgcctgaagtctgaggtgaagatgcagaagggggagcggcagatggccaagcgcttcctggaggagaggaaggaggagctggaggaggtggcccacgagctggccgagacagaacatgagaacacagtgctgcggcacaacatcgagaggatgaaggaggagaaggacttcaccatcctgcagaagaagcacctgcagcaggagaaggagtgcctgatgagcaagctggtggaggccgagatggatggagctgctgctgccaagcaggtgatggccctgaaggacaccatcggcaagctgaagacagagaagcagatgacctgcacagacatcaacaccctgacccggcagaaggagctgctgctgcagaagctgagcacctttgaggagaccaacagaaccctgcgggacctgctgcgggagcagcactgcaaggaggacagcgagcggctgatggagcagcagggcgccctgctgaagaggctggccgaggccgacagcgagaaggcccggctgctgctgctgctgcaggacaaggacaaggaggtggaggagctgctgcaggagatccagtgtgagaaggcccaggccaagacagccagcgagctgagcaagtccatggagagcatgaggggccacctgcaggcccagctgcggagcaaggaggccgagaacagccggctgtgcatgcagatcaagaacctggagaggagcggcaaccagcacaaggccgaggtggaggccatcatggagcagctgaaggagctgaagcagaagggggaccgggacaaggagagcctgaagaaggccatccgggcccagaaggagcgggcagagaagtctgaggagtatgcagagcagctgcacgtgcagctggccgacaaggacctgtatgtggccgaggccctgagcaccctggagagctggaggagccgctacaaccaggtggtgaaggagaagggggacctggagctggagatcatcgtgctgaatgacagagtgacagacctggtgaaccagcagcagaccctggaggagaagatgagggaggaccgggacagcctggtggagcggctgcaccggcagacagctgagtacagcgccttcaagctggagaatgaaaggctgaaggccagctttgcccccatggaggacaagctgaaccaggcccacctggaggtgcagcagctgaaggcctctgtgaagaactatgagggcatgattgacaactacaagagccaggtgatgaagacccggctggaggctgatgaggtggccgcccagctggagcgctgtgacaaggagaacaagatcctgaaggatgagatgaacaaggagattgaagctgcccggcggcagttccagagccagctggccgacctgcagcagctgcctgacatcctgaagatcacagaggccaagctggccgagtgccaggaccagctgcagggctatgaaaggaagaacatcgacctgacagccatcatcagtgacctgcggagccgggtgcgggactggcagaagggcagccatgagctgacccgggccggggcccgcatccccaggtag

SEQ ID NO: 162917 - DNA, 2490 bp, Artificial Sequence
  Description of Artificial Sequence: Synthetic coding sequence
atgtctgccagcagcagcggcggcagcccccgcttccccagctgtgggaagaatggagtgaccagcctgacccagaagaaggtgctgcgggccccctgtggggcccccagcgtgacagtgaccaagagccacaagaggggcatgaagggggacacagtgaatgtgcggcgctctgtgcgggtgaagaccaaggtgccctggatgcctcctgggaagagcagcgcccggcctgtgggctgcaagtgggagaaccccccccactgcctggagatcaccccacccagcagcgagaagctggtgtctgtgatgaggctgagtgacctgagcacagaagatgatgattctggccactgcaagatgaacagatatgacaagaagattgacagcctgatgaatgctgtgggctgcctgaagtctgaggtgaagatgcagaagggggagcggcagatggccaagcgcttcctggaggagaggaaggaggagctggaggaggtggcccacgagctggccgagacagaacatgaaaatacagtgctgcggcacaacattgaaagaatgaaggaggagaaggacttcaccatcctgcagaagaagcacctgcagcaggagaaggaatgtctgatgagcaagctggtggaggccgagatggatggagctgctgctgccaagcaggtgatggccctgaaggacaccatcggcaagctgaagacagagaagcagatgacctgcacagacatcaacaccctgacccggcagaaggagctgctgctgcagaagctgagcacctttgaggagaccaacagaaccctgcgggacctgctgcgggagcagcactgcaaggaggacagcgagcggctgatggagcagcagggcgccctgctgaagaggctggccgaggccgacagcgagaaggcccggctgctgctgctgctgcaggacaaggacaaggaggtggaggagctgctgcaggagatccagtgtgagaaggcccaggccaagacagccagcgagctgagcaagtccatggagagcatgaggggccacctgcaggcccagctgcggagcaaggaggccgagaacagccggctgtgcatgcagatcaagaacctggagaggagcggcaaccagcacaaggccgaggtggaggccatcatggagcagctgaaggagctgaagcagaagggggaccgggacaaggagagcctgaagaaggccatccgggcccagaaggagagagctgagaagtctgaggagtatgcagagcagctgcacgtgcagctggccgacaaggacctgtatgtggccgaggccctgagcaccctggagagctggaggagccgctacaaccaggtggtgaaggagaagggggacctggagctggagatcatcgtgctgaatgacagagtgacagacctggtgaaccagcagcagaccctggaggagaagatgagagaagatcgggacagcctggtggagcggctgcaccggcagacagctgagtacagcgccttcaagctggagaatgaaaggctgaaggccagctttgcccccatggaggacaagctgaaccaggcccacctggaggtgcagcagctgaaggcctctgtgaagaactatgagggcatgattgacaactacaagagccaggtgatgaagacccggctggaggctgatgaggtggccgcccagctggagcgctgtgacaaggagaacaagatcctgaaggatgagatgaacaaggagattgaggccgcccggcggcagttccagagccagctggccgacctgcagcagctgcctgacatcctgaagatcacagaggccaagctggccgagtgccaggaccagctgcagggctatgaaaggaagaacatcgacctgacagccatcatcagtgacctgcggagccgcatcgagcaccagggcgacaagctggagatggcccgggagaagcaccaggccagccagaaggagaacaagcagctgagcctgaaggtggatgagctggagaggaagctggaggccaccagcgcccagaacatcgagttcctgcaggtgattgccaagcgggaggaggccatccaccagagccagctgcggctggaggagaagaccagagaatgtggcaccctggcccggcagctggagagcgccattgaagatgcccggcggcaggtggagcagaccaaggagcacgccctgagcaaggagagagctgcccagaacaagatcctggacctggagacccagctgagcaggaccaagacagagctgagccagctgcggcgcagcagagatgatgctgaccggcgctaccagagccggctgcaggacctgaaggaccggctggagcagagcgagagcaccaacagatccatgcagaactacgtgcagttcctgaagagcagctatgccaacgtgtttggagatggcccctacagcaccttcctgaccagcagccccatccgcagccgcagccccccagcctag

SEQ ID NO: 162918 - DNA, 2106 bp, Artificial Sequence
  Description of Artificial Sequence: Synthetic coding sequence
atgggagagctgcccaccggctgcaggaagagaagaaggaagaggggcggcgctgctgcccgggcccggctgcaccccccccggcggctgcacggcaccaccctggccagtgacttcaatgacttcatcagaagacgcttctgggcccagccctgccgctcctggttccccagctgtgggaagaatggagtgaccagcctgacccagaagaaggtgctgcgggccccctgtggggcccccagcgtgacagtgaccaagagccacaagaggggcatgaagggggacacagtgaatgtgcggcgctctgtgcgggtgaagaccaaggtgccctggatgcctcctgggaagagcagcgcccggcctgtgggctgcaagtgggagaaccccccccactgcctggagatcaccccacccagcagcgagaagctggtgtctgtgatgaggctgagtgacctgagcacagaagatgatgattctggccactgcaagatgaacagatatgacaagaagattgacagcctgatgaatgctgtgggctgcctgaagtctgaggtgaagatgcagaagggggagcggcagatggccaagcgcttcctggaggagaggaaggaggagctggaggaggtggcccacgagctggccgagacagaacatgaaaatacagtgctgcggcacaacattgaaagaatgaaggaggagaaggacttcaccatcctgcagaagaagcacctgcagcaggagaaggaatgtctgatgagcaagctggtggaggccgagatggatggagctgctgctgccaagcaggtgatggccctgaaggacaccatcggcaagctgaagacagagaagcagatgacctgcacagacatcaacaccctgacccggcagaaggagctgctgctgcagaagctgagcacctttgaggagaccaacagaaccctgcgggacctgctgcgggagcagcactgcaaggaggacagcgagcggctgatggagcagcagggcgccctgctgaagaggctggccgaggccgacagcgagaaggcccggctgctgctgctgctgcaggacaaggacaaggaggtggaggagctgctgcaggagatccagtgtgagaaggcccaggccaagacagccagcgagctgagcaagtccatggagagcatgaggggccacctgcaggcccagctgcggagcaaggaggccgagaacagccggctgtgcatgcagatcaagaacctggagaggagcggcaaccagcacaaggccgaggtggaggccatcatggagcagctgaaggagctgaagcagaagggggaccgggacaaggagagcctgaagaaggccatccgggcccagaaggagagagctgagaagtctgaggagtatgcagagcagctgcacgtgcagctggccgacaaggacctgtatgtggccgaggccctgagcaccctggagagctggaggagccgctacaaccaggtggtgaaggagaagggggacctggagctggagatcatcgtgctgaatgacagagtgacagacctggtgaaccagcagcagaccctggaggagaagatgagagaagatcgggacagcctggtggagcggctgcaccggcagacagctgagtacagcgccttcaagctggagaatgaaaggctgaaggccagctttgcccccatggaggacaagctgaaccaggcccacctggaggtgcagcagctgaaggcctctgtgaagaactatgagggcatgattgacaactacaagagccaggtgatgaagacccggctggaggctgatgaggtggccgcccagctggagcgctgtgacaaggagaacaagatcctgaaggatgagatgaacaaggagattgaggccgcccggcggcagttccagagccagctggccgacctgcagcagctgcctgacatcctgaagatcacagaggccaagctggccgagtgccaggaccagctgcagggctatgaaaggaagaacatcgacctgacagccatcatcagtgacctgcggagccgggtgcgggactggcagaagggcagccatgagctgaccagggctggggcccgcatccccaggtag

SEQ ID NO: 162919 - DNA, 1974 bp, Artificial Sequence
  Description of Artificial Sequence: Synthetic coding sequence
atggctgaccagcagggcccccaccagaaccgcttccccagctgtgggaagaatggagtgaccagcctgacccagaagaaggtgctgcgggccccctgtggggcccccagcgtgacagtgaccaagagccacaagaggggcatgaagggggacacagtgaatgtgcggcgctctgtgcgggtgaagaccaaggtgccctggatgcctcctgggaagagcagcgcccggcctgtgggctgcaagtgggagaaccccccccactgcctggagatcaccccacccagcagcgagaagctggtgtctgtgatgaggctgagtgacctgagcacagaagatgatgattctggccactgcaagatgaacagatatgacaagaagattgacagcctgatgaatgctgtgggctgcctgaagtctgaggtgaagatgcagaagggggagcggcagatggccaagcgcttcctggaggagaggaaggaggagctggaggaggtggcccacgagctggccgagacagaacatgaaaatacagtgctgcggcacaacattgaaagaatgaaggaggagaaggacttcaccatcctgcagaagaagcacctgcagcaggagaaggaatgtctgatgagcaagctggtggaggccgagatggatggagctgctgctgccaagcaggtgatggccctgaaggacaccatcggcaagctgaagacagagaagcagatgacctgcacagacatcaacaccctgacccggcagaaggagctgctgctgcagaagctgagcacctttgaggagaccaacagaaccctgcgggacctgctgcgggagcagcactgcaaggaggacagcgagcggctgatggagcagcagggcgccctgctgaagaggctggccgaggccgacagcgagaaggcccggctgctgctgctgctgcaggacaaggacaaggaggtggaggagctgctgcaggagatccagtgtgagaaggcccaggccaagacagccagcgagctgagcaagtccatggagagcatgaggggccacctgcaggcccagctgcggagcaaggaggccgagaacagccggctgtgcatgcagatcaagaacctggagaggagcggcaaccagcacaaggccgaggtggaggccatcatggagcagctgaaggagctgaagcagaagggggaccgggacaaggagagcctgaagaaggccatccgggcccagaaggagagagctgagaagtctgaggagtatgcagagcagctgcacgtgcagctggccgacaaggacctgtatgtggccgaggccctgagcaccctggagagctggaggagccgctacaaccaggtggtgaaggagaagggggacctggagctggagatcatcgtgctgaatgacagagtgacagacctggtgaaccagcagcagaccctggaggagaagatgagagaagatcgggacagcctggtggagcggctgcaccggcagacagctgagtacagcgccttcaagctggagaatgaaaggctgaaggccagctttgcccccatggaggacaagctgaaccaggcccacctggaggtgcagcagctgaaggcctctgtgaagaactatgagggcatgattgacaactacaagagccaggtgatgaagacccggctggaggctgatgaggtggccgcccagctggagcgctgtgacaaggagaacaagatcctgaaggatgagatgaacaaggagattgaggccgcccggcggcagttccagagccagctggccgacctgcagcagctgcctgacatcctgaagatcacagaggccaagctggccgagtgccaggaccagctgcagggctatgaaaggaagaacatcgacctgacagccatcatcagtgacctgcggagccgggtgcgggactggcagaagggcagccatgagctgaccagggctggggcccgcatccccaggtag

SEQ ID NO: 162920 - DNA, 570 bp, Artificial Sequence
  Description of Artificial Sequence: Synthetic coding sequence
atgaaggacaggagcagcaccccacccctgcacgtgcacgtggatgagaacacccctgtgcacgtgcacatcaagaagctgcccaagcccagcgccaccagcagccagaagagccacaagaggggcatgaagggggacacagtgaatgtgagaagatctgtgcgggtgaagaccaaggtgaagatgcagaagggggagcggcagatggccaagcgcttcctggaggagaggaaggaggagctggaggaggtggcccacgagctggccgagacagaacatgagaacacagtgctgcggcacaacatcgagaggatgaaggaggagaaggacttcaccatcctgcagaagaagcacctgcagcaggagaaggagtgcctgatgagcaagctggtggaggccgagatggatggagctgctgctgccaagcaggtgatggccctgaaggacaccatcggcaagctgaagacagagaagcagatgacctgcacagacatcaacaccctgacccggcagaaggagctgctgctgcagaagctgagcacctttgaggagaccaacagaaccctgtag

SEQ ID NO: 162921 - DNA, 618 bp, Artificial Sequence
  Description of Artificial Sequence: Synthetic coding sequence
atgtctgccagcagcagcggcggcagcccccgcttccccagctgtgggaagaatggagtgaccagcctgacccagaagaaggtgctgcgggccccctgtggggcccccagcgtgacagtgaccaagagccacaagaggggcatgaagggggacacagtgaatgtgcggcgctctgtgcgggtgaagaccaaggtgaagatgcagaagggggagcggcagatggccaagcgcttcctggaggagaggaaggaggagctggaggaggtggcccacgagctggccgagacagaacatgaaaatacagtgctgcggcacaacattgaaagaatgaaggaggagaaggacttcaccatcctgcagaagaagcacctgcagcaggagaaggaatgtctgatgagcaagctggtggaggccgagatggatggagctgctgctgccaagcaggtgatggccctgaaggacaccatcggcaagctgaagacagagaagcagatgacctgcacagacatcaacaccctgacccggcagaaggagctgctgctgcagaagctgagcacctttgaggagaccaacagaaccctgcgggacctgctgcgggagcagcactgcaaggagtag

SEQ ID NO: 162922 - DNA, 543 bp, Artificial Sequence
  Description of Artificial Sequence: Synthetic coding sequence
atgtctgccagcagcagcggcggcagcccccgcttccccagctgtgggaagaatggagtgaccagcctgacccagaagaaggtgctgcgggccccctgtggggcccccagcgtgacagtgaccaagagccacaagaggggcatgaagggggacacagtgaatgtgcggcgctctgtgcgggtgaagaccaaggtgccctggatgcctcctgggaagagcagcgcccggcctgtgggctgcaagtgggagaaccccccccactgcctggagatcaccccacccagcagcgagaagctggtgtctgtgatgaggctgagtgacctgagcacagaagatgatgattctggccactgcaagatgaacagatatgacaagaagattgacagcctgatgaatgctgtgggctgcctgaagtctgaggtgaagatgcagaagggggagcggcagatggccaagcgcttcctggaggagaggaaggaggagctggaggaggtggcccacgagctggccgagacagaacatgaaaatacagtgctgaggtag

SEQ ID NO: 162923 - DNA, 648 bp, Artificial Sequence
  Description of Artificial Sequence: Synthetic coding sequence
atgaaggacaggagcagcaccccacccctgcacgtgcacgtggatgagaacacccctgtgcacgtgcacatcaagaagctgcccaagcccagcgccaccagcagccagaagagccacaagaggggcatgaagggggacacagtgaatgtgagaagatctgtgcgggtgaagaccaagaaccccccccactgcctggagatcaccccacccagcagcgagaagctggtgtctgtgatgaggctgagtgacctgagcacagaagatgatgattctggccactgcaagatgaacagatatgacaagaagattgacagcctgatgaatgctgtgggctgcctgaagtctgaggtgaagatgcagaagggggagcggcagatggccaagcgcttcctggaggagaggaaggaggagctggaggaggtggcccacgagctggccgagacagaacatgaaaatacagtgctgcggcacaacattgaaagaatgaaggaggagaaggacttcaccatcctgcagaagaagcacctgcagcaggagaaggaatgtctgatgagcaagctggtggaggccgagatggatggagctgctgctgccaagcaggtgatggccctgaaggacaccatcggcaagctgaagacagtgggctag

SEQ ID NO: 162924 - DNA, 471 bp, Artificial Sequence
  Description of Artificial Sequence: Synthetic coding sequence
atgtctgccagcagcagcggcggcagcccccgcttccccagctgtgggaagaatggagtgaccagcctgacccagaagaaggtgctgcgggccccctgtggggcccccagcgtgacagtgaccaagagccacaagaggggcatgaagggggacacagtgaatgtgcggcgctctgtgcgggtgaagaccaagaaccccccccactgcctggagatcaccccacccagcagcgagaagctggtgtctgtgatgaggctgagtgacctgagcacagaagatgatgacagcggccactgcaagatgaacagatatgacaagaagattgacagcctgatgaatgctgtgggctgcctgaagtctgaggtgaagatgcagaagggggagcggcagatggccaagcgcttcctggaggagaggaaggaggagctggaggaggtggcccacgagctggccgagacagaacatgaatag

SEQ ID NO: 162925 - DNA, 1731 bp, Artificial Sequence
  Description of Artificial Sequence: Synthetic coding sequence
atgaaggacaggagcagcaccccacccctgcacgtgcacgtggatgagaacacccctgtgcacgtgcacatcaagaagctgcccaagcccagcgccaccagcagccagaagagccacaagaggggcatgaagggggacacagtgaatgtgagaagatctgtgcgggtgaagaccaaggtgaagatgcagaagggggagcggcagatggccaagcgcttcctggaggagaggaaggaggagctggaggaggtggcccacgagctggccgagacagaacatgagaacacagtgctgcggcacaacatcgagaggatgaaggaggagaaggacttcaccatcctgcagaagaagcacctgcagcaggagaaggagtgcctgatgagcaagctggtggaggccgagatggatggagctgctgctgccaagcaggtgatggccctgaaggacaccatcggcaagctgaagacagagaagcagatgacctgcacagacatcaacaccctgacccggcagaaggagctgctgctgcagaagctgagcacctttgaggagaccaacagaaccctgcgggacctgctgcgggagcagcactgcaaggaggacagcgagcggctgatggagcagcagggcgccctgctgaagaggctggccgaggccgacagcgagaaggcccggctgctgctgctgctgcaggacaaggacaaggaggtggaggagctgctgcaggagatccagtgtgagaaggcccaggccaagacagccagcgagctgagcaagtccatggagagcatgaggggccacctgcaggcccagctgcggagcaaggaggccgagaacagccggctgtgcatgcagatcaagaacctggagaggagcggcaaccagcacaaggccgaggtggaggccatcatggagcagctgaaggagctgaagcagaagggggaccgggacaaggagagcctgaagaaggccatccgggcccagaaggagcgggcagagaagtctgaggagtatgcagagcagctgcacgtgcagctggccgacaaggacctgtatgtggccgaggccctgagcaccctggagagctggaggagccgctacaaccaggtggtgaaggagaagggggacctggagctggagatcatcgtgctgaatgacagagtgacagacctggtgaaccagcagcagaccctggaggagaagatgagggaggaccgggacagcctggtggagcggctgcaccggcagacagctgagtacagcgccttcaagctggagaatgaaaggctgaaggccagctttgcccccatggaggacaagctgaaccaggcccacctggaggtgcagcagctgaaggcctctgtgaagaactatgagggcatgattgacaactacaagagccaggtgatgaagacccggctggaggctgatgaggtggccgcccagctggagcgctgtgacaaggagaacaagatcctgaaggatgagatgaacaaggagattgaagctgcccggcggcagttccagagccagctggccgacctgcagcagctgcctgacatcctgaagatcacagaggccaagctggccgagtgccaggaccagctgcagggctatgaaaggaagaacatcgacctgacagccatcatcagtgacctgcggagccgggtgcgggactggcagaagggcagccatgagctgacccgggccggggcccgcatccccaggtag

SEQ ID NO: 162926 - DNA, 444 bp, Artificial Sequence
  Description of Artificial Sequence: Synthetic coding sequence
atgaaggacaggagcagcaccccacccctgcacgtgcacgtggatgagaacacccctgtgcacgtgcacatcaagaagctgcccaagcccagcgccaccagcagccagaagagccacaagaggggcatgaagggggacacagtgaatgtgagaagatctgtgcgggtgaagaccaaggtgccctggatgcctcctgggaagagcagcgcccggcctgtgggctgcaagtgggagaccagcgaggagacccccaccaccggggagggcgtgccccacgtgcaggccggcggcggcggcaatggctggggctgcggctgccaggccggccacggcctggagggctaccaccgggaggccgagaaccgggagaccaatgacctgcacggccaccagcacccagacaaggccgagggcaccagccctgctgaggccgagcacatctag

SEQ ID NO: 162927 - DNA, 1917 bp, Artificial Sequence
  Description of Artificial Sequence: Synthetic coding sequence
atgggcaggaaccgctaccccccagcctgctggttccccagctgtgggaagaatggagtgaccagcctgacccagaagaaggtgctgcgggccccctgtggggcccccagcgtgacagtgaccaagagccacaagaggggcatgaagggggacacagtgaatgtgcggcgctctgtgcgggtgaagaccaagaaccccccccactgcctggagatcaccccacccagcagcgagaagctggtgtctgtgatgaggctgagtgacctgagcacagaagatgatgacagcggccactgcaagatgaacagatatgacaagaagattgacagcctgatgaatgctgtgggctgcctgaagtctgaggtgaagatgcagaagggggagcggcagatggccaagcgcttcctggaggagaggaaggaggagctggaggaggtggcccacgagctggccgagacagaacatgagaacacagtgctgcggcacaacatcgagaggatgaaggaggagaaggacttcaccatcctgcagaagaagcacctgcagcaggagaaggagtgcctgatgagcaagctggtggaggccgagatggatggagctgctgctgccaagcaggtgatggccctgaaggacaccatcggcaagctgaagacagagaagcagatgacctgcacagacatcaacaccctgacccggcagaaggagctgctgctgcagaagctgagcacctttgaggagaccaacagaaccctgcgggacctgctgcgggagcagcactgcaaggaggacagcgagcggctgatggagcagcagggcgccctgctgaagaggctggccgaggccgacagcgagaaggcccggctgctgctgctgctgcaggacaaggacaaggaggtggaggagctgctgcaggagatccagtgtgagaaggcccaggccaagacagccagcgagctgagcaagtccatggagagcatgaggggccacctgcaggcccagctgcggagcaaggaggccgagaacagccggctgtgcatgcagatcaagaacctggagaggagcggcaaccagcacaaggccgaggtggaggccatcatggagcagctgaaggagctgaagcagaagggggaccgggacaaggagagcctgaagaaggccatccgggcccagaaggagcgggcagagaagtctgaggagtatgcagagcagctgcacgtgcagctggccgacaaggacctgtatgtggccgaggccctgagcaccctggagagctggaggagccgctacaaccaggtggtgaaggagaagggggacctggagctggagatcatcgtgctgaatgacagagtgacagacctggtgaaccagcagcagaccctggaggagaagatgagggaggaccgggacagcctggtggagcggctgcaccggcagacagctgagtacagcgccttcaagctggagaatgaaaggctgaaggccagctttgcccccatggaggacaagctgaaccaggcccacctggaggtgcagcagctgaaggcctctgtgaagaactatgagggcatgattgacaactacaagagccaggtgatgaagacccggctggaggctgatgaggtggccgcccagctggagcgctgtgacaaggagaacaagatcctgaaggatgagatgaacaaggagattgaagctgcccggcggcagttccagagccagctggccgacctgcagcagctgcctgacatcctgaagatcacagaggccaagctggccgagtgccaggaccagctgcagggctatgaaaggaagaacatcgacctgacagccatcatcagtgacctgcggagccgggtgcgggactggcagaagggcagccatgagctgacccgggccggggcccgcatccccaggtag

SEQ ID NO: 162928 - DNA, 765 bp, Artificial Sequence
  Description of Artificial Sequence: Synthetic coding sequence
atgacagaggaggtgtggatgggcacctggaggccccaccggccccggggccccatcatggccctgtacagcagccctggccccaagtacctgatcccccccaccaccggcttcatgaagcacacccccaccaagctgcgggccccagcctacagcttccggggggcccccatgctgctggccgagaactgcagccctggcccccgctacaacgtgaaccccaagatcctgaggacaggcaaggacctgggccctgcctacagcatcctgggccgctaccagaccaagaccatgctgaccccaggccctggggactacttccctgagaagagcaccaagtatgtgtttgacagcgcccccagccacagcatcagcgcccggaccaaggccttccgggtggacagcaccccaggccctgctgcctacatgctgcccatggtgatgggccccaacacagtgggcaaggccagccagcccagcttcagcatcaagggccgcagcaagctgggcggcttcagtgatgacctgcacaagaccccaggccctgctgcctaccggcagacagatgtgcgggtgaccaagttcaaggccccccagtacaccatggccgcccgggtggagcccccaggggacaagaccctgaagccaggccctggggcccacagccctgagaaggtgaccctgaccaagccctgtgcccctgtggtgaccttcggcatcaagcacagcgactacatgacccccctgctggtggatgtggagtag

SEQ ID NO: 162929 - DNA, 417 bp, Artificial Sequence
  Description of Artificial Sequence: Synthetic coding sequence
atgacagaggaggtgtggatgggcacctggaggccccaccggccccggggccccatcatggccctgtacagcagccctggccccaagtacctgatcccccccaccaccggcttcatgaagcacacccccaccaagctgcgggccccagcctacagcttccggggggcccccatgctgctggccgagaactgcagccctggcccccgctacaacgtgaaccccaagatcctgaggacaggcaaggacctgggccctgcctacagcatcctgggccgctaccagaccaagaccatgctgaccccaggccctgccctgaagagcgccttccccagctggaccccaccagaccccacctggagcccccctgtgctggagccccggggccccacccccaggatgctgggcagccccccatag

SEQ ID NO: 162930 - DNA, 375 bp, Artificial Sequence
  Description of Artificial Sequence: Synthetic coding sequence
atgacagaggaggtgtggatgggcacctggaggccccaccggccccggggccccatcatggccctgtacagcagccctggccccaagtacctgatcccccccaccaccggcttcatgaagcacacccccaccaagctgcgggccccagcctacagcttccggggggcccccatgctgctggccgagaactgcagcccccccaacacagtgggcaaggccagccagcccagcttcagcatcaagggccgcagcaagctgggcggcttcagtgatgacctgcacaaggtgaccctgaccaagccctgtgcccctgtggtgaccttcggcatcaagcacagcgactacatgacccccctgctggtggatgtggagtag

SEQ ID NO: 162931 - DNA, 774 bp, Artificial Sequence
  Description of Artificial Sequence: Synthetic coding sequence
atggatgctgagtacagcggaaatgagttccccaggtctgagggggagcgggaccagcaccagaggcctgggaaggagaggaagtctggagaggccggctggggcaccggggagctgggccaggacggccgcctgctgagcagcaccctgagcctgagcagcaacagaagcctgggccagaggcagaacagccccctgcccttccagtggaggatcacccacagcttccgctggatggcccaggtgctggccagcgagctgagcctggtggccttcatcctgctgctggtggtggccttcagcaagaagtggctggacctgagccgcagcctcttctaccagcgctggcctgtggatgtgagcaaccgcatccacaccagcgcccacgtgatgtccatgggcctgctgcacttctacaagagccgcagctgcagcgacctggagaatggcaaggtgaccttcatcttcagcaccctgatgctgttccccatcaacatctggatctttgagctggagagaaatgtgtccatccccatcggctggagctacttcatcggctggctggtgctgatcctgtacttcacctgtgccatcctgtgctacttcaaccacaagagcttctggagcctcatcctgagccaccccagcggggctgtgtcctgcagcagcagctttggatctgtggaggagagcccccgggcccagaccatcacagacacccccatcacccaggagggcgtgctggaccctgagcagaaggacacccacgtgtag

SEQ ID NO: 162932 - DNA, 1488 bp, Artificial Sequence
  Description of Artificial Sequence: Synthetic coding sequence
atggtgacctggctgtaccgcttcctgcccaccagcaacatggccgccaagctgcggagcctgctgcccccagacctgcggctgcagttctggctgcacgcccggctgcagaagtgcttcctgagccggggctgcggcagctactgtgccggggccaaggccagccccctgcccgggaagatggccatgggcctgatgtgtggcagaagagagctgctgcggctgctgcagagcggccggcgggtgcacagcgtggccggccccagccagtggctgggcaagcccctgaccacccggctgctcttccctgctgccccctgctgctgccggccccactacctgttcctggccgccagcggccccaggagcctgagcaccagcgccatcagctttgctgaggtgcaggtgcaggcccctcctgtggtggccgccacccccagccccacagctgtgcctgaggtggccagcggggagacagcagatgtggtgcagacagctgctgagcagagctttgctgagctgggcctgggcagctacacccctgtgggcctcatccagaacctgctggagttcatgcacgtggacctgggcctgccctggtggggcgccatcgccgcctgcaccgtgtttgcccgctgcctgatcttccccctgattgtgacaggccagcgggaggccgcccgcatccacaaccacctgcctgagatccagaagttcagcagccgcatccgggaggccaagctggccggggaccacatcgagtactacaaggccagcagcgagatggccctgtaccagaagaagcacggcatcaagctgtacaagcccctcatcctgcctgtgacccaggcccccatcttcatctccttcttcatcgccctgcgggagatggccaacctgcctgtgcccagcctgcagacaggaggcctgtggtggttccaggacctgactgtgtctgaccccatctacatcctgcccctggccgtgacagccaccatgtgggccgtgctggagctgggcgctgagactggagtgcagagcagtgacctgcagtggatgagaaatgtcatccgcatgatgcccctcatcaccctgcccatcaccatgcacttccccacagctgtgttcatgtactggctgagcagcaacctcttcagcctggtgcaggtgtcctgcctgcgcatcccagctgtgaggacagtgctgaagatcccccagagggtggtgcatgacctggacaagctgcccccccgggagggcttcctggagagcttcaagaagggctggaagaatgctgagatgacccggcagctgcgggagcgggagcagaggatgaggaaccagctggagctggccgcccggggccccctgcggcagaccttcacccacaaccccctgctgcagcccgggaaggacaacccccccaacatccccagcagcagcagcaagcccaagagcaagtacccctggcatgacaccctgggctag

SEQ ID NO: 162933 - DNA, 1260 bp, Artificial Sequence
  Description of Artificial Sequence: Synthetic coding sequence
atgaggggcacccaggtgcacagcgtggccggccccagccagtggctgggcaagcccctgaccacccggctgctcttccctgctgccccctgctgctgccggccccactacctgttcctggccgccagcggccccaggagcctgagcaccagcgccatcagctttgctgaggtgcaggtgcaggcccctcctgtggtggccgccacccccagccccacagctgtgcctgaggtggccagcggggagacagcagatgtggtgcagacagctgctgagcagagctttgctgagctgggcctgggcagctacacccctgtgggcctcatccagaacctgctggagttcatgcacgtggacctgggcctgccctggtggggcgccatcgccgcctgcaccgtgtttgcccgctgcctgatcttccccctgattgtgacaggccagcgggaggccgcccgcatccacaaccacctgcctgagatccagaagttcagcagccgcatccgggaggccaagctggccggggaccacatcgagtactacaaggccagcagcgagatggccctgtaccagaagaagcacggcatcaagctgtacaagcccctcatcctgcctgtgacccaggcccccatcttcatctccttcttcatcgccctgcgggagatggccaacctgcctgtgcccagcctgcagacaggaggcctgtggtggttccaggacctgactgtgtctgaccccatctacatcctgcccctggccgtgacagccaccatgtgggccgtgctggagctgggcgctgagactggagtgcagagcagtgacctgcagtggatgagaaatgtcatccgcatgatgcccctcatcaccctgcccatcaccatgcacttccccacagctgtgttcatgtactggctgagcagcaacctcttcagcctggtgcaggtgtcctgcctgcgcatcccagctgtgaggacagtgctgaagatcccccagagggtggtgcatgacctggacaagctgcccccccgggagggcttcctggagagcttcaagaagggctggaagaatgctgagatgacccggcagctgcgggagcgggagcagaggatgaggaaccagctggagctggccgcccggggccccctgcggcagaccttcacccacaaccccctgctgcagcccgggaaggacaacccccccaacatccccagcagcagcagcaagcccaagagcaagtacccctggcatgacaccctgggctag

SEQ ID NO: 162934 - DNA, 732 bp, Artificial Sequence
  Description of Artificial Sequence: Synthetic coding sequence
atgagccggctgtggtacggcaagaagggcagaagacaccagcccatcaaccacaagtacaccctggtggtgtctgtggccgagtaccacagaagaattgatgccctgaacacagaggagctgcggaccctgtgccggcggctgcagatcaccacccgggaggacatcaacagcaagcaggtggccaccgtgaaggctgacctggagagcgagagcttccggcccaacctgagtgaccccagcgagctgctgctgcctgaccagatcgagaagctgaccaagcacctgccccccaggaccatcggctacccctggaccctggtgtatggaacaggcaagcacggcaccagcctgaagaccctgtaccgcaccatgacaggcctggacacccctgtgctgatggtgatcaaggacagtgatggccaggtgtttggagccctggccagcgagcccctgaaggtgtctgatggcttctatggaactggagagacctttgtgttcaccttctgcccagagtttgaggtgttcaagtggacaggagacaacatgttcttcatcaagggggacatggacagcctggcctttggaggcggcggcggggagtttgccctgtggctggatggagacctgtaccacggccgcagccacagctgcaagacctttggaaacagaaccctgagcaagaaggaggacttcttcatccaggacatcgagatctgggcctttgaatag

SEQ ID NO: 162935 - DNA, 2520 bp, Artificial Sequence
  Description of Artificial Sequence: Synthetic coding sequence
atggactacctgaccaccttcacagagaagagcggccgcctgctgcggggcacagccaaccggctgctgggctttggaggcggcggggaggcccggcaggtgcgctttgaggactacctgcgggagcccgcccagggcgacctgggctgcggcagccccccccaccggcccccagcccccagcagccctgagggccctgacaccggccagaagaagaccctggacaagaaggatggccgcaggatgtccttccagaagcccaagggcaccatcgagtacacagtggagagccgggacagcctgaacagcatcgccctgaagtttgacaccaccccaaatgagctggtgcagctgaacaagctgttcagcagagctgtggtgacaggccaggtgctgtatgtgcctgaccctgaatatgtgtcctctgtggagagcagccccagcctgagccctgtgagccccctgagccccaccagcagcgaggccgagtttgacaagaccaccaacccagatgtgcaccccacagaggccacccccagcagcaccttcaccggcatccggcctgcccgggtggtgagcagcaccagcgaggaggaggaggccttcacagagaagttcctgaagatcaactgcaagtacatcaccagcggcaagggcaccgtgtctggagtgctgctggtgacccccaacaacatcatgtttgacccccacaagaatgaccccctggtgcaggagaatggctgtgaggagtatggcatcatgtgccccatggaggaggtgatgtctgctgccatgtacaaggagatcctggacagcaagatcaaggagagcctgcccatcgacatcgaccagctgagcggccgggacttctgccacagcaagaagatgacaggcagcaacacagaggagattgacagccgcatcagagatgctggaaatgattctgccagcacagcccccaggagcacagaggagagcctgtctgaagatgtgttcacagaaagtgagctgagccccatccgggaggagctggtgtccagtgatgagctgcggcaggacaagagcagcggggccagcagcgagagcgtgcagacagtgaaccaggccgaggtggagagcctgactgtgaagtctgagagcacaggcaccccaggccacctgcggagtgacacagagcacagcaccaatgaggtgggcaccctgtgccacaagacagacctgaacaacctggagatggccatcaaggaggaccagattgctgacaacttccagggcatcagcggccccaaggaggacagcaccagcatcaagggcaacagcgaccaggacagcttcctgcacgagaacagcctgcaccaggaggagagccagaaggagaacatgccctgtggggagacagctgagttcaagcagaagcagagcgtgaacaagggcaagcagggcaaggagcagaaccaggacagccagacagaggccgaggagctgaggaagctgtggaagacccacaccatgcagcagaccaagcagcagcgggagaacatccagcaggtgtcccagaaggaggccaagcacaagatcaccagcgcagatggccacatcgagagcagcgccctgctgaaggagaagcagaggcaccggctgcacaagttcctgtgcctgcgggtgggcaagcccatgaggaagacctttgtgtcccaggccagcgccaccatgcagcagtatgcccagagggacaagaagcatgagtactggtttgctgtgccccaggagaggacagaccacctgtatgccttcttcatccagtggagccctgagatctatgcagaagatactggagagtacacccgggagcccggcttcatcgtggtgaagaagattgaggagagcgagaccatcgaggacagcagcaaccaggccgccgcccgggagtgggagatcaccacccgggaggacatcaacagcaagcaggtggccaccgtgaaggctgacctggagagcgagagcttccggcccaacctgagtgaccccagcgagctgctgctgcctgaccagatcgagaagctgaccaagcacctgccccccaggaccatcggctacccctggaccctggtgtatggaacaggcaagcacggcaccagcctgaagaccctgtaccgcaccatgacaggcctggacacccctgtgctgatggtgatcaaggacagtgatggccaggtgtttggagccctggccagcgagcccctgaaggtgtctgatggcttctatggaactggagagacctttgtgttcaccttctgcccagagtttgaggtgttcaagtggacaggagacaacatgttcttcatcaagggggacatggacagcctggcctttggaggcggcggcggggagtttgccctgtggctggatggagacctgtaccacggccgcagccacagctgcaagacctttggaaacagaaccctgagcaagaaggaggacttcttcatccaggacatcgagatctgggcctttgaatag

SEQ ID NO: 162936 - DNA, 2625 bp, Artificial Sequence
  Description of Artificial Sequence: Synthetic coding sequence
atgaccaaggacaagaacagccctggcctgaagaagaagagccagagcgtggacatcaatgcccctggcttcaaccccctggccggggccggcaagcagaccccccaggccagcaagcccccagcccccaagacccccatcatcgaggaggagcagaacaatgctgccaacacccagaagcaccccagccgccgctctgagctgaagcgcttctacaccatcgacaccggccagaagaagaccctggacaagaaggatggccgcaggatgtccttccagaagcccaagggcaccatcgagtacacagtggagagccgggacagcctgaacagcatcgccctgaagtttgacaccaccccaaatgagctggtgcagctgaacaagctgttcagcagagctgtggtgacaggccaggtgctgtatgtgcctgaccctgaatatgtgtcctctgtggagagcagccccagcctgagccctgtgagccccctgagccccaccagcagcgaggccgagtttgacaagaccaccaacccagatgtgcaccccacagaggccacccccagcagcaccttcaccggcatccggcctgcccgggtggtgagcagcaccagcgaggaggaggaggccttcacagagaagttcctgaagatcaactgcaagtacatcaccagcggcaagggcaccgtgtctggagtgctgctggtgacccccaacaacatcatgtttgacccccacaagaatgaccccctggtgcaggagaatggctgtgaggagtatggcatcatgtgccccatggaggaggtgatgtctgctgccatgtacaaggagatcctggacagcaagatcaaggagagcctgcccatcgacatcgaccagctgagcggccgggacttctgccacagcaagaagatgacaggcagcaacacagaggagattgacagccgcatcagagatgctggaaatgattctgccagcacagcccccaggagcacagaggagagcctgtctgaagatgtgttcacagaaagtgagctgagccccatccgggaggagctggtgtccagtgatgagctgcggcaggacaagagcagcggggccagcagcgagagcgtgcagacagtgaaccaggccgaggtggagagcctgactgtgaagtctgagagcacaggcaccccaggccacctgcggagtgacacagagcacagcaccaatgaggtgggcaccctgtgccacaagacagacctgaacaacctggagatggccatcaaggaggaccagattgctgacaacttccagggcatcagcggccccaaggaggacagcaccagcatcaagggcaacagcgaccaggacagcttcctgcacgagaacagcctgcaccaggaggagagccagaaggagaacatgccctgtggggagacagctgagttcaagcagaagcagagcgtgaacaagggcaagcagggcaaggagcagaaccaggacagccagacagaggccgaggagctgaggaagctgtggaagacccacaccatgcagcagaccaagcagcagcgggagaacatccagcaggtgtcccagaaggaggccaagcacaagatcaccagcgcagatggccacatcgagagcagcgccctgctgaaggagaagcagaggcaccggctgcacaagttcctgtgcctgcgggtgggcaagcccatgaggaagacctttgtgtcccaggccagcgccaccatgcagcagtatgcccagagggacaagaagcatgagtactggtttgctgtgccccaggagaggacagaccacctgtatgccttcttcatccagtggagccctgagatctatgcagaagatactggagagtacacccgggagcccggcttcatcgtggtgaagaagattgaggagagcgagaccatcgaggacagcagcaaccaggccgccgcccgggagtgggaggtggtgtctgtggccgagtaccacagaagaattgatgccctgaacacagaggagctgcggaccctgtgccggcggctgcagatcaccacccgggaggacatcaacagcaagcaggtggccaccgtgaaggctgacctggagagcgagagcttccggcccaacctgagtgaccccagcgagctgctgctgcctgaccagatcgagaagctgaccaagcacctgccccccaggaccatcggctacccctggaccctggtgtatggcaccgggaagcacggcaccagcctgaagaccctgtaccgcaccatgacaggcctggacacccctgtgctgatggtgatcaaggacagtgatggccaggtgtttggagccctggccagcgagcccctgaaggtgtctgatggcttctacggcaccggggagacctttgtgttcaccttctgcccagagtttgaggtgttcaagtggacaggagacaacatgttcttcatcaagggggacatggacagcctggccttcggcggcggcggcggggagtttgccctgtggctggatggagacctgtaccacggccgcagccacagctgcaagaccttcggcaacagaaccctgagcaagaaggaggacttcttcatccaggacatcgagatctgggcctttgaatag

SEQ ID NO: 162937 - DNA, 2541 bp, Artificial Sequence
  Description of Artificial Sequence: Synthetic coding sequence
atgtctgtgagcaacctgtcctggctgaagaagaagagccagagcgtggacatcaatgcccctggcttcaaccccctggccggggccggcaagcagaccccccaggccagcaagcccccagcccccaagacccccatcatcgaggaggagcagaacaatgctgccaacacccagaagcaccccagcagaagaagtgagctgaagcgcttctacaccatcgacaccggccagaagaagaccctggacaagaaggatggaagaaggatgtccttccagaagcccaagggcaccatcgagtacacagtggagagccgggacagcctgaacagcatcgccctgaagtttgacaccaccccaaatgagctggtgcagctgaacaagctgttcagcagagctgtggtgacaggccaggtgctgtatgtgcctgaccctgaatatgtgtcctctgtggagagcagccccagcctgagccctgtgagccccctgagccccaccagcagcgaggccgagtttgacaagaccaccaacccagatgtgcaccccacagaggccacccccagcagcaccttcaccggcatccggcctgcccgggtggtgagcagcaccagcgaggaggaggaggccttcacagagaagttcctgaagatcaactgcaagtacatcaccagcgggaaaggaacagtgtctggagtgctgctggtgacccccaacaacatcatgtttgacccccacaagaatgaccccctggtgcaggagaatggctgtgaggagtatggcatcatgtgccccatggaggaggtgatgtctgctgccatgtacaaggagatcctggacagcaagatcaaggagagcctgcccattgatattgaccagctgagcggccgggacttctgccacagcaagaagatgacaggcagcaacacagaggagattgacagccgcatcagagatgctggaaatgacagcgccagcacagcccccaggagcacagaggagagcctgtctgaagatgtgttcacagagagcgagctgagccccatccgggaggagctggtgtccagtgatgagctgcggcaggacaagagcagcggggccagcagcgagagcgtgcagacagtgaaccaggccgaggtggagagcctgactgtgaagtctgagagcacaggcaccccaggccacctgcggagtgacacagagcacagcaccaatgaggtgggcaccctgtgccacaagacagacctgaacaacctggagatggccatcaaggaggaccagattgctgacaacttccagggcatcagcggccccaaggaggacagcaccagcatcaagggcaacagcgaccaggacagcttcctgcacgagaacagcctgcaccaggaggagagccagaaggagaacatgccctgtggggagacagctgagttcaagcagaagcagagcgtgaacaagggcaagcagggcaaggagcagaaccaggacagccagacagaagctgaggagctgaggaagctgtggaagacccacaccatgcagcagaccaagcagcagcgggagaacatccagcaggtgtcccagaaggaggccaagcacaagatcaccagcgcagatggccacatcgagagcagcgccctgctgaaggagaagcagaggcaccggctgcacaagttcctgtgcctgcgggtgggcaagcccatgaggaagacctttgtgtcccaggccagcgccaccatgcagcagtatgcccagagggacaagaagcatgagtactggtttgctgtgccccaggagaggacagaccacctgtatgccttcttcatccagtggagccctgagatctatgcagaggacaccggggagtacacccgggagcccggcttcatcgtggtgaagaagattgaggagagcgagaccatcgaggacagcagcaaccaggccgccgcccgggagtgggagatcaccacccgggaggacatcaacagcaagcaggtggccaccgtgaaggctgacctggagagcgagagcttccggcccaacctgagtgaccccagcgagctgctgctgcctgaccagatcgagaagctgaccaagcacctgccccccaggaccatcggctacccctggaccctggtgtatggcaccgggaagcacggcaccagcctgaagaccctgtaccgcaccatgacaggcctggacacccctgtgctgatggtgatcaaggacagtgatggccaggtgtttggagccctggccagcgagcccctgaaggtgtctgatggcttctacggcaccggggagacctttgtgttcaccttctgcccagagtttgaggtgttcaagtggacaggagacaacatgttcttcatcaagggggacatggacagcctggccttcggcggcggcggcggggagtttgccctgtggctggatggagacctgtaccacggccgcagccacagctgcaagaccttcggcaacagaaccctgagcaagaaggaggacttcttcatccaggacatcgagatctgggcctttgaatag

SEQ ID NO: 162938 - DNA, 651 bp, Artificial Sequence
  Description of Artificial Sequence: Synthetic coding sequence
atgagccggctgtggtacggcaagaagggcagaagacaccagcccatcaaccacaagtacaccctcatcaccacccgggaggacatcaacagcaagcaggtggccaccgtgaaggctgacctggagagcgagagcttccggcccaacctgagtgaccccagcgagctgctgctgcctgaccagatcgagaagctgaccaagcacctgccccccaggaccatcggctacccctggaccctggtgtatggcaccgggaagcacggcaccagcctgaagaccctgtaccgcaccatgacaggcctggacacccctgtgctgatggtgatcaaggacagtgatggccaggtgtttggagccctggccagcgagcccctgaaggtgtctgatggcttctacggcaccggggagacctttgtgttcaccttctgcccagagtttgaggtgttcaagtggacaggagacaacatgttcttcatcaagggggacatggacagcctggccttcggcggcggcggcggggagtttgccctgtggctggatggagacctgtaccacggccgcagccacagctgcaagaccttcggcaacagaaccctgagcaagaaggaggacttcttcatccaggacatcgagatctgggcctttgaatag

SEQ ID NO: 162939 - DNA, 885 bp, Artificial Sequence
  Description of Artificial Sequence: Synthetic coding sequence
atgcagcagaccaagcagcagcgggagaacatccagcaggtgtcccagaaggaggccaagcacaagatcaccagcgcagatggccacatcgagagcagcgccctgctgaaggagaagcagaggcaccggctgcacaagttcctgtgcctgcgggtgggcaagcccatgaggaagacctttgtgtcccaggccagcgccaccatgcagcagtatgcccagagggacaagaagcatgagtactggtttgctgtgccccaggagaggacagaccacctgtatgccttcttcatccagtggagccctgagatctatgcagaggacaccggggagtacacccgggagcccggcttcatcgtggtgaagaagattgaggagagcgagaccatcgaggacagcagcaaccaggccgccgcccgggagtgggagctgaccaagcacctgccccccaggaccatcggctacccctggaccctggtgtatggcaccgggaagcacggcaccagcctgaagaccctgtaccgcaccatgacaggcctggacacccctgtgctgatggtgatcaaggacagtgatggccaggtgtttggagccctggccagcgagcccctgaaggtgtctgatggcttctacggcaccggggagacctttgtgttcaccttctgcccagagtttgaggtgttcaagtggacaggagacaacatgttcttcatcaagggggacatggacagcctggccttcggcggcggcggcggggagtttgccctgtggctggatggagacctgtaccacggccgcagccacagctgcaagaccttcggcaacagaaccctgagcaagaaggaggacttcttcatccaggacatcgagatctgggcctttgaatag

SEQ ID NO: 162940 - DNA, 1512 bp, Artificial Sequence
  Description of Artificial Sequence: Synthetic coding sequence
atgttctgccagaggaaggacaccggccagaagaagaccctggacaagaaggatggccgcaggatgtccttccagaagcccaagggcaccatcgagtacacagtggagagccgggacagcctgaacagcatcgccctgaagtttgacaccaccccaaatgagctggtgcagctgaacaagctgttcagcagagctgtggtgacaggccaggtgctgtatgtgcctgaccctgaatatgtgtcctctgtggagagcagccccagcctgagccctgtgagccccctgagccccaccagcagcgaggccgagtttgacaagaccaccaacccagatgtgcaccccacagaggccacccccagcagcaccttcaccggcatccggcctgcccgggtggtgagcagcaccagcgaggaggaggaggccttcacagagaagttcctgaagatcaactgcaagtacatcaccagcggcaagggcaccgtgtctggagtgctgctggtgacccccaacaacatcatgtttgacccccacaagaatgaccccctggtgcaggagaatggctgtgaggagtatggcatcatgtgccccatggaggaggtgatgtctgctgccatgtacaaggagatcctggacagcaagatcaaggagagcctgcccatcgacatcgaccagctgagcggccgggacttctgccacagcaagaagatgacaggcagcaacacagaggagattgacagccgcatcagagatgctggaaatgattctgccagcacagcccccaggagcacagaggagagcctgtctgaagatgtgttcacagaaagtgagctgagccccatccgggaggagctggtgtccagtgatgagctgcggcaggacaagagcagcggggccagcagcgagagcgtgcagacagtgaaccaggccgaggtggagagcctgactgtgaagtctgagagcacaggcaccccaggccacctgcggagtgacacagagcacagcaccaatgaggtgggcaccctgtgccacaagacagacctgaacaacctggagatggccatcaaggaggaccagattgctgacaacttccagggcatcagcggccccaaggaggacagcaccagcatcaagggcaacagcgaccaggacagcttcctgcacgagaacagcctgcaccaggaggagagccagaaggagaacatgccctgtggggagacagctgagttcaagcagaagcagagcgtgaacaagggcaagcagggcaaggagcagaaccaggacagccagacagaggccgaggagctgaggaagctgtggaagacccacaccatgcagcagaccaagcagcagcgggagaacatccagcaggtgtcccagaaggaggccaagcacaagatcaccagcgcagatggccacatcgagagcaagtgctacagagtgaatgaggtgagcagcagcaactgcatggtgagccccagcttcctgacagacagcaaggctgctgtgccctag

SEQ ID NO: 162941 - DNA, 2622 bp, Artificial Sequence
  Description of Artificial Sequence: Synthetic coding sequence
atgtctgtgagcaacctgtcctggctgaagaagaagagccagagcgtggacatcaatgcccctggcttcaaccccctggccggggccggcaagcagaccccccaggccagcaagcccccagcccccaagacccccatcatcgaggaggagcagaacaatgctgccaacacccagaagcaccccagcagaagaagtgagctgaagcgcttctacaccatcgacaccggccagaagaagaccctggacaagaaggatggaagaaggatgtccttccagaagcccaagggcaccatcgagtacacagtggagagccgggacagcctgaacagcatcgccctgaagtttgacaccaccccaaatgagctggtgcagctgaacaagctgttcagcagagctgtggtgacaggccaggtgctgtatgtgcctgaccctgaatatgtgtcctctgtggagagcagccccagcctgagccctgtgagccccctgagccccaccagcagcgaggccgagtttgacaagaccaccaacccagatgtgcaccccacagaggccacccccagcagcaccttcaccggcatccggcctgcccgggtggtgagcagcaccagcgaggaggaggaggccttcacagagaagttcctgaagatcaactgcaagtacatcaccagcgggaaaggaacagtgtctggagtgctgctggtgacccccaacaacatcatgtttgacccccacaagaatgaccccctggtgcaggagaatggctgtgaggagtatggcatcatgtgccccatggaggaggtgatgtctgctgccatgtacaaggagatcctggacagcaagatcaaggagagcctgcccattgatattgaccagctgagcggccgggacttctgccacagcaagaagatgacaggcagcaacacagaggagattgacagccgcatcagagatgctggaaatgacagcgccagcacagcccccaggagcacagaggagagcctgtctgaagatgtgttcacagagagcgagctgagccccatccgggaggagctggtgtccagtgatgagctgcggcaggacaagagcagcggggccagcagcgagagcgtgcagacagtgaaccaggccgaggtggagagcctgactgtgaagtctgagagcacaggcaccccaggccacctgcggagtgacacagagcacagcaccaatgaggtgggcaccctgtgccacaagacagacctgaacaacctggagatggccatcaaggaggaccagattgctgacaacttccagggcatcagcggccccaaggaggacagcaccagcatcaagggcaacagcgaccaggacagcttcctgcacgagaacagcctgcaccaggaggagagccagaaggagaacatgccctgtggggagacagctgagttcaagcagaagcagagcgtgaacaagggcaagcagggcaaggagcagaaccaggacagccagacagaagctgaggagctgaggaagctgtggaagacccacaccatgcagcagaccaagcagcagcgggagaacatccagcaggtgtcccagaaggaggccaagcacaagatcaccagcgcagatggccacatcgagagcagcgccctgctgaaggagaagcagaggcaccggctgcacaagttcctgtgcctgcgggtgggcaagcccatgaggaagacctttgtgtcccaggccagcgccaccatgcagcagtatgcccagagggacaagaagcatgagtactggtttgctgtgccccaggagaggacagaccacctgtatgccttcttcatccagtggagccctgagatctatgcagaggacaccggggagtacacccgggagcccggcttcatcgtggtgaagaagattgaggagagcgagaccatcgaggacagcagcaaccaggccgccgcccgggagtgggaggtggtgtctgtggccgagtaccacagaagaattgatgccctgaacacagaggagctgcggaccctgtgccggcggctgcagatcaccacccgggaggacatcaacagcaagcaggtggccaccgtgaaggctgacctggagagcgagagcttccggcccaacctgagtgaccccagcgagctgctgctgcctgaccagatcgagaagctgaccaagcacctgccccccaggaccatcggctacccctggaccctggtgtatggaacaggcaagcacggcaccagcctgaagaccctgtaccgcaccatgacaggcctggacacccctgtgctgatggtgatcaaggacagtgatggccaggtgtttggagccctggccagcgagcccctgaaggtgtctgatggcttctatggaactggagagacctttgtgttcaccttctgcccagagtttgaggtgttcaagtggacaggagacaacatgttcttcatcaagggggacatggacagcctggcctttggaggcggcggcggggagtttgccctgtggctggatggagacctgtaccacggccgcagccacagctgcaagacctttggaaacagaaccctgagcaagaaggaggacttcttcatccaggacatcgagatctgggcctttgaatag

SEQ ID NO: 162942 - DNA, 2541 bp, Artificial Sequence; identical to SEQ ID NO: 162937
  Description of Artificial Sequence: Synthetic coding sequence

SEQ ID NO: 162943 - DNA, 822 bp, Artificial Sequence
  Description of Artificial Sequence: Synthetic coding sequence
atgacctttgatgacctgaagatccagacagtgaaggaccagccagatgagaagagcaatggcaagaaggccaagggcctgcagttcctgtacagcccctggtggtgcctggccgccgccaccctgggcgtgctgtgcctgggcctggtggtgaccatcatggtgctgggcatgcagctgagccaggtgtctgacctgctgacccaggagcaggccaacctgacccaccagaagaagaagctggagggccagatcagcgcccggcagcaggccgaggaggccagccaggagagtgaaaatgagctgaaggagatgattgagaccctggccaggaagctgaatgagaagagcaaggagcagatggagctgcaccaccagaacctgaacctgcaggagaccctgaagagggtggccaactgcagcgccccctgcccccaggactggatctggcatggagagaactgctacctgttcagcagcggcagcttcaactgggagaagagccaggagaagtgcctgagcctggatgccaagctgctgaagatcaacagcacagctgacctggacttcatccagcaggccatctcctacagcagcttccccttctggatgggcctgagcagaagaaaccccagctacccctggctgtgggaggatggcagccccctgatgccccacctgttccgggtgagaggagctgtgtcccagacctaccccagcggcacctgtgcctacatccagagaggagctgtgtatgcagagaactgcatcctggccgccttcagcatctgccagaagaaggccaacctgcgggcccagtag

SEQ ID NO: 162944 - DNA, 546 bp, Artificial Sequence
  Description of Artificial Sequence: Synthetic coding sequence
atgacctttgatgacctgaagatccagacagtgaaggaccagccagatgagaagagcaatggcaagaaggccaagggcctgcagttcctgtacagcccctggtggtgcctggccgccgccaccctgggcgtgctgtgcctgggcctggtggtgaccatcatggtgctgggcatgcagctgagccaggtgtctgacctgctgacccaggagcaggccaacctgacccaccagaagaagaagctggagggccagatcagcgcccggcagcaggccgaggaggccagccaggagagtgaaaatgagctgaaggagatgattgagaccctggccaggaagctgaatgagaagagcaaggagcagatggagctgcaccaccagaacctgaacctgcaggagaccctgaagagggtggccaactgcagcggcctgcacccagccagcaacttcctgttccagttcagcatcctggatggagctgtgtctgaggagccccagctgcccatggccctgggcggccgcttctcctttgatgcccccctcatctag

SEQ ID NO: 162945 - DNA, 570 bp, Artificial Sequence
  Description of Artificial Sequence: Synthetic coding sequence
atgacctttgatgacctgaagatccagacagtgaaggaccagccagatgagaagagcaatggcaagaaggccaagggcctgcagttcctgtacagcccctggtggtgcctggccgccgccaccctgggcgtgctgtgcctgggcctggtggtgaccatcatggtgctgggcatgcagctgagccaggtgtctgacctgctgacccaggagcaggccaacctgacccaccagaagaagaagctggagggccagatcagcgcccggcagcaggccgaggaggccagccaggagagtgaaaatgagctgaaggagatgattgagaccctggccaggaagctgaatgagaagagcaaggagcagatggagctgcaccaccagaacctgaacctgcaggagaccctgaagagggtggccaactgcagcgccccctgcccccaggactggatctggcatggagagaactgctacctgttcagcagcggcagcttcaactgggagaagagccaggagaagtgcctgagcctggatgccaagctgctgaagatcaacagcacagctgacctgatctag

SEQ ID NO: 162946 - DNA, 1623 bp, Artificial Sequence; identical to SEQ ID NO: 159372
  Description of Artificial Sequence: Synthetic coding sequence

SEQ ID NO: 162947 - DNA, 636 bp, Artificial Sequence
  Description of Artificial Sequence: Synthetic coding sequence
atgttccacctgcggacctgtgccgccaagctgcggcccctgacagccagccagacagtgaagaccttcagccagaacagacctgctgctgcccggaccttccagcagatccgctgctacagcgcccctgtggccgctgagcccttcctgagcggcaccagcagcaactacgtggaggagatgtactgtgcctggctggagaaccccaagtctgtgcacaagtcctgggacatcttcttcaggaacaccaatgctggggcccctcctggaacagcctaccagagccccctgcccctgagccggggcagcctggccgctgtggcccacgcccagagcctggtggaggcccagcccaacgtggacaagctggtggaggaccacctggccgtgcagagcctcatccgggcctaccagatccggggccaccacgtggcccagctggaccccctgggcatcctggatgctgacctggacagctctgtgcctgctgacatcatcagcagcacagacaagctgggcttctacggcctggatgaaagtgacctggacaaggtgttccacctgcccaccaccaccttcatcggcggccaggagagcgccctgcccctgcgggagatcatccggcggctggagtag

SEQ ID NO: 162948 - DNA, 1284 bp, Artificial Sequence
  Description of Artificial Sequence: Synthetic coding sequence
atgttccacctgcggacctgtgccgccaagctgcggcccctgacagccagccagacagtgaagaccttcagccagaacagacctgctgctgcccggaccttccagcagatccgctgctacagcgcccctgtggccgctgagcccttcctgagcggcaccagcagcaactacgtggaggagatgtactgtgcctggctggagaaccccaagtctgtgcacaagtcctgggacatcttcttcaggaacaccaatgctggggcccctcctggaacagcctaccagagccccctgcccctgagccggggcagcctggccgctgtggcccacgcccagagcctggtggaggcccagcccaacgtggacaagctggtggaggaccacctggccgtgcagagcctcatccgggcctaccagatccggggccaccacgtggcccagctggaccccctgggcatcctggatgctgacctggacagctctgtgcctgctgacatcatcagcagcacagacaagctgggcttctacggcctggatgaaagtgacctggacaaggtgttccacctgcccaccaccaccttcatcggcggccaggagagcgccctgcccctgcgggagatcatccggcggctggagatggcctactgccagcacatcggcgtggagttcatgttcatcaatgacctggagcagtgccagtggatccggcagaagtttgagaccccaggcatcatgcagttcaccaatgaggagaagaggaccctgctggcccggctggtgcgcagcaccaggtttgaggagttcctgcagaggaagtggagcagcgagaagcgcttcggcctggagggctgtgaggtgctgatcccagccctgaagaccatcatcgacaagagcagtgaaaatggagtggactatgtgatcatgggcatgccccaccggggccgcctgaatgtgctggccaacgtcatcaggaaggagctggagcagatcttctgccagtttgacagcaagctggaggccgcagatgagggcagcggagatgtgaagtaccacctgggcatgtaccaccggcgcatcaacagagtgacagacaggaacatcaccctgagcctggtggccaaccccagccacctggaggccgctgaccctgtggtgatgggcaagaccaaggccgagcagttctactgtggggacacagagggcaagaaggtgcggccccgggagcggcgggcccggcagatcgtgaaggccccctgcagctccatggagttccgcagccccacctag

SEQ ID NO: 162949 - DNA, 2925 bp, Artificial Sequence
  Description of Artificial Sequence: Synthetic coding sequence
atgtactgtgcctggctggagaaccccaagtctgtgcacaagtcctgggacatcttcttcaggaacaccaatgctggggcccctcctggaacagcctaccagagccccctgcccctgagccggggcagcctggccgctgtggcccacgcccagagcctggtggaggcccagcccaacgtggacaagctggtggaggaccacctggccgtgcagagcctcatccgggcctaccaggtgcggggccaccacatcgccaagctggaccccctgggcatcagctgtgtgaactttgatgatgcccctgtgacagtgagcagcaatgtggacctggccgtgttcaaggagcggctgaggatgctgactgtgggcggcttctacggcctggatgaaagtgacctggacaaggtgttccacctgcccaccaccaccttcatcggcggccaggagagcgccctgcccctgcgggagatcatccggcggctggagatggcctactgccagcacatcggcgtggagttcatgttcatcaatgacctggagcagtgccagtggatccggcagaagtttgagaccccaggcatcatgcagttcaccaatgaggagaagaggaccctgctggcccggctggtgcgcagcaccaggtttgaggagttcctgcagaggaagtggagcagcgagaagagatttggcctggagggctgtgaggtgctgatcccagccctgaagaccatcatcgacaagagcagtgaaaatggagtggactatgtgatcatgggcatgccccaccggggccgcctgaatgtgctggccaacgtcatcaggaaggagctggagcagatcttctgccagtttgacagcaagctggaggccgcagatgagggcagcggagatgtgaagtaccacctgggcatgtaccaccggcgcatcaacagagtgacagacaggaacatcaccctgagcctggtggccaaccccagccacctggaggccgctgaccctgtggtgatgggcaagaccaaggccgagcagttctactgtggggacacagagggcaagaaggtgatgagcatcctgctgcatggagatgctgcctttgctggccagggcatcgtgtatgagaccttccacctgagtgacctgcccagctacaccacccacggcaccgtgcacgtggtggtgaacaaccagatcggcttcaccacagaccccaggatggcccggagcagcccctaccccacagatgtggcccgggtggtgaatgcccccatcttccacgtgaacagtgatgatcctgaggccgtgatgtatgtgtgcaaggtggccgctgagtggaggagcaccttccacaaggatgtggtggtggacctggtgtgctacagaagaaatggccacaatgagatggatgagcccatgttcacccagcccctgatgtacaagcagatcaggaagcagaagcctgtgctgcagaagtatgcagagctgctggtgtcccagggcgtggtgaaccagccagaatatgaggaggagatcagcaaatatgacaagatctgtgaggaggcctttgcccggagcaaggatgagaagatcctgcacatcaagcactggctggacagcccctggccaggcttcttcaccctggatggccagcccaggtccatgagctgccccagcacaggcctgacagaggacatcctgacccacatcggaaatgtggccagctctgtgcctgtggagaacttcaccatccatggaggcctgagccgcatcctgaagaccagaggagagatggtgaagaacagaacagtggactgggccctggccgagtacatggccttcggcagcctgctgaaggagggcatccacatccggctgagcggccaggatgtggagcggggcaccttcagccaccgccaccacgtgctgcatgaccagaatgtggacaagaggacctgcatccccatgaaccacctgtggcccaaccaggccccctacacagtgtgcaacagcagcctgtctgaatatggagtgctgggctttgagctgggctttgccatggccagccccaatgccctggtgctgtgggaggcccagtttggagacttccacaacacagcccagtgcatcatcgaccagttcatctgccccggccaggccaagtgggtgcggcagaatggcatcgtgctgctgctgccccacggcatggagggcatgggccctgagcacagcagcgcccggcctgagcgcttcctgcagatgtgcaatgatgatcctgatgtgctgcctgacctgaaggaggccaactttgacatcaaccagctgtatgactgcaactgggtggtggtgaactgcagcaccccaggcaacttcttccacgtgctgcggcggcagatcctgctgcccttcaggaagcccctcatcatcttcacccccaagagcctgctgcggcaccctgaggcccggagcagctttgatgagatgctgcccggcacccacttccagagggtcatcccagaagatggccctgctgcccagaacccagaaaatgtgaagaggctgctcttctgcaccgggaaggtgtactatgacctgacccgggagaggaaggcccgggacatggtgggccaggtggccatcaccagaattgagcagctgagccccttcccctttgacctgctgctgaaggaggtgcagaagtacccaaatgctgagctggcctggtgccaggaggagcacaagaaccagggctactatgactatgtgaagccccggctgcggaccaccatcagccgggccaagcctgtgtggtacgccggccgggaccctgctgctgccccagccactggaaacaagaagacccacctgacagagctgcagaggctgctggacacagcctttgacctggatgtgttcaagaacttctcctag

SEQ ID NO: 162950 - DNA, 3060 bp, Artificial Sequence
  Description of Artificial Sequence: Synthetic coding sequence
atgttccacctgcggacctgtgccgccaagctgcggcccctgacagccagccagacagtgaagaccttcagccagaacagacctgctgctgcccggaccttccagcagatccgctgctacagcgcccctgtggccgctgagcccttcctgagcggcaccagcagcaactacgtggaggagatgtactgtgcctggctggagaaccccaagtctgtgcacaagtcctgggacatcttcttcaggaacaccaatgctggggcccctcctggaacagcctaccagagccccctgcccctgagccggggcagcctggccgctgtggcccacgcccagagcctggtggaggcccagcccaacgtggacaagctggtggaggaccacctggccgtgcagagcctcatccgggcctaccaggtgcggggccaccacatcgccaagctggaccccctgggcatcagctgtgtgaactttgatgatgcccctgtgacagtgagcagcaatgtgggcttctacggcctggatgaaagtgacctggacaaggtgttccacctgcccaccaccaccttcatcggcggccaggagagcgccctgcccctgcgggagatcatccggcggctggagatggcctactgccagcacatcggcgtggagttcatgttcatcaatgacctggagcagtgccagtggatccggcagaagtttgagaccccaggcatcatgcagttcaccaatgaggagaagaggaccctgctggcccggctggtgcgcagcaccaggtttgaggagttcctgcagaggaagtggagcagcgagaagcgcttcggcctggagggctgtgaggtgctgatcccagccctgaagaccatcatcgacaagagcagtgaaaatggagtggactatgtgatcatgggcatgccccaccggggccgcctgaatgtgctggccaacgtcatcaggaaggagctggagcagatcttctgccagtttgacagcaagctggaggccgcagatgagggcagcggagatgtgaagtaccacctgggcatgtaccaccggcgcatcaacagagtgacagacaggaacatcaccctgagcctggtggccaaccccagccacctggaggccgctgaccctgtggtgatgggcaagaccaaggccgagcagttctactgtggggacacagagggcaagaaggtgatgagcatcctgctgcatggagatgctgcctttgctggccagggcatcgtgtatgagaccttccacctgagtgacctgcccagctacaccacccatggaacagtgcacgtggtggtgaacaaccagatcggcttcaccacagaccccaggatggcccggagcagcccctaccccacagatgtggcccgggtggtgaatgcccccatcttccacgtgaacagtgatgatcctgaggccgtgatgtatgtgtgcaaggtggccgctgagtggaggagcaccttccacaaggatgtggtggtggacctggtgtgctacagaagaaatggccacaatgagatggatgagcccatgttcacccagcccctgatgtacaagcagatcaggaagcagaagcctgtgctgcagaagtatgcagagctgctggtgtcccagggcgtggtgaaccagccagaatatgaggaggagatcagcaaatatgacaagatctgtgaggaggcctttgcccggagcaaggatgagaagatcctgcacatcaagcactggctggacagcccctggccaggcttcttcaccctggatggccagcccaggtccatgagctgccccagcacaggcctgacagaggacatcctgacccacatcggaaatgtggccagctctgtgcctgtggagaacttcaccatccacggcggcctgagccgcatcctgaagaccagaggagagatggtgaagaacagaacagtggactgggccctggccgagtacatggccttcggcagcctgctgaaggagggcatccacatccggctgagcggccaggatgtggagcggggcaccttcagccaccgccaccacgtgctgcatgaccagaatgtggacaagaggacctgcatccccatgaaccacctgtggcccaaccaggccccctacacagtgtgcaacagcagcctgtctgaatatggagtgctgggctttgagctgggctttgccatggccagccccaatgccctggtgctgtgggaggcccagtttggagacttccacaacacagcccagtgcatcatcgaccagttcatctgccccggccaggccaagtgggtgcggcagaatggaattgtgctgctgctgccccacggcatggagggcatgggccctgagcacagcagcgcccggcctgagcgcttcctgcagatgtgcaatgatgatcctgatgtgctgcctgacctgaaggaggccaactttgacatcaaccagctgtatgactgcaactgggtggtggtgaactgcagcaccccaggcaacttcttccacgtgctgcggcggcagatcctgctgcccttcaggaagcccctcatcatcttcacccccaagagcctgctgcggcaccctgaggcccggagcagctttgatgagatgctgcccggcacccacttccagagggtcatcccagaagatggccctgctgcccagaacccagaaaatgtgaagaggctgctcttctgcaccgggaaggtgtactatgacctgacccgggagaggaaggcccgggacatggtgggccaggtggccatcacccgcatcgagcagctgagccccttcccctttgacctgctgctgaaggaggtgcagaagtacccaaatgctgagctggcctggtgccaggaggagcacaagaaccagggctactatgactatgtgaagccccggctgcggaccaccatcagccgggccaagcctgtgtggtacgccggccgggaccctgctgctgccccagccaccggcaacaagaagacccacctgacagagctgcagaggctgctggacacagcctttgacctggatgtgttcaagaacttctcctag

SEQ ID NO: 162951 - DNA, 2424 bp, Artificial Sequence
  Description of Artificial Sequence: Synthetic coding sequence
atggccgccacagagctgcggggcgtggtgggccctggccctgctgccatcgccgccctgggcggcggcggggccggcccccctgtggtgggcggcggcggcggcagaggagatgctggccctggcagcggggccgccagcggcaccgtggtggccgctgctgctgggggccctggccctggggccggcggcgtggccgccgccggccctgccccagccccacccaccggcggcagcggcggcagcggggccggcggcagcggcagcgcccgggagggctggctgttcaagtggaccaactacatcaagggctaccagaggcgctggtttgtgctgagcaatggcctgctgagctactaccgcagcaaggccgagatgaggcacacctgccggggcaccatcaacctggccacagccaacatcaccgtggaggacagctgcaacttcatcatcagcaatggaggagcccagacctaccacctgaaggccagcagcgaggtggagcggcagcgctgggtgacagccctggagctggccaaggccaaggctgtgaagatgctggccgagagtgatgaaagtggagatgaggagagcgtgtcccagacagacaagacagagctgcagaacaccctgcggaccctgagcagcaaggtggaggacctgagcacctgcaatgacctgattgccaagcatggaacagccctgcagaggagcctgtctgagctggagagcctgaagctgcctgctgagagcaatgagaagatcaagcaggtgaatgaaagagccaccctcttccgcatcaccagcaatgccatgatcaatgcctgccgggacttcctgatgctggcccagacccacagcaagaagtggcagaagagcctgcagtatgaaagagaccagaggatccggctggaggagaccctggagcagctggccaagcagcacaaccacctggagcgggccttccggggggccaccgtgctgcctgccaacaccccaggaaatgtgggcagcggcaaggaccagtgctgcagcgggaaaggagacatgtctgatgaagatgatgaaaatgagttctttgatgcccctgagatcatcaccatgcctgagaacctgggccacaagaggacaggcagcaacatcagcggggccagcagtgacatcagcctggatgagcagtacaagcaccagctggaggagaccaagaaggagaagaggacccgcatcccctacaagcccaactacagcctgaacctgtggagcatcatgaagaactgcatcggcaaggagctgagcaagatccccatgcctgtgaacttcaatgagcccctgtccatgctgcagaggctgacagaggacctggagtaccacgagctgctggacagagctgccaagtgtgagaacagcctggagcagctgtgctacgtggccgccttcaccgtgtcctcctacagcaccaccgtcttccgcaccagcaagcccttcaaccccctgctgggggagacctttgagctggaccggctggaggagaatggctaccgcagcctgtgtgagcaggtgagccaccaccccccagctgctgcccaccacgccgagagcaagaatggctggaccctgcggcaggagatcaagatcaccagcaagttccggggcaagtacctgagcatcatgcccctgggcaccatccactgcatcttccacgccaccggccaccactacacctggaagaaggtgaccaccaccgtgcacaacatcatcgtgggcaagctgtggattgaccagagcggggagattgacatcgtgaaccacaagacaggagacaagtgcaacctgaagtttgtgccctacagctacttcagcagagatgtggccaggaaggtgactggagaggtgacagaccccagcggcaaggtgcactttgccctgctgggcacctgggatgagaagatggagtgcttcaaggtgcagcctgtgattggagaaaatggaggagatgcccggcagaggggccatgaagctgaggagagccgggtgatgctgtggaagaggaaccccctgcccaagaatgctgagaacatgtactacttcagcgagctggccctgaccctgaatgcctgggagagcggcacagcccccacagacagccggctgcggccagaccagaggctgatggagaatggccgctgggatgaggccaatgctgagaagcagaggctggaggagaagcagaggctgagcaggaagaagcgggaggccgaggccatgaaggccacagaagatggcaccccctatgacccctacaaggccctgtggtttgagaggaagaaggaccctgtgaccaaggagctgacccacatctacagaggagagtactgggagtgcaaggagaagcaggactggagcagctgcccagacatcttctag

SEQ ID NO: 162952 - DNA, 1224 bp, Artificial Sequence
  Description of Artificial Sequence: Synthetic coding sequence
atggccgccacagagctgcggggcgtggtgggccctggccctgctgccatcgccgccctgggcggcggcggggccggcccccctgtggtgggcggcggcggcggcagaggagatgctggccctggcagcggggccgccctgcagaggctgacagaggacctggagtaccacgagctgctggacagagctgccaagtgtgagaacagcctggagcagctgtgctacgtggccgccttcaccgtgtcctcctacagcaccaccgtcttccgcaccagcaagcccttcaaccccctgctgggggagacctttgagctggaccggctggaggagaatggctaccgcagcctgtgtgagcaggtgagccaccaccccccagctgctgcccaccacgccgagagcaagaatggctggaccctgcggcaggagatcaagatcaccagcaagttccggggcaagtacctgagcatcatgcccctgggcaccatccactgcatcttccacgccaccggccaccactacacctggaagaaggtgaccaccaccgtgcacaacatcatcgtgggcaagctgtggattgaccagagcggggagattgacatcgtgaaccacaagacaggagacaagtgcaacctgaagtttgtgccctacagctacttcagcagagatgtggccaggaaggtgactggagaggtgacagaccccagcggcaaggtgcactttgccctgctgggcacctgggatgagaagatggagtgcttcaaggtgcagcctgtgattggagaaaatggaggagatgcccggcagaggggccatgaagctgaggagagccgggtgatgctgtggaagaggaaccccctgcccaagaatgctgagaacatgtactacttcagcgagctggccctgaccctgaatgcctgggagagcggcacagcccccacagacagccggctgcggccagaccagaggctgatggagaatggccgctgggatgaggccaatgctgagaagcagaggctggaggagaagcagaggctgagcaggaagaagcgggaggccgaggccatgaaggccacagaagatggcaccccctatgacccctacaaggccctgtggtttgagaggaagaaggaccctgtgaccaaggagctgacccacatctacagaggagagtactgggagtgcaaggagaagcaggactggagcagctgcccagacatcttctag

SEQ ID NO: 162953 - DNA, 2751 bp, Artificial Sequence
  Description of Artificial Sequence: Synthetic coding sequence
atgggcaaggctgctgcccccagccggggcggcggctgcggcggccgcagccggggcctgagcagcctcttcaccgtggtgccctgcctgagctgccacacagctgcccctggcatgtctgccagcaccagcggcagcggccctgagcccaagccccagccccagcctgtgcctgagcctgagcggggccccctgtctgagcaggtgtctgaggccgtgtctgaggccgtgcccaggtctgagcctgtgtctgagaccaccagcgagcctgagcccggggccggccagcccagcgagctgctgcagggcagccggcccggcagcgagagcagcagcggcgtgggcgccggccccttcaccaaggccgccagcgagcccctgagcagagctgtgggcagcgccaccttcctgcggcctgagagcggcagcctgcctgccctgaagcccctgcccctgctgcggcccggccaggccaagacccccctgggcgtgcccatgtctggaacaggcaccaccagcagcgcccccctggccctgctgcccctggacagctttgagggctggctgctgaagtggaccaactacctgaagggctaccagaggcgctggtttgtgctgggcaatggcctgctgagctactacagaaaccagggcgagatggcccacacctgccggggcaccatcaacctgagcacagcccacatcgacacagaggacagctgtggcatcctgctgaccagcggggcccggagctaccacctgaaggccagcagcgaggtggaccggcagcagtggatcacagccctggagctggccaaggccaaggctgtgcgggtgatgaacacccacagtgatgattctggagatgatgatgaggccaccaccccagctgacaagtctgagctgcaccacaccctgaagaacctgagcctgaagctggatgacctgagcacctgcaatgacctgattgccaagcacggggccgccctgcagaggagcctgacagagctggatggcctgaagatccccagcgagagcggggagaagctgaaggtggtgaatgaaagagccaccctcttccgcatcaccagcaatgccatgatcaatgcctgccgggacttcctggagctggccgagatccacagcaggaagtggcagagggccctgcagtatgagcaggagcagagggtgcacctggaggagaccatcgagcagctggccaagcagcacaacagcctggagcgggccttccacagcgcccctggccggcctgccaaccccagcaagagcttcatcgagggcagcctgctgacccccaagggggaggacagcgaggaggatgaggacacagagtactttgatgccatggaggacagcaccagcttcatcaccgtcatcacagaggccaaggaggacagcaggaaggccgagggcagcacaggcaccagctctgtggactggagcagcgctgacaacgtgctggatggagccagcctggtgcccaagggcagcagcaaggtgaagagaagagtgcgcatccccaacaagcccaactacagcctgaacctgtggagcatcatgaagaactgcatcggccgggagctgagccgcatccccatgcctgtgaacttcaatgagcccctgtccatgctgcagaggctgacagaggacctggagtaccaccacctgctggacaaggctgtgcactgcaccagctctgtggagcagatgtgcctggtggccgccttctctgtgtcctcctacagcaccaccgtgcacagaattgccaagcccttcaaccccatgctgggggagacctttgagctggaccggctggatgacatgggcctgcggagcctgtgtgagcaggtgagccaccacccccccagcgctgcccactacgtgttcagcaagcacggctggagcctgtggcaggagatcaccatcagcagcaagttccggggcaagtacatcagcatcatgcccctgggcgccatccacctggagttccaggccagcggcaaccactacgtgtggaggaagagcaccagcacagtgcacaacatcatcgtgggcaagctgtggattgaccagagcggggacatcgagatcgtgaaccacaagaccaatgaccgctgccagctgaagttcctgccctacagctacttcagcaaggaggccgccaggaaggtgactggagtggtgtctgacagccagggcaaggcccactacgtgctgagcggctcctgggatgagcagatggagtgcagcaaggtgatgcacagcagccccagcagccccagcagtgatggcaagcagaagacagtgtaccagaccctgagcgccaagctgctgtggaagaagtaccccctgcctgaaaatgctgagaacatgtactacttcagcgagctggccctgaccctgaatgaacatgaggagggcgtggcccccacagacagccggctgcggccagaccagaggctgatggagaagggccgctgggatgaggccaacacagagaagcagaggctggaggagaagcagaggctgagcagaagaagaaggctggaggcctgtggccctggcagcagctgcagcagcgaggaggagaaggaggctgatgcctacacccccctgtggtttgagaagaggctggaccccctgactggagagatggcctgtgtgtacaagggcggctactgggaggccaaggagaagcaggactggcacatgtgccccaacatcttctag

SEQ ID NO: 162954 - DNA, 2625 bp, Artificial Sequence
  Description of Artificial Sequence: Synthetic coding sequence
atgggcaaggctgctgcccccagccggggcggcggctgcggcggccgcagccggggcctgagcagcctcttcaccgtggtgccctgcctgagctgccacacagctgcccctggcatgtctgccagcaccagcggcagcggccctgagcccaagccccagccccagcctgtgcctgagcctgagcggggccccctgtctgagcaggtgtctgaggccgtgtctgaggccgtgcccaggtctgagcctgtgtctgagaccaccagcgagcctgagcccggggccggccagcccagcgagctgctgcagggcagccggcccggcagcgagagcagcagcggcgtgggcgccggccccttcaccaaggccgccagcgagcccctgagcagagctgtgggcagcgccaccttcctgcggcctgagagcggcagcctgcctgccctgaagcccctgcccctgctgcggcccggccaggccaagacccccctgggcgtgcccatgtctggaacaggcaccaccagcagcgcccccctggccctgctgcccctggacagctttgagggctggctgctgaagtggaccaactacctgaagggctaccagaggcgctggtttgtgctgggcaatggcctgctgagctactacagaaaccagggcgagatggcccacacctgccggggcaccatcaacctgagcacagcccacatcgacacagaggacagctgtggcatcctgctgaccagcggggcccggagctaccacctgaaggccagcagcgaggtggaccggcagcagtggatcacagccctggagctggccaaggccaaggctgtgcgggtgatgaacacccacagtgatgattctggagatgatgatgaggccaccaccccagctgacaagtctgagctgcaccacaccctgaagaacctgagcctgaagctggatgacctgagcacctgcaatgacctgattgccaagcacggggccgccctgcagaggagcctgacagagctggatggcctgaagatccccagcgagagcggggagaagctgaaggtggtgaatgaaagagccaccctcttccgcatcaccagcaatgccatgatcaatgcctgccgggacttcctggagctggccgagatccacagcaggaagtggcagagggccctgcagtatgagcaggagcagagggtgcacctggaggagaccatcgagcagctggccaagcagcacaacagcctggagcgggccttccacagcgcccctggccggcctgccaaccccagcaagagcttcatcgagggcagcctgctgacccccaagggggaggacagcgaggaggatgaggacacagagtactttgatgccatggaggacagcaccagcttcatcaccgtcatcacagaggccaaggaggacagcaggaaggccgagggcagcacaggcaccagctctgtggactggagcagcgctgacaacgtgaacttcaatgagcccctgtccatgctgcagaggctgacagaggacctggagtaccaccacctgctggacaaggctgtgcactgcaccagctctgtggagcagatgtgcctggtggccgccttctctgtgagcagctacagcaccaccgtgcaccgcatcgccaagcccttcaaccccatgctgggggagacctttgagctggaccggctggatgacatgggcctgcggagcctgtgtgagcaggtgagccaccaccccccatctgctgcccactacgtgttcagcaagcacggctggagcctgtggcaggagatcaccatcagcagcaagttccggggcaagtacatcagcatcatgcccctgggcgccatccacctggagttccaggccagcggcaaccactacgtgtggaggaagagcaccagcacagtgcacaacatcatcgtgggcaagctgtggattgaccagagcggggacattgaaattgtgaaccacaagaccaatgaccgctgccagctgaagttcctgccctacagctacttcagcaaggaggccgccaggaaggtgactggagtggtgtctgacagccagggcaaggcccactacgtgctgagcggctcctgggatgagcagatggagtgcagcaaggtgatgcacagcagccccagcagccccagcagtgatggcaagcagaagacagtgtaccagaccctgagcgccaagctgctgtggaagaagtaccccctgcctgaaaatgctgagaacatgtactacttcagcgagctggccctgaccctgaatgagcacgaggagggcgtggcccccacagacagccggctgcggccagaccagaggctgatggagaagggccgctgggatgaggccaacacagagaagcagaggctggaggagaagcagaggctgagcagaagaagaaggctggaggcctgtggccctggcagcagctgcagcagcgaggagggggaggccggccgggagggccggcctggaggagaggagcggggggcccgggtgggcgtgccccagggccgcatccctggagagcaggccaccagcccccccaccagccccctgtgcctgcccagccgggagggcggcggctgcctgcacgccaccgtggtgtag

SEQ ID NO: 162955 - DNA, 2253 bp, Artificial Sequence
  Description of Artificial Sequence: Synthetic coding sequence
atgcaccggcagaggaccaggaccatgagcagcctggccgccaagaggctgggcatgaacagaagacctgctggcagcggcggcggcggcggggaggccgccacctggggccaccgcttctggaggccccaggagcggcccacagacaggaaccagggcgagatggcccacacctgccggggcaccatcaacctgagcacagcccacatcgacacagaggacagctgtggcatcctgctgaccagcggggcccggagctaccacctgaaggccagcagcgaggtggaccggcagcagtggatcacagccctggagctggccaaggccaaggctgtgcgggtgatgaacacccacagtgatgacagcggagatgatgatgaggccaccaccccagctgacaagtctgagctgcaccacaccctgaagaacctgagcctgaagctggatgacctgagcacctgcaatgacctgattgccaagcatggagctgccctgcagaggagcctgacagagctggatggcctgaagatccccagcgagagcggggagaagctgaaggtggtgaatgaaagagccaccctcttccgcatcaccagcaatgccatgatcaatgcctgccgggacttcctggagctggccgagatccacagcaggaagtggcagagggccctgcagtatgagcaggagcagagggtgcacctggaggagaccatcgagcagctggccaagcagcacaacagcctggagcgggccttccacagcgcccctggccgcccagccaaccccagcaagagcttcatcgagggcagcctgctgacccccaagggagaagattctgaagaagatgaggacacagagtactttgatgccatggaggacagcaccagcttcatcaccgtcatcacagaggccaaggaggacaggaaggccgagggcagcacaggcaccagctctgtggactggagcagcgctgacaacgtgctggatggagccagcctggtgcccaagggcagcagcaaggtgaagagaagagtgcgcatccccaacaagcccaactacagcctgaacctgtggagcatcatgaagaactgcatcggccgggagctgagccgcatccccatgcctgtgaacttcaatgagcccctgtccatgctgcagaggctgacagaggacctggagtaccaccacctgctggacaaggctgtgcactgcaccagctctgtggagcagatgtgcctggtggccgccttctctgtgtcctcctacagcaccaccgtgcacagaattgccaagcccttcaaccccatgctgggggagacctttgagctggaccggctggatgacatgggcctgcggagcctgtgtgagcaggtgagccaccacccccccagcgctgcccactacgtgttcagcaagcacggctggagcctgtggcaggagatcaccatcagcagcaagttccggggcaagtacatcagcatcatgcccctgggcgccatccacctggagttccaggccagcggcaaccactacgtgtggaggaagagcaccagcacagtgcacaacatcatcgtgggcaagctgtggattgaccagagcggggacatcgagatcgtgaaccacaagaccaatgaccgctgccagctgaagttcctgccctacagctacttcagcaaggaggccgccaggaaggtgactggagtggtgtctgacagccagggcaaggcccactacgtgctgagcggctcctgggatgagcagatggagtgcagcaaggtgatgcacagcagccccagcagccccagcagtgatggcaagcagaagacagtgtaccagaccctgagcgccaagctgctgtggaagaagtaccccctgcctgaaaatgctgagaacatgtactacttcagcgagctggccctgaccctgaatgaacatgaggagggcgtggcccccacagacagccggctgcggccagaccagaggctgatggagaagggccgctgggatgaggccaacacagagaagcagaggctggaggagaagcagaggctgagcagaagaagaaggctggaggcctgtggccctggcagcagctgcagcagcgaggaggagaaggaggctgatgcctacacccccctgtggtttgagaagaggctggaccccctgactggagagatggcctgtgtgtacaagggcggctactgggaggccaaggagaagcaggactggcacatgtgccccaacatcttctag

SEQ ID NO: 162956 - DNA, 1980 bp, Artificial Sequence
  Description of Artificial Sequence: Synthetic coding sequence
atgaagggccggggctgctgggacacagcctctgtgcgctccttctgcagcagcggctgcctgaacaagttcaagaaggatgattctggagatgatgatgaggccaccaccccagctgacaagtctgagctgcaccacaccctgaagaacctgagcctgaagctggatgacctgagcacctgcaatgacctgattgccaagcacggggccgccctgcagaggagcctgacagagctggatggcctgaagatccccagcgagagcggggagaagctgaaggtggtgaatgaaagagccaccctcttccgcatcaccagcaatgccatgatcaatgcctgccgggacttcctggagctggccgagatccacagcaggaagtggcagagggccctgcagtatgagcaggagcagagggtgcacctggaggagaccatcgagcagctggccaagcagcacaacagcctggagcgggccttccacagcgcccctggccggcctgccaaccccagcaagagcttcatcgagggcagcctgctgacccccaagggggaggacagcgaggaggatgaggacacagagtactttgatgccatggaggacagcaccagcttcatcaccgtcatcacagaggccaaggaggacagcaggaaggccgagggcagcacaggcaccagctctgtggactggagcagcgctgacaacgtgctggatggagccagcctggtgcccaagggcagcagcaaggtgaagagaagagtgcgcatccccaacaagcccaactacagcctgaacctgtggagcatcatgaagaactgcatcggccgggagctgagccgcatccccatgcctgtgaacttcaatgagcccctgtccatgctgcagaggctgacagaggacctggagtaccaccacctgctggacaaggctgtgcactgcaccagctctgtggagcagatgtgcctggtggccgccttctctgtgtcctcctacagcaccaccgtgcacagaattgccaagcccttcaaccccatgctgggggagacctttgagctggaccggctggatgacatgggcctgcggagcctgtgtgagcaggtgagccaccacccccccagcgctgcccactacgtgttcagcaagcacggctggagcctgtggcaggagatcaccatcagcagcaagttccggggcaagtacatcagcatcatgcccctgggcgccatccacctggagttccaggccagcggcaaccactacgtgtggaggaagagcaccagcacagtgcacaacatcatcgtgggcaagctgtggattgaccagagcggggacatcgagatcgtgaaccacaagaccaatgaccgctgccagctgaagttcctgccctacagctacttcagcaaggaggccgccaggaaggtgactggagtggtgtctgacagccagggcaaggcccactacgtgctgagcggctcctgggatgagcagatggagtgcagcaaggtgatgcacagcagccccagcagccccagcagtgatggcaagcagaagacagtgtaccagaccctgagcgccaagctgctgtggaagaagtaccccctgcctgaaaatgctgagaacatgtactacttcagcgagctggccctgaccctgaatgaacatgaggagggcgtggcccccacagacagccggctgcggccagaccagaggctgatggagaagggccgctgggatgaggccaacacagagaagcagaggctggaggagaagcagaggctgagcagaagaagaaggctggaggcctgtggccctggcagcagctgcagcagcgaggaggccgagaaggaggctgatgcctacacccccctgtggtttgagaagaggctggaccccctgaccggggagatggcctgtgtgtacaagggcggctactgggaggccaaggagaagcaggactggcacatgtgccccaacatcttctag

SEQ ID NO: 162957 - DNA, 1383 bp, Artificial Sequence
  Description of Artificial Sequence: Synthetic coding sequence
atggaggacagcaccagcttcatcaccgtcatcacagaggccaaggaggacaggaaggccgagggcagcacaggcaccagctctgtggactggagcagcgctgacaacgtgctggatggagccagcctggtgcccaagggcagcagcaaggtgaagagaagagtgcgcatccccaacaagcccaactacagcctgaacctgtggagcatcatgaagaactgcatcggccgggagctgagccgcatccccatgcctgtgaacttcaatgagcccctgtccatgctgcagaggctgacagaggacctggagtaccaccacctgctggacaaggctgtgcactgcaccagctctgtggagcagatgtgcctggtggccgccttctctgtgtcctcctacagcaccaccgtgcacagaattgccaagcccttcaaccccatgctgggggagacctttgagctggaccggctggatgacatgggcctgcggagcctgtgtgagcaggtgagccaccacccccccagcgctgcccactacgtgttcagcaagcacggctggagcctgtggcaggagatcaccatcagcagcaagttccggggcaagtacatcagcatcatgcccctgggcgccatccacctggagttccaggccagcggcaaccactacgtgtggaggaagagcaccagcacagtgcacaacatcatcgtgggcaagctgtggattgaccagagcggggacatcgagatcgtgaaccacaagaccaatgaccgctgccagctgaagttcctgccctacagctacttcagcaaggaggccgccaggaaggtgactggagtggtgtctgacagccagggcaaggcccactacgtgctgagcggctcctgggatgagcagatggagtgcagcaaggtgatgcacagcagccccagcagccccagcagtgatggcaagcagaagacagtgtaccagaccctgagcgccaagctgctgtggaagaagtaccccctgcctgaaaatgctgagaacatgtactacttcagcgagctggccctgaccctgaatgaacatgaggagggcgtggcccccacagacagccggctgcggccagaccagaggctgatggagaagggccgctgggatgaggccaacacagagaagcagaggctggaggagaagcagaggctgagcagaagaagaaggctggaggcctgtggccctggcagcagctgcagcagcgaggaggagaaggaggctgatgcctacacccccctgtggtttgagaagaggctggaccccctgactggagagatggcctgtgtgtacaagggcggctactgggaggccaaggagaagcaggactggcacatgtgccccaacatcttctag

SEQ ID NO: 162958 - DNA, 2295 bp, Artificial Sequence
  Description of Artificial Sequence: Synthetic coding sequence
atggagagagctgtgcagggcacagatggcggcggcggcagcaacagcagcagccgcagcagcagccgggccaccagcgctggcagcagccccagctgcagcctggccggccggggcgtgagcagccgctctgctgctgctggcctgggcggcggcggcagccgcagcagccctggctctgtggccgccagccccagcggcggcggcggcagaagaagagagcccgccctggagggcgtgctgagcaagtacaccaacctgctgcagggctggcagaaccgctactttgtgctggactttgaggccggcatcctgcagtactttgtgaatgagcagagcaagcaccagaagccccggggcgtgctgagcctgagcggggccatcgtgtccctgagtgatgaggccccccacatgctggtggtgtacagcgccaatggagagatgttcaagctgcgggcagcagatgccaaggagaagcagttctgggtgacccagctgcgggcctgtgccaagtaccacatggagatgaacagcaagagcgcccccagcagccgcagccgcagcctgaccctgctgccccacggcacccccaacagcgccagcccctgcagccagaggcacctgtctgtgggcgcccctggggtggtgaccatcacccaccacaagagccctgctgctgcccggcgggccaagagccagtacagcggccagctgcacgaggtgcgggagatgatgaaccaggtggagggccagcagaagaacctggtgcacgccatcgagagcctgcccggcagcggccccctgacagccctggaccaggacctgctgctgctgaaggccaccagcgctgccaccctgagctgcctgggagaatgtctgaacctgctgcagcagagcgtgcaccaggccggccagcccagccagaagccaggggccagcgagaacatcctgggctggcacggcagcaagagccacagcacagagcagctgaagaatggcaccctgggcagcctgcccagcgccagcgccaacatcacctgggccatcctgcccaacagcgcagaagatgagcagaccagccagcctgagcctgagcccaacagcggcagcgagctggtgctgtctgaagatgagaagagtgacaatgaagacaaggaggagacagagctgggcgtgatggaggaccagaggagcatcatcctgcacctgatcagccagctgaagctgggcatggacctgaccaaggtggtgctgcccaccttcatcctggagaagaggagcctgctggagatgtatgctgacttcatggcccacccagacctgctgctggccatcacagctggggccaccccagaggagagggtcatctgctttgtggagtactacctgacagccttccacgagggcaggaaaggagccctggccaagaagccctacaaccccatcattggagagaccttccactgctcctgggaggtgcccaaggacagagtgaagcccaagaggacagccagccgcagccctgccagctgccacgagcaccccatggctgatgaccccagcaagagctacaagctgcgctttgtggccgagcaggtgagccaccacccccccatcagctgcttctactgtgaatgtgaggagaagaggctgtgtgtgaacacccacgtgtggaccaagagcaagttcatgggcatgtctgtgggcgtgtccatgattggagagggcgtgctgcggctgctggagcacggggaggagtatgtgttcaccctgcccagcgcctatgcccggagcatcctgaccatcccctgggtggagctgggcggcaaggtgtccatcaactgtgccaagacaggctacagcgccaccgtcatcttccacaccaagcccttctacggcggcaaggtgcaccgggtgacagctgaggtgaagcacaaccccaccaacaccatcgtgtgcaaggcccacggggagtggaatggcaccctggagttcacctacaacaatggagagaccaaggtgattgacaccaccaccctgcctgtgtaccccaagaagatccggcccctggagaagcagggccccatggagagcaggaacctgtggagggaggtgacccgctacctgcggctgggggacattgatgctgccacagagcagaagaggcacctggaggagaagcagagggtggaggagaggaagcgggagaacctgcggaccccctggaagcccaagtacttcatccaggagggagatggctgggtgtacttcaaccccctgtggaaggcccactag

SEQ ID NO: 162959 - DNA, 2103 bp, Artificial Sequence
  Description of Artificial Sequence: Synthetic coding sequence
atggagagagctgtgcagggcacagatggcggcggcggcagcaacagcagcagccgcagcagcagccgggccaccagcgctggcagcagccccagctgcagcctggccggccggggcgtgagcagccgctctgctgctgctggcctgggcggcggcggcagccgcagcagccctggctctgtggccgccagccccagcggcggcggcggcagaagaagagagcccgccctggagggcgtgctgagcaagtacaccaacctgctgcagggctggcagaaccgctactttgtgctggactttgaggccggcatcctgcagtactttgtgaatgagcagagcaagcaccagaagccccggggcgtgctgagcctgagcggggccatcgtgtccctgagtgatgaggccccccacatgctggtggtgtacagcgccaatggagagatgttcaagctgcgggcagcagatgccaaggagaagcagttctgggtgacccagctgcgggcctgtgccaagtaccacatggagatgaacagcaagatgatgaaccaggtggagggccagcagaagaacctggtgcacgccatcgagagcctgcccggcagcggccccctgacagccctggaccaggacctgctgctgctgaaggccaccagcgctgccaccctgagctgcctgggagaatgtctgaacctgctgcagcagagcgtgcaccaggccggccagcccagccagaagccaggggccagcgagaacatcctgggctggcacggcagcaagagccacagcacagagcagctgaagaatggcaccctgggcagcctgcccagcgccagcgccaacatcacctgggccatcctgcccaacagcgcagaagatgagcagaccagccagcctgagcctgagcccaacagcggcagcgagctggtgctgtctgaagatgagaagagtgacaatgaagacaaggaggagacagagctgggcgtgatggaggaccagaggagcatcatcctgcacctgatcagccagctgaagctgggcatggacctgaccaaggtggtgctgcccaccttcatcctggagaagaggagcctgctggagatgtatgctgacttcatggcccacccagacctgctgctggccatcacagctggggccaccccagaggagagggtcatctgctttgtggagtactacctgacagccttccacgagggcaggaaaggagccctggccaagaagccctacaaccccatcattggagagaccttccactgctcctgggaggtgcccaaggacagagtgaagcccaagaggacagccagccgcagccctgccagctgccacgagcaccccatggctgatgaccccagcaagagctacaagctgcgctttgtggccgagcaggtgagccaccacccccccatcagctgcttctactgtgaatgtgaggagaagaggctgtgtgtgaacacccacgtgtggaccaagagcaagttcatgggcatgtctgtgggcgtgtccatgattggagagggcgtgctgcggctgctggagcacggggaggagtatgtgttcaccctgcccagcgcctatgcccggagcatcctgaccatcccctgggtggagctgggcggcaaggtgtccatcaactgtgccaagacaggctacagcgccaccgtcatcttccacaccaagcccttctacggcggcaaggtgcaccgggtgacagctgaggtgaagcacaaccccaccaacaccatcgtgtgcaaggcccacggggagtggaatggcaccctggagttcacctacaacaatggagagaccaaggtgattgacaccaccaccctgcctgtgtaccccaagaagatccggcccctggagaagcagggccccatggagagcaggaacctgtggagggaggtgacccgctacctgcggctgggggacattgatgctgccacagagcagaagaggcacctggaggagaagcagagggtggaggagaggaagcgggagaacctgcggaccccctggaagcccaagtacttcatccaggagggagatggctgggtgtacttcaaccccctgtggaaggcccactag

SEQ ID NO: 162960 - DNA, 2244 bp, Artificial Sequence
  Description of Artificial Sequence: Synthetic coding sequence
atgcagggcggggagcctgtgtccaccatgaaggtgtctgagagcgagggcaagctggagggccaggccacagctgtgacccccaacaagaacagcagctgtggcggcggcatcagcagcagcagcagcagccggggcggcagcgccaagggctggcagtacagcgaccacatggagaatgtgtatggctacctgatgaagtacaccaacctggtgacaggctggcagtaccgcttctttgtgctgaacaatgaggccggcctgctggagtactttgtgaatgagcagagcaggaaccagaagccccggggcaccctgcagctggccggggctgtgatcagccccagtgatgaggacagccacaccttcaccgtgaatgctgccagcggggagcagtacaagctgcgggccacagatgccaaggagcggcagcactgggtgtcccggctgcagatctgcacccagcaccacacagaggccatcggcaagaacaacccccccctgaagagccgctccttcagcctggccagcagcagcaacagccccatcagccagaggcggcccagccagaatgccatctccttcttcaacgtgggccacagcaagctgcagagcctgagcaagaggaccaacctgcccccagaccacctggtggaggtgcgggagatgatgagccatgctgagggccagcagagggacctgatcagaagaattgaatgtctgcccaccagcggccacctgagcagcctggaccaggacctgctgatgctgaaggccacctccatggccaccatgaactgcctgaatgactgcttccacatcctgcagctgcagcacgccagccaccagaagggcagcctgcccagcggcaccaccatcgagtggctggagcccaagatcagcctgagcaaccactacaagaatggagctgaccagccctttgccacagaccagagcaagcctgtggccgtgcctgaggagcagcctgtggccgagagcggcctgctggcccgggagcctgaggagatcaatgctgatgatgaaattgaggacacctgtgaccacaaggaggatgacctgggcgctgtggaggagcagaggagcgtcatcctgcacctgctgagccagctgaagctgggcatggacctgaccagggtggtgctgcccaccttcatcctggagaagaggagcctgctggagatgtatgctgacttcatgagccacccagacctcttcatcgccatcaccaatggagccacagctgaggacaggatgatccgctttgtggagtactacctgaccagcttccacgagggcaggaaaggagccatcgccaagaagccctacaaccccatcattggagagaccttccactgctcctggaagatgcccaagtctgaggtggccagctctgtgttcagcagcagcagcacccagggcgtgaccaaccacgcccccctgagcggggagagcctgacccaggtgggcagtgactgctacacagtgcgctttgtggccgagcaggtgagccaccacccccctgtgtctggcttctatgcagaatgtacagagaggaagatgtgtgtgaatgcccacgtgtggaccaagagcaagttcctgggcatgagcattggagtgaccatggtgggggagggcatcctgagcctgctggagcacggggaggagtacaccttcagcctgccctgtgcctatgcccggagcatcctgactgtgccctgggtggagctgggcggcaaggtgtctgtgaactgtgccaagacaggctacagcgccagcatcaccttccacaccaagcccttctacggcggcaagctgcaccgggtgacagctgaggtgaagcacaacatcaccaacacagtggtgtgccgggtgcagggcgagtggaacagcgtgctggagttcacctacagcaatggagagaccaagtatgtggacctgaccaagctggccgtgaccaagaagagggtgcggcccctggagaagcaggacccctttgagagccggcggctgtggaagaatgtgacagacagcctgcgggagagcgagattgacaaggccacagagcacaagcacaccctggaggagcggcagaggacagaggagcggcacaggacagagaccggcaccccctggaagaccaagtacttcatcaaggagggagatggctgggtgtaccacaagcccctgtggaagatcatccccaccacccagcctgctgagtag

SEQ ID NO: 162961 - DNA, 2853 bp, Artificial Sequence
  Description of Artificial Sequence: Synthetic coding sequence
atgaacacagaagctgagcagcagctgctgcaccacgccagaaatggaaatgctgaggaggtgcggcagctgctggagaccatggccagaaatgaggtgattgctgacatcaactgcaagggccgcagcaagagcaacctgggctggacccccctgcacctggcctgctacttcggccaccggcaggtggtgcaggacctgctgaaggccggggctgaggtgaatgtgctgaatgacatgggagacacccccctgcaccgggccgccttcaccggcaggaaggagctggtgatgctgctgctggagtacaatgctgacaccaccatcgtgaatggaagtggccagacagccaaggaggtgacccatgctgaggagatccgctccatgctggaggccgtggagaggacccagcagaggaagctggaggagctgctgctggccgccgcccgggagggcaagaccacagagctgacagccctgctgaaccggcccaaccccccagatgtgaactgcagcgaccagctgggcaacacccccctgcactgtgccgcctaccgggcccacaagcagtgtgccctgaagctgctgcggagcggggctgaccccaacctgaagaacaagaatgaccagaagcccctggacctggcccagggcgctgagatgaagcacatcctggtgggcaacaaggtgatctacaaggccctgaagagatatgagggccccctgtggaagagcagccgcttcttcggctggaggctcttctgggtggtgctggagcacggcgtgctgtcctggtacaggaagcagccagatgctgtgcacaacatctaccggcagggctgcaagcacctgacccaggccgtgtgcaccgtgaagagcacagacagctgcctcttcttcatcaagtgctttgatgacaccatccacggcttccgggtgcccaagaacagcctgcagcagagccgggaggactggctggaggccatcgaggagcacagcgcctacagcacccactactgcagccaggaccagctgacagatgaggaggaggaggacacagtgtctgctgctgacctgaagaagagcctggagaaggcccagagctgccagcagaggctggaccgggagatcagcaacttcctgaagatgatcaaggaatgtgacatggccaaggagatgctgcccagcttcctgcagaaggtggaggtggtgtctgaggccagccgggagacctgtgtggccctgacagactgcctgaacctcttcaccaagcaggagggcgtgaggaacttcaagctggagcaggagcaggagaagaacaagatcctgtctgaggccctggagaccctggccacagagcaccacgagctggagcagagcctggtgaagggcagccccccagccagcatcctgtctgaagatgagttctatgatgccctgagtgacagcgagagcgagaggagcctgagccggctggaggccgtgacagcccggagctttgaggaggagggggagcacctgggcagcaggaagcacaggatgtctgaggagaaggactgtggcggcggagatgccctgagcaatggcatcaagaagcacaggaccagcctgcccagccccatgttcagcagaaatgacttcagcatctggagcatcctgaggaaatgtattggcatggagctgagcaagatcaccatgcctgtgatcttcaatgagcccctgtccttcctgcagaggctgacagagtacatggagcacacctacctgatccacaaggccagcagcctgagtgaccctgtggagaggatgcagtgtgtggccgcctttgctgtgtctgctgtggccagccagtgggagaggacaggcaagcccttcaaccccctgctgggggagacctatgagctggtgagagatgacctgggcttccgcctcatcagcgagcaggtgagccaccacccccccatcagcgccttccacgccgagggcctgaacaatgacttcatcttccacggcagcatctaccccaagctgaagttctggggcaagtctgtggaggccgagcccaagggcaccatcaccctggagctgctggagcacaatgaggcctacacctggaccaaccccacctgctgcgtgcacaacatcatcgtgggcaagctgtggattgagcagtatggaaatgtggagatcatcaaccacaagacaggagacaagtgtgtgctgaacttcaagccctgtggcctgtttgggaaggagctgcacaaggtggagggctacatccaggacaagagcaagaagaagctgtgtgccctgtatggcaagtggacagaatgtctgtacagcgtggaccctgccacctttgatgcctacaagaagaatgacaagaagaacacagaggagaagaagaacagcaagcagatgagcaccagcgaggagctggatgagatgcctgtgcctgattctgagagcgtcttcatcatccctggctctgtgctgctgtggagaattgccccccggccccccaacagcgcccagatgtacaacttcaccagctttgccatggtgctgaatgaggtggacaaggacatggagagcgtcatccccaagacagactgccgcctgcggccagacatccgggccatggagaatggagaaattgaccaggccagcgaggagaagaagaggctggaggagaagcagagagctgccaggaagaacagaagcaagtctgaggaggactggaagacccgctggttccaccagggccccaacccctacaatggagcccaggactggatctacagcggcagctactgggacaggaactacttcaacctgcctgacatctactag

SEQ ID NO: 162962 - DNA, 1707 bp, Artificial Sequence
  Description of Artificial Sequence: Synthetic coding sequence
atgatcaaggaatgtgacatggccaaggagatgctgcccagcttcctgcagaaggtggaggtggtgtctgaggccagccgggagacctgtgtggccctgacagactgcctgaacctcttcaccaagcaggagggcgtgaggaacttcaagctggagcaggagcaggagaagaacaagatcctgtctgaggccctggagaccctggccacagagcaccacgagctggagcagagcctggtgaagggcagccccccagccagcatcctgtctgaagatgagttctatgatgccctgagtgacagcgagagcgagaggagcctgagccggctggaggccgtgacagcccggagctttgaggaggagggggagcacctgggcagcaggaagcacaggatgtctgaggagaaggactgtggcggcggagatgccctgagcaatggcatcaagaagcacaggaccagcctgcccagccccatgttcagcagaaatgacttcagcatctggagcatcctgaggaaatgtattggcatggagctgagcaagatcaccatgcctgtgatcttcaatgagcccctgtccttcctgcagaggctgacagagtacatggagcacacctacctgatccacaaggccagcagcctgagtgaccctgtggagaggatgcagtgtgtggccgcctttgctgtgtctgctgtggccagccagtgggagaggacaggcaagcccttcaaccccctgctgggggagacctatgagctggtgagagatgacctgggcttccgcctcatcagcgagcaggtgagccaccacccccccatcagcgccttccacgccgagggcctgaacaatgacttcatcttccacggcagcatctaccccaagctgaagttctggggcaagtctgtggaggccgagcccaagggcaccatcaccctggagctgctggagcacaatgaggcctacacctggaccaaccccacctgctgcgtgcacaacatcatcgtgggcaagctgtggattgagcagtatggaaatgtggagatcatcaaccacaagacaggagacaagtgtgtgctgaacttcaagccctgtggcctgtttgggaaggagctgcacaaggtggagggctacatccaggacaagagcaagaagaagctgtgtgccctgtatggcaagtggacagaatgtctgtacagcgtggaccctgccacctttgatgcctacaagaagaatgacaagaagaacacagaggagaagaagaacagcaagcagatgagcaccagcgaggagctggatgagatgcctgtgcctgattctgagagcgtcttcatcatccctggctctgtgctgctgtggagaattgccccccggccccccaacagcgcccagatgtacaacttcaccagctttgccatggtgctgaatgaggtggacaaggacatggagagcgtcatccccaagacagactgccgcctgcggccagacatccgggccatggagaatggagaaattgaccaggccagcgaggagaagaagaggctggaggagaagcagagagctgccaggaagaacagaagcaagtctgaggaggactggaagacccgctggttccaccagggccccaacccctacaatggagcccaggactggatctacagcggcagctactgggacaggaactacttcaacctgcctgacatctactag

SEQ ID NO: 162963 - DNA, 303 bp, Artificial Sequence
  Description of Artificial Sequence: Synthetic coding sequence
atgaacacagaagctgagcagcagctgctgcaccacgccagaaatggaaatgctgaggaggtgcggcagctgctggagaccatggccagaaatgaggtgattgctgacatcaactgcaagggccgcagcaagagcaacctgggctggacccccctgcacctggcctgctacttcggccaccggcaggtggtgcaggacctgctgaaggccggggctgaggtgaatgtgctgaatgacatgggagacacccccctgcaccgggccgccttcaccggcaggaagatctgcagccagggcagctag

SEQ ID NO: 162964 - DNA, 1314 bp, Artificial Sequence
  Description of Artificial Sequence: Synthetic coding sequence
atgtctgaggagaaggactgtggcggcggagatgccctgagcaatggcatcaagaagcacaggaccagcctgcccagccccatgttcagcagaaatgacttcagcatctggagcatcctgaggaagtgcatcggcatggagctgagcaagatcaccatgcctgtgatcttcaatgagcccctgtccttcctgcagaggctgacagagtacatggagcacacctacctgatccacaaggccagcagcctgagtgaccctgtggagaggatgcagtgtgtggccgcctttgctgtgtctgctgtggccagccagtgggagaggacaggcaagcccttcaaccccctgctgggggagacctatgagctggtgagagatgacctgggcttccgcctcatcagcgagcaggtgagccaccacccccccatcagcgccttccacgccgagggcctgaacaatgacttcatcttccacggcagcatctaccccaagctgaagttctggggcaagtctgtggaggccgagcccaagggcaccatcaccctggagctgctggagcacaatgaggcctacacctggaccaaccccacctgctgcgtgcacaacatcatcgtgggcaagctgtggattgagcagtatggaaatgtggagatcatcaaccacaagacaggagacaagtgtgtgctgaacttcaagccctgtggcctgtttgggaaggagctgcacaaggtggagggctacatccaggacaagagcaagaagaagctgtgtgccctgtatggcaagtggacagagtgcctgtacagcgtggaccctgccacctttgatgcctacaagaagaatgacaagaagaacacagaggagaagaagaacagcaagcagatgagcaccagcgaggagctggatgagatgcctgtgcctgacagcgagagcgtcttcatcatccctggctctgtgctgctgtggagaattgcccccaggcctcccaacagcgcccagatgtacaacttcaccagctttgccatggtgctgaatgaggtggacaaggacatggagagcgtcatccccaagacagactgccgcctgcggccagacatccgggccatggagaatggagaaattgaccaggccagcgaggagaagaagaggctggaggagaagcagagagctgccaggaagaacagaagcaagtctgaggaggactggaagacccgctggttccaccagggccccaacccctacaacggggcccaggactggatctacagcggcagctactgggacaggaactacttcaacctgcctgacatctactag

SEQ ID NO: 162965 - DNA, 345 bp, Artificial Sequence
  Description of Artificial Sequence: Synthetic coding sequence
atgcagagcgtggccgcctttgctgtgtctgctgtggccagccagtgggagaggacaggcaagcccttcaaccccctgctgggggagacctatgagctgatccgggaggacctgggcttccgcttcatcagcgagcaggtgagccaccacccccccatcagcgccttccacagcgagggcctgaaccacgacttcctgttccacggcagcatctaccccaagctgaagttctggggcaagtctgtggaggccgagccccggggcaccatcaccctggagctgctgaatgtgaaccagaggcacctgcgggccaagcacaagagccccaccaatgccggccgctag

SEQ ID NO: 162966 - DNA, 1443 bp, Artificial Sequence
  Description of Artificial Sequence: Synthetic coding sequence
atgaatggagaggaggagttctttgatgctgtgacaggctttgacagcgacaacagcagcggggagttcagcgaggccaaccagaaggtgacaggcatgattgacctggacaccagcaagaacaaccgcatcggcaagacaggagagcggcccagccaggagaatggcatccagaagcacaggaccagcctgcctgcccccatgttcagcagaagtgacttctctgtgtggaccatcctgaagaagtgtgtgggcctggagctgagcaagatcaccatgcccatcgccttcaatgagcccctgtccttcctgcagaggatcacagagtacatggagcacgtgtacctgatccaccgggccagctgccagccccagcccctggagaggatgcagagcgtggccgcctttgctgtgtctgctgtggccagccagtgggagaggacaggcaagcccttcaaccccctgctgggggagacctatgagctgatccgggaggacctgggcttccgcttcatcagcgagcaggtgagccaccacccccccatcagcgccttccacagcgagggcctgaaccacgacttcctgttccacggcagcatctaccccaagctgaagttctggggcaagtctgtggaggccgagccccggggcaccatcaccctggagctgctgaagcacaatgaggcctacacctggaccaaccccacctgctgcgtgcacaacgtcatcatcggcaagctgtggattgagcagtatggcaccgtggagatcctgaaccacaggacaggccacaagtgtgtgctgcacttcaagccctgtggcctgtttgggaaggagctgcacaaggtggagggccacatccaggacaagaacaagaagaagctgttcatgatctacggcaagtggacagagtgcctgtggggcattgatcctgtgtcctatgagagcttcaagaagcaggagcggcggggggaccacctgaggaaggccaagctggatgaggacagcggcaaggctgacagtgatgtggctgatgatgtgcctgtggcccaggagaccgtgcaggtgattcctggcagcaagctgctgtggaggatcaacacccggccccccaacagcgcccagatgtacaacttcaccagcttcaccgtgtccctgaatgagctggagaccggcatggagaagaccctgcccccaacagactgccgcctgcggccagacatccggggcatggagaatggaaacatggacctggccagccaggagaaggagcggctggaggagaagcagcgggaggcccggcgggagcgggccaaggaggaggccgagtggcagacccgctggttctacccaggcaacaacccctacacaggcaccccagactggctgtatgctggggactactttgaaagaaacttcagtgactgcccagacatctactag

SEQ ID NO: 162967 - DNA, 1407 bp, Artificial Sequence
  Description of Artificial Sequence: Synthetic coding sequence
atgaatggagaggaggagttctttgatgctgtgacagaggccaaccagaaggtgacaggcatgattgacctggacaccagcaagaacaaccgcatcggcaagacaggagagcggcccagccaggagaatggcatccagaagcacaggaccagcctgcctgcccccatgttcagcagaagtgacttctctgtgtggaccatcctgaagaagtgtgtgggcctggagctgagcaagatcaccatgcccatcgccttcaatgagcccctgtccttcctgcagaggatcacagagtacatggagcacgtgtacctgatccaccgggccagctgccagccccagcccctggagaggatgcagagcgtggccgcctttgctgtgtctgctgtggccagccagtgggagaggacaggcaagcccttcaaccccctgctgggggagacctatgagctgatccgggaggacctgggcttccgcttcatcagcgagcaggtgagccaccacccccccatcagcgccttccacagcgagggcctgaaccacgacttcctgttccacggcagcatctaccccaagctgaagttctggggcaagtctgtggaggccgagccccggggcaccatcaccctggagctgctgaagcacaatgaggcctacacctggaccaaccccacctgctgcgtgcacaacgtcatcatcggcaagctgtggattgagcagtatggcaccgtggagatcctgaaccacaggacaggccacaagtgtgtgctgcacttcaagccctgtggcctgtttgggaaggagctgcacaaggtggagggccacatccaggacaagaacaagaagaagctgttcatgatctacggcaagtggacagagtgcctgtggggcattgatcctgtgtcctatgagagcttcaagaagcaggagcggcggggggaccacctgaggaaggccaagctggatgaggacagcggcaaggctgacagtgatgtggctgatgatgtgcctgtggcccaggagaccgtgcaggtgattcctggcagcaagctgctgtggaggatcaacacccggccccccaacagcgcccagatgtacaacttcaccagcttcaccgtgtccctgaatgagctggagaccggcatggagaagaccctgcccccaacagactgccgcctgcggccagacatccggggcatggagaatggaaacatggacctggccagccaggagaaggagcggctggaggagaagcagcgggaggcccggcgggagcgggccaaggaggaggccgagtggcagacccgctggttctacccaggcaacaacccctacacaggcaccccagactggctgtatgctggggactactttgaaagaaacttcagtgactgcccagacatctactag

SEQ ID NO: 162968 - DNA, 1113 bp, Artificial Sequence
  Description of Artificial Sequence: Synthetic coding sequence
atgcccatcgccttcaatgagcccctgtccttcctgcagaggatcacagagtacatggagcacgtgtacctgatccaccgggccagctgccagccccagcccctggagaggatgcagagcgtggccgcctttgctgtgtctgctgtggccagccagtgggagaggacaggcaagcccttcaaccccctgctgggggagacctatgagctgatccgggaggacctgggcttccgcttcatcagcgagcaggtgagccaccacccccccatcagcgccttccacagcgagggcctgaaccacgacttcctgttccacggcagcatctaccccaagctgaagttctggggcaagtctgtggaggccgagccccggggcaccatcaccctggagctgctgaagcacaatgaggcctacacctggaccaaccccacctgctgcgtgcacaacgtcatcatcggcaagctgtggattgagcagtatggcaccgtggagatcctgaaccacaggacaggccacaagtgtgtgctgcacttcaagccctgtggcctgtttgggaaggagctgcacaaggtggagggccacatccaggacaagaacaagaagaagctgttcatgatctacggcaagtggacagagtgcctgtggggcattgatcctgtgtcctatgagagcttcaagaagcaggagcggcggggggaccacctgaggaaggccaagctggatgaggacagcggcaaggctgacagtgatgtggctgatgatgtgcctgtggcccaggagaccgtgcaggtgattcctggcagcaagctgctgtggaggatcaacacccggccccccaacagcgcccagatctggccagccaggagaagaagtggctggaggaggagccgggagaagcacggcggcagcggcccccggcggcggcagagcggccggcggggcggcagcacccaggccatcacccccaccctgggcccccccaccggctgcatgcagggcatcaccctgagcggcatcagccccacagcccagatcagcacagagggcctggagggccctggggcccgggaccggcggctgacccggctggacttcctggagtggcccctgtag

SEQ ID NO: 162969 - DNA, 339 bp, Artificial Sequence
  Description of Artificial Sequence: Synthetic coding sequence
tctgtggccgcctttgctgtgtctgctgtggccagccagtgggagaggacaggcaagcccttcaaccccctgctgggggagacctatgagctgatccgggaggacctgggcttccgcttcatcagcgagcaggtgagccaccacccccccatcagcgccttccacagcgagggcctgaaccacgacttcctgttccacggcagcatctaccccaagctgaagttctggggcaagtctgtggaggccgagccccggggcaccatcaccctggagctgctgaatgtgaaccagaggcacctgcgggccaagcacaagagccccaccaatgccggccgctag

SEQ ID NO: 162970 - DNA, 2664 bp, Artificial Sequence
  Description of Artificial Sequence: Synthetic coding sequence
atgatgtctgatgagaagaacctgggcgtgtcccagaagctggtgagccccagccgcagcaccagcagctgcagcagcaagcagggcagccggcaggacagctgggaggtggtggagggcctgcggggggagatgaactacacccaggagccccctgtgcagaagggcttcctgctgaagaagaggaagtggcccctgaagggctggcacaagcgcttcttctacctggacaagggcatcctgaagtatgccaagagccagacagacatcgagcgggagaagctgcacggctgcattgatgtgggcctgtctgtgatgtctgtgaagaagagcagcaaatgtattgacctggacacagaggagcacatctaccacctgaaggtgaagtctgaggaggtgtttgatgagtgggtgtccaagctgcggcaccacaggatgtaccggcagaatgagatcgccatgttcccccatgaggtgaaccacttcttcagcggcagcaccatcacagacagcagcagtggagtgtttgacagcatcagcagcaggaagaggagcagcatcagcaagcagaacctcttccagacaggcagcaatgtgtccttcagctgtggcggggagaccagggtgcccctgtggctgcagagcagcgaggacatggagaagtgcagcaaggacctggcccactgccacgcctacctggtggagatgagccagctgctgcagagcatggatgtgctgcacaggacctacagcgccccagccatcaatgccatccagggcggcagctttgagagccccaagaaggagaagaggagccaccggcgctggaggagccgggccatcggcaaggatgccaagggcaccctgcaggtgcccaagcccttcagcggccctgtgcggctgcacagcagcaaccccaacctgagcaccctggactttggagaggagaagaactacagtgatggcagcgagaccagcagcgagttcagcaagatgcaggaggacctgtgccacatcgcccacaaggtgtacttcaccctgcggagcgccttcaacatcatgtctgctgagcgggagaagctgaagcagctgatggagcaggatgccagcagcagccccagcgcccaggtgattggcctgaagaatgccctgagcagcgccctggcccagaacacagacctgaaggagcggctgcggcgcatccatgctgagagcctgctgctggacagccctgctgtggccaagagcggggacaacctggccgaggagaacagcagagatgagaacagagccctggtgcaccagctgagcaatgaaagccggctgagcatcacagacagcctgtctgagttctttgatgcccaggaggtgctgctgagccccagcagcagtgaaaatgagatcagtgatgatgacagctatgtgtctgacatcagtgacaacctgagcctggacaacctgagcaatgacctggacaatgaaaggcagaccctgggccctgtgctggacagcggccgggaggccaagagcagaagaaggacctgcctgcctgccccctgccccagcagcagcaacatcagcctgtggaacatcctgaggaacaacatcggcaaggacctgagcaaggtggccatgcctgtggagctgaatgagcccctgaacaccctgcagaggctgtgtgaggagctggagtacagcgagctgctggacaaggccgcccagatccccagccccctggagaggatggtgtatgtggccgcctttgccatcagcgcctatgccagcagctactaccgggccggcagcaagcccttcaaccctgtgctgggggagacctatgagtgcatccgggaggacaagggcttccagttcttcagcgagcaggtgagccaccacccccccatcagcgcctgccacgccgagagcaggaactttgtgttctggcaggatgtgcgctggaagaacaagttctggggcaagtccatggagatcgtgcccatcggcaccacccacgtgaccctgcctgtgtttggagaccactttgagtggaacaaggtgaccagctgcatccacaacatcctgagcggccagcgctggattgagcactatggagagatcgtcatcaagaacctgcatgatgacagctgctactgcaaggtgaacttcatcaaggccaagtactggagcaccaatgcccatgaaattgagggcaccgtgtttgacagaagtggcaaggctgtgcaccggctgtttgggaagtggcatgagagcatctactgcggcggcggcagcagcagcgcctgtgtgtggagggccaaccccatgcccaagggctatgagcagtactacagcttcacccagtttgccctggagctgaatgagatggaccccagcagcaagagcctgctgcccccaacagacacccgcttccggccagaccagcgcttcctggaggagggcaacctggaggaggccgagatccagaagcagagaattgagcagctgcagcgggagcggcggcgggtgctggaggagaaccacgtggagcaccagccccgcttcttcaggaagagtgatgatgacagctgggtgtccaatggcacctacctggagctgaggaaggacctgggcttcagcaagctggaccaccctgtgctgtggtag

SEQ ID NO: 162971 - DNA, 2571 bp, Artificial Sequence
  Description of Artificial Sequence: Synthetic coding sequence
atgatgtctgatgagaagaacctgggcgtgtcccagaagctggtgagccccagccgcagcaccagcagctgcagcagcaagcagggcagccggcaggacagctgggaggtggtggagggcctgcggggggagatgaactacacccaggagccccctgtgcagaagggcttcctgctgaagaagaggaagtggcccctgaagggctggcacaagcgcttcttctacctggacaagggcatcctgaagtatgccaagagccagacagacatcgagcgggagaagctgcacggctgcattgatgtgggcctgtctgtgatgtctgtgaagaagagcagcaaatgtattgacctggacacagaggagcacatctaccacctgaaggtgaagtctgaggaggtgtttgatgagtgggtgtccaagctgcggcaccacaggatgtaccggcagaatgagatcgccatgttcccccatgaggtgaaccacttcttcagcggcagcaccatcacagacagcagcagtggagtgtttgacagcatcagcagcaggaagaggagcagcatcagcaagcagaacctcttccagacaggcagcaatgtgtccttcagctgtggcggggagaccagggtgcccctgtggctgcagagcagcgaggacatggagaagtgcagcaaggacctggcccactgccacgcctacctggtggagatgagccagctgctgcagagcatggatgtgctgcacaggacctacagcgccccagccatcaatgccatccaggtgcccaagcccttcagcggccctgtgcggctgcacagcagcaaccccaacctgagcaccctggactttggagaggagaagaactacagtgatggcagcgagaccagcagcgagttcagcaagatgcaggaggacctgtgccacatcgcccacaaggtgtacttcaccctgcggagcgccttcaacatcatgtctgctgagcgggagaagctgaagcagctgatggagcaggatgccagcagcagccccagcgcccaggtgattggcctgaagaatgccctgagcagcgccctggcccagaacacagacctgaaggagcggctgcggcgcatccacgccgagagcctgctgctggacagccctgctgtggccaagagcggggacaacctggccgaggagaacagcagagatgaaaatagagccctggtgcaccagctgagcaatgaaagccggctgagcatcacagacagcctgtctgagttctttgatgcccaggaggtgctgctgagccccagcagcagtgaaaatgagatcagtgatgatgacagctatgtgtctgacatcagtgacaacctgagcctggacaacctgagcaatgacctggacaatgaaaggcagaccctgggccctgtgctggacagcggccgggaggccaagagcagaagaaggacctgcctgcctgccccctgccccagcagcagcaacatcagcctgtggaacatcctgaggaacaacatcggcaaggacctgagcaaggtggccatgcctgtggagctgaatgagcccctgaacaccctgcagaggctgtgtgaggagctggagtacagcgagctgctggacaaggccgcccagatccccagccccctggagaggatggtgtatgtggccgcctttgccatcagcgcctatgccagcagctactacagagctggcagcaagcccttcaaccctgtgctgggggagacctatgagtgcatcagagaagataaaggcttccagttcttcagcgagcaggtgagccaccacccccccatcagcgcctgccacgccgagagcaggaactttgtgttctggcaggatgtgcgctggaagaacaagttctggggcaagtccatggagatcgtgcccatcggcaccacccacgtgaccctgcctgtgtttggagaccactttgagtggaacaaggtgaccagctgcatccacaacatcctgagcggccagcgctggattgagcactacggggagatcgtcatcaagaacctgcatgatgacagctgctactgcaaggtgaacttcatcaaggccaagtactggagcaccaatgcccacgagattgagggcaccgtgtttgacagaagtggcaaggctgtgcaccggctgtttgggaagtggcatgagagcatctactgcggcggcggcagcagcagcgcctgtgtgtggagggccaaccccatgcccaagggctatgagcagtactacagcttcacccagtttgccctggagctgaatgagatggaccccagcagcaagagcctgctgcccccaacagacacccgcttccggccagaccagcgcttcctggaggagggcaacctggaggaggccgagatccagaagcagagaattgagcagctgcagcgggagaggagaagagtgctggaggagaaccacgtggagcaccagccccgcttcttcaggaagagtgatgatgacagctgggtgtccaatggcacctacctggagctgaggaaggacctgggcttcagcaagctggaccaccctgtgctgtggtag

SEQ ID NO: 162972 - DNA, 2556 bp, Artificial Sequence
  Description of Artificial Sequence: Synthetic coding sequence
atgatgtctgatgagaagaacctgggcgtgtcccagaagctggtgagccccagccgcagcaccagcagctgcagcagcaagcagggcagccggcaggacagctgggaggtggtggagggcctgcggggggagatgaactacacccaggagccccctgtgcagaagggcttcctgctgaagaagaggaagtggcccctgaagggctggcacaagcgcttcttctacctggacaagggcatcctgaagtatgccaagagccagacagacatcgagcgggagaagctgcacggctgcattgatgtgggcctgtctgtgatgtctgtgaagaagagcagcaaatgtattgacctggacacagaggagcacatctaccacctgaaggtgaagtctgaggaggtgtttgatgagtgggtgtccaagctgcggcaccacaggatgtaccggcagaatgagatcgccatgttcccccatgaggtgaaccacttcttcagcggcagcaccatcacagacagcagcagtggagtgtttgacagcatcagcagcaggaagaggagcagcatcagcaagcagaacctcttccagacaggcagcaatgtgtccttcagctgtggcggggagaccagggtgcccctgtggctgcagagcagcgaggacatggagaagtgcagcaaggacctggcccactgccacgcctacctggtggagatgagccagctgctgcagagcatggatgtgctgcacaggacctacagcgccccagccatcaatgccatccagggcggcagctttgagagccccaagaaggagaagaggagccaccggcgctggaggagccgggccatcggcaaggatgccaagggcaccctgcaggtgcccaagcccttcagcggccctgtgcggctgcacagcagcaaccccaacctgagcaccctggactttggagaggagaagaactacagtgatggcagcgagaccagcagcgagttcagcaagatgcaggaggacctgtgccacatcgcccacaaggtgtacttcaccctgcggagcgccttcaacatcatgtctgctgagcgggagaagctgaagcagctgatggagcaggatgccagcagcagccccagcgcccaggtgattggcctgaagaatgccctgagcagcgagaacagcagagatgagaacagagccctggtgcaccagctgagcaatgaaagccggctgagcatcacagacagcctgtctgagttctttgatgcccaggaggtgctgctgagccccagcagcagtgaaaatgagatcagtgatgatgacagctatgtgtctgacatcagtgacaacctgagcctggacaacctgagcaatgacctggacaatgaaaggcagaccctgggccctgtgctggacagcggccgggaggccaagagcagaagaaggacctgcctgcctgccccctgccccagcagcagcaacatcagcctgtggaacatcctgaggaacaacatcggcaaggacctgagcaaggtggccatgcctgtggagctgaatgagcccctgaacaccctgcagaggctgtgtgaggagctggagtacagcgagctgctggacaaggccgcccagatccccagccccctggagaggatggtgtatgtggccgcctttgccatcagcgcctatgccagcagctactaccgggccggcagcaagcccttcaaccctgtgctgggggagacctatgagtgcatccgggaggacaagggcttccagttcttcagcgagcaggtgagccaccacccccccatcagcgcctgccacgccgagagcaggaactttgtgttctggcaggatgtgcgctggaagaacaagttctggggcaagtccatggagatcgtgcccatcggcaccacccacgtgaccctgcctgtgtttggagaccactttgagtggaacaaggtgaccagctgcatccacaacatcctgagcggccagcgctggattgagcactatggagagatcgtcatcaagaacctgcatgatgacagctgctactgcaaggtgaacttcatcaaggccaagtactggagcaccaatgcccatgaaattgagggcaccgtgtttgacagaagtggcaaggctgtgcaccggctgtttgggaagtggcatgagagcatctactgcggcggcggcagcagcagcgcctgtgtgtggagggccaaccccatgcccaagggctatgagcagtactacagcttcacccagtttgccctggagctgaatgagatggaccccagcagcaagagcctgctgcccccaacagacacccgcttccggccagaccagcgcttcctggaggagggcaacctggaggaggccgagatccagaagcagagaattgagcagctgcagcgggagcggcggcgggtgctggaggagaaccacgtggagcaccagccccgcttcttcaggaagagtgatgatgacagctgggtgtccaatggcacctacctggagctgaggaaggacctgggcttcagcaagctggaccaccctgtgctgtggtag

SEQ ID NO: 162973 - DNA, 2556 bp, Artificial Sequence; identical to SEQ ID NO: 162972
  Description of Artificial Sequence: Synthetic coding sequence

SEQ ID NO: 162974 - DNA, 2571 bp, Artificial Sequence; identical to SEQ ID NO: 162971
  Description of Artificial Sequence: Synthetic coding sequence

SEQ ID NO: 162975 - DNA, 2463 bp, Artificial Sequence
  Description of Artificial Sequence: Synthetic coding sequence
atgatgtctgatgagaagaacctgggcgtgtcccagaagctggtgagccccagccgcagcaccagcagctgcagcagcaagcagggcagccggcaggacagctgggaggtggtggagggcctgcggggggagatgaactacacccaggagccccctgtgcagaagggcttcctgctgaagaagaggaagtggcccctgaagggctggcacaagcgcttcttctacctggacaagggcatcctgaagtatgccaagagccagacagacatcgagcgggagaagctgcacggctgcattgatgtgggcctgtctgtgatgtctgtgaagaagagcagcaaatgtattgacctggacacagaggagcacatctaccacctgaaggtgaagtctgaggaggtgtttgatgagtgggtgtccaagctgcggcaccacaggatgtaccggcagaatgagatcgccatgttcccccatgaggtgaaccacttcttcagcggcagcaccatcacagacagcagcagtggagtgtttgacagcatcagcagcaggaagaggagcagcatcagcaagcagaacctcttccagacaggcagcaatgtgtccttcagctgtggcggggagaccagggtgcccctgtggctgcagagcagcgaggacatggagaagtgcagcaaggacctggcccactgccacgcctacctggtggagatgagccagctgctgcagagcatggatgtgctgcacaggacctacagcgccccagccatcaatgccatccaggtgcccaagcccttcagcggccctgtgcggctgcacagcagcaaccccaacctgagcaccctggactttggagaggagaagaactacagtgatggcagcgagaccagcagcgagttcagcaagatgcaggaggacctgtgccacatcgcccacaaggtgtacttcaccctgcggagcgccttcaacatcatgtctgctgagcgggagaagctgaagcagctgatggagcaggatgccagcagcagccccagcgcccaggtgattggcctgaagaatgccctgagcagcgagaacagcagagatgaaaatagagccctggtgcaccagctgagcaatgaaagccggctgagcatcacagacagcctgtctgagttctttgatgcccaggaggtgctgctgagccccagcagcagtgaaaatgagatcagtgatgatgacagctatgtgtctgacatcagtgacaacctgagcctggacaacctgagcaatgacctggacaatgaaaggcagaccctgggccctgtgctggacagcggccgggaggccaagagcagaagaaggacctgcctgcctgccccctgccccagcagcagcaacatcagcctgtggaacatcctgaggaacaacatcggcaaggacctgagcaaggtggccatgcctgtggagctgaatgagcccctgaacaccctgcagaggctgtgtgaggagctggagtacagcgagctgctggacaaggccgcccagatccccagccccctggagaggatggtgtatgtggccgcctttgccatcagcgcctatgccagcagctactacagagctggcagcaagcccttcaaccctgtgctgggggagacctatgagtgcatcagagaagataaaggcttccagttcttcagcgagcaggtgagccaccacccccccatcagcgcctgccacgccgagagcaggaactttgtgttctggcaggatgtgcgctggaagaacaagttctggggcaagtccatggagatcgtgcccatcggcaccacccacgtgaccctgcctgtgtttggagaccactttgagtggaacaaggtgaccagctgcatccacaacatcctgagcggccagcgctggattgagcactacggggagatcgtcatcaagaacctgcatgatgacagctgctactgcaaggtgaacttcatcaaggccaagtactggagcaccaatgcccacgagattgagggcaccgtgtttgacagaagtggcaaggctgtgcaccggctgtttgggaagtggcatgagagcatctactgcggcggcggcagcagcagcgcctgtgtgtggagggccaaccccatgcccaagggctatgagcagtactacagcttcacccagtttgccctggagctgaatgagatggaccccagcagcaagagcctgctgcccccaacagacacccgcttccggccagaccagcgcttcctggaggagggcaacctggaggaggccgagatccagaagcagagaattgagcagctgcagcgggagaggagaagagtgctggaggagaaccacgtggagcaccagccccgcttcttcaggaagagtgatgatgacagctgggtgtccaatggcacctacctggagctgaggaaggacctgggcttcagcaagctggaccaccctgtgctgtggtag

SEQ ID NO: 162976 - DNA, 339 bp, Artificial Sequence
  Description of Artificial Sequence: Synthetic coding sequence
atgatgtctgatgagaagaacctgggcgtgtcccagaagctggtgagccccagccgcagcaccagcagctgcagcagcaagcagggcagccggcaggacagctgggaggtggtggagggcctgcggggggagatgaactacacccaggagccccctgtgcagaagggcttcctgctgaagaagaggaagtggcccctgaagggctggcacaagcgcttcttctacctggacaagggcatcctgaagtatgccaagagccagacagacatcgagcgggagaagctgcacggctgcattgatgtgggcctgtctgtgatgtctgtgaagaagagcagctag

SEQ ID NO: 162977 - DNA, 186 bp, Artificial Sequence
  Description of Artificial Sequence: Synthetic coding sequence
atgatgtctgatgagaagaacctgggcgtgtcccagaagctggtgagccccagccgcagcaccagcagctgcagcagcaagcagggcagccggcaggacagctgggaggtggtggagggcctgcggggggagatgaactacacccaggagccccctgtgcagaagggcttcctgctgaagaagtag

SEQ ID NO: 162978 - DNA, 2463 bp, Artificial Sequence; identical to SEQ ID NO: 162975
  Description of Artificial Sequence: Synthetic coding sequence

SEQ ID NO: 162979 - DNA, 270 bp, Artificial Sequence
  Description of Artificial Sequence: Synthetic coding sequence
atgatgtctgatgagaagaacctgggcgtgtcccagaagctggtgagccccagccgcagcaccagcagctgcagcagcaagcagggcagccggcaggacagctgggaggtggtggagggcctgcggggggagatgaactacacccaggagccccctgtgcagaagggcttcctgctgaagaagaggaagtggcccctgaagggctggcacaagcgcttcttctacctggacaagggcatcctgaagtatgccaagagccagacagactag

SEQ ID NO: 162980 - DNA, 2640 bp, Artificial Sequence
  Description of Artificial Sequence: Synthetic coding sequence
atgaaggaggaggccttcctgcggcggcgcttcagcctgtgcccccccagcagcaccccccagaaggtggaccccaggaagctgaccaggaacctgctgctgagcggggacaatgagctgtaccccctgagccctgggaaggacatggagcccaacggccccagcctgcccagagatgagggcccccccacccccagcagcgccaccaaggtgcccccagctgagtaccgcctgtgcaatggaagtgacaaggaatgtgtgagccccacagcccgggtgaccaagaaggagaccctgaaggcccagaaggagaactaccggcaggagaagaagagggccacccggcagctgctgagcgccctgacagaccccagcgtggtgatcatggctgacagcctgaagatccggggcaccctgaagtcctggaccaagctgtggtgtgtgctgaagccaggagtgctgctgatctacaagacccccaaggtgggccagtgggtgggcaccgtgctgctgcactgctgtgagctgattgagcggcccagcaagaaggatggcttctgcttcaagctgttccaccccctggaccagagcgtgtgggccgtgaagggccccaagggggagagcgtgggcagcatcacccagcccctgcccagcagctacctgatcttccgggccgccagcgagagtgatggccgctgctggctggatgccctggagctggccctgcgctgcagcagcctgctgcggctgggcacctgcaagccaggaagagatggagagcccggcaccagcccagatgccagccccagcagcctgtgtggcctgcctgccagcgccaccgtgcacccagaccaggacctcttccccctgaatggcagcagcctggagaatgatgccttcagtgacaagtcagaaagagaaaatcctgaggagagtgacacagagacccaggaccacagcaggaagacagaaagtggcagtgaccagagcgagacccctggggcccctgtgcggcggggcaccacctacgtggagcaggtgcaggaggagctgggggagctgggggaggccagccaggtggagaccgtgtctgaggagaacaagagcctgatgtggaccctgctgaagcagctgcggcccggcatggacctgagccgggtggtgctgcccacctttgtgctggagcccaggagcttcctgaacaagctgagtgactactactaccacgccgacctgctgagcagagctgctgtggaggaggatgcctacagcaggatgaagctggtgctgcgctggtacctgagcggcttctacaagaagcccaagggcatcaagaagccctacaaccccatcctgggggagaccttccgctgctgctggttccacccccagacagacagcaggaccttctacatcgccgagcaggtgagccaccacccccctgtgtctgccttccacgtgagcaacaggaaggatggcttctgcatcagcggcagcatcacagccaagagccgcttctacggcaacagcctgagcgccctgctggatggcaaggccaccctgaccttcctgaacagagctgaggactacaccctgaccatgccctatgcccactgcaagggcatcctgtatggcaccatgaccctggagctgggcggcaaggtgaccattgaatgtgccaagaacaacttccaggcccagctggagttcaagctgaagcccttcttcggcggcagcaccagcatcaaccagatcagcggcaagatcaccagcggggaggaggtgctggccagcctgagcggccactgggacagagatgtgttcatcaaggaggagggcagcggcagcagcgccctcttctggacccccagcggggaggtgcggcggcagaggctgcggcagcacacagtgcccctggaggagcagacagagctggagagcgagcggctgtggcagcacgtgacccgggccatcagcaagggggaccagcaccgggccacccaggagaagtttgccctggaggaggcccagaggcagagggcccgggagcggcaggagagcctgatgccctggaagccccagctgttccacctggaccccatcacccaggagtggcactaccgctatgaggaccacagcccctgggaccccctgaaggacatcgcccagtttgagcaggacggcatcctgcggaccctgcagcaggaggccgtggcccggcagaccaccttcctgggcagccctggccccaggcatgagaggagcggccctgaccagaggctgaggaaggccagtgaccagcccagcggccacagccaggccacagagagcagcggcagcaccccagagagctgcccagagctgagtgatgaggagcaggatggagactttgtgcctggaggagagagcccctgcccccgctgcaggaaggaggcccggcggctgcaggccctgcacgaggccatcctgagcatccgggaggcccagcaggagctgcaccgccacctgagcgccatgctgagcagcacagcccgggccgcccaggcccccaccccaggcctgctgcagagccccaggtcctggttcctgctgtgtgtgttcctggcctgccagctgttcatcaaccacatcctgaagtag

SEQ ID NO: 162981 - DNA, 2436 bp, Artificial Sequence
  Description of Artificial Sequence: Synthetic coding sequence
atgaaggaggaggccttcctgcggcggcgcttcagcctgtgcccccccagcagcaccccccagaaggtggaccccaggaagctgaccaggaacctgctgctgagcggggacaatgagctgtaccccctgagccctgggaaggacatggagcccaacggccccagcctgcccagagatgagggcccccccacccccagcagcgccaccaaggtgcccccagctgagtaccgcctgtgcaatggaagtgacaaggaatgtgtgagccccacagcccgggtgaccaagaaggagaccctgaaggcccagaaggagaactaccggcaggagaagaagagggccacccggcagctgctgagcgccctgacagaccccagcgtggtgatcatggctgacagcctgaagggccccaagggggagagcgtgggcagcatcacccagcccctgcccagcagctacctgatcttccgggccgccagcgagagtgatggccgctgctggctggatgccctggagctggccctgcgctgcagcagcctgctgcggctgggcacctgcaagccaggaagagatggagagcccggcaccagcccagatgccagccccagcagcctgtgtggcctgcctgccagcgccaccgtgcacccagaccaggacctcttccccctgaatggcagcagcctggagaatgatgccttcagtgacaagtcagaaagagaaaatcctgaggagagtgacacagagacccaggaccacagcaggaagacagaaagtggcagtgaccagagcgagacccctggggcccctgtgcggcggggcaccacctacgtggagcaggtgcaggaggagctgggggagctgggggaggccagccaggtggagaccgtgtctgaggagaacaagagcctgatgtggaccctgctgaagcagctgcggcccggcatggacctgagccgggtggtgctgcccacctttgtgctggagcccaggagcttcctgaacaagctgagtgactactactaccacgccgacctgctgagcagagctgctgtggaggaggatgcctacagcaggatgaagctggtgctgcgctggtacctgagcggcttctacaagaagcccaagggcatcaagaagccctacaaccccatcctgggggagaccttccgctgctgctggttccacccccagacagacagcaggaccttctacatcgccgagcaggtgagccaccacccccctgtgtctgccttccacgtgagcaacaggaaggatggcttctgcatcagcggcagcatcacagccaagagccgcttctacggcaacagcctgagcgccctgctggatggcaaggccaccctgaccttcctgaacagagctgaggactacaccctgaccatgccctatgcccactgcaagggcatcctgtatggcaccatgaccctggagctgggcggcaaggtgaccattgaatgtgccaagaacaacttccaggcccagctggagttcaagctgaagcccttcttcggcggcagcaccagcatcaaccagatcagcggcaagatcaccagcggggaggaggtgctggccagcctgagcggccactgggacagagatgtgttcatcaaggaggagggcagcggcagcagcgccctcttctggacccccagcggggaggtgcggcggcagaggctgcggcagcacacagtgcccctggaggagcagacagagctggagagcgagcggctgtggcagcacgtgacccgggccatcagcaagggggaccagcaccgggccacccaggagaagtttgccctggaggaggcccagaggcagagggcccgggagcggcaggagagcctgatgccctggaagccccagctgttccacctggaccccatcacccaggagtggcactaccgctatgaggaccacagcccctgggaccccctgaaggacatcgcccagtttgagcaggacggcatcctgcggaccctgcagcaggaggccgtggcccggcagaccaccttcctgggcagccctggccccaggcatgagaggagcggccctgaccagaggctgaggaaggccagtgaccagcccagcggccacagccaggccacagagagcagcggcagcaccccagagagctgcccagagctgagtgatgaggagcaggatggagactttgtgcctggaggagagagcccctgcccccgctgcaggaaggaggcccggcggctgcaggccctgcacgaggccatcctgagcatccgggaggcccagcaggagctgcaccgccacctgagcgccatgctgagcagcacagcccgggccgcccaggcccccaccccaggcctgctgcagagccccaggtcctggttcctgctgtgtgtgttcctggcctgccagctgttcatcaaccacatcctgaagtag

SEQ ID NO: 162982 - DNA, 1320 bp, Artificial Sequence
  Description of Artificial Sequence: Synthetic coding sequence
atggacctgagccgggtggtgctgcccacctttgtgctggagcccaggagcttcctgaacaagctgagtgactactactaccacgccgacctgctgagcagagctgctgtggaggaggatgcctacagcaggatgaagctggtgctgcgctggtacctgagcggcttctacaagaagcccaagggcatcaagaagccctacaaccccatcctgggggagaccttccgctgctgctggttccacccccagacagacagcaggaccttctacatcgccgagcaggtgagccaccacccccctgtgtctgccttccacgtgagcaacaggaaggatggcttctgcatcagcggcagcatcacagccaagagccgcttctacggcaacagcctgagcgccctgctggatggcaaggccaccctgaccttcctgaacagagctgaggactacaccctgaccatgccctatgcccactgcaagggcatcctgtatggcaccatgaccctggagctgggcggcaaggtgaccattgaatgtgccaagaacaacttccaggcccagctggagttcaagctgaagcccttctttggaggcagcaccagcatcaaccagatcagcggcaagatcaccagcggggaggaggtgctggccagcctgagcggccactgggacagagatgtgttcatcaaggaggagggcagcggcagcagcgccctcttctggaccccatctggagaggtgcggcggcagaggctgcggcagcacacagtgcccctggaggagcagacagagctggagagcgagcggctgtggcagcacgtgacccgggccatcagcaaaggagaccagcaccgggccacccaggagaagtttgccctggaggaggcccagaggcagagggcccgggagcggcaggagagcctgatgccctggaagccccagctgttccacctggaccccatcacccaggagtggcactaccgctatgaggaccacagcccctgggaccccctgaaggacatcgcccagtttgagcaggacggcatcctgcggaccctgcagcaggaggccgtggcccggcagaccaccttcctgggcagccctggccccaggcatgagaggagcggccctgaccagaggctgaggaaggccagtgaccagcccagcggccacagccaggccacagagagcagcggcagcaccccagagagctgcccagagctgcacggcaccggcagcactggaacagaccccaggcctcctgctgagccccccatcctggtgcctgccctgcgggtgcctggggtgtctgctgtgcactag

SEQ ID NO: 162983 - DNA, 2436 bp, Artificial Sequence; identical to SEQ ID NO: 162981
  Description of Artificial Sequence: Synthetic coding sequence

SEQ ID NO: 162984 - DNA, 375 bp, Artificial Sequence
  Description of Artificial Sequence: Synthetic coding sequence
atgaaggaggaggccttcctgcggcggcgcttcagcctgtgcccccccagcagcaccccccagaaggtggaccccaggaagctgaccaggaacctgctgctgagcggggacaatgagctgtaccccctgagccctgggaaggacatggagcccaacggccccagcctgcccagagatgagggcccccccacccccagcagcgccaccaaggtgcccccagctgagtaccgcctgtgcaatggaagtgacaaggaatgtgtgagccccacagcccgggtgaccaagaaggagaccctgaaggcccagaaggagaactaccggcaggagaagaagagggccacccggcagctgctgagcgccctgacagacccctag

SEQ ID NO: 162985 - DNA, 297 bp, Artificial Sequence
  Description of Artificial Sequence: Synthetic coding sequence
atgaaggaggaggccttcctgcggcggcgcttcagcctgtgcccccccagcagcaccccccagaaggtggaccccaggaagctgaccaggaacctgctgctgagcggggacaatgagctgtaccccctgagccctgggaaggacatggagcccaacggccccagcctgcccagagatgagggcccccccacccccagcagcgccaccaaggtgcccccagctgagtaccgcctgtgcaatggaagtgacaaggaatgtgtgagccccacagcccgggtgaccaagaaggagacctag

SEQ ID NO: 162986 - DNA, 420 bp, Artificial Sequence
  Description of Artificial Sequence: Synthetic coding sequence
atgaaggaggaggccttcctgcggcggcgcttcagcctgtgcccccccagcagcaccccccagaaggtggaccccaggaagctgaccaggaacctgctgctgagcggggacaatgagctgtaccccctgagccctgggaaggacatggagcccaacggccccagcctgcccagagatgagggcccccccacccccagcagcgccaccaaggtgcccccagctgagtaccgcctgtgcaatggaagtgacaaggaatgtgtgagccccacagcccgggtgaccaagaaggagaccctgaaggcccagaaggagaactaccggcaggagaagaagagggccacccggcagctgctgagcgccctgacagaccccagcgtggtgatcatggctgacagcctgaagatccggggcaccctgtag

SEQ ID NO: 162987 - DNA, 273 bp, Artificial Sequence
  Description of Artificial Sequence: Synthetic coding sequence
atgaaggaggaggccttcctgcggcggcgcttcagcctgtgcccccccagcagcaccccccagaaggtggaccccaggaagctgaccaggaacctgctgctgagcggggacaatgagctgtaccccctgagccctgggaaggacatggagcccaacggccccagcctgcccagagatgagggcccccccacccccagcagcgccaccaaggtgcccccagctgagtaccgcctgtgcaatggaagtgacaaggaatgtgtgagccccacctag

SEQ ID NO: 162988 - DNA, 210 bp, Artificial Sequence
  Description of Artificial Sequence: Synthetic coding sequence
atgaaggaggaggccttcctgcggcggcgcttcagcctgtgcccccccagcagcaccccccagaaggtggaccccaggaagctgaccaggaacctgctgctgagcggggacaatgagctgtaccccctgagccctgggaaggacatggagcccaacggccccagcctgcccagagatgagggcccccccacccccagcagcgccacctag

SEQ ID NO: 162989 - DNA, 1299 bp, Artificial Sequence
  Description of Artificial Sequence: Synthetic coding sequence
tacaaccccatcctgggggagaccttccgctgctgctggttccacccccagacagacagcaggaccttctacatcgccgagcaggtgagccaccacccccctgtgtctgccttccacgtgagcaacaggaaggatggcttctgcatcagcggcagcatcacagccaagagccgcttctacggcaacagcctgagcgccctgctggatggcaaggccaccctgaccttcctgaacagagctgaggactacaccctgaccatgccctatgcccactgcaagggcatcctgtatggcaccatgaccctggagctgggcggcaaggtgaccattgaatgtgccaagaacaacttccaggcccagctggagttcaagctgaagcccttctttggaggcagcaccagcatcaaccagatcagcggcaagatcaccagcggggaggaggtgctggccagcctgagcggccactgggacagagatgtgttcatcaaggaggagggcagcggcagcagcgccctcttctggaccccatctggagaggtgcggcggcagaggctgcggcagcacacagtgcccctggaggagcagacagagctggagagcgagcggctgtggcagcacgtgacccgggccatcagcaaaggagaccagcaccgggccacccaggagaagtttgccctggaggaggcccagaggcagagggcccgggagcggcaggagagcctgatgccctggaagccccagctgttccacctggaccccatcacccaggagtggcactaccgctatgaggaccacagcccctgggaccccctgaaggacatcgcccagtttgagcaggacggcatcctgcggaccctgcagcaggaggccgtggcccggcagaccaccttcctgggcagccctggccccaggcatgagaggagcggccctgaccagaggctgaggaaggccagtgaccagcccagcggccacagccaggccacagagagcagcggcagcaccccagagagctgcccagagctgagtgatgaggagcaggatggagactttgtgcctggaggagagagcccctgcccccgctgcaggaaggaggcccggcggctgcaggccctgcacgaggccatcctgagcatccgggaggcccagcaggagctgcaccgccacctgagcgccatgctgagcagcacagcccgggccgcccaggcccccaccccaggcctgctgcagagccccaggtcctggttcctgctgtgtgtgttcctggcctgccagctgttcatcaaccacatcctgaagtag

SEQ ID NO: 162990 - DNA, 1533 bp, Artificial Sequence
  Description of Artificial Sequence: Synthetic coding sequence
atgtgtgtgccccaccggcagggccaccaggagggggacagccagggcgctgagggggagctgcctgctggggaggagcccaggagcttcctgaacaagctgagtgactactactaccacgccgacctgctgagcagagctgctgtggaggaggatgcctacagcaggatgaagctggtgctgcgctggtacctgagcggcttctacaagaagcccaagggcatcaagaagccctacaaccccatcctgggggagaccttccgctgctgctggttccacccccagacagacagcaggaccttctacatcgccgagcaggtgagccaccacccccctgtgtctgccttccacgtgagcaacaggaaggatggcttctgcatcagcggcagcatcacagccaagagccgcttctacggcaacagcctgagcgccctgctggatggcaaggccaccctgaccttcctgaacagagctgaggactacaccctgaccatgccctatgcccactgcaagggcatcctgtatggcaccatgaccctggagctgggcggcaaggtgaccattgaatgtgccaagaacaacttccaggcccagctggagttcaagctgaagcccttctttggaggcagcaccagcatcaaccagatcagcggcaagatcaccagcggggaggaggtgctggccagcctgagcggccactgggacagagatgtgttcatcaaggaggagggcagcggcagcagcgccctcttctggaccccatctggagaggtgcggcggcagaggctgcggcagcacacagtgcccctggaggagcagacagagctggagagcgagcggctgtggcagcacgtgacccgggccatcagcaaaggagaccagcaccgggccacccaggagaagtttgccctggaggaggcccagaggcagagggcccgggagcggcaggagagcctgatgccctggaagccccagctgttccacctggaccccatcacccaggagtggcactaccgctatgaggaccacagcccctgggaccccctgaaggacatcgcccagtttgagcaggacggcatcctgcggaccctgcagcaggaggccgtggcccggcagaccaccttcctgggcagccctggccccaggcatgagaggagcggccctgaccagaggctgaggaaggccagtgaccagcccagcggccacagccaggccacagagagcagcggcagcaccccagagagctgcccagagctgagtgatgaggagcaggatggagactttgtgcctggaggagagagcccctgcccccgctgcaggaaggaggcccggcggctgcaggccctgcacgaggccatcctgagcatccgggaggcccagcaggagctgcaccgccacctgagcgccatgctgagcagcacagcccgggccgcccaggcccccaccccaggcctgctgcagagccccaggtcctggttcctgctgtgtgtgttcctggcctgccagctgttcatcaaccacatcctgaagtag

SEQ ID NO: 162991 - DNA, 2805 bp, Artificial Sequence
  Description of Artificial Sequence: Synthetic coding sequence
atgagcagtgatgagaagggcatcagccctgcccacaagaccagcacccccacccacaggtctgccagcagcagcaccagcagccagagggacagccggcagagcatccacatcctggagaggacagccagcagcagcacagagcccagcgtgtcccggcagctgctggagcctgagcctgtgcccctgagcaaggaggccgacagctgggagatcatcgagggcctgaagattggccagaccaacgtgcagaagccagacaagcatgagggcttcatgctgaagaagaggaagtggcccctgaagggctggcacaagcgcttctttgtgctggacaatggcatgctgaagtacagcaaggcccccctggacatccagaagggcaaggtgcacggcagcattgatgtgggcctgtctgtgatgagcatcaagaagaaggccaggagaattgacctggacacagaggagcacatctaccacctgaaggtgaagagccaggactggtttgatgcctgggtgtccaagctgcggcaccaccggctgtaccggcagaatgaaattgtgcgcagccccagagatgccagcttccacatcttccccagcaccagcacagctgagagcagccctgctgccaacgtgtctgtgatggatggcaagatgcagcccaacagcttcccctggcagagccccctgccctgcagcaacagcctgcctgccacctgcaccaccggccagagcaaggtggccgcctggctgcaggacagcgaggagatggacagatgtgccgaggacctggcccactgccagagcaacctggtggagctgagcaagctgctgcagaacctggagatcctgcagaggacccagagcgcccccaacttcacagacatgcaggccaactgtgtggacatcagcaagaaggacaagagggtgacccggcgctggaggaccaagtctgtgtccaaggacaccaagatccagctgcaggtgcccttcagcgccaccatgagccctgtgcggctgcacagcagcaaccccaacctgtgtgccgacatcgagttccagaccccacccagccacctgacagaccccctggagagcagcacagactacaccaagctgcaggaggagttctgcctgattgcccagaaggtgcacagcctgctgaagagcgccttcaacagcatcgccatcgagaaggagaagctgaagcagatggtgtctgagcaggaccacagcaagggccacagcacccagatggcccggctgcggcagagcctgagccaggccctgaaccagaatgctgagctgcggagccggctgaaccgcatccacagcgagagcatcatctgtgaccaggtggtgtctgtgaacatcatccccagcccagatgaggccggggagcagatccacgtgtccctgcccctgagccagcaggtggccaatgaaagccggctgtccatgtctgagagcgtgtctgagttctttgatgcccaggaggtgctgctgagcgccagcagcagtgaaaatgaggccagtgatgatgagagctacatcagtgatgtgtctgacaacatcagcgaggacaacacctctgtggccgacaacatcagccggcagatcctgaatggagagctgactggaggagccttcagaaatggaagaagagcctgcctgcctgccccctgcccagacaccagcaacatcaacctgtggaacatcctgaggaacaacatcggcaaggacctgagcaaggtgtccatgcctgtggagctgaatgagcccctgaacaccctgcagcacctgtgtgaggagatggagtacagcgagctgctggacaaggccagcgagacagatgacccctatgaaagaatggtgctggtggccgcctttgctgtgtctggctactgcagcacctacttccgggccggcagcaagcccttcaaccctgtgctgggggagacctatgagtgcatcagagaagataaaggcttccgcttcttcagcgagcaggtgagccaccacccccccatcagcgcctgccactgtgagagcaagaactttgtgttctggcaggacatccgctggaagaacaagttctggggcaagtccatggagatcctgcctgtgggcaccctgaatgtgatgctgcccaagtacggggactactacgtgtggaacaaggtgaccacctgcatccacaacatcctgagcggccgccgctggattgagcactacggggaggtgaccatccggaacaccaagagctctgtgtgcatctgcaagctgacctttgtgaaggtgaactactggaacagcaacatgaatgaggtgcagggcgtggtgattgaccaggagggcaaggctgtgtaccgcctgtttgggaagtggcatgagggcctgtactgcggcgtggcccccagcgccaagtgcatctggaggcctggctccatgcccaccaactatgagctgtactacggcttcaccaggtttgccatcgagctgaatgagctggaccctgtgctgaaggacctgctgcccccaacagatgcccgcttccggccagaccagcgcttcctggaggagggcaacctggaggccgccgccagcgagaagcagagggtggaggagctgcagaggagcagaagacgctacatggaggagaacaacctggagcacatccccaagttcttcaagaaggtgattgatgccaaccagcgggaggcctgggtgtccaatgacacctactgggagctgaggaaggaccccggcttcagcaaggtggacagccctgtgctgtggtag

SEQ ID NO: 162992 - DNA, 2817 bp, Artificial Sequence
  Description of Artificial Sequence: Synthetic coding sequence
atgcaccagctgagcctcatccggggcaacagaggccgcagcatccacatcctggagaggacagccagcagcagcacagagcccagcgtgtcccggcagctgctggagcctgagcctgtgcccctgagcaaggaggccgacagctgggagatcatcgagggcctgaagattggccagaccaacgtgcagaagccagacaagcatgagggcttcatgctgaagaagaggaagtggcccctgaagggctggcacaagcgcttctttgtgctggacaatggcatgctgaagtacagcaaggcccccctggacatccagaagggcaaggtgcacggcagcattgatgtgggcctgtctgtgatgagcatcaagaagaaggccaggagaattgacctggacacagaggagcacatctaccacctgaaggtgaagagccaggactggtttgatgcctgggtgtccaagctgcggcaccaccggctgtaccggcagaatgagatcgtgcgcagccccagagatgccagcttccacatcttccccagcaccagcacagctgagagcagccctgctgccaacgtgtctgtgatggatggcaagatgcagcccaacagcttcccctggcagagccccctgccctgcagcaacagcctgcctgccacctgcaccaccggccagagcaaggtggccgcctggctgcaggacagcgaggagatggacagatgtgccgaggacctggcccactgccagagcaacctggtggagctgagcaagctgctgcagaacctggagatcctgcagaggacccagagcgcccccaacttcacagacatgcaggccaactgtgtggacatcagcaagaaggacaagagggtgacccggcgctggaggaccaagtctgtgtccaaggacaccaagatccagctgcaggagggccccccagccaagggccagttcagcaccacccggcggcggcagaggctggccgctgctgtggccaccaccgtgcccttcagcgccaccatgagccctgtgcggctgcacagcagcaaccccaacctgtgtgccgacatcgagttccagaccccacccagccacctgacagaccccctggagagcagcacagactacaccaagctgcaggaggagttctgcctgattgcccagaaggtgcacagcctgctgaagagcgccttcaacagcatcgccatcgagaaggagaagctgaagcagatggtgtctgagcaggaccacagcaagggccacagcacccagatggcccggctgcggcagagcctgagccaggccctgaaccagaatgctgagctgcggagccggctgaaccgcatccacagcgagagcatcatctgtgaccaggtggtgtctgtgaacatcatccccagcccagatgaggccggggagcagatccacgtgtccctgcccctgagccagcaggtggccaatgaaagccggctgtccatgtctgagagcgtgtctgagttctttgatgcccaggaggtgctgctgagcgccagcagcagtgaaaatgaggccagtgatgatgagagctacatcagtgatgtgtctgacaacatcagcgaggacaacacctctgtggccgacaacatcagccggcagatcctgaatggagagctgactggaggagccttcagaaatggaagaagagcctgcctgcctgccccctgcccagacaccagcaacatcaacctgtggaacatcctgaggaacaacatcggcaaggacctgagcaaggtgtccatgcctgtggagctgaatgagcccctgaacaccctgcagcacctgtgtgaggagatggagtacagcgagctgctggacaaggccagcgagacagatgacccctatgaaagaatggtgctggtggccgcctttgctgtgtctggctactgcagcacctacttccgggccggcagcaagcccttcaaccctgtgctgggggagacctatgagtgcatcagagaagataaaggcttccgcttcttcagcgagcaggtgagccaccacccccccatcagcgcctgccactgtgagagcaagaactttgtgttctggcaggacatccgctggaagaacaagttctggggcaagtccatggagatcctgcctgtgggcaccctgaatgtgatgctgcccaagtacggggactactacgtgtggaacaaggtgaccacctgcatccacaacatcctgagcggccgccgctggattgagcactacggggaggtgaccatccggaacaccaagagctctgtgtgcatctgcaagctgacctttgtgaaggtgaactactggaacagcaacatgaatgaggtgcagggcgtggtgattgaccaggagggcaaggctgtgtaccgcctgtttgggaagtggcatgagggcctgtactgcggcgtggcccccagcgccaagtgcatctggaggcctggctccatgcccaccaactatgagctgtactacggcttcaccaggtttgccatcgagctgaatgagctggaccctgtgctgaaggacctgctgcccccaacagatgcccgcttccggccagaccagcgcttcctggaggagggcaacctggaggccgccgccagcgagaagcagagggtggaggagctgcagaggagcagaagacgctacatggaggagaacaacctggagcacatccccaagttcttcaagaaggtgattgatgccaaccagcgggaggcctgggtgtccaatgacacctactgggagctgaggaaggaccccggcttcagcaaggtggacagccctgtgctgtggtag

SEQ ID NO: 162993 - DNA, 2697 bp, Artificial Sequence
  Description of Artificial Sequence: Synthetic coding sequence
atgagcagtgatgagaagggcatcagccctgcccacaagaccagcacccccacccacaggtctgccagcagcagcaccagcagccagagggacagccggcagagcatccacatcctggagaggacagccagcagcagcacagagcccagcgtgtcccggcagctgctggagcctgagcctgtgcccctgagcaaggaggccgacagctgggagatcatcgagggcctgaagattggccagaccaacgtgcagaagccagacaagcatgagggcttcatgctgaagaagaggaagtggcccctgaagggctggcacaagcgcttctttgtgctggacaatggcatgctgaagtacagcaaggcccccctggacatccagaagggcaaggtgcacggcagcattgatgtgggcctgtctgtgatgagcatcaagaagaaggccaggagaattgacctggacacagaggagcacatctaccacctgaaggtgaagagccaggactggtttgatgcctgggtgtccaagctgcggcaccaccggctgtaccggcagaatgaaattgtgcgcagccccagagatgccagcttccacatcttccccagcaccagcacagctgagagcagccctgctgccaacgtgtctgtgatggatggcaagatgcagcccaacagcttcccctggcagagccccctgccctgcagcaacagcctgcctgccacctgcaccaccggccagagcaaggtggccgcctggctgcaggacagcgaggagatggacagatgtgccgaggacctggcccactgccagagcaacctggtggagctgagcaagctgctgcagaacctggagatcctgcagaggacccagagcgcccccaacttcacagacatgcaggccaactgtgtggacatcagcaagaaggacaagagggtgacccggcgctggaggaccaagtctgtgtccaaggacaccaagatccagctgcaggtgcccttcagcgccaccatgagccctgtgcggctgcacagcagcaaccccaacctgtgtgccgacatcgagttccagaccccacccagccacctgacagaccccctggagagcagcacagactacaccaagctgcaggaggagttctgcctgattgcccagaaggtgcacagcctgctgaagagcgccttcaacagcatcgccatcgagaaggagaagctgaagcagatggtgtctgagcaggaccacagcaagggccacagcacccagatggcccggctgcggcagagcctgagccaggccggggagcagatccacgtgtccctgcccctgagccagcaggtggccaatgaaagccggctgtccatgtctgagagcgtgtctgagttctttgatgcccaggaggtgctgctgagcgccagcagcagtgaaaatgaggccagtgatgatgagagctacatcagtgatgtgtctgacaacatcagcgaggacaacacctctgtggccgacaacatcagccggcagatcctgaatggagagctgactggaggagccttcagaaatggaagaagagcctgcctgcctgccccctgcccagacaccagcaacatcaacctgtggaacatcctgaggaacaacatcggcaaggacctgagcaaggtgtccatgcctgtggagctgaatgagcccctgaacaccctgcagcacctgtgtgaggagatggagtacagcgagctgctggacaaggccagcgagacagatgacccctatgaaagaatggtgctggtggccgcctttgctgtgtctggctactgcagcacctacttccgggccggcagcaagcccttcaaccctgtgctgggggagacctatgagtgcatcagagaagataaaggcttccgcttcttcagcgagcaggtgagccaccacccccccatcagcgcctgccactgtgagagcaagaactttgtgttctggcaggacatccgctggaagaacaagttctggggcaagtccatggagatcctgcctgtgggcaccctgaatgtgatgctgcccaagtacggggactactacgtgtggaacaaggtgaccacctgcatccacaacatcctgagcggccgccgctggattgagcactacggggaggtgaccatccggaacaccaagagctctgtgtgcatctgcaagctgacctttgtgaaggtgaactactggaacagcaacatgaatgaggtgcagggcgtggtgattgaccaggagggcaaggctgtgtaccgcctgtttgggaagtggcatgagggcctgtactgcggcgtggcccccagcgccaagtgcatctggaggcctggctccatgcccaccaactatgagctgtactacggcttcaccaggtttgccatcgagctgaatgagctggaccctgtgctgaaggacctgctgcccccaacagatgcccgcttccggccagaccagcgcttcctggaggagggcaacctggaggccgccgccagcgagaagcagagggtggaggagctgcagaggagcagaagacgctacatggaggagaacaacctggagcacatccccaagttcttcaagaaggtgattgatgccaaccagcgggaggcctgggtgtccaatgacacctactgggagctgaggaaggaccccggcttcagcaaggtggacagccctgtgctgtggtag

SEQ ID NO: 162994 - DNA, 573 bp, Artificial Sequence
  Description of Artificial Sequence: Synthetic coding sequence
atggatggcaagatgcagcccaacagcttcccctggcagagccccctgccctgcagcaacagcctgcctgccacctgcaccaccggccagagcaaggtggccgcctggctgcaggacagcgaggagatggacagatgtgccgaggacctggcccactgccagagcaacctggtggagctgagcaagctgctgcagaacctggagatcctgcagaggacccagagcgcccccaacttcacagacatgcaggccaactgtgtggacatcagcaagaaggacaagagggtgacccggcgctggaggaccaagtctgtgtccaaggacaccaagatccagctgcaggtgcccttcagcgccaccatgagccctgtgcggctgcacagcagcaaccccaacctgtgtgccgacatcgagttccagaccccaccacccaaccacttcggcatcctgtctgtgctgctgcagccctacagcctgaagaagaagaagaagaagaagaagaagagcacccccagcctggagagccgcatcaagggagctgagtacaagatccagagcctgaccagcctgtag

SEQ ID NO: 162995 - DNA, 2880 bp, Artificial Sequence
  Description of Artificial Sequence: Synthetic coding sequence
atgagcagtgatgagaagggcatcagccctgcccacaagaccagcacccccacccacaggtctgccagcagcagcaccagcagccagagggacagccggcagagcatccacatcctggagaggacagccagcagcagcacagagcccagcgtgtcccggcagctgctggagcctgagcctgtgcccctgagcaaggaggccgacagctgggagatcatcgagggcctgaagattggccagaccaacgtgcagaagccagacaagcatgagggcttcatgctgaagaagaggaagtggcccctgaagggctggcacaagcgcttctttgtgctggacaatggcatgctgaagtacagcaaggcccccctggacatccagaagggcaaggtgcacggcagcattgatgtgggcctgtctgtgatgagcatcaagaagaaggccaggagaattgacctggacacagaggagcacatctaccacctgaaggtgaagagccaggactggtttgatgcctgggtgtccaagctgcggcaccaccggctgtaccggcagaatgaaattgtgcgcagccccagagatgccagcttccacatcttccccagcaccagcacagctgagagcagccctgctgccaacgtgtctgtgatggatggcaagatgcagcccaacagcttcccctggcagagccccctgccctgcagcaacagcctgcctgccacctgcaccaccggccagagcaaggtggccgcctggctgcaggacagcgaggagatggacagatgtgccgaggacctggcccactgccagagcaacctggtggagctgagcaagctgctgcagaacctggagatcctgcagaggacccagagcgcccccaacttcacagacatgcaggccaactgtgtggacatcagcaagaaggacaagagggtgacccggcgctggaggaccaagtctgtgtccaaggacaccaagatccagctgcaggagggccccccagccaagggccagttcagcaccacccggcggcggcagaggctggccgctgctgtggccaccaccgtgcccttcagcgccaccatgagccctgtgcggctgcacagcagcaaccccaacctgtgtgccgacatcgagttccagaccccacccagccacctgacagaccccctggagagcagcacagactacaccaagctgcaggaggagttctgcctgattgcccagaaggtgcacagcctgctgaagagcgccttcaacagcatcgccatcgagaaggagaagctgaagcagatggtgtctgagcaggaccacagcaagggccacagcacccagatggcccggctgcggcagagcctgagccaggccctgaaccagaatgctgagctgcggagccggctgaaccgcatccacagcgagagcatcatctgtgaccaggtggtgtctgtgaacatcatccccagcccagatgaagctggggagcagatccacgtgtccctgcccctgagccagcaggtggccaatgaaagccggctgtccatgtctgagagcgtgtctgagttctttgatgcccaggaggtgctgctgagcgccagcagcagtgaaaatgaggccagtgatgatgagagctacatcagtgatgtgtctgacaacatcagcgaggacaacacctctgtggccgacaacatcagccggcagatcctgaatggagagctgaccggcggggccttcagaaatggccggcgggcctgcctgcctgccccctgcccagacaccagcaacatcaacctgtggaacatcctgaggaacaacatcggcaaggacctgagcaaggtgtccatgcctgtggagctgaatgagcccctgaacaccctgcagcacctgtgtgaggagatggagtacagcgagctgctggacaaggccagcgagacagatgacccctatgaaagaatggtgctggtggccgcctttgctgtgtctggctactgcagcacctacttccgggccggcagcaagcccttcaaccctgtgctgggggagacctatgagtgcatccgggaggacaagggcttccgcttcttcagcgagcaggtgagccaccacccccccatcagcgcctgccactgtgagagcaagaactttgtgttctggcaggacatccgctggaagaacaagttctggggcaagtccatggagatcctgcctgtgggcaccctgaatgtgatgctgcccaagtatggagactactacgtgtggaacaaggtgaccacctgcatccacaacatcctgtctggaagacgctggattgagcactatggagaggtgaccatccggaacaccaagagctctgtgtgcatctgcaagctgacctttgtgaaggtgaactactggaacagcaacatgaatgaggtgcagggcgtggtgattgaccaggagggcaaggctgtgtaccgcctgtttgggaagtggcatgagggcctgtactgcggcgtggcccccagcgccaagtgcatctggaggcctggctccatgcccaccaactatgagctgtactacggcttcaccaggtttgccatcgagctgaatgagctggaccctgtgctgaaggacctgctgcccccaacagatgcccgcttccggccagaccagcgcttcctggaggagggcaacctggaggccgccgccagcgagaagcagagggtggaggagctgcagaggagcagaagacgctacatggaggagaacaacctggagcacatccccaagttcttcaagaaggtgattgatgccaaccagcgggaggcctgggtgtccaatgacacctactgggagctgaggaaggaccccggcttcagcaaggtggacagccctgtgctgtggtag

SEQ ID NO: 162996 - DNA, 2712 bp, Artificial Sequence
  Description of Artificial Sequence: Synthetic coding sequence
atgagcagtgatgagaagggcatcagccctgcccacaagaccagcacccccacccacaggtctgccagcagcagcaccagcagccagagggacagccggcagagcatccacatcctggagaggacagccagcagcagcacagagcccagcgtgtcccggcagctgctggagcctgagcctgtgcccctgagcaaggaggccgacagctgggagatcatcgagggcctgaagattggccagaccaacgtgcagaagccagacaagcatgagggcttcatgctgaagaagaggaagtggcccctgaagggctggcacaagcgcttctttgtgctggacaatggcatgctgaagtacagcaaggcccccctggacatccagaagggcaaggtgcacggcagcattgatgtgggcctgtctgtgatgagcatcaagaagaaggccaggagaattgacctggacacagaggagcacatctaccacctgaaggtgaagagccaggactggtttgatgcctgggtgtccaagctgcggcaccaccggctgtaccggcagaatgaaattgtgcgcagccccagagatgccagcttccacatcttccccagcaccagcacagctgagagcagccctgctgccaacgtgtctgtgatggatggcaagatgcagcccaacagcttcccctggcagagccccctgccctgcagcaacagcctgcctgccacctgcaccaccggccagagcaaggtggccgcctggctgcaggacagcgaggagatggacagatgtgccgaggacctggcccactgccagagcaacctggtggagctgagcaagctgctgcagaacctggagatcctgcagaggacccagagcgcccccaacttcacagacatgcaggtgcccttcagcgccaccatgagccctgtgcggctgcacagcagcaaccccaacctgtgtgccgacatcgagttccagaccccacccagccacctgacagaccccctggagagcagcacagactacaccaagctgcaggaggagttctgcctgattgcccagaaggtgcacagcctgctgaagagcgccttcaacagcatcgccatcgagaaggagaagctgaagcagatggtgtctgagcaggaccacagcaagggccacagcacccagatggcccggctgcggcagagcctgagccaggccctgaaccagaatgctgagctgcggagccggctgaaccgcatccacagcgagagcatcatctgtgaccaggtggtgtctgtgaacatcatccccagcccagatgaagctggggagcagatccacgtgtccctgcccctgagccagcaggtggccaatgaaagccggctgtccatgtctgagagcgtgtctgagttctttgatgcccaggaggtgctgctgagcgccagcagcagtgaaaatgaggccagtgatgatgagagctacatcagtgatgtgtctgacaacatcagcgaggacaacacctctgtggccgacaacatcagccggcagatcctgaatggagagctgaccggcggggccttcagaaatggccggcgggcctgcctgcctgccccctgcccagacaccagcaacatcaacctgtggaacatcctgaggaacaacatcggcaaggacctgagcaaggtgtccatgcctgtggagctgaatgagcccctgaacaccctgcagcacctgtgtgaggagatggagtacagcgagctgctggacaaggccagcgagacagatgacccctatgaaagaatggtgctggtggccgcctttgctgtgtctggctactgcagcacctacttccgggccggcagcaagcccttcaaccctgtgctgggggagacctatgagtgcatccgggaggacaagggcttccgcttcttcagcgagcaggtgagccaccacccccccatcagcgcctgccactgtgagagcaagaactttgtgttctggcaggacatccgctggaagaacaagttctggggcaagtccatggagatcctgcctgtgggcaccctgaatgtgatgctgcccaagtatggagactactacgtgtggaacaaggtgaccacctgcatccacaacatcctgtctggaagacgctggattgagcactatggagaggtgaccatccggaacaccaagagctctgtgtgcatctgcaagctgacctttgtgaaggtgaactactggaacagcaacatgaatgaggtgcagggcgtggtgattgaccaggagggcaaggctgtgtaccgcctgtttgggaagtggcatgagggcctgtactgcggcgtggcccccagcgccaagtgcatctggaggcctggctccatgcccaccaactatgagctgtactacggcttcaccaggtttgccatcgagctgaatgagctggaccctgtgctgaaggacctgctgcccccaacagatgcccgcttccggccagaccagcgcttcctggaggagggcaacctggaggccgccgccagcgagaagcagagggtggaggagctgcagaggagcagaagacgctacatggaggagaacaacctggagcacatccccaagttcttcaagaaggtgattgatgccaaccagcgggaggcctgggtgtccaatgacacctactgggagctgaggaaggaccccggcttcagcaaggtggacagccctgtgctgtggtag

SEQ ID NO: 162997 - DNA, 2529 bp, Artificial Sequence
  Description of Artificial Sequence: Synthetic coding sequence
atggacttccaggagcgggacccccccttcctgcctgagagcgcccagagcagcaagcccagcagcgcccagcaggccagcgagctgtgggaggtggtggaggagccccgggtgcggctgggcacagagggcgtgatgcctgagcggcaggagggccacctgctgaagaagaggaagtggcccctgaagggctggcacaagcgctactttgtgctggaggatggcatcctgcactacgccaccacccggcaggacatcaccaagggcaagctgcacggcagcattgatgtgcggctgtctgtgatgagcatcaacaagaaggcccagagaattgacctggacacagaggacaacatctaccacctgaagatcaagagccaggacctcttccagagctgggtggcccagctgcgggcccaccggctggcccaccggctggacatgccccggggcagcctgcccagcacagcccacaggaaggtgcctggggcccagctgcccacagctgccacagccagcgccctgcccggcctgggcccccgggagaaggtgtcctcctggctgcgggacagtgatggcctggaccgctgcagccatgagctgtctgagtgccagggcaagctgcaggagctgcaccggctgctgcagagcctggagagcctgcaccgcatccccagcgcccctgtgatccccacccaccaggcctctgtgaccacagagcggcccaagaagggcaagaggaccagcaggatgtggtgcacccagagctttgccaaggatgacaccatcggccgggtgggccgcctgcacggctctgtgcccaacctgagccgctacctggagagccgggacagcagcggcacccggggcctgcccccaacagattatgcccacctgcagaggagcttctgggccctggcccagaaggtgcacagcagcctgagctctgtgctggccgccctgaccatggagcgggaccagctgcgggacatgcaccagggcagcgagctgagcaggatgggcgtgtctgaggccagcacaggccagaggcggctgcacagcctgagcaccagcagtgacaccacagctgacagcttcagcagcctgaaccctgaggagcaggaggccctgtacatgaagggccgggagctgaccccccagctgagccagaccagcatcctgagcctggccgacagccacacagagttctttgatgcctgtgaggtgctgctgagcgccagcagcagtgaaaatgaaggcagcgaggaggaggagagctgcaccagcgagatcaccaccagcctgtctgaggagatgctggacctgcggggagctgagcgctgccagaagggcggctgtgtgcccggccggcccatgggccccccaagaagacgctgcctgcctgctgccagcggccctggagcagatgtgtccctgtggaacatcctgaggaacaacatcggcaaggacctgagcaaggtgtccatgcctgtgcagctgaatgagcccctgaacaccctgcagaggctgtgtgaggagctggagtacagcagcctgctggaccaggccagcagaattgctgacccctgtgagaggatggtgtacatcgccgcctttgctgtgtctgcctacagcagcacctaccacagagctggctgcaagcccttcaaccctgtgctgggggagacctatgaatgtgagaggccagaccggggcttccgcttcatcagcgagcaggtgagccaccacccccccatcagcgcctgccacgccgagagcgagaactttgccttctggcaggacatgaagtggaagaacaagttctggggcaagagcctggagatcgtgcctgtgggcaccgtgaatgtgtccctgcccaggtttggagaccactttgagtggaacaaggtgaccagctgcatccacaacgtgctgagcggccagcgctggattgagcactacggggaggtgctgatccggaacacccaggacagcagctgccactgcaagatcaccttctgcaaggccaagtactggagcagcaatgtgcatgaggtgcagggcgctgtgctgagccgcagcggccgggtgctgcaccggctgtttgggaagtggcatgagggcctgtaccggggccccaccccaggcggccagtgcatctggaagcccaacagcatgcccccagaccacgagaggaactttggcttcacccagtttgccctggagctgaatgagctgacagctgagctgaagaggagcctgcccagcacagacacccggctgcggccagaccagcgctacctggaggagggcaacatccaggccgctgaggcccagaagagaagaattgagcagctgcagagggacaggaggaaggtgatggaggagaacaacatcgtgcaccaggcccgcttcttccggcggcagacagacagcagcggcaaggagtggtgggtgaccaacaacacctactggaggctgcgggcagagcccggctacggcaacatggatggagctgtgctgtggtag

SEQ ID NO: 162998 - DNA, 2529 bp, Artificial Sequence; identical to SEQ ID NO: 162997
  Description of Artificial Sequence: Synthetic coding sequence

SEQ ID NO: 162999 - DNA, 2670 bp, Artificial Sequence
  Description of Artificial Sequence: Synthetic coding sequence
atggagggcggcctggctgatggagagccagacaggaccagcctgctgggggacagcaaggatgtgctgggccccagcacagtggtggccaacagtgatgagagccagctgctgacccctgggaagatgagccagaggcagggcaaggaggcctaccccacccccaccaaggacctgcaccagcccagcctgagccctgccagcccccacagccagggctttgagcggggcaaggaggacatcagccagaacaaggatgagagcagcctgtccatgagcaagagcaagtctgagagcaagctgtacaatggaagtgagaaggacagcagcaccagcagcaagctgaccaagaaggagagcctgaaggtgcagaagaagaactaccgggaggagaagaagagggccaccaaggagctgctgagcaccatcacagaccccagcgtgattgtgatggctgactggctgaagatccggggcaccctgaagtcctggaccaagctgtggtgtgtgctgaagccaggagtgctgctgatctacaagacccagaagaatggccagtgggtgggcaccgtgctgctgaatgcctgtgagatcatcgagcggcccagcaagaaggatggcttctgcttcaagctgttccaccccctggagcagagcatctgggccgtgaagggccccaagggggaggccgtgggcagcatcacccagcccctgcccagcagctacctgatcatccgggccaccagcgagagtgatggccgctgctggatggatgccctggagctggccctgaagtgcagcagcctgctgaagaggaccatgatccgggagggcaaggagcatgacctgtctgtgtccagtgacagcacccacgtgaccttctacggcctgctgcgggccaacaacctgcacagcggggacaacttccagctgaatgacagcgagattgaaaggcagcacttcaaggaccaggacatgtacagcgacaagagtgacaaggaaaatgaccaggagcatgatgaaagtgacaatgaggtgatgggcaagtctgaggagagtgacacagacaccagcgagcggcaggatgacagctacatcgagcctgagcctgtggagcccctgaaggagaccacctacacagagcagagccatgaggagctgggggaggccggggaggccagccagacagagaccgtgtctgaggagaacaagagcctcatctggaccctgctgaagcaggtgcggcccggcatggacctgagcaaggtggtgctgcccaccttcatcctggagcccaggagcttcctggacaagctgagtgactactactaccacgccgacttcctgtctgaggccgccctggaggagaacccctacttccggctgaagaaggtggtgaagtggtacctgagcggcttctacaagaagcccaagggcctgaagaagccctacaaccccatcctgggggagaccttccgctgcctgtggatccaccccaggaccaacagcaagaccttctacatcgccgagcaggtgagccaccacccccccatcagcgccttctacgtgagcaacaggaaggatggcttctgcctgagcggcagcatcctggccaagagcaagttctacggcaacagcctgagcgccatcctggagggggaggcccggctgaccttcctgaacagaggagaggactatgtgatgaccatgccctatgcccactgcaagggcatcctgtatggcaccatgaccctggagctgggcggcaccgtgaacatcacctgccagaagacaggctacagcgccatcctggagttcaagctgaagcccttcctgggcagcagtgactgtgtgaaccagatcagcggcaagctgaagctgggcaaggaggtgctggccaccctggagggccactgggacagcgaggtgttcatcacagacaagaagacagacaacagcgaggtgttctggaaccccaccccagacatcaagcagtggaggctcatccgccacacagtgaagtttgaggagcagggcgactttgaaagtgagaagctgtggcagagggtgacccgggccatcaatgccaaggaccagacagaggccacccaggagaagtatgtgctggaggaggcccagaggcaggccgcccgggacaggaagaccaagaatgaggagtggagctgcaagctgtttgagctggaccccctgaccggggagtggcactacaagtttgctgacacccggccctgggaccccctgaatgacatgatccagtttgagaaggatggagtcatccagaccaaggtgaagcacaggacccccatggtgtctgtgcccaagatgaagcacaagcccacccggcagcagaagaaggtggccaagggctacagcagccctgagccagacatccaggacagcagcggcagcgaggcccagagcgtgaagcccagcaccaggaggaagaagggcatcgagctgggggacatccagagcagcattgagagcatcaagcagacccaggaggagatcaagaggaacatcatggccctgaggaaccacctggtgagcagcaccccagccacagactacttcctgcagcagaaggactacttcatcatcttcctgctgatcctgctgcaggtgatcatcaacttcatgttcaagtag

SEQ ID NO: 163000 - DNA, 2544 bp, Artificial Sequence
  Description of Artificial Sequence: Synthetic coding sequence
atgagccagaggcagggcaaggaggcctaccccacccccaccaaggacctgcaccagcccagcctgagccctgccagcccccacagccagggctttgagcggggcaaggaggacatcagccagaacaaggatgagagcagcctgtccatgagcaagagcaagtctgagagcaagctgtacaatggaagtgagaaggacagcagcaccagcagcaagctgaccaagaaggagagcctgaaggtgcagaagaagaactaccgggaggagaagaagagggccaccaaggagctgctgagcaccatcacagaccccagcgtgattgtgatggctgactggctgaagatccggggcaccctgaagtcctggaccaagctgtggtgtgtgctgaagccaggagtgctgctgatctacaagacccagaagaatggccagtgggtgggcaccgtgctgctgaatgcctgtgagatcatcgagcggcccagcaagaaggatggcttctgcttcaagctgttccaccccctggagcagagcatctgggccgtgaagggccccaagggggaggccgtgggcagcatcacccagcccctgcccagcagctacctgatcatccgggccaccagcgagagtgatggccgctgctggatggatgccctggagctggccctgaagtgcagcagcctgctgaagaggaccatgatccgggagggcaaggagcatgacctgtctgtgtccagtgacagcacccacgtgaccttctacggcctgctgcgggccaacaacctgcacagcggggacaacttccagctgaatgacagcgagattgaaaggcagcacttcaaggaccaggacatgtacagcgacaagagtgacaaggaaaatgaccaggagcatgatgaaagtgacaatgaggtgatgggcaagtctgaggagagtgacacagacaccagcgagcggcaggatgacagctacatcgagcctgagcctgtggagcccctgaaggagaccacctacacagagcagagccatgaggagctgggggaggccggggaggccagccagacagagaccgtgtctgaggagaacaagagcctcatctggaccctgctgaagcaggtgcggcccggcatggacctgagcaaggtggtgctgcccaccttcatcctggagcccaggagcttcctggacaagctgagtgactactactaccacgccgacttcctgtctgaggccgccctggaggagaacccctacttccggctgaagaaggtggtgaagtggtacctgagcggcttctacaagaagcccaagggcctgaagaagccctacaaccccatcctgggggagaccttccgctgcctgtggatccaccccaggaccaacagcaagaccttctacatcgccgagcaggtgagccaccacccccccatcagcgccttctacgtgagcaacaggaaggatggcttctgcctgagcggcagcatcctggccaagagcaagttctacggcaacagcctgagcgccatcctggagggggaggcccggctgaccttcctgaacagaggagaggactatgtgatgaccatgccctatgcccactgcaagggcatcctgtatggcaccatgaccctggagctgggcggcaccgtgaacatcacctgccagaagacaggctacagcgccatcctggagttcaagctgaagcccttcctgggcagcagtgactgtgtgaaccagatcagcggcaagctgaagctgggcaaggaggtgctggccaccctggagggccactgggacagcgaggtgttcatcacagacaagaagacagacaacagcgaggtgttctggaaccccaccccagacatcaagcagtggaggctcatccgccacacagtgaagtttgaggagcagggcgactttgaaagtgagaagctgtggcagagggtgacccgggccatcaatgccaaggaccagacagaggccacccaggagaagtatgtgctggaggaggcccagaggcaggccgcccgggacaggaagaccaagaatgaggagtggagctgcaagctgtttgagctggaccccctgaccggggagtggcactacaagtttgctgacacccggccctgggaccccctgaatgacatgatccagtttgagaaggatggagtcatccagaccaaggtgaagcacaggacccccatggtgtctgtgcccaagatgaagcacaagcccacccggcagcagaagaaggtggccaagggctacagcagccctgagccagacatccaggacagcagcggcagcgaggcccagagcgtgaagcccagcaccaggaggaagaagggcatcgagctgggggacatccagagcagcattgagagcatcaagcagacccaggaggagatcaagaggaacatcatggccctgaggaaccacctggtgagcagcaccccagccacagactacttcctgcagcagaaggactacttcatcatcttcctgctgatcctgctgcaggtgatcatcaacttcatgttcaagtag

SEQ ID NO: 163001 - DNA, 2544 bp, Artificial Sequence; identical to SEQ ID NO: 163000
  Description of Artificial Sequence: Synthetic coding sequence

SEQ ID NO: 163002 - DNA, 2187 bp, Artificial Sequence
  Description of Artificial Sequence: Synthetic coding sequence
atggagggcggcctggctgatggagagccagacaggaccagcctgctgggggacagcaaggatgtgctgggccccagcacagtggtggccaacagtgatgagagccagctgctgacccctgggaagatgagccagaggcagggcaaggaggcctaccccacccccaccaaggacctgcaccagcccagcctgagccctgccagcccccacagccagggctttgagcggggcaaggaggacatcagccagaacaaggatgagagcagcctgtccatgagcaagagcaagtctgagagcaagctgtacaatggaagtgagaaggacagcagcaccagcagcaagctgaccaagaaggagagcctgaaggtgcagaagaagaactaccgggaggagaagaagagggccaccaaggagctgctgagcaccatcacagaccccagcgtgattgtgatggctgactggctgaagatccggggcaccctgaagtcctggaccaagctgtggtgtgtgctgaagccaggagtgctgctgatctacaagacccagaagaatggccagtgggtgggcaccgtgctgctgaatgcctgtgagatcatcgagcggcccagcaagaaggatggcttctgcttcaagctgttccaccccctggagcagagcatctgggccgtgaagggccccaagggggaggccgtgggcagcatcacccagcccctgcccagcagctacctgatcatccgggccaccagcgagagtgatggccgctgctggatggatgccctggagctggccctgaagtgcagcagcctgctgaagaggaccatgatccgggagggcaaggagcatgacctgtctgtgtccagtgacagcacccacgtgaccttctacggcctgctgcgggccaacaacctgcacagcggggacaacttccagctgaatgacagcgagattgaaaggcagcacttcaaggaccaggacatgtacagcgacaagagtgacaaggaaaatgaccaggagcatgatgaaagtgacaatgaggtgatgggcaagtctgaggagagtgacacagacaccagcgagcggcaggatgacagctacatcgagcctgagcctgtggagcccctgaaggagaccacctacacagagcagagccatgaggagctgggggaggccggggaggccagccagacagagaccgtgtctgaggagaacaagagcctcatctggaccctgctgaagcaggtgcggcccggcatggacctgagcaaggtggtgctgcccaccttcatcctggagcccaggagcttcctggacaagctgagtgactactactaccacgccgacttcctgtctgaggccgccctggaggagaacccctacttccggctgaagaaggtggtgaagtggtacctgagcggcttctacaagaagcccaagggcctgaagaagccctacaaccccatcctgggggagaccttccgctgcctgtggatccaccccaggaccaacagcaagaccttctacatcgccgagcaggtgagccaccacccccccatcagcgccttctacgtgagcaacaggaaggatggcttctgcctgagcggcagcatcctggccaagagcaagttctacggcaacagcctgagcgccatcctggagggggaggcccggctgaccttcctgaacagaggagaggactatgtgatgaccatgccctatgcccactgcaagggcatcctgtatggcaccatgaccctggagctgggcggcaccgtgaacatcacctgccagaagacaggctacagcgccatcctggagttcaagctgaagcccttcctgggcagcagtgactgtgtgaaccagatcagcggcaagctgaagctgggcaaggaggtgctggccaccctggagggccactgggacagcgaggtgttcatcacagacaagaagacagacaacagcgaggtgttctggaaccccaccccagacatcaagcagtggaggctcatccgccacacagtgaagtttgaggagcagggcgactttgaaagtgagaagctgtggcagagggtgacccgggccatcaatgccaaggaccagacagaggccacccaggagaagtatgtgctggaggaggcccagaggcaggccgcccgggacaggaagaccaagaatgagaagaagaagtag

SEQ ID NO: 163003 - DNA, 2625 bp, Artificial Sequence
  Description of Artificial Sequence: Synthetic coding sequence
atggagggcggcctggctgatggagagccagacaggaccagcgccaacagtgatgagagccagctgctgaccccaggcaagatgagccagaggcagggcaaggaggcctaccccacccccaccaaggacctgcaccagcccagcctgagccctgccagcccccacagccagggctttgagcggggcaaggaggacatcagccagaacaaggatgagagcagcctgtccatgagcaagagcaagtctgagagcaagctgtacaacggcagcgagaaggacagcagcaccagcagcaagctgaccaagaaggagagcctgaaggtgcagaagaagaactaccgggaggagaagaagagggccaccaaggagctgctgagcaccatcacagaccccagcgtcatcgtgatggctgactggctgaagatccggggcaccctgaagtcctggaccaagctgtggtgtgtgctgaagccaggagtgctgctgatctacaagacccagaagaatggccagtgggtgggcaccgtgctgctgaatgcctgtgagatcatcgagcggcccagcaagaaggatggcttctgcttcaagctgttccaccccctggagcagagcatctgggccgtgaagggccccaagggggaggccgtgggcagcatcacccagcccctgcccagcagctacctgatcatccgggccaccagcgagagtgatggccgctgctggatggatgccctggagctggccctgaagtgcagcagcctgctgaagaggaccatgatccgggagggcaaggagcatgacctgtctgtgtccagtgacagcacccacgtgaccttctacggcctgctgcgggccaacaacctgcacagcggggacaacttccagctgaatgattctgaaattgagcggcagcacttcaaggaccaggacatgtacagcgacaagagtgacaaggaaaatgaccaggagcatgatgaaagtgacaatgaggtgatgggcaagtctgaggagagtgacacagacaccagcgagcggcaggatgacagctacatcgagcctgagcctgtggagcccctgaaggagaccacctacacagagcagagccatgaggagctgggggaggccggggaggccagccagacagaaacagtgtctgaggagaacaagagcctcatctggaccctgctgaagcaggtgcggcccggcatggacctgagcaaggtggtgctgcccaccttcatcctggagcccaggagcttcctggacaagctgagtgactactactaccacgccgacttcctgtctgaggccgccctggaggagaacccctacttccggctgaagaaggtggtgaagtggtacctgagcggcttctacaagaagcccaagggcctgaagaagccctacaaccccatcctgggggagaccttccgctgcctgtggatccaccccaggaccaacagcaagaccttctacatcgccgagcaggtgagccaccacccccccatcagcgccttctacgtgagcaacaggaaggatggcttctgcctgagcggcagcatcctggccaagagcaagttctacggcaacagcctgagcgccatcctggagggggaggcccggctgaccttcctgaacagaggagaagattatgtgatgaccatgccctatgcccactgcaagggcatcctgtatggcaccatgaccctggagctgggcggcaccgtgaacatcacctgccagaagacaggctacagcgccatcctggagttcaagctgaagcccttcctgggcagcagtgactgtgtgaaccagatcagcggcaagctgaagctgggcaaggaggtgctggccaccctggagggccactgggacagcgaggtgttcatcacagacaagaagacagacaacagcgaggtgttctggaaccccaccccagacatcaagcagtggaggctcatccgccacacagtgaagtttgaggagcagggcgactttgagagcgagaagctgtggcagagggtgacccgggccatcaatgccaaggaccagacagaggccacccaggagaagtatgtgctggaggaggcccagaggcaggccgcccgggacaggaagaccaagaatgaggagtggagctgcaagctgtttgagctggaccccctgactggagagtggcactacaagtttgctgacacccggccctgggaccccctgaatgacatgatccagtttgagaaggatggagtcatccagaccaaggtgaagcacaggacccccatggtgtctgtgcccaagatgaagcacaagcccacccggcagcagaagaaggtggccaagggctacagcagccctgagccagacatccaggacagcagcggcagcgaggcccagagcgtgaagcccagcaccaggaggaagaagggcatcgagctgggggacatccagagcagcattgagagcatcaagcagacccaggaggagatcaagaggaacatcatggccctgaggaaccacctggtgagcagcaccccagccacagactacttcctgcagcagaaggactacttcatcatcttcctgctgatcctgctgcaggtgatcatcaacttcatgttcaagtag

SEQ ID NO: 163004 - DNA, 162 bp, Artificial Sequence
  Description of Artificial Sequence: Synthetic coding sequence
atggagggcggcctggctgatggagagccagacaggaccagcctgctgggggacagcaaggatgtgctgggccccagcaccaacagtgatgagagccagctgctgaccccaggcaagatgagccagaggcagggcaaggaggcctaccccacccccacctag

SEQ ID NO: 163005 - DNA, 231 bp, Artificial Sequence
  Description of Artificial Sequence: Synthetic coding sequence
atgagccagaggcagggcaaggaggcctaccccacccccaccaaggacctgcaccagcccagcctgagccctgccagcccccacagccagggctttgagcggggcaaggaggacatcagccagaacaaggatgagagcagcctgtccatgagcaagagcaagtctgagagcaagctgtacaatggaagtgagaaggacagcagcaccagcagcaagctgaccaagaagtag

SEQ ID NO: 163006 - DNA, 177 bp, Artificial Sequence
  Description of Artificial Sequence: Synthetic coding sequence
atggagggcggcctggctgatggagagccagacaggaccagcctgctgggggacagcaaggatgtgctgggccccagcacagtggtggccaacagtgatgagagccagctgctgacccctgggaagatgagccagaggcagggcaaggaggcctaccccacccccaccaaggactag

SEQ ID NO: 163007 - DNA, 336 bp, Artificial Sequence
  Description of Artificial Sequence: Synthetic coding sequence
atgagccagaggcagggcaaggaggcctaccccacccccaccaaggacctgcaccagcccagcctgagccctgccagcccccacagccagggctttgagcggggcaaggaggacatcagccagaacaaggatgagagcagcctgtccatgagcaagagcaagtctgagagcaagctgtacaatggaagtgagaaggacagcagcaccagcagcaagctgaccaagaaggagagcctgaaggtgcagaagaagaactaccgggaggagaagaagagggccaccaaggagctgctgagcaccatcacagaccccagcgtgattgtgatggctgactag

SEQ ID NO: 163008 - DNA, 2226 bp, Artificial Sequence
  Description of Artificial Sequence: Synthetic coding sequence
atgccctaccgccgggtgaccagcggccgcctgctgagcctggccgcccccaagatggccagcatcatggagggccccctgagcaagtggaccaacgtgatgaagggctggcagtaccgctggtttgtgctggactacaatgccggcctgctgagctactacaccagcaaggacaagatgatgaggggcagcagaagaggctgtgtgcggctgcggggggccgtcatcggcattgatgatgaagatgacagcaccttcaccatcaccgtggaccagaagaccttccacttccaggccagagatgctgatgagcgggagaagtggatccacgccctggaggagaccatcctgcggcacaccctgcagctgcagggcctggacagcggctttgtgcccagcgtgcaggactttgacaagaagctgacagaagcagatgcctacctgcagatcctgattgagcagctgaagctgtttgatgacaagctgcagaactgcaaggaggatgagcagaggaagaagattgagaccctgaaggagaccaccaacagcatggtggagagcatcaagcactgcatcgtgctgctgcagatcgccaagagcaccatcaaccctgtggatgccatctaccagcccagccccctggagcccgtcatcagcaccatgcccagccagacagtgctgcccccagagcctgtgcagctgtgcaagtctgagcagaggcccagcagcctgcctgtgggccctgtgctggccaccctgggccaccaccagacccccacccccaacagcacaggcagcggccacagcccccccagcagcagcctgaccagccccagccacgtgaacctgagccccaacacagtgcctgagttctcctacagcagcagtgaagatgagttctatgatgctgatgagttccaccagagcggcagcagccccaagaggctgattgacagcagcggcagcgcctctgtgctgacccacagcagcagcggcaacagcctgaagaggccagacaccacagagagcctgaacagcagcctgagcaatggcaccagtgatgctgacctgtttgacagccatgatgacagagatgatgatgctgaggccggctctgtggaggagcacaagagcgtcatcatgcacctgctgagccaggtgcggctgggcatggacctgaccaaggtggtgctgcccaccttcatcctggagaggaggagcctgctggagatgtatgctgacttctttgcccacccagacctgtttgtgtccatcagtgaccagaaggaccccaaggacaggatggtgcaggtggtgaagtggtacctgagcgccttccacgccggcaggaaaggatctgtggccaagaagccctacaaccccatcctgggggagatcttccagtgccactggaccctgcccaatgacacagaagaaaatacagagctggtgtctgagggccctgtgccctgggtgtccaagaacagcgtgacctttgtggccgagcaggtgagccaccacccccccatcagcgccttctatgcagagtgcttcaacaagaagatccagttcaatgcccacatctggaccaagagcaagttcctgggcatgagcattggagtgcacaacatcggccagggctgtgtgtcctgcctggactatgatgagcactacatcctgaccttccccaacggctacggccgcagcatcctgactgtgccctgggtggagctgggcggggagtgcaacatcaactgcagcaagacaggctacagcgccaacatcatcttccacaccaagcccttctatggaggcaagaagcaccgcatcacagctgagatcttcagccccaatgacaagaagagcttctgcagcattgaaggagagtggaatggagtgatgtatgccaagtatgccaccggggagaacacagtgtttgtggacaccaagaagctgcccatcatcaagaagaaggtgaggaagctggaggaccagaatgaatatgagagccgcagcctgtggaaggatgtgaccttcaacctgaagatccgggacattgatgctgccacagaggccaagcaccggctggaggagcggcagagagctgaggcccgggagaggaaggagaaggagatccagtgggagaccaggctcttccatgaagatggagagtgctgggtgtatgatgagcccctgctgaagaggctgggcgccgccaagcactag

SEQ ID NO: 163009 - DNA, 1881 bp, Artificial Sequence
  Description of Artificial Sequence: Synthetic coding sequence
atggccttcctgctggccacctgtggcggcctggacagcggctttgtgcccagcgtgcaggactttgacaagaagctgacagaagcagatgcctacctgcagatcctgattgagcagctgaagctgtttgatgacaagctgcagaactgcaaggaggatgagcagaggaagaagattgagaccctgaaggagaccaccaacagcatggtggagagcatcaagcactgcatcgtgctgctgcagatcgccaagagcaccatcaaccctgtggatgccatctaccagcccagccccctggagcctgtgatcagcaccatgcccagccagacagtgctgcccccagagcctgtgcagctgtgcaagtctgagcagaggcccagcagcctgcctgtgggccctgtgctggccaccctgggccaccaccagacccccacccccaacagcactggaagtggccacagcccccccagcagcagcctgaccagccccagccacgtgaacctgagccccaacacagtgcctgagttctcctacagcagcagtgaagatgagttctatgatgctgatgagttccaccagagcggcagcagccccaagaggctgattgacagcagcggcagcgcctctgtgctgacccacagcagcagcggcaacagcctgaagaggccagacaccacagagagcctgaacagcagcctgagcaatggcaccagtgatgctgacctgtttgacagccatgatgacagagatgatgatgctgaggccggctctgtggaggagcacaagagcgtcatcatgcacctgctgagccaggtgcggctgggcatggacctgaccaaggtggtgctgcccaccttcatcctggagcggcgcagcctgctggagatgtatgctgacttctttgcccacccagacctgtttgtgtccatcagtgaccagaaggaccccaaggacaggatggtgcaggtggtgaagtggtacctgagcgccttccacgccggcaggaagggctctgtggccaagaagccctacaaccccatcctgggggagatcttccagtgccactggaccctgcccaatgacacagaggagaacacagagctggtgtctgagggccctgtgccctgggtgtccaagaacagcgtgacctttgtggccgagcaggtgagccaccacccccccatcagcgccttctatgcagagtgcttcaacaagaagatccagttcaatgcccacatctggaccaagagcaagttcctgggcatgagcattggagtgcacaacatcggccagggctgtgtgtcctgcctggactatgatgagcactacatcctgaccttccccaacggctacggccgcagcatcctgactgtgccctgggtggagctgggcggggagtgcaacatcaactgcagcaagacaggctacagcgccaacatcatcttccacaccaagcccttctacggcggcaagaagcaccgcatcacagctgagatcttcagccccaatgacaagaagagcttctgcagcattgaaggagagtggaatggagtgatgtatgccaagtatgccactggagaaaatacagtgtttgtggacaccaagaagctgcccatcatcaagaagaaggtgaggaagctggaggaccagaatgaatatgagagccgcagcctgtggaaggatgtgaccttcaacctgaagatccgggacattgatgctgccacagaggccaagcaccggctggaggagcggcagagagctgaggcccgggagaggaaggagaaggagatccagtgggagaccaggctcttccatgaagatggagagtgctgggtgtatgatgagcccctgctgaagaggctgggcgccgccaagcactag

SEQ ID NO: 163010 - DNA, 2265 bp, Artificial Sequence
  Description of Artificial Sequence: Synthetic coding sequence
atgccctaccgccgggtgaccagcggccgcctgctgagcctggccgcccccaagatggccagcatcatggagggccccctgagcaagtggaccaacgtgatgaagggctggcagtaccgctggtttgtgctggactacaatgccggcctgctgagctactacaccagcaaggacaagatgatgaggggcagcagaagaggctgtgtgcggctgcggggggccgtcatcggcattgatgatgaagatgacagcaccttcaccatcaccgtggaccagaagaccttccacttccaggccagagatgctgatgagcgggagaagtggatccacgccctggaggagaccatcctgcggcacaccctgcagctgcagggcctggacagcggctttgtgcccagcgtgcaggactttgacaagaagctgacagaagcagatgcctacctgcagatcctgattgagcagctgaagctgtttgatgacaagctgcagaactgcaaggaggatgagcagaggaagaagattgagaccctgaaggagaccaccaacagcatggtggagagcatcaagcactgcatcgtgctgctgcagatcgccaaggaccagagcaatgctgagaagcatgctgatggcatgatcagcaccatcaaccctgtggatgccatctaccagcccagccccctggagcctgtgatcagcaccatgcccagccagacagtgctgcccccagagcctgtgcagctgtgcaagtctgagcagaggcccagcagcctgcctgtgggccctgtgctggccaccctgggccaccaccagacccccacccccaacagcactggaagtggccacagcccccccagcagcagcctgaccagccccagccacgtgaacctgagccccaacacagtgcctgagttctcctacagcagcagtgaagatgagttctatgatgctgatgagttccaccagagcggcagcagccccaagaggctgattgacagcagcggcagcgcctctgtgctgacccacagcagcagcggcaacagcctgaagaggccagacaccacagagagcctgaacagcagcctgagcaatggcaccagtgatgctgacctgtttgacagccatgatgacagagatgatgatgctgaggccggctctgtggaggagcacaagagcgtcatcatgcacctgctgagccaggtgcggctgggcatggacctgaccaaggtggtgctgcccaccttcatcctggagcggcgcagcctgctggagatgtatgctgacttctttgcccacccagacctgtttgtgtccatcagtgaccagaaggaccccaaggacaggatggtgcaggtggtgaagtggtacctgagcgccttccacgccggcaggaagggctctgtggccaagaagccctacaaccccatcctgggggagatcttccagtgccactggaccctgcccaatgacacagaggagaacacagagctggtgtctgagggccctgtgccctgggtgtccaagaacagcgtgacctttgtggccgagcaggtgagccaccacccccccatcagcgccttctatgcagagtgcttcaacaagaagatccagttcaatgcccacatctggaccaagagcaagttcctgggcatgagcattggagtgcacaacatcggccagggctgtgtgtcctgcctggactatgatgagcactacatcctgaccttccccaacggctacggccgcagcatcctgactgtgccctgggtggagctgggcggggagtgcaacatcaactgcagcaagacaggctacagcgccaacatcatcttccacaccaagcccttctacggcggcaagaagcaccgcatcacagctgagatcttcagccccaatgacaagaagagcttctgcagcattgaaggagagtggaatggagtgatgtatgccaagtatgccactggagaaaatacagtgtttgtggacaccaagaagctgcccatcatcaagaagaaggtgaggaagctggaggaccagaatgaatatgagagccgcagcctgtggaaggatgtgaccttcaacctgaagatccgggacattgatgctgccacagaggccaagcaccggctggaggagcggcagagagctgaggcccgggagaggaaggagaaggagatccagtgggagaccaggctcttccatgaagatggagagtgctgggtgtatgatgagcccctgctgaagaggctgggcgccgccaagcactag

SEQ ID NO: 163011 - DNA, 2172 bp, Artificial Sequence
  Description of Artificial Sequence: Synthetic coding sequence
atggccagcatcatggagggccccctgagcaagtggaccaacgtgatgaagggctggcagtaccgctggtttgtgctggactacaatgccggcctgctgagctactacaccagcaaggacaagatgatgaggggcagcagaagaggctgtgtgcggctgcggggggccgtcatcggcattgatgatgaagatgacagcaccttcaccatcaccgtggaccagaagaccttccacttccaggccagagatgctgatgagcgggagaagtggatccacgccctggaggagaccatcctgcggcacaccctgcagctgcagggcctggacagcggctttgtgcccagcgtgcaggactttgacaagaagctgacagaagcagatgcctacctgcagatcctgattgagcagctgaagctgtttgatgacaagctgcagaactgcaaggaggatgagcagaggaagaagattgagaccctgaaggagaccaccaacagcatggtggagagcatcaagcactgcatcgtgctgctgcagatcgccaagagcaccatcaaccctgtggatgccatctaccagcccagccccctggagcccgtcatcagcaccatgcccagccagacagtgctgcccccagagcctgtgcagctgtgcaagtctgagcagaggcccagcagcctgcctgtgggccctgtgctggccaccctgggccaccaccagacccccacccccaacagcacaggcagcggccacagcccccccagcagcagcctgaccagccccagccacgtgaacctgagccccaacacagtgcctgagttctcctacagcagcagtgaagatgagttctatgatgctgatgagttccaccagagcggcagcagccccaagaggctgattgacagcagcggcagcgcctctgtgctgacccacagcagcagcggcaacagcctgaagaggccagacaccacagagagcctgaacagcagcctgagcaatggcaccagtgatgctgacctgtttgacagccatgatgacagagatgatgatgctgaggccggctctgtggaggagcacaagagcgtcatcatgcacctgctgagccaggtgcggctgggcatggacctgaccaaggtggtgctgcccaccttcatcctggagaggaggagcctgctggagatgtatgctgacttctttgcccacccagacctgtttgtgtccatcagtgaccagaaggaccccaaggacaggatggtgcaggtggtgaagtggtacctgagcgccttccacgccggcaggaaaggatctgtggccaagaagccctacaaccccatcctgggggagatcttccagtgccactggaccctgcccaatgacacagaagaaaatacagagctggtgtctgagggccctgtgccctgggtgtccaagaacagcgtgacctttgtggccgagcaggtgagccaccacccccccatcagcgccttctatgcagagtgcttcaacaagaagatccagttcaatgcccacatctggaccaagagcaagttcctgggcatgagcattggagtgcacaacatcggccagggctgtgtgtcctgcctggactatgatgagcactacatcctgaccttccccaacggctacggccgcagcatcctgactgtgccctgggtggagctgggcggggagtgcaacatcaactgcagcaagacaggctacagcgccaacatcatcttccacaccaagcccttctatggaggcaagaagcaccgcatcacagctgagatcttcagccccaatgacaagaagagcttctgcagcattgaaggagagtggaatggagtgatgtatgccaagtatgccaccggggagaacacagtgtttgtggacaccaagaagctgcccatcatcaagaagaaggtgaggaagctggaggaccagaatgaatatgagagccgcagcctgtggaaggatgtgaccttcaacctgaagatccgggacattgatgctgccacagaggccaagcaccggctggaggagcggcagagagctgaggcccgggagaggaaggagaaggagatccagtgggagaccaggctcttccatgaagatggagagtgctgggtgtatgatgagcccctgctgaagaggctgggcgccgccaagcactag

SEQ ID NO: 163012 - DNA, 2211 bp, Artificial Sequence
  Description of Artificial Sequence: Synthetic coding sequence
atggccagcatcatggagggccccctgagcaagtggaccaacgtgatgaagggctggcagtaccgctggtttgtgctggactacaatgccggcctgctgagctactacaccagcaaggacaagatgatgaggggcagcagaagaggctgtgtgcggctgcggggggccgtcatcggcattgatgatgaagatgacagcaccttcaccatcaccgtggaccagaagaccttccacttccaggccagagatgctgatgagcgggagaagtggatccacgccctggaggagaccatcctgcggcacaccctgcagctgcagggcctggacagcggctttgtgcccagcgtgcaggactttgacaagaagctgacagaagcagatgcctacctgcagatcctgattgagcagctgaagctgtttgatgacaagctgcagaactgcaaggaggatgagcagaggaagaagattgagaccctgaaggagaccaccaacagcatggtggagagcatcaagcactgcatcgtgctgctgcagatcgccaaggaccagagcaatgctgagaagcatgctgatggcatgatcagcaccatcaaccctgtggatgccatctaccagcccagccccctggagcctgtgatcagcaccatgcccagccagacagtgctgcccccagagcctgtgcagctgtgcaagtctgagcagaggcccagcagcctgcctgtgggccctgtgctggccaccctgggccaccaccagacccccacccccaacagcactggaagtggccacagcccccccagcagcagcctgaccagccccagccacgtgaacctgagccccaacacagtgcctgagttctcctacagcagcagtgaagatgagttctatgatgctgatgagttccaccagagcggcagcagccccaagaggctgattgacagcagcggcagcgcctctgtgctgacccacagcagcagcggcaacagcctgaagaggccagacaccacagagagcctgaacagcagcctgagcaatggcaccagtgatgctgacctgtttgacagccatgatgacagagatgatgatgctgaggccggctctgtggaggagcacaagagcgtcatcatgcacctgctgagccaggtgcggctgggcatggacctgaccaaggtggtgctgcccaccttcatcctggagcggcgcagcctgctggagatgtatgctgacttctttgcccacccagacctgtttgtgtccatcagtgaccagaaggaccccaaggacaggatggtgcaggtggtgaagtggtacctgagcgccttccacgccggcaggaagggctctgtggccaagaagccctacaaccccatcctgggggagatcttccagtgccactggaccctgcccaatgacacagaggagaacacagagctggtgtctgagggccctgtgccctgggtgtccaagaacagcgtgacctttgtggccgagcaggtgagccaccacccccccatcagcgccttctatgcagagtgcttcaacaagaagatccagttcaatgcccacatctggaccaagagcaagttcctgggcatgagcattggagtgcacaacatcggccagggctgtgtgtcctgcctggactatgatgagcactacatcctgaccttccccaacggctacggccgcagcatcctgactgtgccctgggtggagctgggcggggagtgcaacatcaactgcagcaagacaggctacagcgccaacatcatcttccacaccaagcccttctacggcggcaagaagcaccgcatcacagctgagatcttcagccccaatgacaagaagagcttctgcagcattgaaggagagtggaatggagtgatgtatgccaagtatgccactggagaaaatacagtgtttgtggacaccaagaagctgcccatcatcaagaagaaggtgaggaagctggaggaccagaatgaatatgagagccgcagcctgtggaaggatgtgaccttcaacctgaagatccgggacattgatgctgccacagaggccaagcaccggctggaggagcggcagagagctgaggcccgggagaggaaggagaaggagatccagtgggagaccaggctcttccatgaagatggagagtgctgggtgtatgatgagcccctgctgaagaggctgggcgccgccaagcactag

SEQ ID NO: 163013 - DNA, 1716 bp, Artificial Sequence
  Description of Artificial Sequence: Synthetic coding sequence
atggtggagagcatcaagcactgcatcgtgctgctgcagatcgccaaggaccagagcaatgctgagaagcatgctgatggcatgatcagcaccatcaaccctgtggatgccatctaccagcccagccccctggagcccgtcatcagcaccatgcccagccagacagtgctgcccccagagcctgtgcagctgtgcaagtctgagcagaggcccagcagcctgcctgtgggccctgtgctggccaccctgggccaccaccagacccccacccccaacagcacaggcagcggccacagcccccccagcagcagcctgaccagccccagccacgtgaacctgagccccaacacagtgcctgagttctcctacagcagcagtgaagatgagttctatgatgctgatgagttccaccagagcggcagcagccccaagaggctgattgacagcagcggcagcgcctctgtgctgacccacagcagcagcggcaacagcctgaagaggccagacaccacagagagcctgaacagcagcctgagcaatggcaccagtgatgctgacctgtttgacagccatgatgacagagatgatgatgctgaggccggctctgtggaggagcacaagagcgtcatcatgcacctgctgagccaggtgcggctgggcatggacctgaccaaggtggtgctgcccaccttcatcctggagaggaggagcctgctggagatgtatgctgacttctttgcccacccagacctgtttgtgtccatcagtgaccagaaggaccccaaggacaggatggtgcaggtggtgaagtggtacctgagcgccttccacgccggcaggaaaggatctgtggccaagaagccctacaaccccatcctgggggagatcttccagtgccactggaccctgcccaatgacacagaagaaaatacagagctggtgtctgagggccctgtgccctgggtgtccaagaacagcgtgacctttgtggccgagcaggtgagccaccacccccccatcagcgccttctatgcagagtgcttcaacaagaagatccagttcaatgcccacatctggaccaagagcaagttcctgggcatgagcattggagtgcacaacatcggccagggctgtgtgtcctgcctggactatgatgagcactacatcctgaccttccccaacggctacggccgcagcatcctgactgtgccctgggtggagctgggcggggagtgcaacatcaactgcagcaagacaggctacagcgccaacatcatcttccacaccaagcccttctatggaggcaagaagcaccgcatcacagctgagatcttcagccccaatgacaagaagagcttctgcagcattgaaggagagtggaatggagtgatgtatgccaagtatgccaccggggagaacacagtgtttgtggacaccaagaagctgcccatcatcaagaagaaggtgaggaagctggaggaccagaatgaatatgagagccgcagcctgtggaaggatgtgaccttcaacctgaagatccgggacattgatgctgccacagaggccaagcaccggctggaggagcggcagagagctgaggcccgggagaggaaggagaaggagatccagtgggagaccaggctcttccatgaagatggagagtgctgggtgtatgatgagcccctgctgaagaggctgggcgccgccaagcactag

SEQ ID NO: 163014 - DNA, 2241 bp, Artificial Sequence
  Description of Artificial Sequence: Synthetic coding sequence
atggccagcatcatggagggccccctgagcaagtggaccaacgtgatgaagggctggcagtaccgctggtttgtgctggactacaatgccggcctgctgagctactacaccagcaaggacaagatgatgaggggcagcagaagaggctgtgtgcggctgcggggggccgtcatcggcattgatgatgaagatgacagcaccttcaccatcaccgtggaccagaagaccttccacttccaggccagagatgctgatgagcgggagaagtggatccacgccctggaggagaccatcctgcggcacaccctgcagctgcagatcagcaccaccctggccttcttccagagcagcggcatcagccctgtgctggagttcagcaagatcatcggcctggacagcggctttgtgcccagcgtgcaggactttgacaagaagctgacagaagcagatgcctacctgcagatcctgattgagcagctgaagctgtttgatgacaagctgcagaactgcaaggaggatgagcagaggaagaagattgagaccctgaaggagaccaccaacagcatggtggagagcatcaagcactgcatcgtgctgctgcagatcgccaagagcaccatcaaccctgtggatgccatctaccagcccagccccctggagcctgtgatcagcaccatgcccagccagacagtgctgcccccagagcctgtgcagctgtgcaagtctgagcagaggcccagcagcctgcctgtgggccctgtgctggccaccctgggccaccaccagacccccacccccaacagcactggaagtggccacagcccccccagcagcagcctgaccagccccagccacgtgaacctgagccccaacacagtgcctgagttctcctacagcagcagtgaagatgagttctatgatgctgatgagttccaccagagcggcagcagccccaagaggctgattgacagcagcggcagcgcctctgtgctgacccacagcagcagcggcaacagcctgaagaggccagacaccacagagagcctgaacagcagcctgagcaatggcaccagtgatgctgacctgtttgacagccatgatgacagagatgatgatgctgaggccggctctgtggaggagcacaagagcgtcatcatgcacctgctgagccaggtgcggctgggcatggacctgaccaaggtggtgctgcccaccttcatcctggagcggcgcagcctgctggagatgtatgctgacttctttgcccacccagacctgtttgtgtccatcagtgaccagaaggaccccaaggacaggatggtgcaggtggtgaagtggtacctgagcgccttccacgccggcaggaagggctctgtggccaagaagccctacaaccccatcctgggggagatcttccagtgccactggaccctgcccaatgacacagaggagaacacagagctggtgtctgagggccctgtgccctgggtgtccaagaacagcgtgacctttgtggccgagcaggtgagccaccacccccccatcagcgccttctatgcagagtgcttcaacaagaagatccagttcaatgcccacatctggaccaagagcaagttcctgggcatgagcattggagtgcacaacatcggccagggctgtgtgtcctgcctggactatgatgagcactacatcctgaccttccccaacggctacggccgcagcatcctgactgtgccctgggtggagctgggcggggagtgcaacatcaactgcagcaagacaggctacagcgccaacatcatcttccacaccaagcccttctacggcggcaagaagcaccgcatcacagctgagatcttcagccccaatgacaagaagagcttctgcagcattgaaggagagtggaatggagtgatgtatgccaagtatgccactggagaaaatacagtgtttgtggacaccaagaagctgcccatcatcaagaagaaggtgaggaagctggaggaccagaatgaatatgagagccgcagcctgtggaaggatgtgaccttcaacctgaagatccgggacattgatgctgccacagaggccaagcaccggctggaggagcggcagagagctgaggcccgggagaggaaggagaaggagatccagtgggagaccaggctcttccatgaagatggagagtgctgggtgtatgatgagcccctgctgaagaggctgggcgccgccaagcactag

SEQ ID NO: 163015 - DNA, 2160 bp, Artificial Sequence
  Description of Artificial Sequence: Synthetic coding sequence
atggccagcatcatggagggccccctgagcaagtggaccaacgtgatgaagggctggcagtaccgctggtttgtgctggactacaatgccggcctgctgagctactacacaggagctgtgattggaattgatgatgaagatgacagcaccttcaccatcaccgtggaccagaagaccttccacttccaggccagagatgctgatgagcgggagaagtggattcatgccctggaggagaccatcctgcggcacaccctgcagctgcagggcctggacagcggctttgtgcccagcgtgcaggactttgacaagaagctgacagaagcagatgcctacctgcagatcctgattgagcagctgaagctgtttgatgacaagctgcagaactgcaaggaggatgagcagaggaagaagattgagaccctgaaggagaccaccaacagcatggtggagagcatcaagcactgcatcgtgctgctgcagatcgccaaggaccagagcaatgctgagaagcatgctgatggcatgatcagcaccatcaaccctgtggatgccatctaccagcccagccccctggagcccgtcatcagcaccatgcccagccagacagtgctgcccccagagcctgtgcagctgtgcaagtctgagcagaggcccagcagcctgcctgtgggccctgtgctggccaccctgggccaccaccagacccccacccccaacagcacaggcagcggccacagcccccccagcagcagcctgaccagccccagccacgtgaacctgagccccaacacagtgcctgagttctcctacagcagcagtgaagatgagttctatgatgctgatgagttccaccagagcggcagcagccccaagaggctgattgacagcagcggcagcgcctctgtgctgacccacagcagcagcggcaacagcctgaagaggccagacaccacagagagcctgaacagcagcctgagcaatggcaccagtgatgctgacctgtttgacagccatgatgacagagatgatgatgctgaggccggctctgtggaggagcacaagagcgtcatcatgcacctgctgagccaggtgcggctgggcatggacctgaccaaggtggtgctgcccaccttcatcctggagaggaggagcctgctggagatgtatgctgacttctttgcccacccagacctgtttgtgtccatcagtgaccagaaggaccccaaggacaggatggtgcaggtggtgaagtggtacctgagcgccttccacgccggcaggaaaggatctgtggccaagaagccctacaaccccatcctgggggagatcttccagtgccactggaccctgcccaatgacacagaagaaaatacagagctggtgtctgagggccctgtgccctgggtgtccaagaacagcgtgacctttgtggccgagcaggtgagccaccacccccccatcagcgccttctatgcagagtgcttcaacaagaagatccagttcaatgcccacatctggaccaagagcaagttcctgggcatgagcattggagtgcacaacatcggccagggctgtgtgtcctgcctggactatgatgagcactacatcctgaccttccccaacggctacggccgcagcatcctgactgtgccctgggtggagctgggcggggagtgcaacatcaactgcagcaagacaggctacagcgccaacatcatcttccacaccaagcccttctatggaggcaagaagcaccgcatcacagctgagatcttcagccccaatgacaagaagagcttctgcagcattgaaggagagtggaatggagtgatgtatgccaagtatgccaccggggagaacacagtgtttgtggacaccaagaagctgcccatcatcaagaagaaggtgaggaagctggaggaccagaatgaatatgagagccgcagcctgtggaaggatgtgaccttcaacctgaagatccgggacattgatgctgccacagaggccaagcaccggctggaggagcggcagagagctgaggcccgggagaggaaggagaaggagatccagtgggagaccaggctcttccatgaagatggagagtgctgggtgtatgatgagcccctgctgaagaggctgggcgccgccaagcactag

SEQ ID NO: 163016 - DNA, 1677 bp, Artificial Sequence
  Description of Artificial Sequence: Synthetic coding sequence
atggtggagagcatcaagcactgcatcgtgctgctgcagatcgccaagagcaccatcaaccctgtggatgccatctaccagcccagccccctggagcctgtgatcagcaccatgcccagccagacagtgctgcccccagagcctgtgcagctgtgcaagtctgagcagaggcccagcagcctgcctgtgggccctgtgctggccaccctgggccaccaccagacccccacccccaacagcactggaagtggccacagcccccccagcagcagcctgaccagccccagccacgtgaacctgagccccaacacagtgcctgagttctcctacagcagcagtgaagatgagttctatgatgctgatgagttccaccagagcggcagcagccccaagaggctgattgacagcagcggcagcgcctctgtgctgacccacagcagcagcggcaacagcctgaagaggccagacaccacagagagcctgaacagcagcctgagcaatggcaccagtgatgctgacctgtttgacagccatgatgacagagatgatgatgctgaggccggctctgtggaggagcacaagagcgtcatcatgcacctgctgagccaggtgcggctgggcatggacctgaccaaggtggtgctgcccaccttcatcctggagcggcgcagcctgctggagatgtatgctgacttctttgcccacccagacctgtttgtgtccatcagtgaccagaaggaccccaaggacaggatggtgcaggtggtgaagtggtacctgagcgccttccacgccggcaggaagggctctgtggccaagaagccctacaaccccatcctgggggagatcttccagtgccactggaccctgcccaatgacacagaggagaacacagagctggtgtctgagggccctgtgccctgggtgtccaagaacagcgtgacctttgtggccgagcaggtgagccaccacccccccatcagcgccttctatgcagagtgcttcaacaagaagatccagttcaatgcccacatctggaccaagagcaagttcctgggcatgagcattggagtgcacaacatcggccagggctgtgtgtcctgcctggactatgatgagcactacatcctgaccttccccaacggctacggccgcagcatcctgactgtgccctgggtggagctgggcggggagtgcaacatcaactgcagcaagacaggctacagcgccaacatcatcttccacaccaagcccttctacggcggcaagaagcaccgcatcacagctgagatcttcagccccaatgacaagaagagcttctgcagcattgaaggagagtggaatggagtgatgtatgccaagtatgccactggagaaaatacagtgtttgtggacaccaagaagctgcccatcatcaagaagaaggtgaggaagctggaggaccagaatgaatatgagagccgcagcctgtggaaggatgtgaccttcaacctgaagatccgggacattgatgctgccacagaggccaagcaccggctggaggagcggcagagagctgaggcccgggagaggaaggagaaggagatccagtgggagaccaggctcttccatgaagatggagagtgctgggtgtatgatgagcccctgctgaagaggctgggcgccgccaagcactag

SEQ ID NO: 163017 - DNA, 99 bp, Artificial Sequence
  Description of Artificial Sequence: Synthetic coding sequence
atggtggagagcatcaagcactgcatcgtgctgctgcagatcgccaaggaccagagcaatgctgagaagcatgctgatggcatgattgtgtccctgtag

SEQ ID NO: 163018 - DNA, 1677 bp, Artificial Sequence; identical to SEQ ID NO: 163016
  Description of Artificial Sequence: Synthetic coding sequence

SEQ ID NO: 163019 - DNA, 1968 bp, Artificial Sequence
  Description of Artificial Sequence: Synthetic coding sequence
atgggctgctgctgctgctggctggtgttcacagaggccagagatgctgatgagcgggagaagtggatccacgccctggaggagaccatcctgcggcacaccctgcagctgcagggcctggacagcggctttgtgcccagcgtgcaggactttgacaagaagctgacagaagcagatgcctacctgcagatcctgattgagcagctgaagctgtttgatgacaagctgcagaactgcaaggaggatgagcagaggaagaagattgagaccctgaaggagaccaccaacagcatggtggagagcatcaagcactgcatcgtgctgctgcagatcgccaagagcaccatcaaccctgtggatgccatctaccagcccagccccctggagcccgtcatcagcaccatgcccagccagacagtgctgcccccagagcctgtgcagctgtgcaagtctgagcagaggcccagcagcctgcctgtgggccctgtgctggccaccctgggccaccaccagacccccacccccaacagcacaggcagcggccacagcccccccagcagcagcctgaccagccccagccacgtgaacctgagccccaacacagtgcctgagttctcctacagcagcagtgaagatgagttctatgatgctgatgagttccaccagagcggcagcagccccaagaggctgattgacagcagcggcagcgcctctgtgctgacccacagcagcagcggcaacagcctgaagaggccagacaccacagagagcctgaacagcagcctgagcaatggcaccagtgatgctgacctgtttgacagccatgatgacagagatgatgatgctgaggccggctctgtggaggagcacaagagcgtcatcatgcacctgctgagccaggtgcggctgggcatggacctgaccaaggtggtgctgcccaccttcatcctggagaggaggagcctgctggagatgtatgctgacttctttgcccacccagacctgtttgtgtccatcagtgaccagaaggaccccaaggacaggatggtgcaggtggtgaagtggtacctgagcgccttccacgccggcaggaaaggatctgtggccaagaagccctacaaccccatcctgggggagatcttccagtgccactggaccctgcccaatgacacagaagaaaatacagagctggtgtctgagggccctgtgccctgggtgtccaagaacagcgtgacctttgtggccgagcaggtgagccaccacccccccatcagcgccttctatgcagagtgcttcaacaagaagatccagttcaatgcccacatctggaccaagagcaagttcctgggcatgagcattggagtgcacaacatcggccagggctgtgtgtcctgcctggactatgatgagcactacatcctgaccttccccaacggctacggccgcagcatcctgactgtgccctgggtggagctgggcggggagtgcaacatcaactgcagcaagacaggctacagcgccaacatcatcttccacaccaagcccttctatggaggcaagaagcaccgcatcacagctgagatcttcagccccaatgacaagaagagcttctgcagcattgaaggagagtggaatggagtgatgtatgccaagtatgccaccggggagaacacagtgtttgtggacaccaagaagctgcccatcatcaagaagaaggtgaggaagctggaggaccagaatgaatatgagagccgcagcctgtggaaggatgtgaccttcaacctgaagatccgggacattgatgctgccacagaggccaagcaccggctggaggagcggcagagagctgaggcccgggagaggaaggagaaggagatccagtgggagaccaggctcttccatgaagatggagagtgctgggtgtatgatgagcccctgctgaagaggctgggcgccgccaagcactag

SEQ ID NO: 163020 - DNA, 330 bp, Artificial Sequence
  Description of Artificial Sequence: Synthetic coding sequence
atggtggagagcatcaagcactgcatcgtgctgctgcagatcgccaagagcaccatcaaccctgtggatgccatctaccagcccagccccctggagcctgtgatcagcaccatgcccagccagacagtgctgcccccagagcctgtgcagctgtgcaagtctgagcagaggcccagcagcctgcctgtgggccctgtgctggccaccctgggccaccaccagacccccacccccaacagcactggaagtggccacagcccccccagcagcagcctgaccagccccagccacgtgaacctgagccccaacacagtgcctgagttctcctag

SEQ ID NO: 163021 - DNA, 1170 bp, Artificial Sequence
  Description of Artificial Sequence: Synthetic coding sequence
atggagggcgccctggccgccaactggagcgctgaggccgccaatgccagcgctgcccctcctggagctgagggcaacagaacagctggccccccaagaagaaatgaggccctggcccgggtggaggtggccgtgctgtgcctgatcctgctgctggccctgtctggaaatgcctgtgtgctgctggccctgcggaccacccggcagaagcacagccgcctcttcttcttcatgaagcacctgagcattgctgacctggtggtggccgtgttccaggtgctgccccagctgctgtgggacatcaccttccgcttctacggccctgacctgctgtgccgcctggtgaagtacctgcaggtggtgggcatgtttgccagcacctacctgctgctgctgatgagcctggaccgctgcctggccatctgccagcccctgcggagcctgcggcggaggacagaccggctggccgtgctggccacctggctgggctgcctggtggccagcgccccccaggtgcacatcttcagcctgcgggaggtggctgatggagtgtttgactgctgggccgtgttcatccagccctggggccccaaggcctacatcacctggatcaccctggccgtgtacatcgtgcctgtgattgtgctggccgcctgctacggcctcatctccttcaagatctggcagaacctgcggctgaagacagctgctgctgctgctgctgaggcccctgagggcgctgctgctggagatggcggccgggtggccctggcccgggtgtcctctgtgaagctgatcagcaaggccaagatcagaacagtgaagatgaccttcatcatcgtgctggccttcatcgtgtgctggacccccttcttctttgtgcagatgtggagcgtgtgggatgccaatgcccccaaggaggccagcgccttcatcatcgtgatgctgctggccagcctgaacagctgctgcaacccctggatctacatgctgttcaccggccacctgttccacgagctggtgcagcgcttcctgtgctgcagcgccagctacctgaagggccgccgcctgggggagaccagcgccagcaagaagagcaacagcagcagctttgtgctgagccacaggagcagcagccagaggagctgcagccagcccagcacagcctag

SEQ ID NO: 163022 - DNA, 132 bp, Artificial Sequence
  Description of Artificial Sequence: Synthetic coding sequence
atggagggcgccctggccgccaactggagcgctgaggccgccaatgccagcgctgcccctcctggagctgagggcaacagaacagctggccccccaagaagaaatgaggccctggcccgggtggaggtgtag

SEQ ID NO: 163023 - DNA, 279 bp, Artificial Sequence
  Description of Artificial Sequence: Synthetic coding sequence
atggagggcgccctggccgccaactggagcgctgaggccgccaatgccagcgctgcccctcctggagctgagggcaacagaacagctggccccccaagaagaaatgaggccctggcccgggtggaggtggccgtgctgtgcctgatcctgctgctggccctgtctggaaatgcctgtgtgctgctggccctgcggaccacccggcagaagcacagccgcctcttcttcttcatgaagcacctgagcattgctgacctggtggtggccgtgttccagtag

SEQ ID NO: 163024 - DNA, 1518 bp, Artificial Sequence
  Description of Artificial Sequence: Synthetic coding sequence
atggccagcggcagaagagcccccaggacaggcctgctggagctgcgggccggggccggcagcggggccggcggggagcgctggcagagggtgctgctgagcctggctgaagatgtgctgactgtgtccccagcagatggagaccccggccctgagcccggggccccccgggagcaggagcccgcccagctgaatggagctgctgagcccggggccggccccccccagctgcctgaggccctgctgctgcagaggcggcgggtgacagtgaggaaggcagatgctgggggcctgggcatcagcatcaagggcggccgggagaacaagatgcccatcctgatcagcaagatcttcaagggcctggccgctgaccagacagaggccctgtttgtgggagatgccatcctgtctgtgaatggagaggacctgagcagcgccacccatgatgaagctgtgcaggtgctgaagaagacaggcaaggaggtggtgctggaggtgaagtacatgaaggatgtgagcccctacttcaagaacagcactggaggcacctctgtgggctgggacagccccccagccagccccctgcagaggcagcccagcagccctggccccaccccaagaaacttcagcgaggccaagcacatgagcctgaagatggcctacgtgtccaagcgctgcaccccaaatgaccctgagccccgctacctggagatctgcagcgcagatggccaggacaccctcttcctgcgggccaaggatgaggccagcgcccgctcctgggccacagccatccaggcccaggtgaacaccctgaccccccgggtgaaggatgagctgcaggccctgctggccgccaccagcacagctggcagccaggacatcaagcagatcggctggctgacagagcagctgcccagcggcggcacagcccccaccctggccctgctgacagagaaggagctgctgctgtacctgagcctgcctgagacccgggaggccctgagcaggcctgccaggacagcccccctcatcgccacccggctggtgcacagcggccccagcaaaggatctgtgccctatgatgctgagctgagctttgccctgaggacaggcaccaggcatggagtggacacccacctgttctctgtggagagcccccaggagctggccgcctggacccggcagctggtggatggctgccacagagctgctgagggcgtgcaggaggtgtccacagcctgcacctggaatggccggccctgcagcctgtctgtgcacatcgacaagggcttcaccctgtgggccgctgagcccggggccgcccgggctgtgctgctgcggcagccctttgagaagctgcagatgagcagtgatgatggagccagcctgctcttcctggactttggaggagctgagggggagatccagctggacctgcacagctgccccaagaccatcgtgttcatcatccacagcttcctgagcgccaaggtgacccggctgggcctgctggcctag

SEQ ID NO: 163025 - DNA, 441 bp, Artificial Sequence
  Description of Artificial Sequence: Synthetic coding sequence
atgggcttcctgcggcggctcatctacagaagaagacccatgatctacgtggagagcagcgaggagagcagtgatgagcagccagatgaggtggagagccccacccagagccaggacagcaccccagctgaggagagagaagatgagggcgccagcgctgcccagggccaggagcctgaggccgacagccaggagctggtgcagcccaagacaggctgtgagctgggagatggccctgacaccaagagggtgtgcctgagaaatgaggagcagatgaagctgcctgctgagggccctgagcctgaggccgacagccaggagcaggtgcaccccaagacaggctgtgaaagaggagatggcccagatgtgcaggagctgggcctgcccaaccctgaggaggtgaagaccccagaagaagatgagggccagagccagccctag

SEQ ID NO: 163026 - DNA, 336 bp, Artificial Sequence
  Description of Artificial Sequence: Synthetic coding sequence
atgtctgagctgctgcgggcccggagccagagcagcgagagaggaaatgaccaggagagcagccagcctgtgggcagcgtcatcgtgcaggagcccacagaggagaagaggcaggaggaggagcccccaacagacaaccagggcatcgcccccagcggggagattgagaaccaggccgtgcctgccttccagggccctgacatggaggccttccagcaggagctggccctgctgaagattgaagatgagcctggagatggcccagatgtgcgggagggcatcatgcccacctttgacctgaccaaggtgctggaggccggagatgcccagccctag

SEQ ID NO: 163027 - DNA, 195 bp, Artificial Sequence
  Description of Artificial Sequence: Synthetic coding sequence
atgtctgagctgctgcgggcccggagccagagcagcgagagaggaaatgaccaggagagcagccagcctgtgggcagcgtcatcgtgcaggagcccacagaggagaagaggcaggaggaggagcccccaacagacaaccagggcatcgcccccagcggggagattgagaaccaggccgtgcctgccttccagtag

SEQ ID NO: 163028 - DNA, 342 bp, Artificial Sequence
  Description of Artificial Sequence: Synthetic coding sequence
atgagcggccaccagaggaccaggagccgcagccgggagaggagagatgaccaggacagcaaccaccctgtgggcgctgtggtggcccaggagctgcccagcaatgaccagctgcagcaggaggagccccccatcgagagccaggactacaccccaggccaggagagagatgaaggagccctggacttccaggtgctgggcctggccgcctacctgtgggagctgaccaggagcaagacaggaggagagagaggagatggccccaacgtgaagggggagttcctgcccaacctggagcctgtgaagatccctgaggccggggagggccagcccagcgtgtag

SEQ ID NO: 163029 - DNA, 342 bp, Artificial Sequence; identical to SEQ ID NO: 163028
  Description of Artificial Sequence: Synthetic coding sequence

SEQ ID NO: 163030 - DNA, 1458 bp, Artificial Sequence
  Description of Artificial Sequence: Synthetic coding sequence
atggctgctgtgtggcagcaggtgctggccgtggatgcccgctacaatgcctaccgcacccccaccttcccccagttccgcacccagtacatcagaagaagaagccagctgctgcgggagaatgccaaggccggccaccccccagccctgcggcggcagtacctgcggctgcggggccagctgctgggccagagatatggccccctgtctgagcccggcagcgcccgggcctacagcaacagcatcgtgcgcagcagcaggaccaccctggacaggatggaggactttgaagatgacccccgggccctgggcgcccggggccacagaagatctgtgtcccggggcagctaccagctgcaggcccagatgaacagagctgtgtatgaagatcggcccccaggctctgtggtgcccaccagcgctgctgaggccagccgggccatggccggggacaccagcctgtctgagaactatgcctttgctggcatgtaccacgtgtttgaccagcacgtggatgaggccgtgccccgggtgcgctttgccaatgatgacagacaccggctggcctgctgcagcctggatggcagcatcagcctgtgccagctggtgcctgccccacccaccgtgctgcgggtgctgcggggccacacccggggcgtgtctgactttgcctggagcctgagcaatgacatcctggtgtccaccagcctggatgccaccatgaggatctgggcctctgaagatggccgctgcatccgggagatcccagaccctgacagcgctgagctgctgtgctgcaccttccagcctgtgaacaacaacctgactgtggtgggcaatgccaagcacaacgtgcacgtgatgaacatcagcacaggcaagaaggtgaagggcggcagcagcaagctgaccggccgggtgctggccctgagctttgatgcccctggccgcctgctgtgggccggagatgaccacggctctgtgttctccttcctgtttgacatggccaccgggaagctgaccaaggccaagaggctggtggtgcatgagggcagccctgtgaccagcatcagcgcccgctcctgggtgtcccgggaggcccgggaccccagcctgctgatcaatgcctgcctgaacaagctgctgctgtacagagtggtggacaatgaaggcaccctgcagctgaagaggagcttccccatcgagcagagcagccaccctgtgcgcagcatcttctgccccctgatgtccttccggcagggcgcctgtgtggtgacaggcagcgaggacatgtgtgtgcacttctttgatgtggagagagctgccaaggctgctgtgaacaagctgcagggccacagcgcccctgtgctggatgtgtccttcaactgtgatgagagcctgctggccagcagtgatgccagcggcatggtgattgtgtggaggcgggagcagaagtag

SEQ ID NO: 163031 - DNA, 309 bp, Artificial Sequence; identical to SEQ ID NO: 154190
  Description of Artificial Sequence: Synthetic coding sequence

SEQ ID NO: 163032 - DNA, 1575 bp, Artificial Sequence
  Description of Artificial Sequence: Synthetic coding sequence
atgtctgacaacggggagctggaggacaagcccccagcccctcctgtgaggatgagcagcaccatcttcagcactggaggcaaggaccccctgagcgccaaccacagcctgaagcccctgcccagcgtgcctgaggagaagaagcccaggcacaagatcatcagcatcttcagcggcacagagaagggcagcaagaagaaggagaaggagaggcctgagatcagcccccccagcgactttgagcacaccatccacgtgggctttgatgctgtgactggagagttcaccggcatgcctgagcagtgggcccggctgctgcagaccagcaacatcaccaagctggagcagaagaagaacccccaggccgtgctggatgtgctgaagttctatgacagcaacacagtgaagcagaagtacctgtccttcaccccacctgagaaggatggcttccccagcggcaccccagccctgaatgccaagggcacagaggccccagctgtggtgacagaggaggaggatgatgatgaggagacagcccctcctgtgattgcccccaggccagaccacaccaagagcatctacaccaggtctgtgattgatcctgtgcctgcccctgtgggggacagccacgtggatggagctgccaagagcctggacaagcagaagaagaagaccaagatgacagatgaggagatcatggagaagctgcggaccatcgtgtccatcggggaccccaagaagaagtacaccaggtatgagaagattggccagggcgccagcggcaccgtcttcaccgccacagatgtggccctgggccaggaggtggccatcaagcagatcaacctgcagaagcagcccaagaaggagctgatcatcaatgagatcctggtgatgaaggagctgaagaaccccaacatcgtgaacttcctggacagctacctggtgggagatgagctgtttgtggtgatggagtacctggccggcggcagcctgacagatgtggtgacagagacctgcatggatgaggcccagattgctgctgtgtgcagagaatgtctgcaggccctggagttcctgcacgccaaccaggtgatccaccgggacatcaagagtgacaacgtgctgctgggcatggagggctctgtgaagctgacagactttggcttctgtgcccagatcaccccagagcagagcaagaggagcaccatggtgggcaccccctactggatggcccctgaggtggtgaccaggaaggcctacggccccaaggtggacatctggagcctgggcatcatggccatcgagatggtggagggggagcccccctacctgaatgaaaaccccctgcgggccctgtacctgattgccaccaacggcaccccagagctgcagaaccctgagaagctgagccccatcttccgggacttcctgaaccgctgcctggagatggatgtggagaagaggggcagcgccaaggagctgctgcagcaccccttcctgaagctggccaagcccctgagcagcctgacccccctcatcatggccgccaaggaggccatgaagagcaacagatag

SEQ ID NO: 163033 - DNA, 1680 bp, Artificial Sequence
  Description of Artificial Sequence: Synthetic coding sequence
atgtctgatggcctggacaatgaggagaagcccccagccccacccctgaggatgaacagcaacaacagagacagcagcgccctgaaccacagcagcaagcccctgcccatggcccctgaggagaagaacaagaaggcccggctgcggagcatcttccctgggggcggggacaagaccaacaagaagaaggagaaggagaggcctgagatcagcctgcccagcgactttgagcacaccatccacgtgggctttgatgctgtgactggagagttcaccccagacctgtatggcagccagatgtgccctgggaagctgcctgagggcatccctgagcagtgggcccggctgctgcagaccagcaacatcaccaagctggagcagaagaagaacccccaggccgtgctggatgtgctgaagttctatgacagcaaggagaccgtgaacaaccagaagtacatgtccttcaccagcggggacaagagcgcccacggctacatcgccgcccaccccagcagcaccaagacagccagcgagccccccctggcccctcctgtgtctgaggaggaggatgaggaggaggaggaggaggaggatgaaaatgagcccccacctgtgattgcccccaggcctgagcacaccaagagcatctacaccaggtctgtggtggagagcatcgccagccctgctgtgcccaacaaggaggtgaccccaccttctgcagaaaatgccaacagcagcaccctgtacagaaacacagaccggcagaggaagaagagcaagatgacagatgaggagatcctggagaagctgcggagcatcgtgtctgtgggggaccccaagaagaagtacaccaggtttgagaagattggccagggcgccagcggcaccgtgtacacagccctggacatcgccaccggccaggaggtggccatcaagcagatgaacctgcagcagcagcccaagaaggagctgatcatcaatgagatcctggtgatgagggagaacaagaaccccaacatcgtgaactacctggacagctacctggtgggagatgagctgtgggtggtgatggagtacctggccggcggcagcctgacagatgtggtgacagagacctgcatggatgagggccagattgctgctgtgtgcagagaatgtctgcaggccctggacttcctgcacagcaaccaggtgatccaccgggacatcaagagtgacaacatcctgctgggcatggatggctctgtgaagctgacagactttggcttctgtgcccagatcaccccagagcagagcaagaggagcaccatggtgggcaccccctactggatggcccctgaggtggtgaccaggaaggcctacggccccaaggtggacatctggagcctgggcatcatggccatcgagatggtggagggggagcccccctacctgaatgaaaaccccctgcgggccctgtacctgattgccaccaacggcaccccagagctgcagaaccctgagcggctgtctgctgtgttccgggacttcctgaaccgctgcctggagatggatgtggacagaagaggcagcgccaaggagctgctgcagcaccccttcctgaagctggccaagcccctgagcagcctgacccccctcatcatcgccgccaaggaggccatcaagaacagcagcaggtag

SEQ ID NO: 163034 - DNA, 1743 bp, Artificial Sequence
  Description of Artificial Sequence: Synthetic coding sequence
atgtctgatggcctggacaatgaggagaagcccccagccccacccctgaggatgaacagcaacaacagagacagcagcgccctgaaccacagcagcaagcccctgcccatggcccctgaggagaagaacaagaaggcccggctgcggagcatcttccctgggggcggggacaagaccaacaagaagaaggagaaggagaggcctgagatcagcctgcccagcgactttgagcacaccatccacgtgggctttgatgctgtgactggagagttcaccaacagccccttccagaccagcaggcctgtgacagtggccagcagccagagcgagggcaagatgccagacctgtatggcagccagatgtgccctgggaagctgcctgagggcatccctgagcagtgggcccggctgctgcagaccagcaacatcaccaagctggagcagaagaagaacccccaggccgtgctggatgtgctgaagttctatgacagcaaggagaccgtgaacaaccagaagtacatgtccttcaccagcggggacaagagcgcccacggctacatcgccgcccaccccagcagcaccaagacagccagcgagccccccctggcccctcctgtgtctgaggaggaggatgaggaggaggaggaggaggaggatgaaaatgaacctcctcctgtgattgcccccaggcctgagcacaccaagagcatctacaccaggtctgtggtggagagcatcgccagccctgctgtgcccaacaaggaggtgaccccacccagcgcagaaaatgccaacagcagcaccctgtacagaaacacagaccggcagaggaagaagagcaagatgacagatgaggagatcctggagaagctgcggagcatcgtgtctgtgggggaccccaagaagaagtacaccaggtttgagaagattggccagggcgccagcggcaccgtgtacacagccctggacatcgccaccggccaggaggtggccatcaagcagatgaacctgcagcagcagcccaagaaggagctgatcatcaatgagatcctggtgatgagggagaacaagaaccccaacatcgtgaactacctggacagctacctggtgggagatgagctgtgggtggtgatggagtacctggccggcggcagcctgacagatgtggtgacagagacctgcatggatgagggccagattgctgctgtgtgccgggagtgcctgcaggccctggacttcctgcacagcaaccaggtgatccaccgggacatcaagagtgacaacatcctgctgggcatggatggctctgtgaagctgacagactttggcttctgtgcccagatcaccccagagcagagcaagaggagcaccatggtgggcaccccctactggatggcccctgaggtggtgaccaggaaggcctacggccccaaggtggacatctggagcctgggcatcatggccatcgagatggtggagggggagcccccctacctgaatgaaaaccccctgcgggccctgtacctgattgccaccaacggcaccccagagctgcagaaccctgagcggctgtctgctgtgttccgggacttcctgaaccgctgcctggagatggatgtggaccggcggggcagcgccaaggagctgctgcagcaccccttcctgaagctggccaagcccctgagcagcctgacccccctcatcatcgccgccaaggaggccatcaagaacagcagcaggtag

SEQ ID NO: 163035 - DNA, 1635 bp, Artificial Sequence
  Description of Artificial Sequence: Synthetic coding sequence
atgtctgatggcctggacaatgaggagaagcccccagccccacccctgaggatgaacagcaacaacagagacagcagcgccctgaaccacagcagcaagcccctgcccatggcccctgaggagaagaacaagaaggcccggctgcggagcatcttccctgggggcggggacaagaccaacaagaagaaggagaaggagaggcctgagatcagcctgcccagcgactttgagcacaccatccacgtgggctttgatgctgtgactggagagttcaccggcatccctgagcagtgggcccggctgctgcagaccagcaacatcaccaagctggagcagaagaagaacccccaggccgtgctggatgtgctgaagttctatgacagcaaggagaccgtgaacaaccagaagtacatgtccttcaccagcggggacaagagcgcccacggctacatcgccgcccaccccagcagcaccaagacagccagcgagccccccctggcccctcctgtgtctgaggaggaggatgaggaggaggaggaggaggaggatgaaaatgaacctcctcctgtgattgcccccaggcctgagcacaccaagagcatctacaccaggtctgtggtggagagcatcgccagccctgctgtgcccaacaaggaggtgaccccacccagcgcagaaaatgccaacagcagcaccctgtacagaaacacagaccggcagaggaagaagagcaagatgacagatgaggagatcctggagaagctgcggagcatcgtgtctgtgggggaccccaagaagaagtacaccaggtttgagaagattggccagggcgccagcggcaccgtgtacacagccctggacatcgccaccggccaggaggtggccatcaagcagatgaacctgcagcagcagcccaagaaggagctgatcatcaatgagatcctggtgatgagggagaacaagaaccccaacatcgtgaactacctggacagctacctggtgggagatgagctgtgggtggtgatggagtacctggccggcggcagcctgacagatgtggtgacagagacctgcatggatgagggccagattgctgctgtgtgccgggagtgcctgcaggccctggacttcctgcacagcaaccaggtgatccaccgggacatcaagagtgacaacatcctgctgggcatggatggctctgtgaagctgacagactttggcttctgtgcccagatcaccccagagcagagcaagaggagcaccatggtgggcaccccctactggatggcccctgaggtggtgaccaggaaggcctacggccccaaggtggacatctggagcctgggcatcatggccatcgagatggtggagggggagcccccctacctgaatgaaaaccccctgcgggccctgtacctgattgccaccaacggcaccccagagctgcagaaccctgagcggctgtctgctgtgttccgggacttcctgaaccgctgcctggagatggatgtggaccggcggggcagcgccaaggagctgctgcagcaccccttcctgaagctggccaagcccctgagcagcctgacccccctcatcatcgccgccaaggaggccatcaagaacagcagcaggtag

SEQ ID NO: 163036 - DNA, 1680 bp, Artificial Sequence; identical to SEQ ID NO: 163033
  Description of Artificial Sequence: Synthetic coding sequence

SEQ ID NO: 163037 - DNA, 1698 bp, Artificial Sequence
  Description of Artificial Sequence: Synthetic coding sequence
atgtctgatggcctggacaatgaggagaagcccccagccccacccctgaggatgaacagcaacaacagagacagcagcgccctgaaccacagcagcaagcccctgcccatggcccctgaggagaagaacaagaaggcccggctgcggagcatcttccctgggggcggggacaagaccaacaagaagaaggagaaggagaggcctgagatcagcctgcccagcgactttgagcacaccatccacgtgggctttgatgctgtgactggagagttcaccaacagccccttccagaccagcaggcctgtgacagtggccagcagccagagcgagggcaagatgggcatccctgagcagtgggcccggctgctgcagaccagcaacatcaccaagctggagcagaagaagaacccccaggccgtgctggatgtgctgaagttctatgacagcaaggagaccgtgaacaaccagaagtacatgtccttcaccagcggggacaagagcgcccacggctacatcgccgcccaccccagcagcaccaagacagccagcgagccccccctggcccctcctgtgtctgaggaggaggatgaggaggaggaggaggaggaggatgaaaatgagcccccacctgtgattgcccccaggcctgagcacaccaagagcatctacaccaggtctgtggtggagagcatcgccagccctgctgtgcccaacaaggaggtgaccccaccttctgcagaaaatgccaacagcagcaccctgtacagaaacacagaccggcagaggaagaagagcaagatgacagatgaggagatcctggagaagctgcggagcatcgtgtctgtgggggaccccaagaagaagtacaccaggtttgagaagattggccagggcgccagcggcaccgtgtacacagccctggacatcgccaccggccaggaggtggccatcaagcagatgaacctgcagcagcagcccaagaaggagctgatcatcaatgagatcctggtgatgagggagaacaagaaccccaacatcgtgaactacctggacagctacctggtgggagatgagctgtgggtggtgatggagtacctggccggcggcagcctgacagatgtggtgacagagacctgcatggatgagggccagattgctgctgtgtgcagagaatgtctgcaggccctggacttcctgcacagcaaccaggtgatccaccgggacatcaagagtgacaacatcctgctgggcatggatggctctgtgaagctgacagactttggcttctgtgcccagatcaccccagagcagagcaagaggagcaccatggtgggcaccccctactggatggcccctgaggtggtgaccaggaaggcctacggccccaaggtggacatctggagcctgggcatcatggccatcgagatggtggagggggagcccccctacctgaatgaaaaccccctgcgggccctgtacctgattgccaccaacggcaccccagagctgcagaaccctgagcggctgtctgctgtgttccgggacttcctgaaccgctgcctggagatggatgtggacagaagaggcagcgccaaggagctgctgcagcaccccttcctgaagctggccaagcccctgagcagcctgacccccctcatcatcgccgccaaggaggccatcaagaacagcagcaggtag

SEQ ID NO: 163038 - DNA, 1635 bp, Artificial Sequence; identical to SEQ ID NO: 163035
  Description of Artificial Sequence: Synthetic coding sequence

SEQ ID NO: 163039 - DNA, 546 bp, Artificial Sequence
  Description of Artificial Sequence: Synthetic coding sequence
atgtctgatggcctggacaatgaggagaagcccccagccccacccctgaggatgaacagcaacaacagagacagcagcgccctgaaccacagcagcaagcccctgcccatggcccctgaggagaagaacaagaaggcccggctgcggagcatcttccctgggggcggggacaagaccaacaagaagaaggagaaggagaggcctgagatcagcctgcccagcgactttgagcacaccatccacgtgggctttgatgctgtgactggagagttcaccaacagccccttccagaccagcaggcctgtgacagtggccagcagccagagcgagggcaagatgccagacctgtatggcagccagatgtgccctgggaagctgcctgagggcatccctgagcagtgggcccggctgctgcagaccagcaacatcaccaagctggagcagaagaagaacccccaggccgtgctggatgtgctgaagttctatgacagcaaggagaccgtgaacaaccagaagtacatgtccttcaccagcggggacaagtag

SEQ ID NO: 163040 - DNA, 1635 bp, Artificial Sequence; identical to SEQ ID NO: 163035
  Description of Artificial Sequence: Synthetic coding sequence

SEQ ID NO: 163041 - DNA, 1743 bp, Artificial Sequence; identical to SEQ ID NO: 163034
  Description of Artificial Sequence: Synthetic coding sequence

SEQ ID NO: 163042 - DNA, 1698 bp, Artificial Sequence; identical to SEQ ID NO: 163037
  Description of Artificial Sequence: Synthetic coding sequence

SEQ ID NO: 163043 - DNA, 2046 bp, Artificial Sequence
  Description of Artificial Sequence: Synthetic coding sequence
atgttcaggaagaagaagaagaagaggcctgagatcagcgccccccagaacttccagcaccgggtgcacaccagctttgaccccaaggagggcaagtttgtgggcctgcccccccagtggcagaacatcctggacaccctgcggcggcccaagcctgtggtggaccccagccgcatcaccagggtgcagctgcagcccatgaagacagtggtgcggggcagcgccatgcctgtggatggctacatcagcggcctgctgaatgacatccagaagctgagcgtcatcagcagcaacaccctgcggggccgcagccccaccagcagaagaagagcccagagcctgggcctgctgggagatgagcactgggccacagatcctgacatgtacctgcagagcccccagagcgagaggacagacccccacggcctgtacctgagctgcaatggaggcaccccagctggccacaagcagatgccctggccagagccccagagcccccgggtgctgcccaacggcctggccgccaaggcccagagcctgggccctgctgagttccagggcgccagccagcgctgcctgcagctgggcgcctgcctgcagagcagccccccaggggccagcccccccaccggcaccaacagacatggcatgaaggccgccaagcacggcagcgaggaggcccggccccagagctgcctggtgggcagcgccaccggccggcctggaggagagggcagccccagccccaagacccgggagagcagcctgaagaggaggctcttccgctccatgttcctgagcacagctgccacagccccacccagcagcagcaagccaggccccccaccccagagcaagcccaacagcagcttccggcccccccagaaggacaacccccccagcctggtggccaaggcccagagcctgcccagcgaccagcctgtgggcaccttcagccccctgaccaccagtgacaccagcagcccccagaagagcctgaggacagccccagccaccggccagctgcccggccgcagcagccctgctggcagccccaggacctggcacgcccagatcagcaccagcaacctgtacctgccccaggaccccaccgtggccaagggggccctggccggggaggacaccggggtggtgacccatgagcagttcaaggccgccctgaggatggtggtggaccagggcgacccccggctgctgctggacagctatgtgaagattggagagggcagcacaggcatcgtgtgcctggcccgggagaagcacagcggccggcaggtggccgtgaagatgatggacctgaggaagcagcagaggcgggagctgctcttcaatgaggtggtgatcatgagggactaccagcacttcaacgtggtggagatgtacaagagctacctggtgggggaggagctgtgggtgctgatggagttcctgcagggcggggccctgacagacatcgtgtcccaggtgcggctgaatgaggagcagatcgccaccgtgtgtgaggccgtgctgcaggccctggcctacctgcacgcccagggcgtcatccaccgggacatcaagagtgacagcatcctgctgaccctggatggccgggtgaagctgagtgactttggcttctgtgcccagatcagcaaggatgtgcccaagaggaagagcctggtgggcaccccctactggatggcccctgaggtgatcagccgcagcctgtatgccacagaggtggacatctggagcctgggcatcatggtgattgagatggtggatggagagcccccctacttcagtgacagccctgtgcaggccatgaagaggctgcgggacagccccccacccaagctgaagaacagccacaaggtgtcccctgtgctgcgggacttcctggagaggatgctggtgcgggacccccaggagcgggccacagcccaggagctgctggaccaccccttcctgctgcagacaggcctgcctgaatgtctggtgcccctcatccagctgtacaggaagcagaccagcacctgctag

SEQ ID NO: 163044 - DNA, 2046 bp, Artificial Sequence; identical to SEQ ID NO: 163043
  Description of Artificial Sequence: Synthetic coding sequence

SEQ ID NO: 163045 - DNA, 2046 bp, Artificial Sequence; identical to SEQ ID NO: 163043
  Description of Artificial Sequence: Synthetic coding sequence

SEQ ID NO: 163046 - DNA, 369 bp, Artificial Sequence
  Description of Artificial Sequence: Synthetic coding sequence
atgttcaggaagaagaagaagaagaggcctgagatcagcgccccccagaacttccagcaccgggtgcacaccagctttgaccccaaggagggcaagtttgtgggcctgcccccccagtggcagaacatcctggacaccctgcggcggcccaagcctgtggtggaccccagccgcatcaccagggtgcagctgcagcccatgaagacagtggtgcggggcagcgccatgcctgtggatggctacatcagcggcctgctgaatgacatccagaagctgagcgtcatcagcagcaacaccctgcggggccgcagccccaccagcagaagaagagcccagagcctgggcctgctgggagatgagcactggtag

SEQ ID NO: 163047 - DNA, 372 bp, Artificial Sequence
  Description of Artificial Sequence: Synthetic coding sequence
atgttcaggaagaagaagaagaagaggcctgagatcagcgccccccagaacttccagcaccgggtgcacaccagctttgaccccaaggagggcaagtttgtgggcctgcccccccagtggcagaacatcctggacaccctgcggcggcccaagcctgtggtggaccccagccgcatcaccagggtgcagctgcagcccatgaagacagtggtgcggggcagcgccatgcctgtggatggctacatcagcggcctgctgaatgacatccagaagctgagcgtcatcagcagcaacaccctgcggggccgcagccccaccagcagaagaagagcccagagcctgggcctgctgggagatgagcactgggcctag

SEQ ID NO: 163048 - DNA, 330 bp, Artificial Sequence
  Description of Artificial Sequence: Synthetic coding sequence
atgttcaggaagaagaagaagaagaggcctgagatcagcgccccccagaacttccagcaccgggtgcacaccagctttgaccccaaggagggcaagtttgtgggcctgcccccccagtggcagaacatcctggacaccctgcggcggcccaagcctgtggtggaccccagccgcatcaccagggtgcagctgcagcccatgaagacagtggtgcggggcagcgccatgcctgtggatggctacatcagcggcctgctgaatgacatccagaagctgagcgtcatcagcagcaacaccctgcggggccgcagccccaccagcagaagatag

SEQ ID NO: 163049 - DNA, 339 bp, Artificial Sequence
  Description of Artificial Sequence: Synthetic coding sequence
atgttcaggaagaagaagaagaagaggcctgagatcagcgccccccagaacttccagcaccgggtgcacaccagctttgaccccaaggagggcaagtttgtgggcctgcccccccagtggcagaacatcctggacaccctgcggcggcccaagcctgtggtggaccccagccgcatcaccagggtgcagctgcagcccatgaagacagtggtgcggggcagcgccatgcctgtggatggctacatcagcggcctgctgaatgacatccagaagctgagcgtcatcagcagcaacaccctgcggggccgcagccccaccagcagaagaagagcccagtag

SEQ ID NO: 163050 - DNA, 2046 bp, Artificial Sequence; identical to SEQ ID NO: 163043
  Description of Artificial Sequence: Synthetic coding sequence

SEQ ID NO: 163051 - DNA, 855 bp, Artificial Sequence
  Description of Artificial Sequence: Synthetic coding sequence
atgttcaggaagaagaagaagaagaggcctgagatcagcgccccccagaacttccagcaccgggtgcacaccagctttgaccccaaggagggcaagtttgtgggcctgcccccccagtggcagaacatcctggacaccctgcggcggcccaagcctgtggtggaccccagccgcatcaccagggtgcagctgcagcccatgaagacagtggtgcggggcagcgccatgcctgtggatggctacatcagcggcctgctgaatgacatccagaagctgagcgtcatcagcagcaacaccctgcggggccgcagccccaccagcagaagaagagcccagagcctgggcctgctgggagatgagcactgggccacagatcctgacatgtacctgcagagcccccagagcgagaggacagacccccacggcctgtacctgagctgcaatggaggcaccccagctggccacaagcagatgccctggccagagccccagagcccccgggtgctgcccaacggcctggccgccaaggcccagagcctgggccctgctgagttccagggcgccagccagcgctgcctgcagctgggcgcctgcctgcagagcagccccccaggggccagcccccccaccggcaccaacagacatggcatgaaggccgccaagcacggcagcgaggaggcccggccccagagctgcctggtgggcagcgccaccggccggcctggaggagagggcagccccagccccaagacccgggagagcagcctgaagaggaggctcttccgctccatgttcctgagcacagctgccacagccccacccagcagcagcaagccaggccccccaccccagtag

SEQ ID NO: 163052 - DNA, 318 bp, Artificial Sequence
  Description of Artificial Sequence: Synthetic coding sequence
atgttcaggaagaagaagaagaagaggcctgagatcagcgccccccagaacttccagcaccgggtgcacaccagctttgaccccaaggagggcaagtttgtgggcctgcccccccagtggcagaacatcctggacaccctgcggcggcccaagcctgtggtggaccccagccgcatcaccagggtgcagctgcagcccatgaagacagtggtgcggggcagcgccatgcctgtggatggctacatcagcggcctgctgaatgacatccagaagctgagcgtcatcagcagcaacaccctgcggggccgcagcccctag

SEQ ID NO: 163053 - DNA, 441 bp, Artificial Sequence
  Description of Artificial Sequence: Synthetic coding sequence
atgatcaacatgggagacagccacgtggacaccagcagcacagtgtctgaggccgtggccgaggaggtgtccctcttctccatgacagacatgatcctcttcagcctgattgtgggcctgctgacctactggttcctgttcaggaagaagaaggaggaggtgcctgagttcaccaagatccagaccctgaccagctctgtgcgggagagcagctttgtggagaagatgaagaagacaggaagaaacatcatcgtgttctacggcagccagacaggaacagctgaggagtttgccaaccggctgagcaaggatgcccacagatatggcatgaggggcatgtctgctgaccctgaggagtatgacctggccgacctgagcagcctgcctgagattgacaatgccctggtggtgttctgcatggccacctatggagagggctag

SEQ ID NO: 163054 - DNA, 519 bp, Artificial Sequence
  Description of Artificial Sequence: Synthetic coding sequence
atgatcaacatgggagacagccacgtggacaccagcagcacagtgtctgaggccgtggccgaggaggtgtccctcttctccatgacagacatgatcctcttcagcctgattgtgggcctgctgacctactggttcctgttcaggaagaagaaggaggaggtgcctgagttcaccaagatccagaccctgaccagctctgtgcgggagagcagctttgtggagaagatgaagaagacaggaagaaacatcatcgtgttctacggcagccagacaggaacagctgaggagtttgccaaccggctgagcaaggatgcccacagatatggcatgaggggcatgtctgctgaccctgaggagtatgacctggccgacctgagcagcctgcctgagattgacaatgccctggtggtgttctgcatggccacctatggagagggggaccccacagacaatgcccaggacttctatgactggctgcaggagacagatgtggacctgtctggagtgaagtttgcctag

SEQ ID NO: 163055 - DNA, 189 bp, Artificial Sequence
  Description of Artificial Sequence: Synthetic coding sequence
atgatcaacatgggagacagccacgtggacaccagcagcacagtgtctgaggccgtggccgaggaggtgtccctcttctccatgacagacatgatcctcttcagcctgattgtgggcctgctgacctactggttcctgttcaggaagaagaaggaggaggtgcctgagttcaccaagatccagacctag

SEQ ID NO: 163056 - DNA, 1107 bp, Artificial Sequence
  Description of Artificial Sequence: Synthetic coding sequence
atgggcaagtatgtggacaagaggctggagcagctgggcgcccagaggatctttgagctgggcctgggagatgatgatggcaacctggaggaggacttcatcacctggagggagcagttctggccagctgtgtgtgagcactttggagtggaggccactggagaggagagcagcatccggcagtatgagctggtggtgcacacagacattgatgctgccaaggtgtacatgggagagatgggccgcctgaagagctatgagaaccagaagcccccatttgatgccaagaaccccttcctggccgctgtgaccaccaacaggaagctgaaccagggcacagagcggcacctgatgcacctggagctggacatcagtgacagcaagatccgctatgaaagtggggaccacgtggccgtgtacccagccaatgattctgccctggtgaaccagctgggcaagatcctgggcgctgacctggatgtggtgatgagcctgaacaacctggatgaggagagcaacaagaagcaccccttcccctgccccaccagctacagaacagccctgacctactacctggacatcaccaacccccccaggaccaacgtgctgtatgagctggcccagtatgccagcgagcccagcgagcaggagctgctgaggaagatggccagcagcagcggggagggcaaggagctgtacctgtcctgggtggtggaggcccggcggcacatcctggccatcctgcaggactgccccagcctgcggccccccatcgaccacctgtgtgagctgctgccccggctgcaggcccgctactacagcatcgccagcagcagcaaggtgcaccccaacagcgtgcacatctgtgctgtggtggtggagtatgagaccaaggccggccgcatcaacaagggcgtggccaccaactggctgcgggccaaggagcctgctggagaaaatggaggccgggccctggccgtgcccaccagcacctctgtgggcatgcacggcacctggccaggcatgtgcaggacccccagcaccacctcctggctgagcagcggcccctggagcacccggcggcgctggaccaccagcagaaattag

SEQ ID NO: 163057 - DNA, 120 bp, Artificial Sequence
  Description of Artificial Sequence: Synthetic coding sequence
atgatcaacatgggagacagccacgtggacaccagcagcacagtgtctgaggccgtggccgaggaggtgtccctcttctccatgacagacatgatcctcttcagcctgattgtgggctag

SEQ ID NO: 163058 - DNA, 501 bp, Artificial Sequence
  Description of Artificial Sequence: Synthetic coding sequence
atgatcaacatgggagacagccacgtggacaccagcagcacagtgtctgaggccgtggccgaggaggtgtccctcttctccatgacagacatgatcctcttcagcctgattgtgggcctgctgacctactggttcctgttcaggaagaagaaggaggaggtgcctgagttcaccaagatccagaccctgaccagctctgtgcgggagagcagctttgtggagaagatgaagaagacaggaagaaacatcatcgtgttctacggcagccagacaggaacagctgaggagtttgccaaccggctgagcaaggatgcccacagatatggcatgaggggcatgtctgctgaccctgaggagtatgacctggccgacctgagcagcctgcctgagattgacaatgccctggtggtgttctgcatggccacctatggagagggggaccccacagacaatgcccaggacttctatgactggctgcaggagacagatgtggacctgtag

SEQ ID NO: 163059 - DNA, 567 bp, Artificial Sequence
  Description of Artificial Sequence: Synthetic coding sequence
atgatcaacatgggagacagccacgtggacaccagcagcacagtgtctgaggccgtggccgaggaggtgtccctcttctccatgacagacatgatcctcttcagcctgattgtgggcctgctgacctactggttcctgttcaggaagaagaaggaggaggtgcctgagttcaccaagatccagaccctgaccagctctgtgcgggagagcagctttgtggagaagatgaagaagacaggaagaaacatcatcgtgttctacggcagccagacaggaacagctgaggagtttgccaaccggctgagcaaggatgcccacagatatggcatgaggggcatgtctgctgaccctgaggagtatgacctggccgacctgagcagcctgcctgagattgacaatgccctggtggtgttctgcatggccacctatggagagggggaccccacagacaatgcccaggacttctatgactggctgcaggagacagatgtggacctgtctggagtgaagtttgctgtgtttggcctgggcaacaagacctatgagcacttcaatgccatgggctag

SEQ ID NO: 163060 - DNA, 189 bp, Artificial Sequence; identical to SEQ ID NO: 163055
  Description of Artificial Sequence: Synthetic coding sequence

SEQ ID NO: 163061 - DNA, 1722 bp, Artificial Sequence
  Description of Artificial Sequence: Synthetic coding sequence
atgggcagccgctggccagctgtgcccccctggggcctgcagatccacgtgtctgagcggcagcccagccggcccccaccctgcccccagcagcccggccaggccacctgtgagaccctgagcagcgccccagaccccagcaccaccaggatgagccccccctgcccccagccccagagcgcccctgggggcatcggctgctggaggctgaaggtgtttggcctgggcaacaagacctatgagcacttcaatgccatgggcaagtatgtggacaagaggctggagcagctgggcgcccagaggatctttgagctgggcctgggagatgatgatggcaacctggaggaggacttcatcacctggagggagcagttctggccagctgtgtgtgagcactttggagtggaggccaccggggaggagagcagcatccggcagtatgagctggtggtgcacacagacattgatgctgccaaggtgtacatgggagagatgggccgcctgaagagctatgagaaccagaagcccccatttgatgccaagaaccccttcctggccgctgtgaccaccaacaggaagctgaaccagggcacagagcggcacctgatgcacctggagctggacatcagtgacagcaagatccgctatgagagcggggaccacgtggccgtgtacccagccaatgacagcgccctggtgaaccagctgggcaagatcctgggcgctgacctggatgtggtgatgagcctgaacaacctggatgaggagagcaacaagaagcaccccttcccctgccccaccagctacagaacagccctgacctactacctggacatcaccaacccccccaggaccaacgtgctgtatgagctggcccagtatgccagcgagcccagcgagcaggagctgctgaggaagatggccagcagcagtggagagggcaaggagctgtacctgtcctgggtggtggaggcccggcggcacatcctggccatcctgcaggactgccccagcctgcggccccccatcgaccacctgtgtgagctgctgccccggctgcaggcccgctactacagcatcgccagcagcagcaaggtgcaccccaacagcgtgcacatctgtgctgtggtggtggagtatgagaccaaggccggccgcatcaacaagggcgtggccaccaactggctgcgggccaaggagcctgctggggagaatggaggccgggccctggtgcccatgtttgtgaggaagagccagttccggctgcccttcaaggccaccacccctgtgatcatggtgggccctggcactggagtggcccccttcatcggcttcatccaggagcgggcctggctgcggcagcagggcaaggaggtgggggagaccctgctgtactacggctgcagaagaagtgatgaggactacctgtaccgggaggagctggcccagttccacagagatggagccctgacccagctgaatgtggccttcagccgggagcagagccacaaggtgtatgtgcagcacctgctgaagcaggaccgggagcacctgtggaagctgattgagggcggggcccacatctacgtgtgtggcacccccagcagctgccccggcatgcacggcacctggccaggcatgtgcaggacccccagcaccacctcctggctgagcagcggcccctggagcacccggcggcgctggaccaccagcaggaactag

SEQ ID NO: 163062 - DNA, 423 bp, Artificial Sequence
  Description of Artificial Sequence: Synthetic coding sequence
atgatcaacatgggagacagccacgtggacaccagcagcacagtgtctgaggccgtggccgaggaggtgtccctcttctccatgacagacatgatcctcttcagcctgattgtgggcctgctgacctactggttcctgttcaggaagaagaaggaggaggtgcctgagttcaccaagatccagaccctgaccagctctgtgcgggagagcagctttgtggagaagatgaagaagacaggaagaaacatcatcgtgttctacggcagccagacaggaacagctgaggagtttgccaaccggctgagcaaggatgcccacagatatggcatgaggggcatgtctgctgaccctgaggagtatgacctggccgacctgagcagcctgcctgagattgacaatgccctggtggtgttctgcatgtag

SEQ ID NO: 163063 - DNA, 2043 bp, Artificial Sequence
  Description of Artificial Sequence: Synthetic coding sequence
atgatcaacatgggagacagccacgtggacaccagcagcacagtgtctgaggccgtggccgaggaggtgtccctcttctccatgacagacatgatcctcttcagcctgattgtgggcctgctgacctactggttcctgttcaggaagaagaaggaggaggtgcctgagttcaccaagatccagaccctgaccagctctgtgcgggagagcagctttgtggagaagatgaagaagacaggaagaaacatcatcgtgttctacggcagccagacaggaacagctgaggagtttgccaaccggctgagcaaggatgcccacagatatggcatgaggggcatgtctgctgaccctgaggagtatgacctggccgacctgagcagcctgcctgagattgacaatgccctggtggtgttctgcatggccacctatggagagggggaccccacagacaatgcccaggacttctatgactggctgcaggagacagatgtggacctgtctggagtgaagtttgctgtgtttggcctgggcaacaagacctatgagcacttcaatgccatgggcaagtatgtggacaagaggctggagcagctgggcgcccagaggatctttgagctgggcctgggagatgatgatggcaacctggaggaggacttcatcacctggagggagcagttctggccagctgtgtgtgagcactttggagtggaggccactggagaggagagcagcatccggcagtatgagctggtggtgcacacagacattgatgctgccaaggtgtacatgggagagatgggccgcctgaagagctatgagaaccagaagcccccatttgatgccaagaaccccttcctggccgctgtgaccaccaacaggaagctgaaccagggcacagagcggcacctgatgcacctggagctggacatcagtgacagcaagatccgctatgaaagtggggaccacgtggccgtgtacccagccaatgattctgccctggtgaaccagctgggcaagatcctgggcgctgacctggatgtggtgatgagcctgaacaacctggatgaggagagcaacaagaagcaccccttcccctgccccaccagctacagaacagccctgacctactacctggacatcaccaacccccccaggaccaacgtgctgtatgagctggcccagtatgccagcgagcccagcgagcaggagctgctgaggaagatggccagcagcagcggggagggcaaggagctgtacctgtcctgggtggtggaggcccggcggcacatcctggccatcctgcaggactgccccagcctgcggccccccatcgaccacctgtgtgagctgctgccccggctgcaggcccgctactacagcatcgccagcagcagcaaggtgcaccccaacagcgtgcacatctgtgctgtggtggtggagtatgagaccaaggccggccgcatcaacaagggcgtggccaccaactggctgcgggccaaggagcctgctggagaaaatggaggccgggccctggtgcccatgtttgtgaggaagagccagttccggctgcccttcaaggccaccacccctgtgatcatggtgggccctggcaccggggtggcccccttcatcggcttcatccaggagcgggcctggctgcggcagcagggcaaggaggtgggggagaccctgctgtactacggctgccgccgcagtgatgaggactacctgtaccgggaggagctggcccagttccacagagatggagccctgacccagctgaatgtggccttcagccgggagcagagccacaaggtgtatgtgcagcacctgctgaagcaggaccgggagcacctgtggaagctgattgaaggaggagcccacatctacgtgtgtggagatgccaggaacatggccagagatgtgcagaacaccttctatgacatcgtggccgagctgggcgccatggagcacgcccaggccgtggactacatcaagaagctgatgaccaagggccgctacagcctggatgtgtggagctag

SEQ ID NO: 163064 - DNA, 1467 bp, Artificial Sequence
  Description of Artificial Sequence: Synthetic coding sequence
atgcccaggaccagcaccaccggctgccggcggcagacctggatcagcctgggcagcagcagccggctggaggaggacttcatcacctggagggagcagttctggccagctgtgtgtgagcactttggagtggaggccactggagaggagagcagcatccggcagtatgagctggtggtgcacacagacattgatgctgccaaggtgtacatgggagagatgggccgcctgaagagctatgagaaccagaagcccccatttgatgccaagaaccccttcctggccgctgtgaccaccaacaggaagctgaaccagggcacagagcggcacctgatgcacctggagctggacatcagtgacagcaagatccgctatgaaagtggggaccacgtggccgtgtacccagccaatgattctgccctggtgaaccagctgggcaagatcctgggcgctgacctggatgtggtgatgagcctgaacaacctggatgaggagagcaacaagaagcaccccttcccctgccccaccagctacagaacagccctgacctactacctggacatcaccaacccccccaggaccaacgtgctgtatgagctggcccagtatgccagcgagcccagcgagcaggagctgctgaggaagatggccagcagcagcggggagggcaaggagctgtacctgtcctgggtggtggaggcccggcggcacatcctggccatcctgcaggactgccccagcctgcggccccccatcgaccacctgtgtgagctgctgccccggctgcaggcccgctactacagcatcgccagcagcagcaaggtgcaccccaacagcgtgcacatctgtgctgtggtggtggagtatgagaccaaggccggccgcatcaacaagggcgtggccaccaactggctgcgggccaaggagcctgctggagaaaatggaggccgggccctggtgcccatgtttgtgaggaagagccagttccggctgcccttcaaggccaccacccctgtgatcatggtgggccctggcaccggggtggcccccttcatcggcttcatccaggagcgggcctggctgcggcagcagggcaaggaggtgggggagaccctgctgtactacggctgccgccgcagtgatgaggactacctgtaccgggaggagctggcccagttccacagagatggagccctgacccagctgaatgtggccttcagccgggagcagagccacaaggtgtatgtgcagcacctgctgaagcaggaccgggagcacctgtggaagctgattgaaggaggagcccacatctacgtgtgtggagatgccaggaacatggccagagatgtgcagaacaccttctatgacatcgtggccgagctgggcgccatggagcacgcccaggccgtggactacatcaagaagctgatgaccaagggccgctacagcctggatgtgtggagctag

SEQ ID NO: 163065 - DNA, 402 bp, Artificial Sequence
  Description of Artificial Sequence: Synthetic coding sequence
atgctgagccctgaggccgagcgggtgctgcgctacctggtggaggtggaggagctggccgaggaggtgctggccgacaagaggcagatcgtggacctggacaccaagaggaaccagaaccgggagggcctgcgggccctgcagaaggacctgagcctgtctgaagatgtgatggtgtgctttggaaacatgttcatcaagatgccccaccctgagaccaaggagatgattgagaaggaccaggaccacctggacaaggagattgagaagctgaggaagcagctgaaggtgaaggtgaaccggctgtttgaggcccagggcaagccagagctgaagggcttcaacctgaaccccctgaaccaggatgagctgaaggccctgaaggtgatcctgaagggctag

SEQ ID NO: 163066 - DNA, 1605 bp, Artificial Sequence
  Description of Artificial Sequence: Synthetic coding sequence
atgaagttcaccctgggcctgggcagccgggcctggagggtgtcctgggagggcgctgctgctgctgctgctggccctggggccggcggcagcgccctgcgctgccgggcccagagggtgagcagcccccggctgggcagaagaggcagccggctgagcggggccctgcccctgtgcctgagcagaggaggcggcggggcccaggccctgcctgactgtgccggccccagccctggccaccctggccaccctggggcccggcagctggccggccccctggccatggagcagacctatggagaggtgaaccagctgggcggcgtgtttgtgaatggccggcccctgcccaatgccatccggctgagaattgtggagctggcccagctgggcatccggccctgtgacatcagccggcagctgcgggtgagccacggctgtgtgtccaagatcctggcccgctacaatgaaacaggcagcatcctgcccggggccatcggcggcagcaagccccgggtgaccacccccaacgtggtgaagcacatccgggactacaagcagggcgaccccggcatctttgcctgggagatccgggaccggctgctggctgatggagtgtgtgacaagtacaacgtgcccagcgtgagcagcatcagccgcatcctgaggaacaagattggcagcctggcccagcccggcccctatgaggccagcaagcagccccccagccagcccaccctgccctacaaccacatctaccagtacccctaccccagccctgtgagccccactggagccaagatgggcagccaccctggggtgcccggcacagctggccacgtgtccatccccaggtcctggcccagcgcccacagcgtgagcaacatcctgggcatccgcaccttcatggagcagacaggagccctggccggcagcgagggcacagcctacagccccaagatggaggactgggccggcgtgaacagaacagccttccctgccaccccagctgtgaatggcctggagaagccagccctggaggccgacatcaagtacacccagagcgccagcaccctgtctgctgtgggcggcttcctgcctgcctgtgcctacccagccagcaaccagcacggcgtgtacagcgcccctgggggcggctacctggcccctggccccccctggcccccagcccagggcccccccctggcccctcctggggccggcgtggccgtgcatggaggagagctggccgccgccatgaccttcaagcaccccagccgggagggcagcctgcctgccccagctgcccggcccaggaccccatctgtggcctacacagactgccccagccggcccaggcctccccggggcagcagccccaggacccgggcccggcgggagcggcaggccgaccccggggcccaggtgtgtgccgccgccccagccatcggcaccggcagaattggaggcctggccgaggaggaggccagcgctggccccaggggggcccggcctgccagcccccaggcccagccctgcctgtggccagaccccccccacttcctgtactggagcggcttcctgggcttcagcgagctgggcttctag

SEQ ID NO: 163067 - DNA, 1185 bp, Artificial Sequence
  Description of Artificial Sequence: Synthetic coding sequence
atggacatgcactgcaaggctgaccccttcagcgccatgcaccctggccatggaggagtgaaccagctgggcggcgtgtttgtgaatggccggcccctgcctgatgtggtgcggcagagaattgtggagctggcccaccagggcgtgcggccctgtgacatcagccggcagctgcgggtgagccacggctgtgtgtccaagatcctgggccgctactatgaaacaggcagcatcaagccaggagtgattggaggcagcaagcccaaggtggccacccccaaggtggtggacaagattgctgagtacaagaggcagaaccccaccatgtttgcctgggagatccgggaccggctgctggccgagggcatctgtgacaatgacacagtgcccagcgtgagcagcatcaaccgcatcatccgcaccaaggtgcagcagcccttccaccccaccccagatggagctggcaccggggtgacagcccctggccacaccatcgtgcccagcacagccagcccccctgtgagcagcgccagcaatgaccctgtgggcagctacagcatcaatggcatcctgggcatccccaggagcaatggagagaagaggaagagagatgaagatgtgtctgagggctctgtgcccaacggggacagccagagcggcgtggacagcctgaggaagcacctgcgggctgacaccttcacccagcagcagctggaggccctggacagagtgtttgagcggcccagctacccagatgtgttccaggccagcgagcacatcaagtctgagcagggcaatgagtacagcctgcctgccctgaccccaggcctggatgaggtgaagagcagcctgagcgccagcaccaaccctgagctgggcagcaatgtgtctggcacccagacctaccctgtggtgacaggccgggacatggccagcaccaccctgcccggctacccacctcatgtgcccccaacaggccagggcagctaccccaccagcaccctggccggcatggtgcccggcagcgagttcagcggcaacccctacagccacccccagtacacagcctacaatgaggcctggaggttcagcaacccagccctgctgagcagcccctactactacagcgctgccccccggggcagcgccccagctgctgctgctgctgcctatgacagacactag

SEQ ID NO: 163068 - DNA, 1191 bp, Artificial Sequence
  Description of Artificial Sequence: Synthetic coding sequence
atggacatgcactgcaaggctgaccccttcagcgccatgcaccctggccatggaggagtgaaccagctgggcggcgtgtttgtgaatggccggcccctgcctgatgtggtgcggcagagaattgtggagctggcccaccagggcgtgcggccctgtgacatcagccggcagctgcgggtgagccacggctgtgtgtccaagatcctgggccgctactatgaaacaggcagcatcaagccaggagtgattggaggcagcaagcccaaggtggccacccccaaggtggtggacaagattgctgagtacaagaggcagaaccccaccatgtttgcctgggagatccgggaccggctgctggccgagggcatctgtgacaatgacacagtgcccagcgtgagcagcatcaaccgcatcatccgcaccaaggtgcagcagcccttccaccccaccccagatggagctggcaccggggtgacagcccctggccacaccatcgtgcccagcacagccagcccccctgtgagcagcgccagcaatgaccctgtgggcagctacagcatcaatggcatcctgggcatccccaggagcaatggagagaagaggaagagagatgaagatgtgtctgagggctctgtgcccaacggggacagccagagcggcgtggacagcctgaggaagcacctgcgggctgacaccttcacccagcagcagctggaggccctggacagagtgtttgagcggcccagctacccagatgtgttccaggccagcgagcacatcaagtctgagcagggcaatgagtacagcctgcctgccctgaccccaggcctggatgaggtgaagagcagcctgagcgccagcaccaaccctgagctgggcagcaatgtgtctggcacccagacctaccctgtggtgacaggccgggacatggccagcaccaccctgcccggctacccacctcatgtgcccccaacaggccagggcagctaccccaccagcaccctggccggcatggtgcctgaggccgctgtgggccccagcagcagcctgatgagcaagccaggcaggaagctggccgaggtgcccccctgtgtgcagcccaccggggccagcagccctgccaccaggacagccacccccagcacccggcccaccacccggctgggggacagcgccaccccaccctactag

SEQ ID NO: 163069 - DNA, 990 bp, Artificial Sequence
  Description of Artificial Sequence: Synthetic coding sequence
atgtttgcctgggagatccgggaccggctgctggccgagggcatctgtgacaatgacacagtgcccagcgtgagcagcatcaaccgcatcatccgcaccaaggtgcagcagcccttccaccccaccccagatggagctggcaccggggtgacagcccctggccacaccatcgtgcccagcacagccagcccccctgtgagcagcgccagcaatgaccctgtgggcagctacagcatcaatggcatcctgggcatccccaggagcaatggagagaagaggaagagagatgaggtggaggtgtacacagatcctgcccacatccggggcggcggcggcctgcacctggtgtggaccctgagagatgtgtctgagggctctgtgcccaatggagacagccagagcggcgtggacagcctgaggaagcacctgcgggctgacaccttcacccagcagcagctggaggccctggacagagtgtttgagcggcccagctacccagatgtgttccaggccagcgagcacatcaagtctgagcagggcaatgagtacagcctgcctgccctgaccccaggcctggatgaggtgaagagcagcctgagcgccagcaccaaccctgagctgggcagcaatgtgtctggcacccagacctaccctgtggtgacaggccgggacatggccagcaccaccctgcccggctacccaccccacgtgccccccaccggccagggcagctaccccaccagcaccctggccggcatggtgcccggcagcgagttcagcggcaacccctacagccacccccagtacacagcctacaatgaggcctggaggttcagcaacccagccctgctgagcagcccctactactacagcgctgccccccggggcagcctgcccctgctgcccctgcccatgacagccaccagctacagaggagaccacatcaagctgcaggccgacagctttggcctgcacatcgtgcctgtgtag

SEQ ID NO: 163070 - DNA, 1260 bp, Artificial Sequence
  Description of Artificial Sequence: Synthetic coding sequence
atggacatgcactgcaaggctgaccccttcagcgccatgcaccctggccatggaggagtgaaccagctgggcggcgtgtttgtgaatggccggcccctgcctgatgtggtgcggcagagaattgtggagctggcccaccagggcgtgcggccctgtgacatcagccggcagctgcgggtgagccacggctgtgtgtccaagatcctgggccgctactatgaaacaggcagcatcaagccaggagtgattggaggcagcaagcccaaggtggccacccccaaggtggtggacaagattgctgagtacaagaggcagaaccccaccatgtttgcctgggagatccgggaccggctgctggccgagggcatctgtgacaatgacacagtgcccagcgtgagcagcatcaaccgcatcatccgcaccaaggtgcagcagcccttccaccccaccccagatggagctggcaccggggtgacagcccctggccacaccatcgtgcccagcacagccagcccccctgtgagcagcgccagcaatgaccctgtgggcagctacagcatcaatggcatcctgggcatccccaggagcaatggagagaagaggaagagagatgaggtggaggtgtacacagatcctgcccacatccggggcggcggcggcctgcacctggtgtggaccctgagagatgtgtctgagggctctgtgcccaatggagacagccagagcggcgtggacagcctgaggaagcacctgcgggctgacaccttcacccagcagcagctggaggccctggacagagtgtttgagcggcccagctacccagatgtgttccaggccagcgagcacatcaagtctgagcagggcaatgagtacagcctgcctgccctgaccccaggcctggatgaggtgaagagcagcctgagcgccagcaccaaccctgagctgggcagcaatgtgtctggcacccagacctaccctgtggtgacaggccgggacatggccagcaccaccctgcccggctacccaccccacgtgccccccaccggccagggcagctaccccaccagcaccctggccggcatggtgcctgaggccgctgtgggccccagcagcagcctgatgagcaagccaggcaggaagctggccgaggtgcccccctgtgtgcagcccactggagccagcagccctgccaccaggacagccacccccagcacccggcccaccacccggctgggggacagcgccaccccaccctactag

SEQ ID NO: 163071 - DNA, 645 bp, Artificial Sequence
  Description of Artificial Sequence: Synthetic coding sequence
atggacatgcactgcaaggctgaccccttcagcgccatgcaccctggccatggaggagtgaaccagctgggcggcgtgtttgtgaatggccggcccctgcctgatgtggtgcggcagagaattgtggagctggcccaccagggcgtgcggccctgtgacatcagccggcagctgcgggtgagccacggctgtgtgtccaagatcctgggccgctactatgaaacaggcagcatcaagccaggagtgattggaggcagcaagcccaaggtggccacccccaaggtggtggacaagattgctgagtacaagaggcagaaccccaccatgtttgcctgggagatccgggaccggctgctggccgagggcatctgtgacaatgacacagtgcccagcgtgagcagcatcaaccgcatcatccgcaccaaggtgcagcagcccttccaccccaccccagatggagctggcaccggggtgacagcccctggccacaccatcgtgcccagcacagccagcccccctgtgagcagcgccagcaatgaccctgtgggcagctacagcatcaatggcatcctgggcatccccaggagcaatggagagaagaggaagagagatgaggtggaggtgtacacagatcctgcccactag

SEQ ID NO: 163072 - DNA, 1254 bp, Artificial Sequence
  Description of Artificial Sequence: Synthetic coding sequence
atggacatgcactgcaaggctgaccccttcagcgccatgcaccctggccatggaggagtgaaccagctgggcggcgtgtttgtgaatggccggcccctgcctgatgtggtgcggcagagaattgtggagctggcccaccagggcgtgcggccctgtgacatcagccggcagctgcgggtgagccacggctgtgtgtccaagatcctgggccgctactatgaaacaggcagcatcaagccaggagtgattggaggcagcaagcccaaggtggccacccccaaggtggtggacaagattgctgagtacaagaggcagaaccccaccatgtttgcctgggagatccgggaccggctgctggccgagggcatctgtgacaatgacacagtgcccagcgtgagcagcatcaaccgcatcatccgcaccaaggtgcagcagcccttccaccccaccccagatggagctggcaccggggtgacagcccctggccacaccatcgtgcccagcacagccagcccccctgtgagcagcgccagcaatgaccctgtgggcagctacagcatcaatggcatcctgggcatccccaggagcaatggagagaagaggaagagagatgaggtggaggtgtacacagatcctgcccacatccggggcggcggcggcctgcacctggtgtggaccctgagagatgtgtctgagggctctgtgcccaatggagacagccagagcggcgtggacagcctgaggaagcacctgcgggctgacaccttcacccagcagcagctggaggccctggacagagtgtttgagcggcccagctacccagatgtgttccaggccagcgagcacatcaagtctgagcagggcaatgagtacagcctgcctgccctgaccccaggcctggatgaggtgaagagcagcctgagcgccagcaccaaccctgagctgggcagcaatgtgtctggcacccagacctaccctgtggtgacaggccgggacatggccagcaccaccctgcccggctacccaccccacgtgccccccaccggccagggcagctaccccaccagcaccctggccggcatggtgcccggcagcgagttcagcggcaacccctacagccacccccagtacacagcctacaatgaggcctggaggttcagcaacccagccctgctgagcagcccctactactacagcgctgccccccggggcagcgccccagctgctgctgctgctgcctatgacagacactag

SEQ ID NO: 163073 - DNA, 621 bp, Artificial Sequence
  Description of Artificial Sequence: Synthetic coding sequence
atgaccaccctggccggggctgtgcccaggatgatgaggcctggccctggccagaactaccccaggagcggcttccccctggaggtgtccacccccctgggccagggccgggtgaaccagctgggcggcgtcttcatcaatggccggcccctgcccaaccacatccgccacaagatcgtggagatggcccaccacggcatccggccctgcgtcatcagccggcagctgcgggtgagccacggctgtgtgtccaagatcctgtgccgctaccaggagaccggcagcatccggcctggggccatcggcggcagcaagcccaagcaggtgaccaccccagatgtggagaagaagattgaggagtacaagcgggagaaccctggcatgttctcctgggagatccgggacaagctgctgaaggatgctgtgtgtgacaggaacacagtgcccagcgtgagcagcatcagccgcatcctgcggagcaagtttgggaagggggaggaggaggaggccgacctggagaggaaggaggccgaggagagcgagaagaaggccaagcacagcattgatggcatcctgtctgagcggggcaaggccctggtgtctggagtgagcagccactag

SEQ ID NO: 163074 - DNA, 1224 bp, Artificial Sequence
  Description of Artificial Sequence: Synthetic coding sequence
atgaccaccctggccggggctgtgcccaggatgatgaggcctggccctggccagaactaccccaggagcggcttccccctggaggtgtccacccccctgggccagggccgggtgaaccagctgggcggcgtcttcatcaatggccggcccctgcccaaccacatccgccacaagatcgtggagatggcccaccacggcatccggccctgcgtcatcagccggcagctgcgggtgagccacggctgtgtgtccaagatcctgtgccgctaccaggagaccggcagcatccggcctggggccatcggcggcagcaagcccaagcaggtgaccaccccagatgtggagaagaagattgaggagtacaagcgggagaaccctggcatgttctcctgggagatccgggacaagctgctgaaggatgctgtgtgtgacaggaacacagtgcccagcgtgagcagcatcagccgcatcctgcggagcaagtttgggaagggggaggaggaggaggccgacctggagaggaaggaggccgaggagagcgagaagaaggccaagcacagcattgatggcatcctgtctgagcgggccagcgccccccagagtgatgagggcagtgacattgattctgagccagacctgcccctgaagaggaagcagaggaggagcaggaccaccttcaccgctgagcagctggaggagctggagcgggcctttgagaggacccactacccagacatctacacccgggaggagctggcccagagggccaagctgacagaggcccgggtgcaggtgtggttcagcaacagaagagcccgctggaggaagcaggccggggccaaccagctgatggccttcaaccacctgatccctgggggcttccccccaacagccatgcccaccctgcccacctaccagctgtctgagaccagctaccagcccaccagcatcccccaggccgtgtctgaccccagcagcacagtgcaccggccccagcccctgccccccagcacagtgcaccagagcaccatccccagcaacccagacagcagcagcgcctactgcctgcccagcaccaggcatggcttcagcagctacacagacagctttgtgccccccagcggccccagcaaccccatgaaccccaccatcggaaatggcctgagcccccaggtgcccttcatcatcagcagccagatcagcctgggcttcaagagcttctag

SEQ ID NO: 163075 - DNA, 1212 bp, Artificial Sequence
  Description of Artificial Sequence: Synthetic coding sequence
atgaccaccctggccggggctgtgcccaggatgatgaggcctggccctggccagaactaccccaggagcggcttccccctggaggtgtccacccccctgggccagggccgggtgaaccagctgggcggcgtcttcatcaatggccggcccctgcccaaccacatccgccacaagatcgtggagatggcccaccacggcatccggccctgcgtcatcagccggcagctgcgggtgagccacggctgtgtgtccaagatcctgtgccgctaccaggagaccggcagcatccggcctggggccatcggcggcagcaagcccaagcaggtgaccaccccagatgtggagaagaagattgaggagtacaagcgggagaaccctggcatgttctcctgggagatccgggacaagctgctgaaggatgctgtgtgtgacaggaacacagtgcccagcgtgagcagcatcagccgcatcctgcggagcaagtttgggaagggggaggaggaggaggccgacctggagaggaaggaggccgaggagagcgagaagaaggccaagcacagcattgatggcatcctgtctgagcgggccagcgccccccagagtgatgagggcagtgacattgattctgagccagacctgcccctgaagaggaagcagaggaggagcaggaccaccttcaccgctgagcagctggaggagctggagcgggcctttgagaggacccactacccagacatctacacccgggaggagctggcccagagggccaagctgacagaggcccgggtgcaggtgtggttcagcaacagaagagcccgctggaggaagcaggccggggccaaccagctgatggccttcaaccacctgatccctgggggcttccccccaacagccatgcccaccctgcccacctaccagctgtctgagaccagctaccagcccaccagcatcccccaggccgtgtctgaccccagcagcacagtgcaccggccccagcccctgccccccagcacagtgcaccagagcaccatccccagcaacccagacagcagcagcgcctactgcctgcccagcaccaggcatggcttcagcagctacacagacagctttgtgccccccagcggccccagcaaccccatgaaccccaccatcggaaatggcctgagcccccaggtgcccttcatcatcagcagccagatcagcaggaagtag

SEQ ID NO: 163076 - DNA, 1440 bp, Artificial Sequence
  Description of Artificial Sequence: Synthetic coding sequence
atgaccaccctggccggggctgtgcccaggatgatgaggcctggccctggccagaactaccccaggagcggcttccccctggaggtgtccacccccctgggccagggccgggtgaaccagctgggcggcgtcttcatcaatggccggcccctgcccaaccacatccgccacaagatcgtggagatggcccaccacggcatccggccctgcgtcatcagccggcagctgcgggtgagccacggctgtgtgtccaagatcctgtgccgctaccaggagaccggcagcatccggcctggggccatcggcggcagcaagcccaagcaggtgaccaccccagatgtggagaagaagattgaggagtacaagcgggagaaccctggcatgttctcctgggagatccgggacaagctgctgaaggatgctgtgtgtgacaggaacacagtgcccagcgtgagcagcatcagccgcatcctgcggagcaagtttgggaagggggaggaggaggaggccgacctggagaggaaggaggccgaggagagcgagaagaaggccaagcacagcattgatggcatcctgtctgagcgggccagcgccccccagagtgatgagggcagtgacattgattctgagccagacctgcccctgaagaggaagcagaggaggagcaggaccaccttcaccgctgagcagctggaggagctggagcgggcctttgagaggacccactacccagacatctacacccgggaggagctggcccagagggccaagctgacagaggcccgggtgcaggtgtggttcagcaacagaagagcccgctggaggaagcaggccggggccaaccagctgatggccttcaaccacctgatccctgggggcttccccccaacagccatgcccaccctgcccacctaccagctgtctgagaccagctaccagcccaccagcatcccccaggccgtgtctgaccccagcagcacagtgcaccggccccagcccctgccccccagcacagtgcaccagagcaccatccccagcaacccagacagcagcagcgcctactgcctgcccagcaccaggcatggcttcagcagctacacagacagctttgtgccccccagcggccccagcaaccccatgaaccccaccatcggaaatggcctgagcccccaggtgatgggcctgctgaccaaccacggcggcgtgccccaccagccccagacagattatgccctgagccccctgaccggcggcctggagcccaccaccaccgtgtctgccagctgcagccagaggctggaccacatgaagagcctggacagcctgcccaccagccagagctactgcccccccacctacagcaccaccggctacagcatggaccctgtgacaggctaccagtatggccagtatggccagagcaagccctggaccttctag

SEQ ID NO: 163077 - DNA, 1518 bp, Artificial Sequence
  Description of Artificial Sequence: Synthetic coding sequence
atgaccaccctggccggggctgtgcccaggatgatgaggcctggccctggccagaactaccccaggagcggcttccccctggaggtgtccacccccctgggccagggccgggtgaaccagctgggcggcgtcttcatcaatggccggcccctgcccaaccacatccgccacaagatcgtggagatggcccaccacggcatccggccctgcgtcatcagccggcagctgcgggtgagccacggctgtgtgtccaagatcctgtgccgctaccaggagaccggcagcatccggcctggggccatcggcggcagcaagcccaagcaggtgaccaccccagatgtggagaagaagattgaggagtacaagcgggagaaccctggcatgttctcctgggagatccgggacaagctgctgaaggatgctgtgtgtgacaggaacacagtgcccagcgtgagcagcatcagccgcatcctgcggagcaagtttgggaagggggaggaggaggaggccgacctggagaggaaggaggccgaggagagcgagaagaaggccaagcacagcattgatggcatcctgtctgagcgggccagcgccccccagagtgatgagggcagtgacattgattctgagccagacctgcccctgaagaggaagcagaggaggagcaggaccaccttcaccgctgagcagctggaggagctggagcgggcctttgagaggacccactacccagacatctacacccgggaggagctggcccagagggccaagctgacagaggcccgggtgcaggtgtggttcagcaacagaagagcccgctggaggaagcaggccggggccaaccagctgatggccttcaaccacctgatccctgggggcttccccccaacagccatgcccaccctgcccacctaccagctgtctgagaccagctaccagcccaccagcatcccccaggccgtgtctgaccccagcagcacagtgcaccggccccagcccctgccccccagcacagtgcaccagagcaccatccccagcaacccagacagcagcagcgcctactgcctgcccagcaccaggcatggcttcagcagctacacagacagctttgtgccccccagcggccccagcaaccccatgaaccccaccatcggaaatggcctgagcccccaggtgatgggcctgctgaccaaccacggcggcgtgccccaccagccccagacagattatgccctgagccccctgaccggcggcctggagcccaccaccaccgtgtctgccagctgcagccagaggctggaccacatgaagagcctggacagcctgcccaccagccagagctactgcccccccacctacagcaccaccggctacagcatggaccctgtgacaggctaccagtatggccagtatggccagagcgccttccactacctgaagccagacatcgcctggttccagatcctgctgaacacctttgacaagagcagtggagaggaggaggacctggagcagtag

SEQ ID NO: 163078 - DNA, 1455 bp, Artificial Sequence
  Description of Artificial Sequence: Synthetic coding sequence
atgaccaccctggccggggctgtgcccaggatgatgaggcctggccctggccagaactaccccaggagcggcttccccctggaggtgtccacccccctgggccagggccgggtgaaccagctgggcggcgtcttcatcaatggccggcccctgcccaaccacatccgccacaagatcgtggagatggcccaccacggcatccggccctgcgtcatcagccggcagctgcgggtgagccacggctgtgtgtccaagatcctgtgccgctaccaggagaccggcagcatccggcctggggccatcggcggcagcaagcccaagcaggtgaccaccccagatgtggagaagaagattgaggagtacaagcgggagaaccctggcatgttctcctgggagatccgggacaagctgctgaaggatgctgtgtgtgacaggaacacagtgcccagcgtgagcagcatcagccgcatcctgcggagcaagtttgggaagggggaggaggaggaggccgacctggagaggaaggaggccgaggagagcgagaagaaggccaagcacagcattgatggcatcctgtctgagcgggccagcgccccccagagtgatgagggcagtgacattgattctgagccagacctgcccctgaagaggaagcagaggaggagcaggaccaccttcaccgctgagcagctggaggagctggagcgggcctttgagaggacccactacccagacatctacacccgggaggagctggcccagagggccaagctgacagaggcccgggtgcaggtgtggttcagcaacagaagagcccgctggaggaagcaggccggggccaaccagctgatggccttcaaccacctgatccctgggggcttccccccaacagccatgcccaccctgcccacctaccagctgtctgagaccagctaccagcccaccagcatcccccaggccgtgtctgaccccagcagcacagtgcaccggccccagcccctgccccccagcacagtgcaccagagcaccatccccagcaacccagacagcagcagcgcctactgcctgcccagcaccaggcatggcttcagcagctacacagacagctttgtgccccccagcggccccagcaaccccatgaaccccaccatcggaaatggcctgagcccccaggtgatgggcctgctgaccaaccacggcggcgtgccccaccagccccagacagattatgccctgagccccctgaccggcggcctggagcccaccaccaccgtgtctgccagctgcagccagaggctggaccacatgaagagcctggacagcctgcccaccagccagagctactgcccccccacctacagcaccaccggctacagcatggaccctgtgacaggctaccagtatggccagtatggccagagcgccttccactacctgaagccagacatcgcctag

SEQ ID NO: 163079 - DNA, 1452 bp, Artificial Sequence
  Description of Artificial Sequence: Synthetic coding sequence
atgaccaccctggccggggctgtgcccaggatgatgaggcctggccctggccagaactaccccaggagcggcttccccctggaggtgtccacccccctgggccagggccgggtgaaccagctgggcggcgtcttcatcaatggccggcccctgcccaaccacatccgccacaagatcgtggagatggcccaccacggcatccggccctgcgtcatcagccggcagctgcgggtgagccacggctgtgtgtccaagatcctgtgccgctaccaggagaccggcagcatccggcctggggccatcggcggcagcaagcccaaggtgaccaccccagatgtggagaagaagattgaggagtacaagagagaaaatcctggcatgttctcctgggagatccgggacaagctgctgaaggatgctgtgtgtgacaggaacacagtgcccagcgtgagcagcatcagccgcatcctgcggagcaagtttggaaaaggagaggaggaggaggccgacctggagaggaaggaggccgaggagagcgagaagaaggccaagcacagcattgatggcatcctgtctgagcgggccagcgccccccagagtgatgagggcagtgacatcgacagcgagccagacctgcccctgaagaggaagcagaggaggagcaggaccaccttcaccgctgagcagctggaggagctggagcgggcctttgagaggacccactacccagacatctacacccgggaggagctggcccagagggccaagctgacagaggcccgggtgcaggtgtggttcagcaacagaagagcccgctggaggaagcaggccggggccaaccagctgatggccttcaaccacctgatccctgggggcttccccccaacagccatgcccaccctgcccacctaccagctgtctgagaccagctaccagcccaccagcatcccccaggccgtgtctgaccccagcagcacagtgcaccggccccagcccctgccccccagcacagtgcaccagagcaccatccccagcaacccagacagcagcagcgcctactgcctgcccagcaccaggcatggcttcagcagctacacagacagctttgtgcccccatctggccccagcaaccccatgaaccccaccatcggaaatggcctgagcccccaggtgatgggcctgctgaccaaccacggcggcgtgccccaccagccccagacagattatgccctgagccccctgactggaggcctggagcccaccaccaccgtgtctgccagctgcagccagaggctggaccacatgaagagcctggacagcctgcccaccagccagagctactgcccccccacctacagcaccaccggctacagcatggaccctgtgacaggctaccagtatggccagtatggccagagcgccttccactacctgaagccagacatcgcctag

SEQ ID NO: 163080 - DNA, 648 bp, Artificial Sequence
  Description of Artificial Sequence: Synthetic coding sequence
atgaccaccctggccggggctgtgcccaggatgatgaggcctggccctggccagaactaccccaggagcggcttccccctggaggtgtccacccccctgggccagggccgggtgaaccagctgggcggcgtcttcatcaatggccggcccctgcccaaccacatccgccacaagatcgtggagatggcccaccacggcatccggccctgcgtcatcagccggcagctgcgggtgagccacggctgtgtgtccaagatcctgtgccgctaccaggagaccggcagcatccggcctggggccatcggcggcagcaagcccaagcaggtgaccaccccagatgtggagaagaagattgaggagtacaagcgggagaaccctggcatgttctcctgggagatccgggacaagctgctgaaggatgctgtgtgtgacaggaacacagtgcccagcgtgagcagcatcagccgcatcctgcggagcaagtttgggaagggggaggaggaggaggccgacctggagaggaaggaggccgaggagagcgagaagaaggccaagcacagcattgatggcatcctgtctgagcggggcaagcgctggaggctgggccgccgcacctgctgggtgacctggagggccagcgccagctag

SEQ ID NO: 163081 - DNA, 822 bp, Artificial Sequence
  Description of Artificial Sequence: Synthetic coding sequence
atgcaccaggacggcatcagctccatgaaccagctgggcggcctgtttgtgaatggccggcccctgcccctggacacccggcagcagatcgtgcggctggccgtgtctggcatgaggccctgtgacatcagccgcatcctgaaggtgtccaatggctgtgtgtccaagatcctgggccgctactacagaactggagtgctggagcccaagggcatcggcggcagcaagccccggctggccaccccacctgtggtggcccgcatcgcccagctgaagggggagtgcccagccctgtttgcctgggagatccagaggcagctgtgtgccgagggcctgtgcacccaggacaagacccccagcgtgagcagcatcaacagagtgctgcgggccctgcaggaggaccagggcctgccctgcacccggctgcggagccctgctgtgctggccccagctgtgctgaccccccacagcggcagcgagaccccccggggcacccaccctggcaccggccacaggaacagaaccatcttcagccccagccaggccgaggccctggagaaggagttccagaggggccagtacccagattctgtggcccggggcaagctggccacagccaccagcctgcctgaagatactgtgcgggtgtggttcagcaacagaagagccaagtggaggcggcaggagaagctgaagtgggagatgcagctgcctgctgtgccctggcagtgtgcccacagcagccctgcctgccccggcaccaccggcagcctgctgctgtctgctgtgctgggcaacagcaccaggaaggtgtctgagtag

SEQ ID NO: 163082 - DNA, 1032 bp, Artificial Sequence
  Description of Artificial Sequence: Synthetic coding sequence
atgaaccagctgggcggcctgtttgtgaatggccggcccctgcccctggacacccggcagcagatcgtgcggctggccgtgtctggcatgaggccctgtgacatcagccgcatcctgaaggtgtccaatggctgtgtgtccaagatcctgggccgctactacagaactggagtgctggagcccaagggcatcggcggcagcaagccccggctggccaccccacctgtggtggcccgcatcgcccagctgaagggggagtgcccagccctgtttgcctgggagatccagaggcagctgtgtgccgagggcctgtgcacccaggacaagacccccagcgtgagcagcatcaacagagtgctgcgggccctgcaggaggaccagggcctgccctgcacccggctgcggagccctgctgtgctggccccagctgtgctgaccccccacagcggcagcgagaccccccggggcacccaccctggcaccggccacaggaacagaaccatcttcagccccagccaggccgaggccctggagaaggagttccagaggggccagtacccagattctgtggcccggggcaagctggccacagccaccagcctgcctgaagatactgtgcgggtgtggttcagcaacagaagagccaagtggaggcggcaggagaagctgaagtgggagatgcagctgcccggggccagccagggcctgactgtgccccgggtggcccctggcatcatcagcgcccagcagagccctggctctgtgcccacagctgccctgcctgccctggagcccctgggccccagctgctaccagctgtgctgggccacagcccctgagcgctgcctgagtgacaccccacccaaggcctgcctgaagccctgctggggccacctgcccccccagcccaacagcctggacagcggcctgctgtgcctgccctgccccagcagccactgccacctggccagcctgagcggcagccaggccctgctgtggccaggctgccccctgctgtatggcctggagtag

SEQ ID NO: 163083 - DNA, 1047 bp, Artificial Sequence
  Description of Artificial Sequence: Synthetic coding sequence
atgcaccaggacggcatcagctccatgaaccagctgggcggcctgtttgtgaatggccggcccctgcccctggacacccggcagcagatcgtgcggctggccgtgtctggcatgaggccctgtgacatcagccgcatcctgaaggtgtccaatggctgtgtgtccaagatcctgggccgctactacagaactggagtgctggagcccaagggcatcggcggcagcaagccccggctggccaccccacctgtggtggcccgcatcgcccagctgaagggggagtgcccagccctgtttgcctgggagatccagaggcagctgtgtgccgagggcctgtgcacccaggacaagacccccagcgtgagcagcatcaacagagtgctgcgggccctgcaggaggaccagggcctgccctgcacccggctgcggagccctgctgtgctggccccagctgtgctgaccccccacagcggcagcgagaccccccggggcacccaccctggcaccggccacaggaacagaaccatcttcagccccagccaggccgaggccctggagaaggagttccagaggggccagtacccagattctgtggcccggggcaagctggccacagccaccagcctgcctgaagatactgtgcgggtgtggttcagcaacagaagagccaagtggaggcggcaggagaagctgaagtgggagatgcagctgcccggggccagccagggcctgactgtgccccgggtggcccctggcatcatcagcgcccagcagagccctggctctgtgcccacagctgccctgcctgccctggagcccctgggccccagctgctaccagctgtgctgggccacagcccctgagcgctgcctgagtgacaccccacccaaggcctgcctgaagccctgctgggactgtggcagcttcctgctgcccgtcatcgcccccagctgtgtggatgtggcctggccctgcctggatgccagcctggcccaccacctgattggaggagctgggaaggccacccccacccacttcagccactag

SEQ ID NO: 163084 - DNA, 1563 bp, Artificial Sequence
  Description of Artificial Sequence: Synthetic coding sequence
atggccgccctgcccggcaccgtgcccaggatgatgaggcctgcccctggccagaactaccccaggacaggcttccccctggaggtgtccacccccctgggccagggccgggtgaaccagctgggcggcgtcttcatcaatggccggcccctgcccaaccacatccgccacaagatcgtggagatggcccaccacggcatccggccctgcgtcatcagccggcagctgcgggtgagccacggctgtgtgtccaagatcctgtgccgctaccaggagaccggcagcatccggcctggggccatcggcggcagcaagccccggcaggtggccaccccagatgtggagaagaagattgaggagtacaagcgggagaaccctggcatgttctcctgggagatccgggaccggctgctgaaggatggccactgtgacaggagcacagtgcccagcggcctggtgagcagcatcagccgggtgctgcgcatcaagtttgggaagaaggaggaggaggatgaagctgacaagaaggaggatgatggagagaagaaggccaagcacagcattgatggcatcctgggggacaagggcaaccggctggatgagggcagtgatgtggagagcgagccagacctgcccctgaagaggaagcagaggaggagcaggaccaccttcaccgctgagcagctggaggagctggagaaggcctttgagaggacccactacccagacatctacacccgggaggagctggcccagaggaccaagctgacagaggcccgggtgcaggtgtggttcagcaacagaagagcccgctggaggaagcaggccggggccaaccagctggccgccttcaaccacctgctgcccggcggcttccccccaacaggcatgcccaccctgcccccctaccagctgcctgacagcacctaccccaccaccaccatcagccaggacggcggcagcacagtgcaccggccccagcccctgccccccagcaccatgcaccagggcggcctggccgctgctgctgctgctgctgacaccagcagcgcctacggggcccggcacagcttcagcagctacagcgacagcttcatgaacccagctgcccccagcaaccacatgaaccctgtgtccaatggcctgagcccccaggtgatgagcatcctgggcaaccccagcgctgtgcccccccagccccaggccgacttcagcatcagccccctgcacggcggcctggacagcgccaccagcatcagcgccagctgcagccagagagctgacagcatcaagccaggggacagcctgcccaccagccaggcctactgcccccccacctacagcaccaccggctacagcgtggaccctgtggccggctaccagtatggccagtatggccagagtgaatgtctggtgccctgggccagccctgtgcccatccccagccccaccccccgggccagctgcctcttcatggagagctacaaggtggtgtctggctggggcatgagcatcagccagatggagaagctgaagagcagccagatggagcagttcacctag

SEQ ID NO: 163085 - DNA, 1557 bp, Artificial Sequence
  Description of Artificial Sequence: Synthetic coding sequence
atggccgccctgcccggcaccgtgcccaggatgatgaggcctgcccctggccagaactaccccaggacaggcttccccctggaggtgtccacccccctgggccagggccgggtgaaccagctgggcggcgtcttcatcaatggccggcccctgcccaaccacatccgccacaagatcgtggagatggcccaccacggcatccggccctgcgtcatcagccggcagctgcgggtgagccacggctgtgtgtccaagatcctgtgccgctaccaggagaccggcagcatccggcctggggccatcggcggcagcaagccccggcaggtggccaccccagatgtggagaagaagattgaggagtacaagcgggagaaccctggcatgttctcctgggagatccgggaccggctgctgaaggatggccactgtgacaggagcacagtgcccagcgtgagcagcatcagccgggtgctgcgcatcaagtttgggaagaaggaggaggaggatgaagctgacaagaaggaggatgatggagagaagaaggccaagcacagcattgatggcatcctgggggacaagggcaaccggctggatgagggcagtgatgtggagagcgagccagacctgcccctgaagaggaagcagaggaggagcaggaccaccttcaccgctgagcagctggaggagctggagaaggcctttgagaggacccactacccagacatctacacccgggaggagctggcccagaggaccaagctgacagaggcccgggtgcaggtgtggttcagcaacagaagagcccgctggaggaagcaggccggggccaaccagctggccgccttcaaccacctgctgcccggcggcttccccccaacaggcatgcccaccctgcccccctaccagctgcctgacagcacctaccccaccaccaccatcagccaggacggcggcagcacagtgcaccggccccagcccctgccccccagcaccatgcaccagggcggcctggccgctgctgctgctgctgctgacaccagcagcgcctacggggcccggcacagcttcagcagctacagcgacagcttcatgaacccagctgcccccagcaaccacatgaaccctgtgtccaatggcctgagcccccaggtgatgagcatcctgggcaaccccagcgctgtgcccccccagccccaggccgacttcagcatcagccccctgcacggcggcctggacagcgccaccagcatcagcgccagctgcagccagagagctgacagcatcaagccaggggacagcctgcccaccagccaggcctactgcccccccacctacagcaccaccggctacagcgtggaccctgtggccggctaccagtatggccagtatggccagagtgaatgtctggtgccctgggccagccctgtgcccatccccagccccaccccccgggccagctgcctcttcatggagagctacaaggtggtgtctggctggggcatgagcatcagccagatggagaagctgaagagcagccagatggagcagttcacctag

SEQ ID NO: 163086 - DNA, 1518 bp, Artificial Sequence
  Description of Artificial Sequence: Synthetic coding sequence
atggccgccctgcccggcaccgtgcccaggatgatgaggcctgcccctggccagaactaccccaggacaggcttccccctggaggtgtccacccccctgggccagggccgggtgaaccagctgggcggcgtcttcatcaatggccggcccctgcccaaccacatccgccacaagatcgtggagatggcccaccacggcatccggccctgcgtcatcagccggcagctgcgggtgagccacggctgtgtgtccaagatcctgtgccgctaccaggagaccggcagcatccggcctggggccatcggcggcagcaagccccggcaggtggccaccccagatgtggagaagaagattgaggagtacaagcgggagaaccctggcatgttctcctgggagatccgggaccggctgctgaaggatggccactgtgacaggagcacagtgcccagcggcctggtgagcagcatcagccgggtgctgcgcatcaagtttgggaagaaggaggaggaggatgaagctgacaagaaggaggatgatggagagaagaaggccaagcacagcattgatggcatcctgggggacaagggcaaccggctggatgagggcagtgatgtggagagcgagccagacctgcccctgaagaggaagcagaggaggagcaggaccaccttcaccgctgagcagctggaggagctggagaaggcctttgagaggacccactacccagacatctacacccgggaggagctggcccagaggaccaagctgacagaggcccgggtgcaggtgtggttcagcaacagaagagcccgctggaggaagcaggccggggccaaccagctggccgccttcaaccacctgctgcccggcggcttccccccaacaggcatgcccaccctgcccccctaccagctgcctgacagcacctaccccaccaccaccatcagccaggacggcggcagcacagtgcaccggccccagcccctgccccccagcaccatgcaccagggcggcctggccgctgctgctgctgctgctgacaccagcagcgcctacggggcccggcacagcttcagcagctacagcgacagcttcatgaacccagctgcccccagcaaccacatgaaccctgtgtccaatggcctgagcccccaggtgatgagcatcctgggcaaccccagcgctgtgcccccccagccccaggccgacttcagcatcagccccctgcacggcggcctggacagcgccaccagcatcagcgccagctgcagccagagagctgacagcatcaagccaggggacagcctgcccaccagccaggcctactgcccccccacctacagcaccaccggctacagcgtggaccctgtggccggctaccagtatggccagtatggccagacagctgtggactacctggccaagaatgtgtccctgagcacccagaggaggatgaagctgggggagcacagcgctgtgctgggcctgctgcctgtggagaccggccaggcctactag

SEQ ID NO: 163087 - DNA, 1026 bp, Artificial Sequence
  Description of Artificial Sequence: Synthetic coding sequence
atggagcccgcctttggagaggtgaaccagctgggcggcgtgtttgtgaatggccggcccctgcccaatgccatccggctgagaattgtggagctggcccagctgggcatccggccctgtgacatcagccggcagctgcgggtgagccacggctgtgtgtccaagatcctggcccgctacaatgaaacaggcagcatcctgcccggggccatcggcggcagcaagccccgggtgaccacccccaccgtggtgaagcacatccgcacctacaagcagagggaccccggcatctttgcctgggagatccgggaccggctgctggctgatggagtgtgtgacaagtacaacgtgcccagcgtgagcagcatcagccgcatcctgaggaacaagattggcaacctggcccagcagggccactatgacagctacaagcagcaccagcccaccccccagcctgccctgccctacaaccacatctacagctaccccagccccatcacagctgctgctgccaaggtgcccaccccacctggggtgcctgccatccctggctctgtggccatgcccaggacctggcccagcagccacagcgtgacagacatcctgggcatccgcagcatcacagaccaggtgtctgacagcagcccctaccacagccccaaggtggaggagtggagcagcctgggcaggaacaacttccctgctgctgcccctcatgctgtgaatggcctggagaagggggccctggagcaggaggccaagtatggccaggcccccaacggcctgcctgctgtgggcagctttgtgtctgccagctccatggccccctaccccaccccagcccaggtgagcccctacatgacctacagcgctgcccccagcggctacgtggccggccacggctggcagcacgccggcggcaccagcctgagcccccacaactgtgacatcccagccagcctggccttcaagggcatgcaggccgcccgggagggcagccacagcgtgacagccagcgccctgtag

SEQ ID NO: 163088 - DNA, 1026 bp, Artificial Sequence; identical to SEQ ID NO: 163087
  Description of Artificial Sequence: Synthetic coding sequence

SEQ ID NO: 163089 - DNA, 183 bp, Artificial Sequence
  Description of Artificial Sequence: Synthetic coding sequence
agtgacagcagcccctaccacagccccaaggtggaggagtggagcagcctgggcaggaacaacttccctgctgctgcccctcatgctgtgaatggcctggagaagggggccctggagcaggaggccaagtatggccagatccagaacttcttcctgctgatgatcagccggctgaagttctag

SEQ ID NO: 163090 - DNA, 912 bp, Artificial Sequence
  Description of Artificial Sequence: Synthetic coding sequence
atgggccggcccctgctgctgcccctgctgcccctgctgctgcccccagccttcctgcagcccagcggcagcactggaagtggccccagctacctgtatggagtgacccagcccaagcacctgagcgcctccatgggcggctctgtggagatccccttctccttctactacccctgggagctggccacagccccagatgtgcgcatctcctggaggcggggccacttccaccggcagagcttctacagcacccggccccccagcatccacaaggactatgtgaacagactcttcctgaactggacagagggccagaagagcggcttcctgcgcatcagcaacctgcagaagcaggaccagagcgtgtacttctgccgggtggagctggacaccaggagcagcggccggcagcagtggcagagcattgagggcaccaagctgagcatcacccaggccgtgaccaccaccacccagaggcccagctccatgaccaccacctggaggctgagcagcaccaccaccaccaccggcctgcgggtgacccagggcaagagaagaagtgacagctggcacatcagcctggagacagctgtgggcgtggccgtggccgtgacagtgctgggcatcatgatcctgggcctcatctgcctgctgcgctggaggaggaggaagggccagcagaggaccaaggccaccaccccagcccgggagcccttccagaacacagaggagccctatgagaacatcagaaatgaaggccagaacacagaccccaagctgaaccccaaggatgatggcatcgtgtatgccagcctggccctgagcagcagcaccagcccccgggccccacccagccaccggcccctgaagagcccccagaatgagaccctgtacagcgtgctgaaggcctag

SEQ ID NO: 163091 - DNA, 693 bp, Artificial Sequence
  Description of Artificial Sequence: Synthetic coding sequence
atgggccggcccctgctgctgcccctgctgcccctgctgctgcccccagccttcctgcagcccagcggcagcactggaagtggccccagctacctgtatggagtgacccagcccaagcacctgagcgcctccatgggcggctctgtggagatccccttctccttctactacccctgggagctggccacagccccagatgtgcgcatctcctggaggcggggccacttccaccggcagagcttctacagcacccggccccccagcatccacaaggactatgtgaacagactcttcctgaactggacagagggccagaagagcggcttcctgcgcatcagcaacctgcagaagcaggaccagagcgtgtacttctgccgggtggagctggacaccaggagcagcggccggcagcagtggcagagcattgagggcaccaagctgagcatcacccagggccagcagaggaccaaggccaccaccccagcccgggagcccttccagaacacagaggagccctatgagaacatcagaaatgaaggccagaacacagaccccaagctgaaccccaaggatgatggcatcgtgtatgccagcctggccctgagcagcagcaccagcccccgggccccacccagccaccggcccctgaagagcccccagaatgagaccctgtacagcgtgctgaaggcctag

SEQ ID NO: 163092 - DNA, 528 bp, Artificial Sequence
  Description of Artificial Sequence: Synthetic coding sequence
atgggccggcccctgctgctgcccctgctgcccctgctgctgcccccagccttcctgcagcccagcggcagcactggaagtggccccagctacctgtatggagtgacccagcccaagcacctgagcgcctccatgggcggctctgtggagatccccttctccttctactacccctgggagctggccacagccccagatgtgcgcatctcctggaggcggggccacttccaccggcagagcttctacagcacccggccccccagcatccacaaggactatgtgaacagactcttcctgaactggacagagggccagaagagcggcttcctgcgcatcagcaacctgcagaagcaggaccagagcgtgtacttctgccgggtggagctggacaccaggagcagcggccggcagcagtggcagagcattgagggcaccaagctgagcatcacccagggcaaccccagcaagacccagaggagccacatgaggatcagcggcatgaaggacaagatccagatccccagctag

SEQ ID NO: 163093 - DNA, 492 bp, Artificial Sequence
  Description of Artificial Sequence: Synthetic coding sequence
atgggccggcccctgctgctgcccctgctgcccctgctgctgcccccagccttcctgcagcccagcggcagcactggaagtggccccagctacctgtatggagtgacccagcccaagcacctgagcgcctccatgggcggctctgtggagatccccttctccttctactacccctgggagctggccacagccccagatgtgcgcatctcctggaggcggggccacttccaccggcagagcttctacagcacccggccccccagcatccacaaggactatgtgaacagactcttcctgaactggacagagggccagaagagcggcttcctgcgcatcagcaacctgcagaagcaggaccagagcgtgtacttctgccgggtggagctggacaccaggagcagcggccggcagcagtggcagagcattgagggcaccaagctgagcatcacccagggccagcagaggaccaaggccaccaccccagccaggtag

SEQ ID NO: 163094 - DNA, 684 bp, Artificial Sequence
  Description of Artificial Sequence: Synthetic coding sequence
atgggccggcccctgctgctgcccctgctgctgctgctgcagcccccagccttcctgcagcccggcggcagcactggaagtggccccagctacctgtatggagtgacccagcccaagcacctgagcgcctccatgggcggctctgtggagatccccttctccttctactacccctgggagctggccatcgtgcccaacgtgcgcatctcctggaggcggggccacttccacggccagagcttctacagcacccggccccccagcatccacaaggactatgtgaacagactcttcctgaactggacagagggccaggagagcggcttcctgcgcatcagcaacctgaggaaggaggaccagagcgtgtacttctgccgggtggagctggacacccggcgcagcggccggcagcagctgcagagcatcaagggcaccaagctgaccatcacccaggccgtgaccaccaccaccacctggaggcccagcagcaccaccaccatcgccggcctgcgggtgacagagagcaagggccacagcgagagctggcacctgagcctggacacagccatccgggtggccctggccgtggccgtgctgaagacagtcatcctgggcctgctgtgcctgctgctgctgtggtggaggaggaggaagggcagccgggcccccagcagtgacttctag

SEQ ID NO: 163095 - DNA, 999 bp, Artificial Sequence
  Description of Artificial Sequence: Synthetic coding sequence
atgggccgggccagctatggaggcagccctgtgggccaccagagcagcagtgaccacccccgggccaagacctgccgcagccctgtgagagatggccccaggaccctgtgtggggtgcccaccgtggccctgagcctgcacttcctgcgggaggccagcagcggcagcaggacctgtggccgccgcaccagcctgtgcaccagcgccaagagctcctggacctacagaagtgccctgcggcagcccctgcaccgggcccccctgctgcccggccagctgtgctggagcccccggcccctggagaagaacaaggccatgggccggcccctgctgctgcccctgctgctgctgctgcagcccccagccttcctgcagcccggcggcagcacaggcagcggccccagctacctgtatggagtgacccagcccaagcacctgagcgcctccatgggcggctctgtggagatccccttctccttctactacccctgggagctggccatcgtgcccaacgtgcgcatctcctggaggcggggccacttccacggccagagcttctacagcaccaggcctccttccatccacaaggactatgtgaacagactcttcctgaactggacagagggccaggagagcggcttcctgcgcatcagcaacctgaggaaagaagaccagagcgtgtacttctgccgggtggagctggacaccaggagaagtggccggcagcagctgcagagcatcaagggcaccaagctgaccatcacccaggccgtgaccaccaccaccacctggaggcccagcagcaccaccaccatcgccggcctgcgggtgacagagagcaagggccacagcgagagctggcacctgagcctggacacagccatccgggtggccctggccgtggccgtgctgaagacagtcatcctgggcctgctgtgcctgctgctgctgtggtggaggaggaggaagggcagccgggcccccagcagtgacttctag

SEQ ID NO: 163096 - DNA, 384 bp, Artificial Sequence
  Description of Artificial Sequence: Synthetic coding sequence
atgggccggcccctgctgctgcccctgctgctgctgctgcagcccccagccttcctgcagcccggcggcagcactggaagtggccccagctacctgtatggagtgacccagcccaagcacctgagcgcctccatgggcggctctgtggagatccccttctccttctactacccctgggagctggccatcgtgcccaacgtgcgcatctcctggaggcggggccacttccacggccagagcttctacagcacccggccccccagcatccacaaggactatgtgaacagactcttcctgaactggacagagggccaggagagcggcttcctgcgcatcagcaacctgaggaaggaggaccagagcgtgtacttctgccgggtgtag

SEQ ID NO: 163097 - DNA, 684 bp, Artificial Sequence; identical to SEQ ID NO: 163094
  Description of Artificial Sequence: Synthetic coding sequence

SEQ ID NO: 163098 - DNA, 384 bp, Artificial Sequence; identical to SEQ ID NO: 163096
  Description of Artificial Sequence: Synthetic coding sequence

SEQ ID NO: 163099 - DNA, 183 bp, Artificial Sequence
  Description of Artificial Sequence: Synthetic coding sequence
atgggccggcccctgctgctgcccctgctgctgctgctgcagcccccagccttcctgcagcccggcctgtgtgagcccgccctgtctgagctggaccggggcagcggggagcggctgccccaggacctgaagccagctgagggcggccctgtgtgtgtgttcctgcccagcagagctggatag

SEQ ID NO: 163100 - DNA, 366 bp, Artificial Sequence
  Description of Artificial Sequence: Synthetic coding sequence
atgggccggcccctgctgctgcccctgctgctgctgctgcagcccccagccttcctgcagcccggcggcagcactggaagtggccccagctacctgtatggagtgacccagcccaagcacctgagcgcctccatgggcggctctgtggagatccccttctccttctactacccctgggagctggccatcgtgcccaacgtgcgcatctcctggaggcggggccacttccacggccagagcttctacagcacccggccccccagcatccacaaggactatgtgaacagactcttcctgaactggacagagggccaggagagcggcttcctgcgcatcagcaacctgaggaaggaggaccagagctag

SEQ ID NO: 163101 - DNA, 384 bp, Artificial Sequence; identical to SEQ ID NO: 163096
  Description of Artificial Sequence: Synthetic coding sequence

SEQ ID NO: 163102 - DNA, 684 bp, Artificial Sequence; identical to SEQ ID NO: 163094
  Description of Artificial Sequence: Synthetic coding sequence

SEQ ID NO: 163103 - DNA, 450 bp, Artificial Sequence
  Description of Artificial Sequence: Synthetic coding sequence
atgggccggcccctgctgctgcccctgctgctgctgctgcagcccccagccttcctgcagcccggcctgtgtgagcccgccctgtctgagctggaccggggcagcggggagcggctgccccaggacctgaagccagctgagggcggccctgtgtgtgtgttcctgcccagcagagctggccaccctgagatccgggaggccgctgtggccgtgcaccagggcgaccagacccaccaccaccctggctgccacaaccaccaccacctggaggcccagcagcacaaccaccacagccggccccagggccacaggaagcagagggccctgcgcatcatggcccccaagagcggccactgccaccagggctgcatcggctgccgctgtgcccagaactgccacttcggcacagctgtgcccccacctcctgtggtggaggagaaggagaggtag

SEQ ID NO: 163104 - DNA, 816 bp, Artificial Sequence
  Description of Artificial Sequence: Synthetic coding sequence
atgggccgggccagctatggaggcagccctgtgggccaccagagcagcagtgaccacccccgggccaagacctgccgcagccctgtgagagatggccccaggaccctgtgtggggtgcccaccgtggccctgagcctgcacttcctgcgggaggccagcagcggcagcaggacctgtggccgccgcaccagcctgtgcaccagcgccaagagctcctggacctacagaagtggccgcctgtcctggcagagcatcaagggcacccacctgaccatcacccaggccctgcggcagcccctgcaccgggcccccctgctgcccggccagctgtgctggagcccccggcccctggagaagaacaaggccatgggccggcccctgctgctgcccctgctgctgctgctgcagcccccagccttcctgcagcccggcctgtgtgagcccgccctgtctgagctggaccggggcagcggggagcggctgccccaggacctgaagccagctgagggcggccctgtgtgtgtgttcctgcccagcagagctggccaccctgagatccgggaggccgctgtggccgtgcaccagggcgaccagacccaccaccaccctggctgccacaaccaccaccacctggaggcccagcagcacaaccaccacagccggccccagggccacaggaagcagagggccctgcgcatcatggcccccaagagcggccactgccaccagggctgcatcggctgccgctgtgcccagaactgccacttcggcacagctgtgcccccacctcctgtggtggaggagaaggagaggtag

SEQ ID NO: 163105 - DNA, 684 bp, Artificial Sequence; identical to SEQ ID NO: 163094
  Description of Artificial Sequence: Synthetic coding sequence

SEQ ID NO: 163106 - DNA, 327 bp, Artificial Sequence
  Description of Artificial Sequence: Synthetic coding sequence
atgggccgggccagctatggaggcagccctgtgggccaccagagcagcagtgaccacccccgggccaagacctgccgcagccctgtgagagatggccccaggaccctgtgtggggtgcccaccgtggccctgagcctgcacttcctgcgggaggccagcagcggcagcaggacctgtggccgccgcaccagcctgtgcaccagcgccaagagctcctggacctacagaagtggccgcctgtcctggcagagcatcaagggcacccacctgaccatcacccaggccctgcggcagcccctgcaccgggcccccctgctgcctggatag

SEQ ID NO: 163107 - DNA, 384 bp, Artificial Sequence; identical to SEQ ID NO: 163096
  Description of Artificial Sequence: Synthetic coding sequence

SEQ ID NO: 163108 - DNA, 738 bp, Artificial Sequence
  Description of Artificial Sequence: Synthetic coding sequence
atgaccagcagctatggccacgtgctggagcggcagcctgccctgggcggccgcctggacagccctggcaacctggacaccctgcaggccaagaagaacttctctgtgagccacctgctggacctggaggaggccggggacatggtggccgcccaggctgatgaaaatgtgggggaggccggccgcagcctgctggagagccctggcctgaccagcggcagtgacaccccccagcaggacaatgaccagctgaacagcgaggagaagaagaagaggaagcagaggaggaacagaaccaccttcaacagcagccagctgcaggccctggagcgggtgtttgagaggacccactacccagatgcctttgtgcgggaggacctggccaggagagtgaacctgacagaggcccgggtgcaggtgtggttccagaacagaagagccaagttcagaagaaatgaaagagccatgctggccaacaagaatgccagcctgctgaagagctacagcggagatgtgacagctgtggagcagcccatcgtgcccaggcctgccccccggcccacagactacctgtcctggggcacagccagcccctacagcgccatggccacctacagcgccacctgtgccaacaacagccctgcccagggcatcaacatggccaacagcatcgccaacctgcggctgaaggccaaggagtacagcctgcagaggaaccaggtgcccaccgtgaactag

SEQ ID NO: 163109 - DNA, 654 bp, Artificial Sequence
  Description of Artificial Sequence: Synthetic coding sequence
atgaccagcagctatggccacgtgctggagcggcagcctgccctgggcggccgcctggacagccctggcaacctggacaccctgcaggccaagaagaacttctctgtgagccacctgctggacctggaggaggccggggacatggtggccgcccaggctgatgaaaatgtgggggaggccggccgcagcctgctggagagccctggcctgaccagcggcagtgacaccccccagcaggacaatgaccagctgaacagcgaggagaagaagaagaggaagcagaggaggaacagaaccaccttcaacagcagccagctgcaggccctggagcgggtgtttgagaggacccactacccagatgcctttgtgcgggaggacctggccaggagagtgaacctgacagaggcccgggtgcaggtgtggttccagaacagaagagccaagttcagaagaaatgaaagagccatgctggccaacaagaatgccagcctgctgaagagctacagcggagatgtgacagctgtggagcagcccatcgtgcccaggcctgccccccggcccacagactacctgtcctggggcacagccagcccctaccgcagcagcagcctgccccgctgctgcctgcacgagggcctgcacaacggcttctag

SEQ ID NO: 163110 - DNA, 762 bp, Artificial Sequence
  Description of Artificial Sequence: Synthetic coding sequence
atggattctgctgctgctgcctttgccctggacaagccagccctgggccctggccccccacctcctcctccagccctgggccctggggactgtgcccaggccaggaagaacttctctgtgagccacctgctggacctggaggaggtggccgccgccggccgcctggccgcccggcctggggcccgggcagaggcccgggagggcgccgcccgggagcccagcggcggcagcagcggcagcgaggccgccccccaggatggagagtgccccagccctggccggggcagcgctgccaagaggaagaagaagcagaggaggaacagaaccaccttcaacagcagccagctgcaggccctggagcgggtgtttgagaggacccactacccagatgcctttgtgcgggaggagctggccaggagagtgaacctgtctgaggcccgggtgcaggtgtggttccagaacagaagagccaagttcagaagaaatgaaagagccatgctggccagccgcagcgccagcctgctgaagagctacagccaggaggccgccatcgagcagcctgtggccccccggcccacagccctgagcccagactacctgtcctggacagccagcagcccctacagcacagtgcccccctacagccctggcagcagcggccctgccaccccaggagtgaacatggccaacagcatcgccagcctgcggctgaaggccaaggagttcagcctgcaccacagccaggtgcccaccgtgaactag

SEQ ID NO: 163111 - DNA, 855 bp, Artificial Sequence
  Description of Artificial Sequence: Synthetic coding sequence
atggactacagctacctgaacagctatgacagctgtgtggccgccatggaggccagcgcctatggagactttggagcctgcagccagcccggcggcttccagtacagccccctgcggcctgccttccctgctgctggccccccctgcccagccctgggcagcagcaactgtgccctgggcgccctgcgggaccaccagcctgccccctacagcgctgtgccctacaagttcttccctgagcccagcggcctgcacgagaagaggaagcagaggcgcatccgcaccaccttcaccagcgcccagctgaaggagctggagcgggtgtttgctgagacccactacccagacatctacacccgggaggagctggccctgaagattgacctgacagaggcccgggtgcaggtgtggttccagaacagaagagccaagttcaggaagcaggagagagctgccagcgccaagggagctgctggagctgctggggccaagaagggggaggcccgctgcagcagtgaagatgatgacagcaaggagagcacctgcagccccaccccagacagcacagccagcctgcccccacctccagcccctggcctggccagcccccggctgagccccagccccctgcctgtggccctgggcagcggccctggccctggccctggcccccagcccctgaagggggccctgtgggccggcgtggccggcggcggcggcggcggccctggagctggagctgctgagctgctgaaggcctggcagcctgctgagagcggccctggccccttctctggagtgctgagcagcttccacaggaagccaggccctgccctgaagaccaacctcttctag

SEQ ID NO: 163112 - DNA, 1800 bp, Artificial Sequence
  Description of Artificial Sequence: Synthetic coding sequence
atgaagctgctgaagctgaccggcttcatcttcttcctgttcttcctgacagagagcctgaccctgcccacccagccccgggacatcgagaacttcaacagcacccagaagttcatcgaggacaacatcgagtacatcaccatcatcgcctttgcccagtatgtgcaggaggccacctttgaggagatggagaagctggtgaaggacatggtggagtacaaggaccgctgcatggctgacaagaccctgcctgaatgttccaagctgcccaacaacgtgctgcaggagaagatctgtgccatggagggcctgccccagaagcacaacttcagccactgctgcagcaaggtggatgcccagaggcggctgtgcttcttctacaacaagaagagtgatgtgggcttcctgccccccttccccaccctggaccctgaggagaagtgccaggcctatgagagcaaccgggagagcctgctgaaccacttcctgtatgaggtggcccggaggaacccctttgtgtttgcccccaccctgctgactgtggccgtgcactttgaggaggtggccaagagctgctgtgaggagcagaacaaggtgaactgcctgcagacccgggccatccctgtgacccagtacctgaaggccttcagcagctaccagaagcacgtgtgtggggccctgctgaagtttggcaccaaggtggtgcacttcatctacatcgccatcctgagccagaagttccccaagattgagttcaaggagctgatcagcctggtggaggatgtgagcagcaactatgatggctgctgtgaaggagatgtggtgcagtgcatccgggacaccagcaaggtgatgaaccacatctgcagcaagcaggacagcatcagcagcaagatcaaggagtgctgtgagaagaagatccctgagcggggccagtgcatcatcaacagcaacaaggatgaccggcccaaggacctgagcctgcgggagggcaagttcacagacagtgaaaatgtgtgccaggagagagatgctgaccctgacaccttctttgccaagttcacctttgagtacagccgccgccacccagacctgagcatccctgagctgctgagaattgtgcagatctacaaggacctgctgaggaactgctgcaacacagagaaccccccaggctgctaccgctatgcagaggacaagttcaatgagaccacagagaagagcctgaagatggtgcagcaggagtgcaagcacttccagaacctgggcaaggatggcctgaagtaccactacctgatccggctgaccaagatcgccccccagctgagcacagaggagctggtgtccctgggggagaagatggtgacagccttcaccacctgctgcaccctgtctgaggagtttgcctgtgtggacaacctggccgacctggtgtttggagagctgtgtggggtgaatgaaaatagaaccatcaacccagctgtggaccactgctgcaagaccaactttgccttccggcggccctgctttgagagcctgaaggctgacaagacctacgtgcccccacccttcagccaggacctcttcaccttccacgccgacatgtgccagagccagaatgaggagctgcagaggaagacagaccgcttcctggtgaacctggtgaagctgaagcatgagctgacagatgaggagctgcagagcctcttcaccaactttgccaacgtggtggacaagtgctgcaaggccgagagccctgaggtgtgcttcaatgaggagagccccaagattggcaactag

SEQ ID NO: 163113 - DNA, 945 bp, Artificial Sequence
  Description of Artificial Sequence: Synthetic coding sequence
atggatgccttcaagggcggcatgagcctggagcggctgcctgagggcctgcggcccccacctcctcctcctcatgacatgggccctgccttccacctggcccggcctgctgacccccgggagcccctggagaacagcgccagcgagagcagtgacacagagctgcctgagaaggagcggggcggggagcccaagggccctgaggacagcggggccggcggcaccggctgcggcggcgcagatgatcctgccaagaagaagaagcagaggcggcagaggacccacttcaccagccagcagctgcaggagctggaggccaccttccagaggaaccgctacccagacatgtccatgagggaggagattgctgtgtggaccaacctgacagagccccgggtgcgggtgtggttcaagaacagaagagccaagtggaggaagcgggagaggaaccagcagctggacctgtgcaagggcggctacgtgccccagttcagcggcctggtgcagccctatgaagatgtgtatgctgctggctacagctacaacaactgggccgccaagagcctggccccagcccccctgagcaccaagagcttcaccttcttcaacagcatgagccccctgagcagccagagcatgttttctgcccccagcagcatcagctccatgaccatgcccagctccatgggccctggagctgtgcccggcatgcccaacagcggcctgaacaacatcaacaacctgaccggcagcagcctgaacagcgccatgagccctggggcctgcccctacggcaccccagccagcccctacagcgtgtacagagacacctgcaacagcagcctggccagcctgcggctgaagagcaagcagcacagcagctttggctatggaggcctgcagggccctgccagcggcctgaatgcctgccagtacaacagctag

SEQ ID NO: 163114 - DNA, 345 bp, Artificial Sequence
  Description of Artificial Sequence: Synthetic coding sequence
atggatgccttcaagggcggcatgagcctggagcggctgcctgagggcctgcggcccccacctcctcctcctcatgacatgggccctgccttccacctggcccggcctgctgacccccgggagcccctggagaacagcgccagcgagagcagtgacacagagctgcctgagaaggagcggggcggggagcccaagggccctgaggacagcggggccggcggcaccggctgcggcggcgcagatgatcctgccaagaagaagaagcagaggcggcagaggacccacttcaccagccagcagctgcaggagctggaggccaccttccagaggaaccgctacccctag

SEQ ID NO: 163115 - DNA, 945 bp, Artificial Sequence; identical to SEQ ID NO: 163113
  Description of Artificial Sequence: Synthetic coding sequence

SEQ ID NO: 163116 - DNA, 396 bp, Artificial Sequence
  Description of Artificial Sequence: Synthetic coding sequence
atggatgccttcaagggcggcatgagcctggagcggctgcctgagggcctgcggcccccacctcctcctcctcatgacatgggccctgccttccacctggcccggcctgctgacccccgggagcccctggagaacagcgccagcgagagcagtgacacagagctgcctgagaaggagcggggcggggagcccaagggccctgaggacagcggggccggcggcaccggctgcggcggcgcagatgatcctgccaagaagaagaagcagaggcggcagaggacccacttcaccagccagcagctgcaggagctggaggccaccttccagaggaaccgctacccagacatgtccatgagggaggagattgctgtgtggaccaacctgacagagccctag

SEQ ID NO: 163117 - DNA, 975 bp, Artificial Sequence
  Description of Artificial Sequence: Synthetic coding sequence
atgaactgcatgaagggccccctgcacctggagcacagagctgctggcaccaagctgtctgctgtgagcagcagcagctgccaccacccccagcccctggccatggcctctgtgctggcccctggccagcccaggagcctggacagcagcaagcaccggctggaggtgcacaccatcagtgacaccagcagccctgaggccgctgagaaggacaagagccagcagggcaagaatgaagatgtgggcgctgaggaccccagcaagaagaagaggcagaggcggcagaggacccacttcaccagccagcagctgcaggagctggaggccaccttccagaggaaccgctacccagacatgagcacccgggaggagattgctgtgtggaccaacctgacagaggcccgggtgcgggtgtggttcaagaacagaagagccaagtggaggaagcgggagaggaaccagcaggccgagctgtgcaagaatggatttggcccccagttcaacggcctgatgcagccctatgatgacatgtacccaggctacagctacaacaactgggccgccaagggcctgaccagcgccagcctgagcaccaagagcttccccttcttcaacagcatgaatgtgaaccccctgagcagccagagcatgttcagcccccccaacagcatcagctccatgtccatgagcagctccatggtgcccagcgctgtgactggagtgcccggcagcagcctgaacagcctgaacaacctgaacaacctgagcagccccagcctgaacagcgctgtgcccaccccagcctgcccctatgccccacccaccccaccctacgtgtacagagacacctgcaacagcagcctggccagcctgcggctgaaggccaagcagcacagcagctttggctacgcctctgtgcagaacccagccagcaacctgagcgcctgccagtatgctgtggacaggcctgtgtag

SEQ ID NO: 163118 - DNA, 954 bp, Artificial Sequence
  Description of Artificial Sequence: Synthetic coding sequence
atggagaccaactgcaggaagctggtgtctgcctgtgtgcagctgggcgtgcagcctgctgctgtggagtgcctcttcagcaaggacagcgagatcaagaaggtggagttcacagacagccctgagagcaggaaggaggccgccagcagcaagttcttcccccggcagcaccctggggccaatgagaaggacaagagccagcagggcaagaatgaagatgtgggcgctgaggaccccagcaagaagaagaggcagaggcggcagaggacccacttcaccagccagcagctgcaggagctggaggccaccttccagaggaaccgctacccagacatgagcacccgggaggagattgctgtgtggaccaacctgacagaggcccgggtgcgggtgtggttcaagaacagaagagccaagtggaggaagcgggagaggaaccagcaggccgagctgtgcaagaatggcttcggcccccagttcaacggcctgatgcagccctatgatgacatgtacccaggctacagctacaacaactgggccgccaagggcctgaccagcgccagcctgagcaccaagagcttccccttcttcaacagcatgaatgtgaaccccctgagcagccagagcatgttcagcccccccaacagcatcagctccatgtccatgagcagctccatggtgcccagcgctgtgactggagtgcccggcagcagcctgaacagcctgaacaacctgaacaacctgagcagccccagcctgaacagcgctgtgcccaccccagcctgcccctatgccccacccaccccaccctacgtgtacagagacacctgcaacagcagcctggccagcctgcggctgaaggccaagcagcacagcagctttggctacgcctctgtgcagaacccagccagcaacctgagcgcctgccagtatgctgtggacaggcctgtgtag

SEQ ID NO: 163119 - DNA, 816 bp, Artificial Sequence
  Description of Artificial Sequence: Synthetic coding sequence
atggagaccaactgcaggaagctggtgtctgcctgtgtgcagctggagaaggacaagagccagcagggcaagaatgaagatgtgggcgctgaggaccccagcaagaagaagaggcagaggcggcagaggacccacttcaccagccagcagctgcaggagctggaggccaccttccagaggaaccgctacccagacatgagcacccgggaggagattgctgtgtggaccaacctgacagaggcccgggtgcgggtgtggttcaagaacagaagagccaagtggaggaagcgggagaggaaccagcaggccgagctgtgcaagaatggcttcggcccccagttcaacggcctgatgcagccctatgatgacatgtacccaggctacagctacaacaactgggccgccaagggcctgaccagcgccagcctgagcaccaagagcttccccttcttcaacagcatgaatgtgaaccccctgagcagccagagcatgttcagcccccccaacagcatcagctccatgtccatgagcagctccatggtgcccagcgctgtgactggagtgcccggcagcagcctgaacagcctgaacaacctgaacaacctgagcagccccagcctgaacagcgctgtgcccaccccagcctgcccctatgccccacccaccccaccctacgtgtacagagacacctgcaacagcagcctggccagcctgcggctgaaggccaagcagcacagcagctttggctacgcctctgtgcagaacccagccagcaacctgagcgcctgccagtatgctgtggacaggcctgtgtag

SEQ ID NO: 163120 - DNA, 954 bp, Artificial Sequence; identical to SEQ ID NO: 163118
  Description of Artificial Sequence: Synthetic coding sequence

SEQ ID NO: 163121 - DNA, 873 bp, Artificial Sequence
  Description of Artificial Sequence: Synthetic coding sequence
atggagaccaactgcaggaagctggtgtctgcctgtgtgcagctgggcgtgcagcctgctgctgtggagtgcctcttcagcaaggacagcgagatcaagaaggtggagttcacagacagccctgagagcaggaaggaggccgccagcagcaagttcttcccccggcagcaccctggggccaatgagaaggacaagagccagcagggcaagaatgaagatgtgggcgctgaggaccccagcaagaagaagaggcagaggcggcagaggacccacttcaccagccagcagctgcaggagctggaggccaccttccagaggaaccgctacccagacatgagcacccgggaggagattgctgtgtggaccaacctgacagaggcccgggtgcgggtgtggttcaagaacagaagagccaagtggaggaagcgggagaggaaccagcaggccgagctgtgcaagaatggcttcggcccccagttcaacggcctgatgcagccctatgatgacatgtacccaggctacagctacaacaactgggccgccaagggcctgaccagcgccagcctgagcaccaagagcttccccttcttcaacagcatgaatgtgaaccccctgagcagccagagcatgttcagcccccccaacagcatcagctccatgtccatgagcagctccatggtgcccagcgctgtgactggagtgcccggcagcagcctgaacagcctgaacaacctgaacaacctgagcagccccagcctgaacagcgctgtgcccaccccagcctgcccctatgccccacccaccccaccctacgtgtacagagacacctgcaacagcagcctggccagcctgcggctgaaggccaagcagtag

SEQ ID NO: 163122 - DNA, 357 bp, Artificial Sequence
  Description of Artificial Sequence: Synthetic coding sequence
atggagaccaactgcaggaagctggtgtctgcctgtgtgcagctggagaaggacaagagccagcagggcaagaatgaagatgtgggcgctgaggaccccagcaagaagaagaggcagaggcggcagaggacccacttcaccagccagcagctgcaggagctggaggccaccttccagaggaaccgctacccagacatgagcacccgggaggagattgctgtgtggaccaacctgacagaggcccgggtgcgggtgtggttcaagaacagaagagccaagtggaggaagcgggagaggaaccagcaggccgagctgtgcaagaatggcttcggcccccagttcaacggcctgatgtag

SEQ ID NO: 163123 - DNA, 909 bp, Artificial Sequence
  Description of Artificial Sequence: Synthetic coding sequence
atggagtttggcctgctgtctgaggccgaggcccggagccctgccctgagcctgagtgatgctggcaccccccacccccagctgcctgagcacggctgcaagggccaggagcacagcgacagcgagaaggccagcgccagcctgcccggcggcagcccagaagatggcagcctgaagaagaagcagaggcggcagaggacccacttcaccagccagcagctgcaggagctggaggccaccttccagaggaaccgctacccagacatgagcacccgggaggagattgctgtgtggaccaacctgacagaggcccgggtgcgggtgtggttcaagaacagaagagccaagtggaggaagcgggagaggagccagcaggccgagctgtgcaagggcagctttgctgcccccctgggcggcctggtgcccccctatgaggaggtgtacccaggctacagctatggcaactggccacccaaggccctggccccacccctggccgccaagaccttcccctttgccttcaacagcgtgaatgtgggccccctggccagccagcccgtcttcagcccccccagcagcattgctgcctccatggtgcccagcgctgctgctgcccctggcaccgtgcccggccctggggccctgcagggcctgggcggcggccccccaggcctggccccagctgctgtgagcagcggggctgtgtcctgcccctatgccagcgctgctgctgctgctgctgctgctgccagcagcccctacgtgtacagagacccctgcaacagcagcctggccagcctgcggctgaaggccaagcagcacgccagcttctcctacccagctgtgcacggccccccacctgctgccaacctgagcccctgccagtatgctgtggagaggcctgtgtag

SEQ ID NO: 163124 - DNA, 909 bp, Artificial Sequence; identical to SEQ ID NO: 163123
  Description of Artificial Sequence: Synthetic coding sequence

SEQ ID NO: 163125 - DNA, 1179 bp, Artificial Sequence
  Description of Artificial Sequence: Synthetic coding sequence
atggagctggtggccggctgctatgagcaggtgctgtttggatttgctgtgcaccctgagcctgaggcctgtggggaccacgagcagtggaccctggtggccgacttcacccaccacgcccacacagccagcctgtctgctgtggccgtgaacagcagatttgtggtgacaggcagcaaggatgagaccatccacatctatgacatgaagaagaagattgaacatggagccctggtgcaccacagcggcaccatcacctgcctgaagttctacggcaacagacacctgatcagcggggctgaagatggcctcatctgcatctgggatgccaagaagtgggagtgcctgaagagcatcaaggcccacaagggccaggtgaccttcctgagcatccaccccagcggcaagctggccctgtctgtgggcacagacaagaccctgcggacctggaacctggtggagggccgcagcgccttcatcaagaacatcaagcagaatgcccacatcgtggagtggagccccagaggagagcagtatgtggtgatcatccagaacaagattgacatctaccagctggacacagccagcatcagcggcaccatcaccaatgagaagaggatcagctctgtgaagttcctgtctgagagcgtgctggccgtggccggagatgaggaggtgatccgcttctttgactgtgacagcctggtgtgcctgtgtgagttcaaggcccatgaaaatagagtgaaggacatgttctcctttgagatccctgagcaccacgtgattgtgtctgccagcagtgatggcttcatcaagatgtggaagctgaagcaggacaagaaggtgccccccagcctgctgtgtgagatcaacaccaatgcccggctgacctgcctgggcgtgtggctggacaaggtggccgacatgaaggagagcctgcccccagctgctgagcccagccctgtgtccaaggagcagagcaagattggcaagaaggagcccggggacacagtgcacaaggaggagaagaggagcaagcccaacaccaagaagaggggcctgactggagacagcaagaaggccaccaaggagagcggcctcatcagcaccaagaagaggaagatggtggagatgctggagaagaagaggaagaagaagaagatcaagaccatgcagtag

SEQ ID NO: 163126 - DNA, 3372 bp, Artificial Sequence
  Description of Artificial Sequence: Synthetic coding sequence
atgagcggcaccagcagccatgagagcttctatgacagcctgagtgacatgcaggaggagagcaagaacacagacttcttccctggcctgagcgccttcctgagccaggaggagatcaacaagagcctggacctggcccggcgggccatcgctgacagcgagacagaggactttgacagcgagaaggagatcagccagatcttcagcaccagccctgccagcctgtgtgagcaccccagccacaaggagaccaagctgggggagcacgccagccggcggccccaggacaacagaagcacccctgtgcagcccctggccgagaagcagaccaagagcatcagcagccctgtgtccaagaggaagccagccatgagccccctgctgacccggcccagctacatccgcagcctgaggaaggccgagaagagaggagccaagacccccagcaccaacgtgaagcccaagaccccccaccagaggaaaggaggcccccagagccagctgtgtgacaaggccgccaacctgattgaggagctgaccagcatcttcaaggccgccaagcccaggaacagaagccccaacggggagagcagcagcccagacagcggctacctgagccccaagaaccagcccagcgccctgctgagcgccagcgccagccagagccccatggaggaccagggcgagatggagcgggaggtgaagagccctggggcccggcactgctaccaggacaaccaggacctggccgtgccccacaacaggaagagccacccccagccccacagcgccctgcacttccctgctgccccccgcttcatccagaagctgcggagccaggaggtggccgagggcagccgggtgtacctggagtgccgggtgactggaaaccccaccccccgggtgcgctggttctgtgagggcaaggagctgcacaacaccccagacatccagatccactgtgagggcggggacctgcacaccctcatcatcgccgaggcctttgaagatgacaccggccgctacacctgcctggccaccaaccccagcggcagtgacaccaccagcgctgaggtgttcattgaaggagccagcagcacagacagcgacagcgagagcctggccttcaagagccgggccggggccatgccccaggcccagaagaagaccacctctgtgtccctgaccatcggcagcagcagccccaagacaggagtgaccacagctgtgatccagcccctgtctgtgcctgtgcagcaggtgcacagccccaccagctacctgtgcaggccagatggcaccaccacagcctacttcccccctgtgttcaccaaggagctgcagaacacagctgtggccgagggccaggtggtggtgctggagtgccgggtgcggggggccccacccctgcaggtgcagtggttccggcagggcagcgagatccaggacagcccagacttccgcatcctgcagaagaagcccaggagcacagctgagcctgaggagatctgcaccctggtgattgctgagaccttcccagaagatgctggcatcttcacctgcagcgccagaaatgactatggcagcgccaccagcacagcccagctggtggtgaccagcgccaacacagagaactgcagctatgagagcatgggagagagcaacaatgaccacttccagcacttccccccacctccacccatcctggagaccagcagcctggagctggccagcaagaagcccagcgagatccagcaggtgaacaaccctgagctgggcctgagcagagctgccctgcagatgcagttcaatgctgctgagcgggagaccaatggagtgcaccccagccggggcgtgaatggcctcatcaacgggaaggccaacagcaacaagagcctgcccaccccagctgtgctgctgagccccaccaaggagcccccacccctgctggccaagcccaagctgggcttccccaagaaggccagcaggacagccagaattgccagtgatgaggagatccagggcaccaaggatgctgtgatccaggacctggagaggaagctgcgcttcaaggaggacctgctgaacaacggccagccccggctgacctatgaggagaggatggcccggcggctgctgggcgctgacagcgccaccgtcttcaacatccaggagcctgaggaggagacagccaaccaggacatcggcagcccccacgcctctgtgggcagccccctggatggccagaaggagtacaaggtgagcagctgtgagcagaggctcatcagcgagattgagtaccgcctggagaggagccctgtggatgaaagtggagatgaggtgcagtatggagatgtgcctgtggagaatggcatggcccccttctttgagatgaagctgaagcactacaagatctttgagggcatgcctgtgaccttcacctgccgggtggccggcaaccccaagcccaagatctactggttcaaggatggcaagcagatcagccccaagagtgaccactacaccatccagagggacctggatggcacctgcagcctgcacaccacagccagcaccctggatgatgatggcaactacaccatcatggccgccaacccccagggccgcatcagctgcaccggccgcctgatggtgcaggccgtgaaccagaggggccgcagccccaggagccccagcggccacccccacgtgagaagacccaggagccgcagccgggacagcggagatgaaaatgagcccatccaggagcgcttcttccggccccacttcctgcaggcccctggggacctgactgtgcaggagggcaagctgtgcaggatggactgcaaggtgtctggcctgcccaccccagacctgtcctggcagctggatggcaagcctgtgcggccagacagcgcccacaagatgctggtgcgggagaatggagtgcacagcctcatcatcgagcctgtgaccagcagagatgctggcatctacacctgcatcgccaccaacagagctggccagaacagcttcagcctggagctggtggtggccgccaaggaggcccacaagccccctgtgttcatcgagaagctgcagaacacaggagtggctgatggctaccctgtgcggctggagtgccgggtgctgggcgtgcccccaccccagatcttctggaagaaggaaaatgaaagcctgacccacagcacagacagagtgtccatgcaccaggacaaccacggctacatctgcctgctgatccagggcgccaccaaggaggatgctggctggtacacagtgtctgccaagaatgaagctggcatcgtgtcctgcacagcccggctggatgtgtacatcagccgccactag

SEQ ID NO: 163127 - DNA, 2019 bp, Artificial Sequence
  Description of Artificial Sequence: Synthetic coding sequence
atgtctgccctggccagccgcagcgccccagccatgcagagcagcggcagcttcaactatgcccggcccaagcagttcatcgccgcccagaacctgggccctgccagcggccacggcaccccagccagcagccccagcagcagcagcctgcccagccccatgagccccaccccccggcagtttggccgggcccctgtgcccccatttgcccagccctttggagctgagcctgaggccccctggggcagcagcagccccagccccccacctcctcctcctcctgtgttcagccccacagctgccttccctgtgcctgatgtgttccccctgcccccacctcctccacccctgcccagccctggccaggccagccactgcagcagccctgccaccaggtttggccacagccagaccccagctgccttcctgagcgccctgctgcccagccagcccccacctgctgctgtgaatgccctgggcctgcccaagggcgtgaccccagctggcttccccaagaaggccagcaggacagcccgcatcgccagtgatgaggagatccagggcaccaaggatgctgtgatccaggacctggagaggaagctgcgcttcaaggaggacctgctgaacaacggccagccccggctgacctatgaggagaggatggcccggcggctgctgggcgctgacagcgccaccgtcttcaacatccaggagcctgaggaggagacagccaaccaggagtacaaggtgagcagctgtgagcagaggctcatcagcgagattgagtaccgcctggagaggagccctgtggatgaaagtggagatgaggtgcagtatggagatgtgcctgtggagaatggcatggcccccttctttgagatgaagctgaagcactacaagatctttgagggcatgcctgtgaccttcacctgccgggtggccggcaaccccaagcccaagatctactggttcaaggatggcaagcagatcagccccaagagtgaccactacaccatccagagggacctggatggcacctgcagcctgcacaccacagccagcaccctggatgatgatggcaactacaccatcatggccgccaacccccagggccgcatcagctgcaccggccgcctgatggtgcaggccgtgaaccagaggggccgcagccccaggagccccagcggccacccccacgtgagaagacccaggagccgcagccgggacagcggagatgaaaatgagcccatccaggagcgcttcttccggccccacttcctgcaggcccctggggacctgactgtgcaggagggcaagctgtgcaggatggactgcaaggtgtctggcctgcccaccccagacctgtcctggcagctggatggcaagcctgtgcggccagacagcgcccacaagatgctggtgcgggagaatggagtgcacagcctcatcatcgagcctgtgaccagcagagatgctggcatctacacctgcatcgccaccaacagagctggccagaacagcttcagcctggagctggtggtggccgccaaggaggcccacaagccccctgtgttcatcgagaagctgcagaacacaggagtggctgatggctaccctgtgcggctggagtgccgggtgctgggcgtgcccccaccccagatcttctggaagaaggaaaatgaaagcctgacccacagcacagacagagtgtccatgcaccaggacaaccacggctacatctgcctgctgatccagggcgccaccaaggaggatgctggctggtacacagtgtctgccaagaatgaagctggcatcgtgtcctgcacagcccggctggatgtgtacacccagtggcaccagcagagccagagcaccaagcccaagaaggtgcggcccagcgccagccgctatgctgccctgagtgaccagggcctggacatcaaggccgccttccagcctgaggccaaccccagccacctgaccctgaacacagccctggtggagagcgaggacctgtag

SEQ ID NO: 163128 - DNA, 2334 bp, Artificial Sequence
  Description of Artificial Sequence: Synthetic coding sequence
atgccccaggcccagaagaagaccacctctgtgtccctgaccatcggcagcagcagccccaagacaggagtgaccacagctgtgatccagcccctgtctgtgcctgtgcagcaggtgcacagccccaccagctacctgtgcaggccagatggcaccaccacagcctacttcccccctgtgttcaccaaggagctgcagaacacagctgtggccgagggccaggtggtggtgctggagtgccgggtgcggggggccccacccctgcaggtgcagtggttccggcagggcagcgagatccaggacagcccagacttccgcatcctgcagaagaagcccaggagcacagctgagcctgaggagatctgcaccctggtgattgctgagaccttcccagaagatgctggcatcttcacctgcagcgccagaaatgactatggcagcgccaccagcacagcccagctggtggtgaccagcgccaacacagagaactgcagctatgagagcatgggagagagcaacaatgaccacttccagcacttccccccacctccacccatcctggagaccagcagcctggagctggccagcaagaagcccagcgagatccagcaggtgaacaaccctgagctgggcctgagcagagctgccctgcagatgcagttcaatgctgctgagcgggagaccaatggagtgcaccccagccggggcgtgaatggcctcatcaacgggaaggccaacagcaacaagagcctgcccaccccagctgtgctgctgagccccaccaaggagcccccacccctgctggccaagcccaagctgggcttccccaagaaggccagcaggacagccagaattgccagtgatgaggagatccagggcaccaaggatgctgtgatccaggacctggagaggaagctgcgcttcaaggaggacctgctgaacaacggccagccccggctgacctatgaggagaggatggcccggcggctgctgggcgctgacagcgccaccgtcttcaacatccaggagcctgaggaggagacagccaaccaggagtacaaggtgagcagctgtgagcagaggctcatcagcgagattgagtaccgcctggagaggagccctgtggatgagagcggagatgaggtgcagtatggagatgtgcctgtggagaatggcatggcccccttctttgagatgaagctgaagcactacaagatctttgagggcatgcctgtgaccttcacctgccgggtggccggcaaccccaagcccaagatctactggttcaaggatggcaagcagatcagccccaagagtgaccactacaccatccagagggacctggatggcacctgcagcctgcacaccacagccagcaccctggatgatgatggcaactacaccatcatggccgccaacccccagggccgcatcagctgcaccggccgcctgatggtgcaggccgtgaaccagaggggccgcagccccaggagccccagcggccacccccacgtgcggcggcccaggagccgcagccgggacagcggagatgaaaatgagcccatccaggagcgcttcttccggccccacttcctgcaggcccctggggacctgactgtgcaggagggcaagctgtgcaggatggactgcaaggtgtctggcctgcccaccccagacctgtcctggcagctggatggcaagcctgtgcggccagattctgcccacaagatgctggtgagagaaaatggagtgcacagcctcatcatcgagcctgtgaccagcagagatgctggcatctacacctgcatcgccaccaacagagctggccagaacagcttcagcctggagctggtggtggccgccaaggaggcccacaagccccctgtgttcatcgagaagctgcagaacacaggagtggctgatggctaccctgtgcggctggagtgccgggtgctgggcgtgcccccaccccagatcttctggaagaaggaaaatgaaagcctgacccacagcacagacagagtgtccatgcaccaggacaaccacggctacatctgcctgctgatccagggcgccaccaaggaggatgctggctggtacacagtgtctgccaagaatgaggccggcatcgtgtcctgcacagcccggctggatgtgtacacccagtggcaccagcagagccagagcaccaagcccaagaaggtgcggcccagcgccagccgctatgctgccctgagtgaccagggcctggacatcaaggccgccttccagcctgaggccaaccccagccacctgaccctgaacacagccctggtggagagcgaggacctgtag

SEQ ID NO: 163129 - DNA, 3321 bp, Artificial Sequence
  Description of Artificial Sequence: Synthetic coding sequence
atgagcggcaccagcagccatgagagcttctatgacagcctgagtgacatgcaggaggagagcaagaacacagacttcttccctggcctgagcgccttcctgagccaggaggagatcaacaagagcctggacctggcccggcgggccatcgctgacagcgagacagaggactttgacagcgagaaggagatcagccagatcttcagcaccagccctgccagcctgtgtgagcaccccagccacaaggagaccaagctgggggagcacgccagccggcggccccaggacaacagaagcacccctgtgcagcccctggccgagaagcagaccaagagcatcagcagccctgtgtccaagaggaagccagccatgagccccctgctgacccggcccagctacatccgcagcctgaggaaggccgagaagagaggagccaagacccccagcaccaacgtgaagcccaagaccccccaccagaggaaaggaggcccccagagccagctgtgtgacaaggccgccaacctgattgaggagctgaccagcatcttcaaggccgccaagcccaggaacagaagccccaacggggagagcagcagcccagacagcggctacctgagccccaagaaccagcccagcgccctgctgagcgccagcgccagccagagccccatggaggaccagggcgagatggagcgggaggtgaagagccctggggcccggcactgctaccaggacaaccaggacctggccgtgccccacaacaggaagagccacccccagccccacagcgccctgcacttccctgctgccccccgcttcatccagaagctgcggagccaggaggtggccgagggcagccgggtgtacctggagtgccgggtgactggaaaccccaccccccgggtgcgctggttctgtgagggcaaggagctgcacaacaccccagacatccagatccactgtgagggcggggacctgcacaccctcatcatcgccgaggcctttgaagatgacaccggccgctacacctgcctggccaccaaccccagcggcagtgacaccaccagcgctgaggtgttcattgaaggagccagcagcacagacagcgacagcgagagcctggccttcaagagccgggccggggccatgccccaggcccagaagaagaccacctctgtgtccctgaccatcggcagcagcagccccaagacaggagtgaccacagctgtgatccagcccctgtctgtgcctgtgcagcaggtgcacagccccaccagctacctgtgcaggccagatggcaccaccacagcctacttcccccctgtgttcaccaaggagctgcagaacacagctgtggccgagggccaggtggtggtgctggagtgccgggtgcggggggccccacccctgcaggtgcagtggttccggcagggcagcgagatccaggacagcccagacttccgcatcctgcagaagaagcccaggagcacagctgagcctgaggagatctgcaccctggtgattgctgagaccttcccagaagatgctggcatcttcacctgcagcgccagaaatgactatggcagcgccaccagcacagcccagctggtggtgaccagcgccaacacagagaactgcagctatgagagcatgggagagagcaacaatgaccacttccagcacttccccccacctccacccatcctggagaccagcagcctggagctggccagcaagaagcccagcgagatccagcaggtgaacaaccctgagctgggcctgagcagagctgccctgcagatgcagttcaatgctgctgagcgggagaccaatggagtgcaccccagccggggcgtgaatggcctcatcaacgggaaggccaacagcaacaagagcctgcccaccccagctgtgctgctgagccccaccaaggagcccccacccctgctggccaagcccaagctgggcttccccaagaaggccagcaggacagccagaattgccagtgatgaggagatccagggcaccaaggatgctgtgatccaggacctggagaggaagctgcgcttcaaggaggacctgctgaacaacggccagccccggctgacctatgaggagaggatggcccggcggctgctgggcgctgacagcgccaccgtcttcaacatccaggagcctgaggaggagacagccaaccaggagtacaaggtgagcagctgtgagcagaggctcatcagcgagattgagtaccgcctggagaggagccctgtggatgagagcggagatgaggtgcagtatggagatgtgcctgtggagaatggcatggcccccttctttgagatgaagctgaagcactacaagatctttgagggcatgcctgtgaccttcacctgccgggtggccggcaaccccaagcccaagatctactggttcaaggatggcaagcagatcagccccaagagtgaccactacaccatccagagggacctggatggcacctgcagcctgcacaccacagccagcaccctggatgatgatggcaactacaccatcatggccgccaacccccagggccgcatcagctgcaccggccgcctgatggtgcaggccgtgaaccagaggggccgcagccccaggagccccagcggccacccccacgtgcggcggcccaggagccgcagccgggacagcggagatgaaaatgagcccatccaggagcgcttcttccggccccacttcctgcaggcccctggggacctgactgtgcaggagggcaagctgtgcaggatggactgcaaggtgtctggcctgcccaccccagacctgtcctggcagctggatggcaagcctgtgcggccagattctgcccacaagatgctggtgagagaaaatggagtgcacagcctcatcatcgagcctgtgaccagcagagatgctggcatctacacctgcatcgccaccaacagagctggccagaacagcttcagcctggagctggtggtggccgccaaggaggcccacaagccccctgtgttcatcgagaagctgcagaacacaggagtggctgatggctaccctgtgcggctggagtgccgggtgctgggcgtgcccccaccccagatcttctggaagaaggaaaatgaaagcctgacccacagcacagacagagtgtccatgcaccaggacaaccacggctacatctgcctgctgatccagggcgccaccaaggaggatgctggctggtacacagtgtctgccaagaatgaggccggcatcgtgtcctgcacagcccggctggatgtgtacatcagccgccactag

SEQ ID NO: 163130 - DNA, 1233 bp, Artificial Sequence
  Description of Artificial Sequence: Synthetic coding sequence
atgagccccctgctgacccggcccagctacatccgcagcctgaggaaggccgagaagagaggagccaagacccccagcaccaacgtgaagcccaagaccccccaccagaggaagggcggcccccagagccagctgtgtgacaaggccgccaacctgattgaggagctgaccagcatcttcaaggccgccaagcccaggaacagaagccccaatggagagagcagcagcccagattctggctacctgagccccaagaaccagcccagcgccctgctgagcgccagcgccagccagagccccatggaggaccagggcgagatggagcgggaggtgaagagccctggggcccggcactgctaccaggacaaccaggacctggccgtgccccacaacaggaagagccacccccagccccacagcgccctgcacttccctgctgccccccgcttcatccagaagctgcggagccaggaggtggccgagggcagccgggtgtacctggagtgccgggtgacaggcaaccccaccccccgggtgcgctggttctgtgagggcaaggagctgcacaacaccccagacatccagatccactgtgagggcggggacctgcacaccctcatcatcgccgaggcctttgaagatgacaccggccgctacacctgcctggccaccaaccccagcggcagtgacaccaccagcgctgaggtgttcatcgagggcgccagcagcacagacagcgacagcgagagcctggccttcaagagcagagctggggccatgccccaggcccagaagaagaccacctctgtgtccctgaccatcggcagcagcagccccaagacaggagtgaccacagctgtgatccagcccctgtctgtgcctgtgcagcaggtgcacagccccaccagctacctgtgcaggccagatggcaccaccacagcctacttcccccctgtgttcaccaaggagctgcagaacacagctgtggccgagggccaggtggtggtgctggagtgccgggtgcggggggccccacccctgcaggtgcagtggttccggcagggcagcgagatccaggacagcccagacttccgcatcctgcagaagaagcccaggagcacagctgagccagatgtgctgtatgtgtttgtgcgggtgcgctgccaccagatgaagatccagtactacaacctggcccacctgatcagctcctggctgagcagcttcctgtag

SEQ ID NO: 163131 - DNA, 3006 bp, Artificial Sequence
  Description of Artificial Sequence: Synthetic coding sequence
atgccccaggcccagaagaagaccacctctgtgtccctgaccatcggcagcagcagccccaagacaggagtgaccacagctgtgatccagcccctgtctgtgcctgtgcagcaggtgcacagccccaccagctacctgtgcaggccagatggcaccaccacagcctacttcccccctgtgttcaccaaggagctgcagaacacagctgtggccgagggccaggtggtggtgctggagtgccgggtgcggggggccccacccctgcaggtgcagtggttccggcagggcagcgagatccaggacagcccagacttccgcatcctgcagaagaagcccaggagcacagctgagcctgaggagatctgcaccctggtgattgctgagaccttcccagaagatgctggcatcttcacctgcagcgccagaaatgactatggcagcgccaccagcacagcccagctggtggtgaccagcgccaacacagagaactgcagctatgagagcatgggagagagcaacaatgaccacttccagcacttccccccacctccacccatcctggagaccagcagcctggagctggccagcaagaagcccagcgagatccagcaggtgaacaaccctgagctgggcctgagcagagctgccctgcagatgcagttcaatgctgctgagcgggagaccaatggagtgcaccccagccggggcgtgaatggcctcatcaacgggaaggccaacagcaacaagagcctgcccaccccagctgtgctgctgagccccaccaaggagcccccacccctgctggccaagcccaagctggaccccctgaagctgcagcagctgcagaaccagatccggctggagcaggaggccggggcccggcagcccccaccagcccccaggtctgccccacccagcccccccttccccccacctccagccttccctgagctggccgcctgcaccccaccagccagccctgagcccatgtctgccctggccagccgcagcgccccagccatgcagagcagcggcagcttcaactatgcccggcccaagcagttcatcgccgcccagaacctgggccctgccagcggccacggcaccccagccagcagccccagcagcagcagcctgcccagccccatgagccccaccccccggcagtttggccgggcccctgtgcccccatttgcccagccctttggagctgagcctgaggccccctggggcagcagcagccccagccccccacctcctcctcctcctgtgttcagccccacagctgccttccctgtgcctgatgtgttccccctgcccccacctcctccacccctgcccagccctggccaggccagccactgcagcagccctgccacccgcttcggccacagccagaccccagctgccttcctgagcgccctgctgcccagccagcccccacctgctgctgtgaatgccctgggcctgcccaagggcgtgaccccagctggcttccccaagaaggccagcaggacagccagaattgccagtgatgaggagatccagggcaccaaggatgctgtgatccaggacctggagaggaagctgcgcttcaaggaggacctgctgaacaacggccagccccggctgacctatgaggagaggatggcccggcggctgctgggcgctgacagcgccaccgtcttcaacatccaggagcctgaggaggagacagccaaccaggagtacaaggtgagcagctgtgagcagaggctcatcagcgagattgagtaccgcctggagaggagccctgtggatgagagcggagatgaggtgcagtatggagatgtgcctgtggagaatggcatggcccccttctttgagatgaagctgaagcactacaagatctttgagggcatgcctgtgaccttcacctgccgggtggccggcaaccccaagcccaagatctactggttcaaggatggcaagcagatcagccccaagagtgaccactacaccatccagagggacctggatggcacctgcagcctgcacaccacagccagcaccctggatgatgatggcaactacaccatcatggccgccaacccccagggccgcatcagctgcaccggccgcctgatggtgcaggccgtgaaccagaggggccgcagccccaggagccccagcggccacccccacgtgcggcggcccaggagccgcagccgggacagcggagatgaaaatgagcccatccaggagcgcttcttccggccccacttcctgcaggcccctggggacctgactgtgcaggagggcaagctgtgcaggatggactgcaaggtgtctggcctgcccaccccagacctgtcctggcagctggatggcaagcctgtgcggccagattctgcccacaagatgctggtgagagaaaatggagtgcacagcctcatcatcgagcctgtgaccagcagagatgctggcatctacacctgcatcgccaccaacagagctggccagaacagcttcagcctggagctggtggtggccgccaaggaggcccacaagccccctgtgttcatcgagaagctgcagaacacaggagtggctgatggctaccctgtgcggctggagtgccgggtgctgggcgtgcccccaccccagatcttctggaagaaggaaaatgaaagcctgacccacagcacagacagagtgtccatgcaccaggacaaccacggctacatctgcctgctgatccagggcgccaccaaggaggatgctggctggtacacagtgtctgccaagaatgaggccggcatcgtgtcctgcacagcccggctggatgtgtacacccagtggcaccagcagagccagagcaccaagcccaagaaggtgcggcccagcgccagccgctatgctgccctgagtgaccagggcctggacatcaaggccgccttccagcctgaggccaaccccagccacctgaccctgaacacagccctggtggagagcgaggacctgtag

SEQ ID NO: 163132 - DNA, 483 bp, Artificial Sequence
  Description of Artificial Sequence: Synthetic coding sequence
tgaggaaaacctgtgcggccagattctgcccacaagatgctggtgagagaaaatggagtgcacagcctcatcatcgagcctgtgaccagcagagatgctggcatctacacctgcatcgccaccaacagagctggccagaacagcttcagcctggagctggtggtggccgccaaggaggcccacaagccccctgtgttcatcgagaagctgcagaacacaggagtggctgatggctaccctgtgcggctggagtgccgggtgctgggcgtgcccccaccccagatcttctggaagaaggaaaatgaaagcctgacccacagcacagacagagtgtccatgcaccaggacaaccacggctacatctgcctgctgatccagggcgccaccaaggaggatgctggctggtacacagtgtctgccaagaatgaggccggcatcgtgtcctgcacagcccggctggatgtgtacatcagccgccactag

SEQ ID NO: 163133 - DNA, 1539 bp, Artificial Sequence
  Description of Artificial Sequence: Synthetic coding sequence
aagaacacagacttcttccctggcctgagcgccttcctgagccaggaggagatcaacaagagcctggacctggcccggcgggccatcgctgacagcgagacagaagattttgattctgagaaggagatcagccagatcttcagcaccagccctgccagcctgtgtgagcaccccagccacaaggagaccaagctgggggagcacgccagcagaagaccccaggacaacagaagcacccctgtgcagcccctggccgagaagcagaccaagagcatcagcagccctgtgtccaagaggaagccagccatgagccccctgctgacccggcccagctacatccgcagcctgaggaaggccgagaagagaggagccaagacccccagcaccaacgtgaagcccaagaccccccaccagaggaagggcggcccccagagccagctgtgtgacaaggccgccaacctgattgaggagctgaccagcatcttcaaggccgccaagcccaggaacagaagccccaatggagagagcagcagcccagattctggctacctgagccccaagaaccagcccagcgccctgctgagcgccagcgccagccagagccccatggaggaccagggcgagatggagcgggaggtgaagagccctggggcccggcactgctaccaggacaaccaggacctggccgtgccccacaacaggaagagccacccccagccccacagcgccctgcacttccctgctgccccccgcttcatccagaagctgcggagccaggaggtggccgagggcagccgggtgtacctggagtgccgggtgacaggcaaccccaccccccgggtgcgctggttctgtgagggcaaggagctgcacaacaccccagacatccagatccactgtgagggcggggacctgcacaccctcatcatcgccgaggcctttgaagatgacaccggccgctacacctgcctggccaccaaccccagcggcagtgacaccaccagcgctgaggtgttcatcgagggcgccagcagcacagacagcgacagcgagagcctggccttcaagagcagagctggggccatgccccaggcccagaagaagaccacctctgtgtccctgaccatcggcagcagcagccccaagacaggagtgaccacagctgtgatccagcccctgtctgtgcctgtgcagcaggtgcacagccccaccagctacctgtgcaggccagatggcaccaccacagcctacttcccccctgtgttcaccaaggagctgcagaacacagctgtggccgagggccaggtggtggtgctggagtgccgggtgcggggggccccacccctgcaggtgcagtggttccggcagggcagcgagatccaggacagcccagacttccgcatcctgcagaagaagcccaggagcacagctgagccagatgtgctgtatgtgtttgtgcgggtgcgctgccaccagatgaagatccagtactacaacctggcccacctgatcagctcctggctgagcagcttcctgtag

SEQ ID NO: 163134 - DNA, 87 bp, Artificial Sequence
  Description of Artificial Sequence: Synthetic coding sequence
atgagcggcaccagcagccatgagagcttctatgacagcctgagtgacatgcaggaggagagcaagaacacagacttcttcccctag

SEQ ID NO: 163135 - DNA, 690 bp, Artificial Sequence
  Description of Artificial Sequence: Synthetic coding sequence
atggccgcccagcccctgcggcacaggagccgctgtgccaccccacccaggggggacttctgtggcggcacagagcgggccatcgaccaggccagcttcaccacctccatggagtgggacacccaggtggtgaagggcagcagccccctgggccctgctggcctgggcgctgaggagcctgctgctggcccccagctgcccagctggctgcagcctgagcgctgtgctgtgttccagtgtgcccagtgccacgctgtgctggccgacagcgtgcacctggcctgggacctgagccgcagcctgggcgctgtggtgttcagccgggtgaccaacaacgtggtgctggaggcccccttcctggtgggcatcgagggcagcctgaagggcagcacctacaacctgctcttctgtggcagctgtggcatccctgtgggcttccacctgtacagcacccatgctgccctggccgccctgcggggccacttctgcctgagcagtgacaagatggtgtgctacctgctgaagaccaaggccatcgtgaatgccagcgagatggacatccagaatgtgcccctgtctgagaagattgctgagctgaaggagaagatcgtgctgacccacaaccggctgaagagcctgatgaagatcctgtctgaggtgaccccagaccagagcaagccagagaactag

SEQ ID NO: 163136 - DNA, 816 bp, Artificial Sequence
  Description of Artificial Sequence: Synthetic coding sequence
atggccagccctggctgcctgtggctgctggccgtggccctgctgccctggacctgtgccagccgggccctgcagcacctggaccccccagcccccctgcccctggtgatctggcacggcatgggcagccgctacgtggcccagacaggcctggagctgctggccagcagcaaccccccagccagcagctaccagagcgctggcatgattggagacagctgctgcaaccccctgtccatgggcgccatcaagaagatggtggagaagaagatccctggcatctacgtgctgagcctggagatcggcaagaccctgatggaggatgtggagaacagcttcttcctgaatgtgaacagccaggtgaccaccgtgtgccaggccctggccaaggaccccaagctgcagcagggctacaatgccatgggcttcagccagggcggccagttcctgcgggctgtggcccagcgctgccccagcccccccatgatcaacctgatctctgtgggcggccagcaccagggcgtgtttggcctgccccgctgccctggagagagcagccacatctgtgacttcatcaggaagaccctgaatgctggggcctacagcaaggtggtgcaggagcggctggtgcaggccgagtactggcatgaccccatcaaggaggatgtgtacagaaaccacagcatcttcctggccgacatcaaccaggagcggggcatcaatgaaagctacaagaagaacctgatggccctgaagaagtttgtgatggtgaagttcctgaatgacagcatcgtggaccctgtggacagcgagtag

SEQ ID NO: 163137 - DNA, 921 bp, Artificial Sequence
  Description of Artificial Sequence: Synthetic coding sequence
atggccagccctggctgcctgtggctgctggccgtggccctgctgccctggacctgtgccagccgggccctgcagcacctggaccccccagcccccctgcccctggtgatctggcacggcatgggagacagctgctgcaaccccctgtccatgggcgccatcaagaagatggtggagaagaagatccctggcatctacgtgctgagcctggagatcggcaagaccctgatggaggatgtggagaacagcttcttcctgaatgtgaacagccaggtgaccaccgtgtgccaggccctggccaaggaccccaagctgcagcagggctacaatgccatgggcttcagccagggcggccagttcctgcgggctgtggcccagcgctgccccagcccccccatgatcaacctgatctctgtgggcggccagcaccagggcgtgtttggcctgccccgctgccctggagagagcagccacatctgtgacttcatcaggaagaccctgaatgctggggcctacagcaaggtggtgcaggagcggctggtgcaggccgagtactggcatgaccccatcaaggaggatgtgtacagaaaccacagcatcttcctggccgacatcaaccaggagcggggcatcaatgaaagctacaagaagaacctgatggccctgaagaagtttgtgatggtgaagttcctgaatgacagcatcgtggaccctgtggacagcgagtggtttggcttctacagaagtggccaggccaaggagaccatccccctgcaggagaccagcctgtacacccaggaccggctgggcctgaaggagatggacaatgccggccagctggtgttcctggccacagaaggagaccacctgcagctgtctgaggagtggttctacgcccacatcatccccttcctgggctag

SEQ ID NO: 163138 - DNA, 612 bp, Artificial Sequence
  Description of Artificial Sequence: Synthetic coding sequence
atggccagccctggctgcctgtggctgctggccgtggccctgctgccctggacctgtgccagccgggccctgcagcacctggaccccccagcccccctgcccctggtgatctggcacggcatgggcgtgtttggcctgccccgctgccctggagagagcagccacatctgtgacttcatcaggaagaccctgaatgctggggcctacagcaaggtggtgcaggagcggctggtgcaggccgagtactggcatgaccccatcaaggaggatgtgtacagaaaccacagcatcttcctggccgacatcaaccaggagcggggcatcaatgaaagctacaagaagaacctgatggccctgaagaagtttgtgatggtgaagttcctgaatgacagcatcgtggaccctgtggacagcgagtggtttggcttctaccgcagcggccaggccaaggagaccatccccctgcaggagaccagcctgtacacccaggaccggctgggcctgaaggagatggacaatgccggccagctggtgttcctggccacagaaggagaccacctgcagctgtctgaggagtggttctacgcccacatcatccccttcctgggctag

SEQ ID NO: 163139 - DNA, 921 bp, Artificial Sequence; identical to SEQ ID NO: 163137
  Description of Artificial Sequence: Synthetic coding sequence

SEQ ID NO: 163140 - DNA, 909 bp, Artificial Sequence
  Description of Artificial Sequence: Synthetic coding sequence
atgctgggcctgtgtggccagaggctgcctgctgcctgggtgctgctgctgctgcccttcctgcccctgctgctgctggccgccccagccccccaccgggccagctacaagcctgtgattgtggtgcacggcctgtttgacagcagctacagcttccgccacctgctggagtacatcaatgagacccaccctggcaccgtggtgacagtgctggacctgtttgatggccgggagagcctgcggcccctgtgggagcaggtgcagggcttccgggaggccgtggtgcccatcatggccaaggccccccagggcgtgcacctgatctgctacagccagggcggcctggtgtgccgggccctgctgtctgtgatggatgaccacaacgtggacagcttcatcagcctgagcagcccccagatgggccagtatggagacacagactacctgaagtggctgttccccacctccatgaggagcaacctgtaccgcatctgctacagcccctggggccaggagttcagcatctgcaactactggcatgacccccaccatgatgacctgtacctgaatgccagcagcttcctggccctgatcaatggagagcgggaccaccccaatgccaccgtgtggaggaagaacttcctgcgggtgggccacctggtgctgattggaggcccagatgatggagtcatcaccccctggcagagcagcttcttcggcttctatgatgccaatgaaacagtgctggagatggaggagcagctggtgtacctgcgggacagctttggcctgaagaccctgctggcccggggggccatcgtgcgctgccccatggccggcatcagccacacagcctggcacagcaacagaaccctgtatgagacctgcatcgagccctggctgtcctag

SEQ ID NO: 163141 - DNA, 927 bp, Artificial Sequence
  Description of Artificial Sequence: Synthetic coding sequence
atgaagagctgtggctccatgctgggcctgtgtggccagaggctgcctgctgcctgggtgctgctgctgctgcccttcctgcccctgctgctgctggccgccccagccccccaccgggccagctacaagcctgtgattgtggtgcacggcctgtttgacagcagctacagcttccgccacctgctggagtacatcaatgagacccaccctggcaccgtggtgacagtgctggacctgtttgatggccgggagagcctgcggcccctgtgggagcaggtgcagggcttccgggaggccgtggtgcccatcatggccaaggccccccagggcgtgcacctgatctgctacagccagggcggcctggtgtgccgggccctgctgtctgtgatggatgaccacaacgtggacagcttcatcagcctgagcagcccccagatgggccagtatggagacacagactacctgaagtggctgttccccacctccatgaggagcaacctgtaccgcatctgctacagcccctggggccaggagttcagcatctgcaactactggcatgacccccaccatgatgacctgtacctgaatgccagcagcttcctggccctgatcaatggagagcgggaccaccccaatgccaccgtgtggaggaagaacttcctgcgggtgggccacctggtgctgattggaggcccagatgatggagtcatcaccccctggcagagcagcttcttcggcttctatgatgccaatgaaacagtgctggagatggaggagcagctggtgtacctgcgggacagctttggcctgaagaccctgctggcccggggggccatcgtgcgctgccccatggccggcatcagccacacagcctggcacagcaacagaaccctgtatgagacctgcatcgagccctggctgtcctag

SEQ ID NO: 163142 - DNA, 909 bp, Artificial Sequence; identical to SEQ ID NO: 163140
  Description of Artificial Sequence: Synthetic coding sequence

SEQ ID NO: 163143 - DNA, 909 bp, Artificial Sequence; identical to SEQ ID NO: 163140
  Description of Artificial Sequence: Synthetic coding sequence

SEQ ID NO: 163144 - DNA, 927 bp, Artificial Sequence
  Description of Artificial Sequence: Synthetic coding sequence
atgaagagctgtggctccatgctgggcctgtggggccagaggctgcctgctgcctgggtgctgctgctgctgcccttcctgcccctgctgctgctggccgccccagccccccaccgggagagctacaagcctgtgattgtggtgcacggcctgtttgacagcagctacagcttccgccacctgctggagtacatcaatgagacccaccctggcaccgtggtgacagtgctggacctgtttgatggccgggagagcctgcggcccctgtgggagcaggtgcagggcttccgggaggccgtggtgcccatcatggccaaggccccccagggcgtgcacctgatctgctacagccagggcggcctggtgtgccgggccctgctgtctgtgatggatgaccacaacgtggacagcttcatcagcctgagcagcccccagatgggccagtatggagacacagactacctgaagtggctgttccccacctccatgaggagcaacctgtaccgcatctgctacagcccctggggccaggagttcagcatctgcaactactggcatgacccccaccatgatgacctgtacctgaatgccagcagcttcctggccctgatcaatggagagcgggaccaccccaatgccaccgtgtggaggaagaacttcctgcgggtgggccacctggtgctgattggaggcccagatgatggagtcatcaccccctggcagagcagcttcttcggcttctatgatgccaatgaaacagtgctggagatggaggagcagctggtgtacctgcgggacagctttggcctgaagaccctgctggcccggggggccatcgtgcgctgccccatggccggcatcagccacacagcctggcacagcaacagaaccctgtatgagacctgcatcgagccctggctgtcctag

SEQ ID NO: 163145 - DNA, 927 bp, Artificial Sequence
  Description of Artificial Sequence: Synthetic coding sequence
atgaagagctgtggctccatgctgggcctgtggggccagaggctgcctgctgcctgggtgctgctgctgctgcccttcctgcccctgctgctgctggccgccccagccccccaccgggccagctacaagcctgtgattgtggtgcacggcctgtttgacagcagctacagcttccgccacctgctggagtacatcaatgagacccaccctggcaccgtggtgacagtgctggacctgtttgatggccgggagagcctgcggcccctgtgggagcaggtgcagggcttccgggaggccgtggtgcccatcatggccaaggccccccagggcgtgcacctgatctgctacagccagggcggcctggtgtgccgggccctgctgtctgtgatggatgaccacaacgtggacagcttcatcagcctgagcagcccccagatgggccagtatggagacacagactacctgaagtggctgttccccacctccatgaggagcaacctgtaccgcatctgctacagcccctggggccaggagttcagcatctgcaactactggcatgacccccaccatgatgacctgtacctgaatgccagcagcttcctggccctgatcaatggagagcgggaccaccccaatgccaccgtgtggaggaagaacttcctgcgggtgggccacctggtgctgattggaggcccagatgatggagtcatcaccccctggcagagcagcttcttcggcttctatgatgccaatgaaacagtgctggagatggaggagcagctggtgtacctgcgggacagctttggcctgaagaccctgctggcccggggggccatcgtgcgctgccccatggccggcatcagccacacagcctggcacagcaacagaaccctgtatgagacctgcatcgagccctggctgtcctag

SEQ ID NO: 163146 - DNA, 909 bp, Artificial Sequence; identical to SEQ ID NO: 163140
  Description of Artificial Sequence: Synthetic coding sequence

SEQ ID NO: 163147 - DNA, 909 bp, Artificial Sequence
  Description of Artificial Sequence: Synthetic coding sequence
atgctgggcctgtggggccagaggctgcctgctgcctgggtgctgctgctgctgcccttcctgcccctgctgctgctggccgccccagccccccaccgggagagctacaagcctgtgattgtggtgcacggcctgtttgacagcagctacagcttccgccacctgctggagtacatcaatgagacccaccctggcaccgtggtgacagtgctggacctgtttgatggccgggagagcctgcggcccctgtgggagcaggtgcagggcttccgggaggccgtggtgcccatcatggccaaggccccccagggcgtgcacctgatctgctacagccagggcggcctggtgtgccgggccctgctgtctgtgatggatgaccacaacgtggacagcttcatcagcctgagcagcccccagatgggccagtatggagacacagactacctgaagtggctgttccccacctccatgaggagcaacctgtaccgcatctgctacagcccctggggccaggagttcagcatctgcaactactggcatgacccccaccatgatgacctgtacctgaatgccagcagcttcctggccctgatcaatggagagcgggaccaccccaatgccaccgtgtggaggaagaacttcctgcgggtgggccacctggtgctgattggaggcccagatgatggagtcatcaccccctggcagagcagcttcttcggcttctatgatgccaatgaaacagtgctggagatggaggagcagctggtgtacctgcgggacagctttggcctgaagaccctgctggcccggggggccatcgtgcgctgccccatggccggcatcagccacacagcctggcacagcaacagaaccctgtatgagacctgcatcgagccctggctgtcctag

SEQ ID NO: 163148 - DNA, 909 bp, Artificial Sequence; identical to SEQ ID NO: 163147
  Description of Artificial Sequence: Synthetic coding sequence

SEQ ID NO: 163149 - DNA, 909 bp, Artificial Sequence; identical to SEQ ID NO: 163147
  Description of Artificial Sequence: Synthetic coding sequence

SEQ ID NO: 163150 - DNA, 909 bp, Artificial Sequence
  Description of Artificial Sequence: Synthetic coding sequence
atgctgggcctgtggggccagaggctgcctgctgcctgggtgctgctgctgctgcccttcctgcccctgctgctgctggccgccccagccccccaccgggccagctacaagcctgtgattgtggtgcacggcctgtttgacagcagctacagcttccgccacctgctggagtacatcaatgagacccaccctggcaccgtggtgacagtgctggacctgtttgatggccgggagagcctgcggcccctgtgggagcaggtgcagggcttccgggaggccgtggtgcccatcatggccaaggccccccagggcgtgcacctgatctgctacagccagggcggcctggtgtgccgggccctgctgtctgtgatggatgaccacaacgtggacagcttcatcagcctgagcagcccccagatgggccagtatggagacacagactacctgaagtggctgttccccacctccatgaggagcaacctgtaccgcatctgctacagcccctggggccaggagttcagcatctgcaactactggcatgacccccaccatgatgacctgtacctgaatgccagcagcttcctggccctgatcaatggagagcgggaccaccccaatgccaccgtgtggaggaagaacttcctgcgggtgggccacctggtgctgattggaggcccagatgatggagtcatcaccccctggcagagcagcttcttcggcttctatgatgccaatgaaacagtgctggagatggaggagcagctggtgtacctgcgggacagctttggcctgaagaccctgctggcccggggggccatcgtgcgctgccccatggccggcatcagccacacagcctggcacagcaacagaaccctgtatgagacctgcatcgagccctggctgtcctag

SEQ ID NO: 163151 - DNA, 909 bp, Artificial Sequence; identical to SEQ ID NO: 163150
  Description of Artificial Sequence: Synthetic coding sequence

SEQ ID NO: 163152 - DNA, 909 bp, Artificial Sequence; identical to SEQ ID NO: 163150
  Description of Artificial Sequence: Synthetic coding sequence

SEQ ID NO: 163153 - DNA, 927 bp, Artificial Sequence; identical to SEQ ID NO: 163145
  Description of Artificial Sequence: Synthetic coding sequence

SEQ ID NO: 163154 - DNA, 282 bp, Artificial Sequence
  Description of Artificial Sequence: Synthetic coding sequence
atgctgggcctgtggggccagaggctgcctgctgcctgggtgctgctgctgctgcccttcctgcccctgctgctgctggccgccccagccccccaccgggccagctacaagcctgtgattgtggtgcacggcctgtttgacagcagctacagcttccgccacctgctggagtacatcaatgaaggagccctgtgtgccggcctgtgcttcctgtcctggatgatcaccacctggatcctgagcagccccagccccctgcaccgctgggacagcatggagtag

SEQ ID NO: 163155 - DNA, 543 bp, Artificial Sequence
  Description of Artificial Sequence: Synthetic coding sequence
atgctgggcctgtgtggccagaggctgcctgctgcctgggtgctgctgctgctgcccttcctgcccctgctgctgctggccgccccagccccccaccgggccagctacaagcctgtgattgtggtgcacggcctgtttgacagcagctacagcttccgccacctgctggagtacatcaatgagacccaccctggcaccgtggtgacagtgctggacctgtttgatggccgggagagcctgcggcccctgtgggagcaggtgcagggcttccgggaggccgtggtgcccatcatggccaaggccccccagggcgtgcacctgatctgctacagccagggcggcctggtgtgccgggccctgctgtctgtgatggatgaccacaacgtggacagcttcatcagcctgagcagcccccagatgggccagtatggagacacagactacctgaagtggctgttccccacctccatgaggagcaacctgtaccgcatctgctacagcccctggggccaggagttcagcatctgcaactactggcactag

SEQ ID NO: 163156 - DNA, 927 bp, Artificial Sequence; identical to SEQ ID NO: 163145
  Description of Artificial Sequence: Synthetic coding sequence

SEQ ID NO: 163157 - DNA, 603 bp, Artificial Sequence
  Description of Artificial Sequence: Synthetic coding sequence
atgctgggcctgtggggccagaggctgcctgctgcctgggtgctgctgctgctgcccttcctgcccctgctgctgctggccgccccagccccccaccgggagagctacaagcctgtgattgtggtgcacggcctgtttgacagcagctacagcttccgccacctgctggagtacatcaatgagacccaccctggcaccgtggtgacagtgctggacctgtttgatggccgggagagcctgcggcccctgtgggagcaggtgcagggcttccgggaggccgtggtgcccatcatggccaaggccccccagggcgtgcacctgatctgctacagccagggcggcctggtgtgccgggccctgctgtctgtgatggatgaccacaacgtggacagcttcatcagcctgagcagcccccagatgggccagtatggagacacagactacctgaagtggctgttccccacctccatgaggagcaacctgtaccgcatctgctacagcccctggggccaggagttcagcatctgcaactactggcatgacccccaccatgatgacctgtacctgaatgccagcagcttcctggccctgatcaatggatag

SEQ ID NO: 163158 - DNA, 477 bp, Artificial Sequence
  Description of Artificial Sequence: Synthetic coding sequence
atgctgggcctgtggggccagaggctgcctgctgcctgggtgctgctgctgctgcccttcctgcccctgctgctgctggccgccccagccccccaccgggagagctacaagcctgtgattgtggtgcacggcctgtttgacagcagctacagcttccgccacctgctggagtacatcaatgagatgggccagtatggagacacagactacctgaagtggctgttccccacctccatgaggagcaacctgtaccgcatctgctacagcccctggggccaggagttcagcatctgcaactactggcatgacccccaccatgatgacctgtacctgaatgccagcagcttcctggccctgatcaatggagagcgggaccaccccaatgccaccgtgtggaggaagaacttcctgcgggtgggccacctggtgctgattggaggcccagatgatggagtcatcaccccctggcagagctag

SEQ ID NO: 163159 - DNA, 543 bp, Artificial Sequence
  Description of Artificial Sequence: Synthetic coding sequence
atgctgggcctgtggggccagaggctgcctgctgcctgggtgctgctgctgctgcccttcctgcccctgctgctgctggccgccccagccccccaccgggccagctacaagcctgtgattgtggtgcacggcctgtttgacagcagctacagcttccgccacctgctggagtacatcaatgagacccaccctggcaccgtggtgacagtgctggacctgtttgatggccgggagagcctgcggcccctgtgggagcaggtgcagggcttccgggaggccgtggtgcccatcatggccaaggccccccagggcgtgcacctgatctgctacagccagggcggcctggtgtgccgggccctgctgtctgtgatggatgaccacaacgtggacagcttcatcagcctgagcagcccccagatgggccagtatggagacacagactacctgaagtggctgttccccacctccatgaggagcaacctgtaccgcatctgctacagcccctggggccaggagttcagcatctgcaactactggcactag

SEQ ID NO: 163160 - DNA, 477 bp, Artificial Sequence
  Description of Artificial Sequence: Synthetic coding sequence
atgctgggcctgtggggccagaggctgcctgctgcctgggtgctgctgctgctgcccttcctgcccctgctgctgctggccgccccagccccccaccgggccagctacaagcctgtgattgtggtgcacggcctgtttgacagcagctacagcttccgccacctgctggagtacatcaatgagatgggccagtatggagacacagactacctgaagtggctgttccccacctccatgaggagcaacctgtaccgcatctgctacagcccctggggccaggagttcagcatctgcaactactggcatgacccccaccatgatgacctgtacctgaatgccagcagcttcctggccctgatcaatggagagcgggaccaccccaatgccaccgtgtggaggaagaacttcctgcgggtgggccacctggtgctgattggaggcccagatgatggagtcatcaccccctggcagagctag

SEQ ID NO: 163161 - DNA, 543 bp, Artificial Sequence; identical to SEQ ID NO: 163159
  Description of Artificial Sequence: Synthetic coding sequence

SEQ ID NO: 163162 - DNA, 909 bp, Artificial Sequence; identical to SEQ ID NO: 163150
  Description of Artificial Sequence: Synthetic coding sequence

SEQ ID NO: 163163 - DNA, 909 bp, Artificial Sequence; identical to SEQ ID NO: 163150
  Description of Artificial Sequence: Synthetic coding sequence

SEQ ID NO: 163164 - DNA, 927 bp, Artificial Sequence; identical to SEQ ID NO: 163145
  Description of Artificial Sequence: Synthetic coding sequence

SEQ ID NO: 163165 - DNA, 282 bp, Artificial Sequence; identical to SEQ ID NO: 163154
  Description of Artificial Sequence: Synthetic coding sequence

SEQ ID NO: 163166 - DNA, 909 bp, Artificial Sequence; identical to SEQ ID NO: 163150
  Description of Artificial Sequence: Synthetic coding sequence

SEQ ID NO: 163167 - DNA, 477 bp, Artificial Sequence
  Description of Artificial Sequence: Synthetic coding sequence
atgctgggcctgtgtggccagaggctgcctgctgcctgggtgctgctgctgctgcccttcctgcccctgctgctgctggccgccccagccccccaccgggccagctacaagcctgtgattgtggtgcacggcctgtttgacagcagctacagcttccgccacctgctggagtacatcaatgagatgggccagtatggagacacagactacctgaagtggctgttccccacctccatgaggagcaacctgtaccgcatctgctacagcccctggggccaggagttcagcatctgcaactactggcatgacccccaccatgatgacctgtacctgaatgccagcagcttcctggccctgatcaatggagagcgggaccaccccaatgccaccgtgtggaggaagaacttcctgcgggtgggccacctggtgctgattggaggcccagatgatggagtcatcaccccctggcagagctag

SEQ ID NO: 163168 - DNA, 711 bp, Artificial Sequence
  Description of Artificial Sequence: Synthetic coding sequence
atgctgggcctgtggggccagaggctgcctgctgcctgggtgctgctgctgctgcccttcctgcccctgctgctgctggccgccccagccccccaccgggagagctacaagcctgtgattgtggtgcacggcctgtttgacagcagctacagcttccgccacctgctggagtacatcaatgagacccaccctggcaccgtggtgacagtgctggacctgtttgatggccgggagagcctgcggcccctgtgggagcaggtgcagggcttccgggaggccgtggtgcccatcatggccaaggccccccagggcgtgcacctgatctgctacagccagggcggcctggtgtgccgggccctgctgtctgtgatggatgaccacaacgtggacagcttcatcagcctgagcagcccccagatgggccagtatggagacacagactacctgaagtggctgttccccacctccatgaggagcaacctgtaccgcatctgctacagcccctggggccaggagttcagcatctgcaactactggcatgacccccaccatgatgacctgtacctgaatgccagcagcttcctggccctgatcaatggagagcgggaccaccccaatgccaccgtgtggaggaagaacttcctgcgggtgggccacctggtgctgattggaggcccagatgatggagtcatcaccccctggcagagctag

SEQ ID NO: 163169 - DNA, 543 bp, Artificial Sequence; identical to SEQ ID NO: 163159
  Description of Artificial Sequence: Synthetic coding sequence

SEQ ID NO: 163170 - DNA, 711 bp, Artificial Sequence; identical to SEQ ID NO: 163168
  Description of Artificial Sequence: Synthetic coding sequence

SEQ ID NO: 163171 - DNA, 603 bp, Artificial Sequence
  Description of Artificial Sequence: Synthetic coding sequence
atgctgggcctgtggggccagaggctgcctgctgcctgggtgctgctgctgctgcccttcctgcccctgctgctgctggccgccccagccccccaccgggccagctacaagcctgtgattgtggtgcacggcctgtttgacagcagctacagcttccgccacctgctggagtacatcaatgagacccaccctggcaccgtggtgacagtgctggacctgtttgatggccgggagagcctgcggcccctgtgggagcaggtgcagggcttccgggaggccgtggtgcccatcatggccaaggccccccagggcgtgcacctgatctgctacagccagggcggcctggtgtgccgggccctgctgtctgtgatggatgaccacaacgtggacagcttcatcagcctgagcagcccccagatgggccagtatggagacacagactacctgaagtggctgttccccacctccatgaggagcaacctgtaccgcatctgctacagcccctggggccaggagttcagcatctgcaactactggcatgacccccaccatgatgacctgtacctgaatgccagcagcttcctggccctgatcaatggatag

SEQ ID NO: 163172 - DNA, 909 bp, Artificial Sequence; identical to SEQ ID NO: 163150
  Description of Artificial Sequence: Synthetic coding sequence

SEQ ID NO: 163173 - DNA, 603 bp, Artificial Sequence; identical to SEQ ID NO: 163171
  Description of Artificial Sequence: Synthetic coding sequence

SEQ ID NO: 163174 - DNA, 729 bp, Artificial Sequence
  Description of Artificial Sequence: Synthetic coding sequence
atgaagagctgtggctccatgctgggcctgtggggccagaggctgcctgctgcctgggtgctgctgctgctgcccttcctgcccctgctgctgctggccgccccagccccccaccgggagagctacaagcctgtgattgtggtgcacggcctgtttgacagcagctacagcttccgccacctgctggagtacatcaatgagacccaccctggcaccgtggtgacagtgctggacctgtttgatggccgggagagcctgcggcccctgtgggagcaggtgcagggcttccgggaggccgtggtgcccatcatggccaaggccccccagggcgtgcacctgatctgctacagccagggcggcctggtgtgccgggccctgctgtctgtgatggatgaccacaacgtggacagcttcatcagcctgagcagcccccagatgggccagtatggagacacagactacctgaagtggctgttccccacctccatgaggagcaacctgtaccgcatctgctacagcccctggggccaggagttcagcatctgcaactactggcatgacccccaccatgatgacctgtacctgaatgccagcagcttcctggccctgatcaatggagagcgggaccaccccaatgccaccgtgtggaggaagaacttcctgcgggtgggccacctggtgctgattggaggcccagatgatggagtcatcaccccctggcagagctag

SEQ ID NO: 163175 - DNA, 711 bp, Artificial Sequence; identical to SEQ ID NO: 163168
  Description of Artificial Sequence: Synthetic coding sequence

SEQ ID NO: 163176 - DNA, 543 bp, Artificial Sequence; identical to SEQ ID NO: 163159
  Description of Artificial Sequence: Synthetic coding sequence

SEQ ID NO: 163177 - DNA, 477 bp, Artificial Sequence; identical to SEQ ID NO: 163160
  Description of Artificial Sequence: Synthetic coding sequence

SEQ ID NO: 163178 - DNA, 603 bp, Artificial Sequence; identical to SEQ ID NO: 163157
  Description of Artificial Sequence: Synthetic coding sequence

SEQ ID NO: 163179 - DNA, 603 bp, Artificial Sequence
  Description of Artificial Sequence: Synthetic coding sequence
atgctgggcctgtgtggccagaggctgcctgctgcctgggtgctgctgctgctgcccttcctgcccctgctgctgctggccgccccagccccccaccgggccagctacaagcctgtgattgtggtgcacggcctgtttgacagcagctacagcttccgccacctgctggagtacatcaatgagacccaccctggcaccgtggtgacagtgctggacctgtttgatggccgggagagcctgcggcccctgtgggagcaggtgcagggcttccgggaggccgtggtgcccatcatggccaaggccccccagggcgtgcacctgatctgctacagccagggcggcctggtgtgccgggccctgctgtctgtgatggatgaccacaacgtggacagcttcatcagcctgagcagcccccagatgggccagtatggagacacagactacctgaagtggctgttccccacctccatgaggagcaacctgtaccgcatctgctacagcccctggggccaggagttcagcatctgcaactactggcatgacccccaccatgatgacctgtacctgaatgccagcagcttcctggccctgatcaatggatag

SEQ ID NO: 163180 - DNA, 441 bp, Artificial Sequence
  Description of Artificial Sequence: Synthetic coding sequence
atggatgaccacaacgtggacagcttcatcagcctgagcagcccccagatgggccagtacggggacacagactacctgaagtggctgttccccacctccatgaggagcaacctgtaccgcatctgctacagcccctggggccaggagttcagcatctgcaactactggcatgacccccaccatgatgacctgtacctgaatgccagcagcttcctggccctgatcaacggggagcgggaccaccccaatgccaccgtgtggaggaagaacttcctgcgggtgggccacctggtgctgattggaggcccagatgatggagtcatcaccccctggcagagcagcttcttcggcttctatgatgccaatgagaccgtgctggagatggaggagcagctgcctgtgggcagctctgtgaaggccaaccacggcgtgcagggctag

SEQ ID NO: 163181 - DNA, 477 bp, Artificial Sequence; identical to SEQ ID NO: 163160
  Description of Artificial Sequence: Synthetic coding sequence

SEQ ID NO: 163182 - DNA, 909 bp, Artificial Sequence; identical to SEQ ID NO: 163150
  Description of Artificial Sequence: Synthetic coding sequence

SEQ ID NO: 163183 - DNA, 909 bp, Artificial Sequence; identical to SEQ ID NO: 163150
  Description of Artificial Sequence: Synthetic coding sequence

SEQ ID NO: 163184 - DNA, 909 bp, Artificial Sequence; identical to SEQ ID NO: 163150
  Description of Artificial Sequence: Synthetic coding sequence

SEQ ID NO: 163185 - DNA, 282 bp, Artificial Sequence
  Description of Artificial Sequence: Synthetic coding sequence
atgctgggcctgtggggccagaggctgcctgctgcctgggtgctgctgctgctgcccttcctgcccctgctgctgctggccgccccagccccccaccgggagagctacaagcctgtgattgtggtgcacggcctgtttgacagcagctacagcttccgccacctgctggagtacatcaatgaaggagccctgtgtgccggcctgtgcttcctgtcctggatgatcaccacctggatcctgagcagccccagccccctgcaccgctgggacagcatggagtag

SEQ ID NO: 163186 - DNA, 603 bp, Artificial Sequence; identical to SEQ ID NO: 163171
  Description of Artificial Sequence: Synthetic coding sequence

SEQ ID NO: 163187 - DNA, 603 bp, Artificial Sequence; identical to SEQ ID NO: 163171
  Description of Artificial Sequence: Synthetic coding sequence

SEQ ID NO: 163188 - DNA, 909 bp, Artificial Sequence; identical to SEQ ID NO: 163150
  Description of Artificial Sequence: Synthetic coding sequence

SEQ ID NO: 163189 - DNA, 906 bp, Artificial Sequence
  Description of Artificial Sequence: Synthetic coding sequence
atgctgggcctgtgtggccagaggctgcctgctgcctgggtgctgctgctgctgcccttcctgcccctgctgctgctggccgccccagccccccaccgggccagctacaagcctgtgattgtggtgcacggcctgtttgacagcagctacagcttccgccacctgctggagtacatcaatgagacccaccctggcaccgtggtgacagtgctggacctgtttgatggccgggagagcctgcggcccctgtgggagcaggtgcagggcttccgggaggccgtggtgcccatcatggccaaggccccccagggcgtgcacctgatctgctacagccagggcggcctggtgtgccgggccctgctgtctgtgatggatgaccacaacgtggacagcttcatcagcctgagcagcccccagatgggccagtatggagacacagactacctgaagtggctgttccccacctccatgaggagcaacctgtaccgcatctgctacagcccctggggccaggagttcagcatctgcaactactggcatgacccccaccatgatgacctgtacctgaatgccagcagcttcctggccctgatcaatggagagcgggaccaccccaatgccaccgtgtggaggaagaacttcctgcgggtgggccacctggtgctgattggaggcccagatgatggagtcatcaccccctggcagagcagcttcttcggcttctatgatgccaatgaaacagtgctggagatggaggagcagctgcctgcccggcccacccaccagagcgagctgctgctgctgcggctggtgtgcctgaagccacccaggaggaagaagccagcctgccgggtgcagaggcagagcgagagctggggccctggcctgagctgtgccctgtcctag

SEQ ID NO: 163190 - DNA, 477 bp, Artificial Sequence; identical to SEQ ID NO: 163158
  Description of Artificial Sequence: Synthetic coding sequence

SEQ ID NO: 163191 - DNA, 543 bp, Artificial Sequence; identical to SEQ ID NO: 163159
  Description of Artificial Sequence: Synthetic coding sequence

SEQ ID NO: 163192 - DNA, 603 bp, Artificial Sequence; identical to SEQ ID NO: 163171
  Description of Artificial Sequence: Synthetic coding sequence

SEQ ID NO: 163193 - DNA, 909 bp, Artificial Sequence; identical to SEQ ID NO: 163150
  Description of Artificial Sequence: Synthetic coding sequence

SEQ ID NO: 163194 - DNA, 909 bp, Artificial Sequence; identical to SEQ ID NO: 163150
  Description of Artificial Sequence: Synthetic coding sequence

SEQ ID NO: 163195 - DNA, 282 bp, Artificial Sequence; identical to SEQ ID NO: 163154
  Description of Artificial Sequence: Synthetic coding sequence

SEQ ID NO: 163196 - DNA, 282 bp, Artificial Sequence
  Description of Artificial Sequence: Synthetic coding sequence
atgctgggcctgtgtggccagaggctgcctgctgcctgggtgctgctgctgctgcccttcctgcccctgctgctgctggccgccccagccccccaccgggccagctacaagcctgtgattgtggtgcacggcctgtttgacagcagctacagcttccgccacctgctggagtacatcaatgaaggagccctgtgtgccggcctgtgcttcctgtcctggatgatcaccacctggatcctgagcagccccagccccctgcaccgctgggacagcatggagtag

SEQ ID NO: 163197 - DNA, 909 bp, Artificial Sequence; identical to SEQ ID NO: 163150
  Description of Artificial Sequence: Synthetic coding sequence

SEQ ID NO: 163198 - DNA, 909 bp, Artificial Sequence; identical to SEQ ID NO: 163150
  Description of Artificial Sequence: Synthetic coding sequence

SEQ ID NO: 163199 - DNA, 543 bp, Artificial Sequence
  Description of Artificial Sequence: Synthetic coding sequence
atgctgggcctgtggggccagaggctgcctgctgcctgggtgctgctgctgctgcccttcctgcccctgctgctgctggccgccccagccccccaccgggagagctacaagcctgtgattgtggtgcacggcctgtttgacagcagctacagcttccgccacctgctggagtacatcaatgagacccaccctggcaccgtggtgacagtgctggacctgtttgatggccgggagagcctgcggcccctgtgggagcaggtgcagggcttccgggaggccgtggtgcccatcatggccaaggccccccagggcgtgcacctgatctgctacagccagggcggcctggtgtgccgggccctgctgtctgtgatggatgaccacaacgtggacagcttcatcagcctgagcagcccccagatgggccagtatggagacacagactacctgaagtggctgttccccacctccatgaggagcaacctgtaccgcatctgctacagcccctggggccaggagttcagcatctgcaactactggcactag

SEQ ID NO: 163200 - DNA, 543 bp, Artificial Sequence; identical to SEQ ID NO: 163199
  Description of Artificial Sequence: Synthetic coding sequence

SEQ ID NO: 163201 - DNA, 282 bp, Artificial Sequence; identical to SEQ ID NO: 163185
  Description of Artificial Sequence: Synthetic coding sequence

SEQ ID NO: 163202 - DNA, 711 bp, Artificial Sequence; identical to SEQ ID NO: 163168
  Description of Artificial Sequence: Synthetic coding sequence

SEQ ID NO: 163203 - DNA, 165 bp, Artificial Sequence
  Description of Artificial Sequence: Synthetic coding sequence
tgacatgatgacctgtacctgaatgccagcagcttcctggccctgatcaatggagagcgggaccaccccaatgccaccgtgtggaggaagaacttcctgcgggtgggccacctggtgctgattggaggcccagatgatggagtcatcaccccctggcagagctag

SEQ ID NO: 163204 - DNA, 711 bp, Artificial Sequence; identical to SEQ ID NO: 163168
  Description of Artificial Sequence: Synthetic coding sequence

SEQ ID NO: 163205 - DNA, 909 bp, Artificial Sequence; identical to SEQ ID NO: 163150
  Description of Artificial Sequence: Synthetic coding sequence

SEQ ID NO: 163206 - DNA, 909 bp, Artificial Sequence; identical to SEQ ID NO: 163150
  Description of Artificial Sequence: Synthetic coding sequence

SEQ ID NO: 163207 - DNA, 909 bp, Artificial Sequence; identical to SEQ ID NO: 163150
  Description of Artificial Sequence: Synthetic coding sequence

SEQ ID NO: 163208 - DNA, 441 bp, Artificial Sequence; identical to SEQ ID NO: 163180
  Description of Artificial Sequence: Synthetic coding sequence

SEQ ID NO: 163209 - DNA, 927 bp, Artificial Sequence; identical to SEQ ID NO: 163145
  Description of Artificial Sequence: Synthetic coding sequence

SEQ ID NO: 163210 - DNA, 882 bp, Artificial Sequence; identical to SEQ ID NO: 150980
  Description of Artificial Sequence: Synthetic coding sequence

SEQ ID NO: 163211 - DNA, 906 bp, Artificial Sequence
  Description of Artificial Sequence: Synthetic coding sequence
atgctgggcctgtggggccagaggctgcctgctgcctgggtgctgctgctgctgcccttcctgcccctgctgctgctggccgccccagccccccaccgggccagctacaagcctgtgattgtggtgcacggcctgtttgacagcagctacagcttccgccacctgctggagtacatcaatgagacccaccctggcaccgtggtgacagtgctggacctgtttgatggccgggagagcctgcggcccctgtgggagcaggtgcagggcttccgggaggccgtggtgcccatcatggccaaggccccccagggcgtgcacctgatctgctacagccagggcggcctggtgtgccgggccctgctgtctgtgatggatgaccacaacgtggacagcttcatcagcctgagcagcccccagatgggccagtatggagacacagactacctgaagtggctgttccccacctccatgaggagcaacctgtaccgcatctgctacagcccctggggccaggagttcagcatctgcaactactggcatgacccccaccatgatgacctgtacctgaatgccagcagcttcctggccctgatcaatggagagcgggaccaccccaatgccaccgtgtggaggaagaacttcctgcgggtgggccacctggtgctgattggaggcccagatgatggagtcatcaccccctggcagagcagcttcttcggcttctatgatgccaatgaaacagtgctggagatggaggagcagctgcctgcccggcccacccaccagagcgagctgctgctgctgcggctggtgtgcctgaagccacccaggaggaagaagccagcctgccgggtgcagaggcagagcgagagctggggccctggcctgagctgtgccctgtcctag

SEQ ID NO: 163212 - DNA, 909 bp, Artificial Sequence; identical to SEQ ID NO: 163147
  Description of Artificial Sequence: Synthetic coding sequence

SEQ ID NO: 163213 - DNA, 441 bp, Artificial Sequence; identical to SEQ ID NO: 163180
  Description of Artificial Sequence: Synthetic coding sequence

SEQ ID NO: 163214 - DNA, 882 bp, Artificial Sequence; identical to SEQ ID NO: 150980
  Description of Artificial Sequence: Synthetic coding sequence

SEQ ID NO: 163215 - DNA, 906 bp, Artificial Sequence; identical to SEQ ID NO: 163211
  Description of Artificial Sequence: Synthetic coding sequence

SEQ ID NO: 163216 - DNA, 441 bp, Artificial Sequence; identical to SEQ ID NO: 163180
  Description of Artificial Sequence: Synthetic coding sequence

SEQ ID NO: 163217 - DNA, 906 bp, Artificial Sequence; identical to SEQ ID NO: 163211
  Description of Artificial Sequence: Synthetic coding sequence

SEQ ID NO: 163218 - DNA, 441 bp, Artificial Sequence; identical to SEQ ID NO: 163180
  Description of Artificial Sequence: Synthetic coding sequence

SEQ ID NO: 163219 - DNA, 882 bp, Artificial Sequence; identical to SEQ ID NO: 150980
  Description of Artificial Sequence: Synthetic coding sequence

SEQ ID NO: 163220 - DNA, 882 bp, Artificial Sequence; identical to SEQ ID NO: 150980
  Description of Artificial Sequence: Synthetic coding sequence

SEQ ID NO: 163221 - DNA, 909 bp, Artificial Sequence; identical to SEQ ID NO: 163150
  Description of Artificial Sequence: Synthetic coding sequence

SEQ ID NO: 163222 - DNA, 441 bp, Artificial Sequence; identical to SEQ ID NO: 163180
  Description of Artificial Sequence: Synthetic coding sequence

SEQ ID NO: 163223 - DNA, 909 bp, Artificial Sequence; identical to SEQ ID NO: 163150
  Description of Artificial Sequence: Synthetic coding sequence

SEQ ID NO: 163224 - DNA, 441 bp, Artificial Sequence; identical to SEQ ID NO: 163180
  Description of Artificial Sequence: Synthetic coding sequence

SEQ ID NO: 163225 - DNA, 906 bp, Artificial Sequence; identical to SEQ ID NO: 163211
  Description of Artificial Sequence: Synthetic coding sequence

SEQ ID NO: 163226 - DNA, 906 bp, Artificial Sequence
  Description of Artificial Sequence: Synthetic coding sequence
atgctgggcctgtggggccagaggctgcctgctgcctgggtgctgctgctgctgcccttcctgcccctgctgctgctggccgccccagccccccaccgggagagctacaagcctgtgattgtggtgcacggcctgtttgacagcagctacagcttccgccacctgctggagtacatcaatgagacccaccctggcaccgtggtgacagtgctggacctgtttgatggccgggagagcctgcggcccctgtgggagcaggtgcagggcttccgggaggccgtggtgcccatcatggccaaggccccccagggcgtgcacctgatctgctacagccagggcggcctggtgtgccgggccctgctgtctgtgatggatgaccacaacgtggacagcttcatcagcctgagcagcccccagatgggccagtatggagacacagactacctgaagtggctgttccccacctccatgaggagcaacctgtaccgcatctgctacagcccctggggccaggagttcagcatctgcaactactggcatgacccccaccatgatgacctgtacctgaatgccagcagcttcctggccctgatcaatggagagcgggaccaccccaatgccaccgtgtggaggaagaacttcctgcgggtgggccacctggtgctgattggaggcccagatgatggagtcatcaccccctggcagagcagcttcttcggcttctatgatgccaatgaaacagtgctggagatggaggagcagctgcctgcccggcccacccaccagagcgagctgctgctgctgcggctggtgtgcctgaagccacccaggaggaagaagccagcctgccgggtgcagaggcagagcgagagctggggccctggcctgagctgtgccctgtcctag

SEQ ID NO: 163227 - DNA, 906 bp, Artificial Sequence; identical to SEQ ID NO: 163211
  Description of Artificial Sequence: Synthetic coding sequence

SEQ ID NO: 163228 - DNA, 909 bp, Artificial Sequence; identical to SEQ ID NO: 163150
  Description of Artificial Sequence: Synthetic coding sequence

SEQ ID NO: 163229 - DNA, 3606 bp, Artificial Sequence
  Description of Artificial Sequence: Synthetic coding sequence
atgaactttgagggcctggaccccggcctggccgagtatgccccagccatgcacagcgccctggaccctgtgctggatgcccacctgaaccccagcctgctgcagaatgtggagctggaccctgagggcgtggccctggaggccctgcctgtgcaggagagcgtgcacatcatggagggcgtgtacagcgagctgcacagcgtggtggccgaggtgggcgtgcctgtgtctgtgagccactttgacctgcacgaggagatgctgtgggtgggcagccatggaggccacgccaccagcttctttggacctgccctggagcgctacagcagcttccaggtgaatggaagtgatgacatccggcagatccagagcctggagaatggcatcctcttcctgaccaagaacaacctgaagtacatggcccggggcggcctcatcatctttgactacctgctggatgaaaatgaagacatgcacagcctgctgctgacagacagcagcaccctgctggtgggcggcctgcagaaccacatcattgaaattgacctgaacacagtgcaggagacccagaagtatgctgtggagaccccaggagtgaccatcatgaggcagaccaaccgcttcttcttctgtggccacaccagcggcaaggtgtccctgcgggacctgcggaccttcaaggtggagcacgagtttgatgccttcagcggcagcctgagtgactttgatgtgcacggcaacctgctggccgcctgtggcttcagcagccggctgaccggcctggcctgtgaccgcttcctgaaggtgtatgacctgaggatgatgagggccatcacccccctgcaggtgcacgtggaccctgccttcctgcgcttcatccccacctacaccagccggctggccatcatcagccagagcggccagtgccagttctgtgagcccaccggcctggccaacccagctgacatcttccacgtgaaccctgtgggccccctgctgatgacctttgatgtgtctgccagcaagcaggccctggcctttggagacagcgagggctgtgtgcacctgtggacagacagccctgagcccagcttcaacccctacagccgggagacagaatttgccctgccctgcctggtggacagcctgccccccctggactggagccaggacctgctgcccctgagcctcatccctgtgcccctgaccacagacaccctgctgagtgactggccagctgccaacagcgccccagccccccggcgggcccctcctgtggatgctgagatcctgcggaccatgaagaaggtgggcttcatcggctacgcccccaaccccaggacccggctgaggaaccagatcccctaccgcctgaaggagagtgacagcgagtttgacagcttcagccaggtgacagagagccctgtgggccgggaggaggagccccacctgcacatggtgtccaagaagtacaggaaggtgaccatcaagtacagcaagctgggcctggaggactttgacttcaagcactacaacaagaccctgtttgctggcctggagccccacatccccaatgcctactgcaactgcatgatccaggtgctgtacttcctggagcctgtgcgctgcctgatccagaaccacctgtgccagaaggagttctgcctggcctgtgagctgggcttcctgttccacatgctggacctgagcagaggagacccctgccagggcaacaacttcctgcgggccttccgcaccatccctgaggccagcgccctgggcctcatcctggccgacagtgatgaggccagcggcaagggcaacctggcccggctcatccagcgctggaaccgcttcatcctgacccagctgcaccaggacatgcaggagctggagatcccccaggcctacagaggagctgggggcagcttctgcagcagcggggacagcgtcatcggccagctgttcagctgtgagatggagaactgcagcctgtgccgctgtggcagcgagaccgtgcgggccagcagcaccctgctcttcaccctgagctacccagatggcagcaagagtgacaagacaggcaagaactatgactttgcccaggtgctgaagaggagcatctgcctggaccagaacacccaggcctggtgtgacacctgtgagaagtaccagcccaccatccagaccaggaacatccgccacctgcctgacatcctggtgatcaactgtgaggtgaacagcagcaaggaggccgacttctggaggatgcaggccgaggtggccttcaagatggctgtgaagaagcacggcggggagatcagcaagaacaaggagtttgccctggccgactggaaggagctgggcagccctgagggcgtgctggtgtgccccagcattgaggagctgaagaatgtgtggctgcccttcagcatccgcatgaagatgaccaagaacaagggcctggatgtgtgcaactggacagatggagatgagatgcagtggggccctgcccgggcagaggaggagcacggcgtgtatgtgtatgacctgatggccaccgtggtgcacatcctggacagcaggactggaggcagcctggtggcccacatcaaggtgggggagacctaccaccagaggaaggagggcgtgacccaccagcagtggtacctgttcaatgacttcctgattgagcccatcgacaagcatgaagctgtgcagtttgacatgaactggaaggtgcctgccatcctgtactacgtgaagaggaacctgaacagccgctacaacctgaacatcaagaaccccatcgaggcctctgtgctgctggccgaggccagcctggccaggaagcagaggaagacccacaccaccttcatccccctgatgctgaatgagatgccccagatcggggacctggtgggcctggatgctgagtttgtgaccctgaatgaggaggaggccgagctgcggagtgatggcaccaagagcaccatcaagcccagccagatgtctgtggcccgcatcacctgtgtgcggggccagggccccaatgaaggcatccccttcattgatgactacatcagcacccaggagcaggtggtggactacctgacccagtacagcggcatcaagccaggggacctggatgccaagatcagcagcaagcacctgaccaccctgaagagcacctacctgaagctgcgcttcctgattgacatcggcgtgaagtttgtgggccacggcctgcagaaggacttccgggtcatcaacctgatggtgcccaaggaccaggtgctggacacagtgtacctgttccacatgcccaggaagaggatgatcagcctgcgcttcctggcctggtacttcctggacctgaagatccagggcgagacccatgacagcattgaagatgccaggacagccctgcagctgtacaggaagtacctggagctgagcaagaatggaacagagcctgagagcttccacaaggtgctgaagggcctgtatgagaagggcaggaagatggactggaaggtgcctgagcctgagggccagaccagccccaagaatgctgctgtgttcagctctgtgctggccctgtag

SEQ ID NO: 163230 - DNA, 3609 bp, Artificial Sequence
  Description of Artificial Sequence: Synthetic coding sequence
atgaactttgagggcctggaccccggcctggccgagtatgccccagccatgcacagcgccctggaccctgtgctggatgcccacctgaaccccagcctgctgcagaatgtggagctggaccctgagggcgtggccctggaggccctgcctgtgcaggagagcgtgcacatcatggagggcgtgtacagcgagctgcacagcgtggtggccgaggtgggcgtgcctgtgtctgtgagccactttgacctgcacgaggagatgctgtgggtgggcagccatggaggccacgccaccagcttctttggacctgccctggagcgctacagcagcttccaggtgaatggaagtgatgacatccggcagatccagagcctggagaatggcatcctcttcctgaccaagaacaacctgaagtacatggcccggggcggcctcatcatctttgactacctgctggatgaaaatgaagacatgcacagcctgctgctgacagacagcagcaccctgctggtgggcggcctgcagaaccacatcattgaaattgacctgaacacagtgcaggagacccagaagtatgctgtggagaccccaggagtgaccatcatgaggcagaccaaccgcttcttcttctgtggccacaccagcggcaaggtgtccctgcgggacctgcggaccttcaaggtggagcacgagtttgatgccttcagcggcagcctgagtgactttgatgtgcacggcaacctgctggccgcctgtggcttcagcagccggctgaccggcctggcctgtgaccgcttcctgaaggtgtatgacctgaggatgatgagggccatcacccccctgcaggtgcacgtggaccctgccttcctgcgcttcatccccacctacaccagccggctggccatcatcagccagagcggccagtgccagttctgtgagcccaccggcctggccaacccagctgacatcttccacgtgaaccctgtgggccccctgctgatgacctttgatgtgtctgccagcaagcaggccctggcctttggagacagcgagggctgtgtgcacctgtggacagacagccctgagcccagcttcaacccctacagccgggagacagaatttgccctgccctgcctggtggacagcctgccccccctggactggagccaggacctgctgcccctgagcctcatccctgtgcccctgaccacagacaccctgctgagtgactggccagctgccaacagcgccccagccccccggcgggcccctcctgtggatgctgagatcctgcggaccatgaagaaggtgggcttcatcggctacgcccccaaccccaggacccggctgaggaaccagatcccctaccgcctgaaggagagtgacagcgagtttgacagcttcagccaggtgacagagagccctgtgggccgggaggaggagccccacctgcacatggtgtccaagaagtacaggaaggtgaccatcaagtacagcaagctgggcctggaggactttgacttcaagcactacaacaagaccctgtttgctggcctggagccccacatccccaatgcctactgcaactgcatgatccaggtgctgtacttcctggagcctgtgcgctgcctgatccagaaccacctgtgccagaaggagttctgcctggcctgtgagctgggcttcctgttccacatgctggacctgagcagaggagacccctgccagggcaacaacttcctgcgggccttccgcaccatccctgaggccagcgccctgggcctcatcctggccgacagtgatgaggccagcggcaagggcaacctggcccggctcatccagcgctggaaccgcttcatcctgacccagctgcaccaggacatgcaggagctggagatcccccaggcctacagaggagctgggggcagcagcttctgcagcagcggggacagcgtgattggccagctgttcagctgtgagatggagaactgcagcctgtgccgctgtggcagcgagaccgtgcgggccagcagcaccctgctcttcaccctgagctacccagatggcagcaagagtgacaagacaggcaagaactatgactttgcccaggtgctgaagaggagcatctgcctggaccagaacacccaggcctggtgtgacacctgtgagaagtaccagcccaccatccagaccaggaacatccgccacctgcctgacatcctggtgatcaactgtgaggtgaacagcagcaaggaggccgacttctggaggatgcaggccgaggtggccttcaagatggctgtgaagaagcatggaggagagatcagcaagaacaaggagtttgccctggccgactggaaggagctgggcagccctgagggcgtgctggtgtgccccagcattgaggagctgaagaatgtgtggctgcccttcagcatccgcatgaagatgaccaagaacaagggcctggatgtgtgcaactggacagatggagatgagatgcagtggggccctgcccgggcagaggaggagcacggcgtgtatgtgtatgacctgatggccaccgtggtgcacatcctggacagcaggactggaggcagcctggtggcccacatcaaggtgggggagacctaccaccagaggaaggagggcgtgacccaccagcagtggtacctgttcaatgacttcctgattgagcccatcgacaagcatgaggccgtgcagtttgacatgaactggaaggtgcctgccatcctgtactacgtgaagaggaacctgaacagccgctacaacctgaacatcaagaaccccatcgaggcctctgtgctgctggccgaggccagcctggccaggaagcagaggaagacccacaccaccttcatccccctgatgctgaatgagatgccccagattggagacctggtgggcctggatgctgagtttgtgaccctgaatgaggaggaggccgagctgcggagtgatggcaccaagagcaccatcaagcccagccagatgtctgtggcccgcatcacctgtgtgcggggccagggccccaatgaaggcatccccttcattgatgactacatcagcacccaggagcaggtggtggactacctgacccagtacagcggcatcaagccaggggacctggatgccaagatcagcagcaagcacctgaccaccctgaagagcacctacctgaagctgcgcttcctgattgatattggagtgaagtttgtgggccacggcctgcagaaggacttccgggtcatcaacctgatggtgcccaaggaccaggtgctggacacagtgtacctgttccacatgcccaggaagaggatgatcagcctgcgcttcctggcctggtacttcctggacctgaagatccagggcgagacccatgacagcattgaagatgccaggacagccctgcagctgtacaggaagtacctggagctgagcaagaatggaacagagcctgagagcttccacaaggtgctgaagggcctgtatgaaaaaggaaggaagatggactggaaggtgcctgagcctgagggccagaccagccccaagaatgctgctgtgttcagctctgtgctggccctgtag

SEQ ID NO: 163231 - DNA, 3597 bp, Artificial Sequence
  Description of Artificial Sequence: Synthetic coding sequence
atgaactttgagggcctggaccccggcctggccgagtatgccccagccatgcacagcgccctggaccctgtgctggatgcccacctgaaccccagcctgctgcagaatgtggagctggaccctgagggcgtggccctggaggccctgcctgtgcaggagagcgtgcacatcatggagggcgtgtacagcgagctgcacagcgtggtggccgaggtgggcgtgcctgtgtctgtgagccactttgacctgcacgaggagatgctgtgggtgggcagccatggaggccacgccaccagcttctttggacctgccctggagcgctacagcagcttccaggtgaatggaagtgatgacatccggcagatccagagcctggagaatggcatcctcttcctgaccaagaacaacctgaagtacatggcccggggcggcctcatcatctttgactacctgctggatgaaaatgaagacatgcacagcctgctgctgacagacagcagcaccctgctggtgggcggcctgcagaaccacatcattgaaattgacctgaacacagtgcaggagacccagaagtatgctgtggagaccccaggagtgaccatcatgaggcagaccaaccgcttcttcttctgtggccacaccagcggcaaggtgtccctgcgggacctgcggaccttcaaggtggagcacgagtttgatgccttcagcggcagcctgagtgactttgatgtgcacggcaacctgctggccgcctgtggcttcagcagccggctgaccggcctggcctgtgaccgcttcctgaaggtgtatgacctgaggatgatgagggccatcacccccctgcaggtgcacgtggaccctgccttcctgcgcttcatccccacctacaccagccggctggccatcatcagccagagcggccagtgccagttctgtgagcccaccggcctggccaacccagctgacatcttccacgtgaaccctgtgggccccctgctgatgacctttgatgtgtctgccagcaagcaggccctggcctttggagacagcgagggctgtgtgcacctgtggacagacagccctgagcccagcttcaacccctacagccgggagacagaatttgccctgccctgcctggtggacagcctgccccccctggactggagccaggacctgctgcccctgagcctcatccctgtgcccctgaccacagacaccctgctgagtgactggccagctgccaacagcgccccagccccccggcgggcccctcctgtggatgctgagatcctgcggaccatgaagaaggtgggcttcatcggctacgcccccaaccccaggacccggctgaggaaccagatcccctaccgcctgaaggagagtgacagcgagtttgacagcttcagccaggtgacagagagccctgtgggccgggaggaggagccccacctgcacatggtgtccaagaagtacaggaaggtgaccatcaagtacagcaagctgggcctggaggactttgacttcaagcactacaacaagaccctgtttgctggcctggagccccacatccccaatgcctactgcaactgcatgatccaggtgctgtacttcctggagcctgtgcgctgcctgatccagaaccacctgtgccagaaggagttctgcctggcctgtgagctgggcttcctgttccacatgctggacctgagcagaggagacccctgccagggcaacaacttcctgcgggccttccgcaccatccctgaggccagcgccctgggcctcatcctggccgacagtgatgaggccagcggcaagggcaacctggcccggctcatccagcgctggaaccgcttcatcctgacccagctgcaccaggacatgcaggagctggagatcccccaggcctacagaggagctgggggcagcagcttctgcagcagcggggacagcgtgattggccagctgttcagctgtgagatggagaactgcagcctgtgccgctgtggcagcgagaccgtgcgggccagcagcaccctgctcttcaccctgagctacccagatgacaagacaggcaagaactatgactttgcccaggtgctgaagaggagcatctgcctggaccagaacacccaggcctggtgtgacacctgtgagaagtaccagcccaccatccagaccaggaacatccgccacctgcctgacatcctggtgatcaactgtgaggtgaacagcagcaaggaggccgacttctggaggatgcaggccgaggtggccttcaagatggctgtgaagaagcatggaggagagatcagcaagaacaaggagtttgccctggccgactggaaggagctgggcagccctgagggcgtgctggtgtgccccagcattgaggagctgaagaatgtgtggctgcccttcagcatccgcatgaagatgaccaagaacaagggcctggatgtgtgcaactggacagatggagatgagatgcagtggggccctgcccgggcagaggaggagcacggcgtgtatgtgtatgacctgatggccaccgtggtgcacatcctggacagcaggactggaggcagcctggtggcccacatcaaggtgggggagacctaccaccagaggaaggagggcgtgacccaccagcagtggtacctgttcaatgacttcctgattgagcccatcgacaagcatgaggccgtgcagtttgacatgaactggaaggtgcctgccatcctgtactacgtgaagaggaacctgaacagccgctacaacctgaacatcaagaaccccatcgaggcctctgtgctgctggccgaggccagcctggccaggaagcagaggaagacccacaccaccttcatccccctgatgctgaatgagatgccccagattggagacctggtgggcctggatgctgagtttgtgaccctgaatgaggaggaggccgagctgcggagtgatggcaccaagagcaccatcaagcccagccagatgtctgtggcccgcatcacctgtgtgcggggccagggccccaatgaaggcatccccttcattgatgactacatcagcacccaggagcaggtggtggactacctgacccagtacagcggcatcaagccaggggacctggatgccaagatcagcagcaagcacctgaccaccctgaagagcacctacctgaagctgcgcttcctgattgatattggagtgaagtttgtgggccacggcctgcagaaggacttccgggtcatcaacctgatggtgcccaaggaccaggtgctggacacagtgtacctgttccacatgcccaggaagaggatgatcagcctgcgcttcctggcctggtacttcctggacctgaagatccagggcgagacccatgacagcattgaagatgccaggacagccctgcagctgtacaggaagtacctggagctgagcaagaatggaacagagcctgagagcttccacaaggtgctgaagggcctgtatgaaaaaggaaggaagatggactggaaggtgcctgagcctgagggccagaccagccccaagaatgctgctgtgttcagctctgtgctggccctgtag

SEQ ID NO: 163232 - DNA, 3609 bp, Artificial Sequence; identical to SEQ ID NO: 163230
  Description of Artificial Sequence: Synthetic coding sequence

SEQ ID NO: 163233 - DNA, 987 bp, Artificial Sequence
  Description of Artificial Sequence: Synthetic coding sequence
atggatgctgtgctgctggagcacttccctgggggcctggatgccttccccagcagctactttgatgaagatgacttcttcacagaccagagcagccgggaccccctggaggatggagatgagctgctggctgatgagcaggccgaggtggagttcctgagccaccagctgcacgagtactgctacagagatggagcctgcctgctgctgcagcctgcccccccagctgcccccctggccctggccccacccagcagcggcggcctgggggagccagatgatggcggcggcggcggctactgctgtgagaccggggcccctcctgggggcttcccctacagccctggcagcccccccagctgcctggcctacccctgtgccggggctgctgtgctgagccctggggcccggctgcggggcctgagcggggctgctgctgctgctgccaggagaagaagaagagtgcgctctgaggccgagctgcagcagctgcggcaggccgccaacgtgcgggagaggaggaggatgcagagcatcaatgatgcctttgagggcctgcggagccacatccccaccctgccctatgagaagaggctgagcaaggtggacaccctgcggctggccatcggctacatcaacttcctgtctgagctggtgcaggccgacctgcccctgcggggcggcggggccggcggctgcggcggccctgggggcggcggccgcctgggcggggacagccctggcagccaggcccagaaggtgatcatctgccaccggggcaccaggagccccagccccagcgaccctgactatggcctgccccccctggccggccacagcctgtcctggacagatgagaagcagctgaaggagcagaacatcatcagaacagccaaggtgtggaccccagaggaccccaggaagctgaacagcaagagcagcttcaacaacattgaaaatgagcccccatttgaatttgtgtcctag

SEQ ID NO: 163234 - DNA, 852 bp, Artificial Sequence
  Description of Artificial Sequence: Synthetic coding sequence
atgaatggagaggagcagtactatgctgccacccagctgtacaaggacccctgtgccttccagaggggccctgcccctgagttcagcgccagccccccagcctgcctgtacatgggccggcagcccccacctcctccaccccaccccttccctggggccctgggcgccctggagcagggcagccccccagacatcagcccctatgaggtgccccccctggctgatgatcctgctgtggcccacctgcaccaccacctgcctgcccagctggccctgccccaccccccagctggccccttccctgagggcgctgagcccggggtgctggaggagcccaacagagtgcagctgcccttcccctggatgaagagcaccaaggcccacgcctggaagggccagtgggccggcggggcctatgctgctgagcctgaggagaacaagaggaccaggacagcctacacccgggcccagctgctggagctggagaaggagttcctgttcaacaagtacatcagccggcccaggagagtggagctggccgtgatgctgaacctgacagagcggcacatcaagatctggttccagaacagaaggatgaagtggaagaaggaggaggacaagaagaggggcggcggcacagctgtgggcggcggcggcgtggccgagcctgagcaggactgtgctgtgaccagcggggaggagctgctggccctgcccccacctcctcctcctgggggcgctgtgcccccagctgcccctgtggccgcccgggagggccgcctgcccccaggcctgagcgccagcccccagcccagctctgtggccccccggcggccccaggagcccaggtag

SEQ ID NO: 163235 - DNA, 1398 bp, Artificial Sequence
  Description of Artificial Sequence: Synthetic coding sequence
atgctgcccctgtggaccctgagcctgctgctgggcgctgtggccggcaaggaggtgtgctatgagcggctgggctgcttcagtgatgacagcccctggagcggcatcacagagcggcccctgcacatcctgccctggagccccaaggatgtgaacacccgcttcctgctgtacaccaatgaaaaccccaacaacttccaggaggtggccgctgacagcagcagcatcagcggcagcaacttcaagaccaacaggaagacccgcttcatcatccacggcttcatcgacaagggggaggagaactggctggccaacgtgtgcaagaacctcttcaaggtggagagcgtgaactgcatctgtgtggactggaagggcggcagcaggacaggctacacccaggccagccagaacatccgcatcgtgggcgctgaggtggcctactttgtggagttcctgcagagcgccttcggctacagccccagcaatgtgcacgtgattggccacagcctgggcgcccacgccgccggggaggccggccgccgcaccaacggcaccatcggccgcatcaccggcctggaccctgctgagccctgcttccagggcaccccagagctggtgcggctggaccccagtgatgccaagtttgtggatgtgatccacacagatggagcccccatcgtgcccaacctgggcttcggcatgagccaggtggtgggccacctggacttcttccccaacggcggcgtggagatgcctggctgcaagaagaacatcctgagccagatcgtggacattgatggcatctgggagggcacccgggactttgctgcctgcaaccacctgcggagctacaagtactacacagacagcatcgtgaacccagatggctttgctggcttcccctgtgccagctacaacgtgttcaccgccaacaagtgcttcccctgccccagcggcggctgcccccagatgggccactacgccgaccgctacccaggcaagaccaatgatgtgggccagaagttctacctggacacaggagatgccagcaactttgcccgctggagatacaaggtgtctgtgaccctgagcggcaagaaggtgacaggccacatcctggtgtccctgtttggaaacaagggcaacagcaagcagtatgagatcttcaagggcaccctgaagccagacagcacccacagcaatgaatttgacagtgatgtggatgtgggggacctgcagatggtgaagttcatctggtacaacaacgtcatcaaccccaccctgccccgggtgggcgccagcaagatcatcgtggagaccaacgtgggcaagcagttcaacttctgcagccctgagaccgtgcgggaggaggtgctgctgaccctgaccccctgctag

SEQ ID NO: 163236 - DNA, 3372 bp, Artificial Sequence
  Description of Artificial Sequence: Synthetic coding sequence
atgaacagccccaatgaatctgcagatggcatgagcggccgggagcccagcctggagatcctgcccaggaccagcctgcacagcatccctgtgacagtggaggtgaagcctgtgctgccccgggccatgcccagctccatgggcggcggcggcggcggcagccccagccctgtggagctgcggggggccctggtgggctctgtggaccccaccctgcgggagcagcagctgcagcaggagctgctggccctgaagcagcagcagcagctgcagaagcagctgctgtttgctgagttccagaagcagcacgaccacctgacccggcagcacgaggtgcagctgcagaagcacctgaagcagcagcaggagatgctggccgccaagcagcagcaggagatgctggccgccaagaggcagcaggagctggagcagcagaggcagcgggagcagcagaggcaggaggagctggagaagcagaggctggagcagcagctgctgatcctgaggaacaaggagaagagcaaggagagcgccatcgccagcacagaggtgaagctgcggctgcaggagttcctgctgagcaagagcaaggagcccaccccaggcggcctgaaccacagcctgccccagcaccccaagtgctggggcgcccaccacgccagcctggaccagagcagccccccccagagcggccccccaggcaccccacccagctacaagctgcccctgcccggcccctatgacagcagagatgacttccccctgaggaagacagccagcgagcccaacctgaaggtgcgcagccggctgaagcagaaggtggccgagaggaggagcagccccctgctgcggaggaaggatggcaccgtcatcagcaccttcaagaagagagctgtggagatcaccggggccggccctggggccagctctgtgtgcaacagcgcccctggcagcggccccagcagccccaacagcagccacagcaccatcgccgagaatggcttcaccggctctgtgcccaacatccccacagagatgctgccccagcaccgggccctgcccctggacagcagccccaaccagttcagcctgtacaccagccccagcctgcccaacatcagcctgggcctgcaggccaccgtgacagtgaccaacagccacctgacagccagccccaagctgagcacccagcaggaggccgagcggcaggccctgcagagcctgcggcagggcggcaccctgaccgggaagttcatgagcaccagcagcatccctggctgcctgctgggcgtggccctggagggagatggcagcccccacggccacgccagcctgctgcagcacgtgctgctgctggagcaggcccggcagcagagcaccctgattgctgtgcccctgcacggccagagccccctggtgactggagagcgggtggccacctccatgaggacagtgggcaagctgcccaggcaccggcccctgagcaggacccagagcagccccctgccccagagcccccaggccctgcagcagctggtgatgcagcagcagcaccagcagttcctggagaagcagaagcagcagcagctgcagctgggcaagatcctgaccaagacaggagagctgccccggcagcccaccacccaccctgaggagacagaggaggagctgacagagcagcaggaggtgctgctgggggagggcgccctgaccatgccccgggagggcagcacagagagcgagagcacccaggaggacctggaggaggaggatgaagaagatgatggagaggaggaggaggactgcatccaggtgaaggatgaggagggggagagcggggctgaggagggccctgacctggaggagcctggagctggctacaagaagctgttcagtgatgcccagcccctgcagcccctgcaggtgtaccaggcccccctgagcctggccaccgtgccccaccaggccctgggccgcacccagagcagccctgctgcccctgggggcatgaagagccccccagaccagcctgtgaagcacctgttcaccaccggggtggtgtatgacaccttcatgctgaagcaccagtgcatgtgtggcaacacccacgtgcaccctgagcacgccggccgcatccagagcatctggagccggctgcaggagaccggcctgctgagcaaatgtgagcgcatccggggcaggaaggccaccctggatgagatccagacagtgcacagcgagtaccacaccctgctgtatggcaccagccccctgaaccggcagaagctggacagcaagaagctgctgggccccatcagccagaagatgtatgctgtgctgccctgtggcggcattggagtggacagcgacacagtgtggaatgagatgcacagcagcagcgctgtgaggatggctgtgggctgcctgctggagctggccttcaaggtggccgccggggagctgaagaatggatttgccatcatccggcccccaggccaccacgccgaggagagcacagccatgggcttctgcttcttcaacagcgtggccatcacagccaagctgctgcagcagaagctgaatgtgggcaaggtgctgattgtggactgggacatccaccacggcaatggcacccagcaggccttctacaatgaccccagcgtgctgtacatcagcctgcacagatatgacaatggaaacttcttccctggcagcggggcccctgaggaggtgggcggcggccctggggtgggctacaacgtgaatgtggcctggacaggaggagtggacccccccatcggagatgtggagtacctgacagccttcagaacagtggtgatgcccatcgcccacgagttctccccagatgtggtgctggtgtctgctggctttgatgctgtggagggccacctgagccccctgggcggctacagcgtgacagcccgctgcttcggccacctgacccggcagctgatgaccctggccggcggccgggtggtgctggccctggagggcggccatgacctgacagccatctgtgatgccagcgaggcctgtgtgtctgccctgctgtctgtggagctgcagcccctggatgaggccgtgctgcagcagaagcccaacatcaatgctgtggccaccctggagaaggtgattgagatccagagcaagcactggagctgtgtgcagaagtttgctgctggcctgggccgcagcctgcgggaggcccaggccggggagacagaggaggccgagaccgtgtctgccatggccctgctgtctgtgggcgctgagcaggcccaggccgccgccgcccgggagcacagccccaggcctgctgaggagcccatggagcaggagcccgccctgtag

SEQ ID NO: 163237 - DNA, 1128 bp, Artificial Sequence
  Description of Artificial Sequence: Synthetic coding sequence
atgaacaccagccacctgctggccctgctgctgcccaagagcccccagggcgagaacagaagcaagcccctgggcaccccctacaacttcagcgagcactgccaggacagcgtggatgtgatggtgttcatcgtgaccagctacagcattgagaccgtggtgggcgtgctgggcaacctgtgcctgatgtgtgtgacagtgcggcagaaggagaaggccaacgtgaccaacctgctgattgccaacctggccttcagtgacttcctgatgtgcctgctgtgccagcccctgacagctgtgtacaccatcatggactactggatctttggagagaccctgtgcaagatgtctgccttcatccagtgcatgtctgtgacagtgtccatcctgagcctggtgctggtggccctggagcggcaccagctgatcatcaaccccaccggctggaagcccagcatcagccaggcctacctgggcatcgtgctgatctgggtgattgcctgtgtgctgagcctgcccttcctggccaacagcatcctggagaatgtgttccacaagaaccacagcaaggccctggagttcctggccgacaaggtggtgtgcacagagagctggcccctggcccaccacaggaccatctacaccaccttcctgctgctcttccagtactgcctgcccctgggcttcatcctggtgtgctacgcccgcatctacagaaggctgcagaggcagggccgggtcttccacaagggcacctacagcctgcgggccggccacatgaagcaggtgaatgtggtgctggtggtgatggtggtggcctttgctgtgctgtggctgcccctgcacgtgttcaacagcctggaggactggcaccacgaggccatccccatctgccacggcaacctgatcttcctggtgtgccacctgctggccatggccagcacctgtgtgaaccccttcatctacggcttcctgaacaccaacttcaagaaggagatcaaggccctggtgctgacctgccagcagagcgcccccctggaggagagcgagcacctgcccctgagcacagtgcacacagaggtgtccaagggcagcctgcggctgagcggccgcagcaaccccatctag

SEQ ID NO: 163238 - DNA, 1128 bp, Artificial Sequence; identical to SEQ ID NO: 163237
  Description of Artificial Sequence: Synthetic coding sequence

SEQ ID NO: 163239 - DNA, 1797 bp, Artificial Sequence
  Description of Artificial Sequence: Synthetic coding sequence
atgctgaagctggtgggcggcggcggcggccaggactgggcctgcagcgtggccggcaccagcctgggcggggaggaggccgcctttgaggtggcccggcctggggaccagggcaaggccggcggcggcagccctggctggggctgtgccggcatcccagattctgcccctggagctggggtgctgcaggccggggctgtgggccctgcccggggcggccagggcgctgaggaggtgggggagagcgctgggggcggggaggagaggagagtgcgccacccccaggccccagccctgcggctgctgaacaggaagccccagggcggcagcggggagatcaagaccccagaaaatgacctgcagaggggccgcctgagccggggccccaggacagcccccccagcccctggcatgggagacaggagcggccagcaggagaggtctgtgccccacagccctggggcccctgtgggcaccagcgctgctgctgtgaatggcctgctgcacaacggcttccaccccccacctgtgcagccccctcatgtgtgcagccggggccctgtgggcggcagtgatgctgccccccagaggctgcccctgctgcctgagctgcagccccagcccctgctgccccagcacgacagccctgccaagaagtgccgcctgcggcggaggatggacagcggcaggaagaaccggccccccttcccctggtttggcatggacattggaggcaccctggtgaagctggtgtactttgagcccaaggacatcacagctgaggaggagcaggaggaggtggagaacctgaagagcatcaggaagtacctgaccagcaacacagcctacggcaagacaggcatcagagatgtgcacctggagctgaagaacctgaccatgtgtggcaggaagggcaacctgcacttcatccgcttccccagctgtgccatgcaccgcttcatccagatgggcagcgagaagaacttcagcagcctgcacaccaccctgtgtgccactggaggaggagccttcaagtttgaggaggacttcaggatgattgctgacctgcagctgcacaagctggatgagctggactgcctgatccagggcctgctgtatgtggacagcgtgggcttcaacgggaagccagagtgctactactttgagaaccccaccaaccctgagctgtgccagaagaagccctactgcctggacaacccctaccccatgctgctggtgaacatgggcagcggcgtgtccatcctggccgtgtacagcaaggacaactacaagagggtgacaggcaccagcctgggcggcggcaccttcctgggcctgtgctgcctgctgaccggctgtgagacctttgaggaggccctggagatggccgccaagggggacagcaccaacgtggacaagctggtgaaggacatctatggaggagactatgagcgcttcggcctgcagggcagcgctgtggccagcagctttggaaacatgatgagcaaggagaagagggacagcatcagcaaggaggacctggcccgggccaccctggtgaccatcaccaacaacatcggcagcatcgccaggatgtgtgccctgaatgaaaatattgacagagtggtgtttgtgggcaacttcctgcgcatcaacatggtgtccatgaagctgctggcctatgccatggacttctggagcaagggccagctgaaggccctcttcctggagcacgagggctactttggagctgtgggcgccctgctggagctgttcaagatgacagatgacaagtag

SEQ ID NO: 163240 - DNA, 945 bp, Artificial Sequence
  Description of Artificial Sequence: Synthetic coding sequence
atgaagctgatcaatggcaagaagcagaccttcccctggtttggcatggacatcggcggcaccctggtgaagctggtgtactttgagcccaaggacatcacagctgaggaggagcaggaggaggtggagaacctgaagagcatcaggaagtacctgaccagcaacacagcctacggcaagacaggcatcagagatgtgcacctggagctgaagaacctgaccatgtgtggcaggaaaggaaacctgcacttcatccgcttccccagctgtgccatgcaccgcttcatccagatgggcagcgagaagaacttcagcagcctgcacaccaccctgtgtgccaccggcggcggggccttcaagtttgaggaggacttcaggatgattgctgacctgcagctgcacaagctggatgagctggactgcctgatccagggcctgctgtatgtggacagcgtgggcttcaacgggaagccagagtgctactactttgagaaccccaccaaccctgagctgtgccagaagaagccctactgcctggacaacccctaccccatgctgctggtgaacatgggcagcggcgtgtccatcctggccgtgtacagcaaggacaactacaagagggtgacaggcaccagctttggaaacatgatgagcaaggagaagagggacagcatcagcaaggaggacctggcccgggccaccctggtgaccatcaccaacaacatcggcagcatcgccaggatgtgtgccctgaatgaaaatattgacagagtggtgtttgtgggcaacttcctgcgcatcaacatggtgtccatgaagctgctggcctatgccatggacttctggagcaagggccagctgaaggccctcttcctggagcacgagggctactttggagctgtgggcgccctgctggagctgttcaagatgacagatgacaagtag

SEQ ID NO: 163241 - DNA, 1122 bp, Artificial Sequence
  Description of Artificial Sequence: Synthetic coding sequence
atgaagctgatcaatggcaagaagcagaccttcccctggtttggcatggacatcggcggcaccctggtgaagctggtgtactttgagcccaaggacatcacagctgaggaggagcaggaggaggtggagaacctgaagagcatcaggaagtacctgaccagcaacacagcctacggcaagacaggcatcagagatgtgcacctggagctgaagaacctgaccatgtgtggcaggaaaggaaacctgcacttcatccgcttccccagctgtgccatgcaccgcttcatccagatgggcagcgagaagaacttcagcagcctgcacaccaccctgtgtgccaccggcggcggggccttcaagtttgaggaggacttcaggatgattgctgacctgcagctgcacaagctggatgagctggactgcctgatccagggcctgctgtatgtggacagcgtgggcttcaacgggaagccagagtgctactactttgagaaccccaccaaccctgagctgtgccagaagaagccctactgcctggacaacccctaccccatgctgctggtgaacatgggcagcggcgtgtccatcctggccgtgtacagcaaggacaactacaagagggtgacaggcaccagcctgggcggcggcaccttcctgggcctgtgctgcctgctgaccggctgtgagacctttgaggaggccctggagatggccgccaagggggacagcaccaacgtggacaagctggtgaaggacatctacggcggggactatgaaagatttggcctgcagggcagcgctgtggccagcagctttggaaacatgatgagcaaggagaagagggacagcatcagcaaagaagacctggcccgggccaccctggtgaccatcaccaacaacatcggcagcatcgccaggatgtgtgccctgaatgaaaacatcgacagagtggtgtttgtgggcaacttcctgcgcatcaacatggtgtccatgaagctgctggcctatgccatggacttctggagcaagggccagctgaaggccctcttcctggagcacgagggctactttggagctgtgggcgccctgctggagctgttcaagatgacagatgacaagtag

SEQ ID NO: 163242 - DNA, 1203 bp, Artificial Sequence
  Description of Artificial Sequence: Synthetic coding sequence
atggccaagagcaagcacgccctgctgcccttctgccacggcatgatgcagcaggagggcctgcaccagatgcagagcctggacctgggcctgctgagcctgcagaacagcttcccctggtttggcatggacattggaggcaccctggtgaagctggtgtactttgagcccaaggacatcacagctgaggaggagcaggaggaggtggagaacctgaagagcatcaggaagtacctgaccagcaacacagcctacggcaagacaggcatcagagatgtgcacctggagctgaagaacctgaccatgtgtggcaggaagggcaacctgcacttcatccgcttccccagctgtgccatgcaccgcttcatccagatgggcagcgagaagaacttcagcagcctgcacaccaccctgtgtgccactggaggaggagccttcaagtttgaggaggacttcaggatgattgctgacctgcagctgcacaagctggatgagctggactgcctgatccagggcctgctgtatgtggacagcgtgggcttcaacgggaagccagagtgctactactttgagaaccccaccaaccctgagctgtgccagaagaagccctactgcctggacaacccctaccccatgctgctggtgaacatgggcagcggcgtgtccatcctggccgtgtacagcaaggacaactacaagagggtgacaggcaccagcctgggcggcggcaccttcctgggcctgtgctgcctgctgaccggctgtgagacctttgaggaggccctggagatggccgccaagggggacagcaccaacgtggacaagctggtgaaggacatctatggaggagactatgagcgcttcggcctgcagggcagcgctgtggccagcagctttggaaacatgatgagcaaggagaagagggacagcatcagcaaggaggacctggcccgggccaccctggtgaccatcaccaacaacatcggcagcatcgccaggatgtgtgccctgaatgaaaatattgacagagtggtgtttgtgggcaacttcctgcgcatcaacatggtgtccatgaagctgctggcctatgccatggacttctggagcaagggccagctgaaggccctcttcctggagcacgagggctactttggagctgtgggcgccctgctggagctgttcaagatgacagatgacaagtag

SEQ ID NO: 163243 - DNA, 1386 bp, Artificial Sequence
  Description of Artificial Sequence: Synthetic coding sequence
atgggagacagaagtggccagcaggagaggtctgtgccccacagccctggggcccctgtgggcaccagcgctgctgctgtgaatggcctgctgcacaacggcttccaccccccacctgtgcagcccccccacgtgtgcagccggggccctgtgggcggcagtgatgctgccccccagaggctgcccctgctgcctgagctgcagccccagcccctgctgccccagcacgacagccctgccaagaagtgccgcctgcggcggaggatggattctggcaggaagaacagaccacccttcccctggtttggcatggacatcggcggcaccctggtgaagctggtgtactttgagcccaaggacatcacagctgaggaggagcaggaggaggtggagaacctgaagagcatcaggaagtacctgaccagcaacacagcctacggcaagacaggcatcagagatgtgcacctggagctgaagaacctgaccatgtgtggcaggaaaggaaacctgcacttcatccgcttccccagctgtgccatgcaccgcttcatccagatgggcagcgagaagaacttcagcagcctgcacaccaccctgtgtgccaccggcggcggggccttcaagtttgaggaggacttcaggatgattgctgacctgcagctgcacaagctggatgagctggactgcctgatccagggcctgctgtatgtggacagcgtgggcttcaacgggaagccagagtgctactactttgagaaccccaccaaccctgagctgtgccagaagaagccctactgcctggacaacccctaccccatgctgctggtgaacatgggcagcggcgtgtccatcctggccgtgtacagcaaggacaactacaagagggtgacaggcaccagcctgggcggcggcaccttcctgggcctgtgctgcctgctgaccggctgtgagacctttgaggaggccctggagatggccgccaagggggacagcaccaacgtggacaagctggtgaaggacatctacggcggggactatgaaagatttggcctgcagggcagcgctgtggccagcagctttggaaacatgatgagcaaggagaagagggacagcatcagcaaagaagacctggcccgggccaccctggtgaccatcaccaacaacatcggcagcatcgccaggatgtgtgccctgaatgaaaacatcgacagagtggtgtttgtgggcaacttcctgcgcatcaacatggtgtccatgaagctgctggcctatgccatggacttctggagcaagggccagctgaaggccctcttcctggagcacgagggctactttggagctgtgggcgccctgctggagctgttcaagatgacagatgacaagtag

SEQ ID NO: 163244 - DNA, 1713 bp, Artificial Sequence
  Description of Artificial Sequence: Synthetic coding sequence
atgaggcggctgggccccttccacccccgggtgcactgggccgccccacccagcctgagcagcggcctgcaccggctgctcttcctgcggggcacccgcatccccagcagcaccaccctgagcccccccaggcatgacagcctgagcctggatggcggcaccgtgaaccccccccgggtgcgggagcccaccggccgggaggccttcggccccagccctgccagcagtgactggctgcctgcccgctggagaaatggccggggcggccggccccgggcccggctgtgcagcggctggacagctgctgaggaggcccggaggaaccccaccctgggcggcctgctgggccggcagaggctgctgctgaggatgggcggcggccgcctgggcgcccccatggagcggcacggccgggccagcgccacctctgtgagcagcgctggggagcaggccgccggggaccctgagggccggcggcaggagcccctgcggcggcgggccagcagcgcctctgtgcctgctgtgggcgccagcgctgagggcacccggcgggaccggctgggcagctacagcggccccacctctgtgtcccggcagagggtggagagcctgaggaagaagaggcccctcttcccctggtttggcctggacatcggcggcaccctggtgaagctggtgtactttgagcccaaggacatcacagctgaggaggaggaggaggaggtggagagcctgaagagcatcaggaagtacctgaccagcaatgtggcctacggcagcacaggcatcagagatgtgcacctggagctgaaggacctgaccctgtgtggcaggaaaggaaacctgcacttcatccgcttccccacccatgacatgcctgccttcatccagatgggccgggacaagaacttcagcagcctgcacacagtgttctgtgccaccggcggcggggcctacaagtttgagcaggacttcctgaccatcggggacctgcagctgtgcaagctggatgagctggactgcctgatcaagggcatcctgtacattgattctgtgggcttcaacggccgcagccagtgctactactttgagaacccagctgacagcgagaagtgccagaagctgccctttgacctgaagaacccctaccccctgctgctggtgaacatcggcagcggcgtgtccatcctggccgtgtacagcaaggacaactacaagagggtgacaggcaccagcctgggcggcggcaccttcttcggcctgtgctgcctgctgaccggctgcaccacctttgaggaggccctggagatggccagcagaggagacagcaccaaggtggacaagctggtgcgggacatctacggcggggactatgaaagatttggcctgcccggctgggccgtggccagcagctttggaaacatgatgagcaaggagaagcgggaggccgtgtccaaagaagacctggcccgggccaccctcatcaccatcaccaacaacatcggcagcatcgccaggatgtgtgccctgaatgaaaacatcaaccaggtggtgtttgtgggcaacttcctgcgcatcaacaccatcgccatgaggctgctggcctatgccctggactactggagcaagggccagctgaaggccctcttcagcgagcacgagggctactttggagctgtgggcgccctgctggagctgctgaagatcccctag

SEQ ID NO: 163245 - DNA, 1161 bp, Artificial Sequence
  Description of Artificial Sequence: Synthetic coding sequence
tctggccgggtgaacccagctgggggcctgggctgcagcgagagcggcaccttcggcggccccccagcccccatcgtgttcccctggtttggcctggacatcggcggcaccctggtgaagctggtgtactttgagcccaaggacatcacagctgaggaggaggaggaggaggtggagagcctgaagagcatcaggaagtacctgaccagcaatgtggcctacggcagcacaggcatcagagatgtgcacctggagctgaaggacctgaccctgtgtggcaggaaaggaaacctgcacttcatccgcttccccacccatgacatgcctgccttcatccagatgggccgggacaagaacttcagcagcctgcacacagtgttctgtgccaccggcggcggggcctacaagtttgagcaggacttcctgaccatcggggacctgcagctgtgcaagctggatgagctggactgcctgatcaagggcatcctgtacattgattctgtgggcttcaacggccgcagccagtgctactactttgagaacccagctgacagcgagaagtgccagaagctgccctttgacctgaagaacccctaccccctgctgctggtgaacatcggcagcggcgtgtccatcctggccgtgtacagcaaggacaactacaagagggtgacaggcaccagcctgggcggcggcaccttcttcggcctgtgctgcctgctgaccggctgcaccacctttgaggaggccctggagatggccagcagaggagacagcaccaaggtggacaagctggtgcgggacatctacggcggggactatgaaagatttggcctgcccggctgggccgtggccagcagctttggaaacatgatgagcaaggagaagcgggaggccgtgtccaaagaagacctggcccgggccaccctcatcaccatcaccaacaacatcggcagcatcgccaggatgtgtgccctgaatgaaaacatcaaccaggtggtgtttgtgggcaacttcctgcgcatcaacaccatcgccatgaggctgctggcctatgccctggactactggagcaagggccagctgaaggccctcttcagcgagcacgagggctactttggagctgtgggcgccctgctggagctgctgaagatcccctag

SEQ ID NO: 163246 - DNA, 840 bp, Artificial Sequence
  Description of Artificial Sequence: Synthetic coding sequence
atgcctgccttcatccagatgggccgggacaagaacttcagcagcctgcacacagtgttctgtgccactggaggaggagcctacaagtttgagcaggacttcctgaccatcggggacctgcagctgtgcaagctggatgagctggactgcctgatcaagggcatcctgtacatcgacagcgtgggcttcaacggccgcagccagtgctactactttgaaaatcctgctgacagcgagaagtgccagaagctgccctttgacctgaagaacccctaccccctgctgctggtgaacatcggcagcggcgtgtccatcctggccgtgtacagcaaggacaactacaagagggtgacaggcaccagcctgggcggcggcaccttcttcggcctgtgctgcctgctgaccggctgcaccacctttgaggaggccctggagatggccagcagaggagacagcaccaaggtggacaagctggtgcgggacatctatggaggagactatgagcgcttcggcctgcccggctgggccgtggccagcagctttggaaacatgatgagcaaggagaagcgggaggccgtgtccaaggaggacctggcccgggccaccctcatcaccatcaccaacaacatcggcagcatcgccaggatgtgtgccctgaatgaaaacatcaaccaggtggtgtttgtgggcaacttcctgcgcatcaacaccatcgccatgaggctgctggcctatgccctggactactggagcaagggccagctgaaggccctcttcagcgagcacgagggctactttggagctgtgggcgccctgctggagctgctgaagatcccctag

SEQ ID NO: 163247 - DNA, 1113 bp, Artificial Sequence
  Description of Artificial Sequence: Synthetic coding sequence
atgaagatcaaggatgccaagaagcccagcttcccctggtttggcatggacatcggcggcaccctggtgaagctgagctactttgagcccatcgacatcacagctgaggaggagcaggaggaggtggagagcctgaagagcatcaggaagtacctgaccagcaatgtggcctacggcagcacaggcatcagagatgtgcacctggagctgaaggacctgaccctgtttggccggcggggcaacctgcacttcatccgcttccccacccaggacctgcccaccttcatccagatgggccgggacaagaacttcagcaccctgcagacagtgctgtgtgccaccggcggcggggcctacaagtttgagaaggacttccgcaccatcggcaacctgcacctgcacaagctggatgagctggactgcctggtgaagggcctgctgtacattgattctgtgtccttcaacggccaggccgagtgctactactttgccaatgccagcgagcctgagcgctgccagaagatgcccttcaacctggatgacccctaccccctgctggtggtgaacatcggcagcggcgtgtccatcctggccgtgcacagcaaggacaactacaagagggtgacaggcaccagcctgggcggcggcaccttcctgggcctgtgcagcctgctgaccggctgtgagagctttgaggaggccctggagatggccagcaagggggacagcacccaggccgacaagctggtgcgggacatctacggcggggactatgaaagatttggcctgcccggctgggccgtggccagcagctttggaaacatgatctacaaggagaagcgggagagcgtgtccaaagaagacctggcccgggccaccctggtgaccatcaccaacaacatcggctctgtggccaggatgtgtgctgtgaatgagaagatcaacagagtggtgtttgtgggcaacttcctgcgggtgaacaccctgtccatgaagctgctggcctatgccctggactactggagcaagggccagctgaaggccctcttcctggagcacgagggctactttggagctgtgggcgccctgctgggcctgcccaacttctcctag

SEQ ID NO: 163248 - DNA, 2322 bp, Artificial Sequence
  Description of Artificial Sequence: Synthetic coding sequence
atggctgaatgtggggccagcggcagcggcagcagcggggacagcctggacaagagcatcaccctgcccccagatgagatcttcaggaacctggagaatgccaagagatttgccattgatattggaggcagcctgaccaagctggcctactacagcacagtgcagcacaaggtggccaaggtgcgcagctttgaccacagcggcaaggacacagagcgggagcacgagcccccctatgagatctctgtgcaggaggagatcacagcccggctgcacttcatcaagtttgagaacacctacatcgaggcctgcctggacttcatcaaggaccacctggtgaacacagagaccaaggtgatccaggccactggaggaggagcctacaagttcaaggacctgattgaggagaagctgcggctgaaggtggacaaggaggatgtgatgacctgcctgatcaagggctgcaactttgtgctgaagaacatcccccatgaggcctttgtgtaccagaaggacagcgaccctgagttccgcttccagaccaaccacccccacatcttcccctacctgctggtgaacatcggcagcggcgtgtccatcgtgaaggtggagacagaggacagatttgagtgggtgggcggcagcagcattggaggcggcaccttctggggcctgggcgccctgctgaccaagaccaagaagtttgatgagctgctgcacctggccagccggggccagcacagcaatgtggacatgctggtgagagatgtgtatggaggagcccaccagaccctgggcctgagcggcaacctgattgccagcagctttgggaagagcgccacagctgaccaggagttcagcaaagaagacatggccaagagcctgctgcacatgatcagcaatgacatcggccagctggcctgcctgcacgcccggctgcacagcctggacagagtgtactttggaggcttcttcatccggggccaccctgtgaccatgaggaccatcacctacagcatcaacttcttcagcaaaggagaggtgcaggccctcttcctgcggcatgagggctacctgggcgccatcggggccttcctgaagggagctgagcaggacaaccccaaccagtacagctggggagaaaattatgccggcagcagcggcctgatgtctgccagccctgagctgggccctgcccagagggcccggagcggcacctttgacctgctggagatggaccggctggagcggcccctggtggacctgcccctgctgctggacccccccagctatgtgcctgacacagtggacctgacagatgatgccctggccaggaagtactggctgacctgctttgaggaggccctggatggagtggtgaagagagctgtggccagccagcctgacagcgtggatgctgctgagagagctgagaagttccggcagaagtactggaacaagctgcagaccctgcggcagcagccctttgcctacggcaccctgactgtgcgcagcctgctggacacccgggagcactgcctgaatgagttcaacttcccagacccctacagcaaggtgaagcagcgggagaatggagtggccctgcgctgcttccctggggtggtgcgcagcctggatgccctgggctgggaggagcggcagctggccctggtgaagggcctgctggccggaaatgtgtttgactggggcgccaaggctgtgtctgctgtgctggagagtgacccctacttcggctttgaggaggccaagaggaagctgcaggagcggccctggctggtggacagctacagcgagtggctgcagaggctgaagggccccccccacaagtgtgccctgatctttgctgacaacagcggcatcgacatcatcctgggcgtcttcccctttgtgcgggagctgctgctgcggggcacagaggtgatcctggcctgcaacagcggccctgccctgaatgatgtgacccacagcgagagcctgattgtggccgagagaattgctggcatggaccctgtggtgcacagcgccctgcaggaggagcggctgctgctggtgcagacaggcagcagcagcccctgcctggacctgagccggctggacaagggcctggccgccctggtgcgggagagaggagctgacctggtggtgattgagggcatgggccgggctgtgcacaccaactaccacgccgccctgcgctgtgagagcctgaagctggccgtcatcaagaatgcctggctggccgagcggctgggcggccgcctcttcagcgtcatcttcaagtatgaggtgcctgctgagtag

SEQ ID NO: 163249 - DNA, 1455 bp, Artificial Sequence
  Description of Artificial Sequence: Synthetic coding sequence
atgttccccaacagcatcctgggccggccccccttcacccccaaccaccagcagcacaacaacttcttcaccctgagccccaccgtgtacagccaccagcagctgattgatgcccagttcaacttccagaatgctgacctgagcagagctgtgtccctgcagcagctgacctatggaaatgtgagccccatccagaccagcgccagccccctcttccggggcaggaagaggctgagtgatgagaagaacctgcccctggatggcaagaggcagcgcttccacagcccccaccaggagcccaccgtggtgaaccagatcgtgcccctgagcggggagcggcgctacagcatgccacccctcttccacacccactacgtgcctgacatcgtgcgctgtgtgccccccttccgggagatcgccttcctggagccccgggagatcaccctgcctgaggccaaggacaagctgagccagcagatcctggagctgtttgagacctgccagcagcagatcagtgacctgaagaagaaggagctgtgcaggacccagctgcagcgggagatccagctgctcttcccccagagccgcctcttcctggtgggcagcagcctgaatggatttggcaccaggagcagtgatggagacctgtgcctggtggtgaaggaggagccctgcttcttccaggtgaaccagaagacagaggcccggcacatcctgaccctggtgcacaagcacttctgcacccggctgagcggctacatcgagcggccccagctgatccgggccaaggtgcccatcgtgaagttccgggacaaggtgtcctgtgtggagtttgacctgaatgtgaacaacatcgtgggcatccggaacaccttcctgctgcggacctacgcctacctggagaacagagtgcggcccctggtgctggtgatcaagaagtgggccagccaccaccagatcaatgatgccagccggggcaccctgagcagctacagcctggtgctgatggtgctgcactacctgcagaccctgcctgagcccatcctgcccagcctgcagaagatctacccagagagcttcagccctgccatccagctgcacctggtgcaccaggccccctgcaatgtgcccccctacctgagcaagaatgaaagcaacctgggggacctgctgctgggcttcctgaagtactatgccacagaatttgactggaacagccagatgatctctgtgcgggaggccaaggccatccccaggccagatggcatcgagtggaggaacaagtacatctgtgtggaggagccctttgatggcaccaacacagcccgggctgtgcatgagaagcagaagtttgacatgatcaaggaccagttcctgaagtcctggcaccggctgaagaacaagagggacctgaacagcatcctgcctgtgcgggctgctgtgctgaagaggtag

SEQ ID NO: 163250 - DNA, 1443 bp, Artificial Sequence
  Description of Artificial Sequence: Synthetic coding sequence
atgttccccaacagcatcctgggccggccccccttcacccccaaccaccagcagcacaacaacttcttcaccctgagccccaccgtgtacagccaccagcagctgattgatgcccagttcaacttccagaatgctgacctgagcagagctgtgtccctgcagcagctgacctatggaaatgtgagccccatccagaccagcgccagccccctcttccggggcaggaagaggctgagtgatgagaagaacctgcccctggatggcaagaggcagcgcttccacagcccccaccaggagcccaccgtggtgaaccagatcgtgcccctgagcggggagcggcgctacagcatgccacccctcttccacacccactacgtgcctgacatcgtgcgctgtgtgccccccttccgggagatcgccttcctggagccccgggagatcaccctgcctgaggccaaggacaagctgagccagcagatcctggagctgtttgagacctgccagcagcagatcagtgacctgaagaagaaggagctgtgcaggacccagctgcagcgggagatccagctgctcttcccccagagccgcctcttcctggtgggcagcagcctgaatggatttggcaccaggagcagtgatggagacctgtgcctggtggtgaaggaggagcctgtgaaccagaagacagaggcccggcacatcctgaccctggtgcacaagcacttctgcacccggctgagcggctacatcgagcggccccagctgatccgggccaaggtgcccatcgtgaagttccgggacaaggtgtcctgtgtggagtttgacctgaatgtgaacaacatcgtgggcatccggaacaccttcctgctgcggacctacgcctacctggagaacagagtgcggcccctggtgctggtgatcaagaagtgggccagccaccaccagatcaatgatgccagccggggcaccctgagcagctacagcctggtgctgatggtgctgcactacctgcagaccctgcctgagcccatcctgcccagcctgcagaagatctacccagagagcttcagccctgccatccagctgcacctggtgcaccaggccccctgcaatgtgcccccctacctgagcaagaatgaaagcaacctgggggacctgctgctgggcttcctgaagtactatgccacagaatttgactggaacagccagatgatctctgtgcgggaggccaaggccatccccaggccagatggcatcgagtggaggaacaagtacatctgtgtggaggagccctttgatggcaccaacacagcccgggctgtgcatgagaagcagaagtttgacatgatcaaggaccagttcctgaagtcctggcaccggctgaagaacaagagggacctgaacagcatcctgcctgtgcgggctgctgtgctgaagaggtag

SEQ ID NO: 163251 - DNA, 1455 bp, Artificial Sequence; identical to SEQ ID NO: 163249
  Description of Artificial Sequence: Synthetic coding sequence

SEQ ID NO: 163252 - DNA, 1455 bp, Artificial Sequence; identical to SEQ ID NO: 163249
  Description of Artificial Sequence: Synthetic coding sequence

SEQ ID NO: 163253 - DNA, 1476 bp, Artificial Sequence
  Description of Artificial Sequence: Synthetic coding sequence
atgagcctggtggcctatgccagcagtgatgagagcgagccagatgaagctgagcctgagcctgaggaggaggaggccgtggcccccaccagcggccctgccctgggcggcctgtttgccagcctgcctgcccccaagggccctgccctgctgcccccaccaccccagatgctggccccagccttccccccacccctgctgctgcccccacccaccggggacccccggctgcagcccccaccacccctgcccttcggcctgggcggcttccccccacctcctggggtgtccccagctgaggccgccggcgtgggggagggcctgggcctgggcctgcccagcccccggggccctggcctgaacctgcccccacccatcggcggggccggcccccccctgggcctgcccaagcccaagaagaggaaggagcctgtgaagattgctgcccctgagctgcacaagggggacagcgacagtgaagaagatgagcccaccaagaagaagaccatcctgcagggcagcagcgagggcaccggcctgagcgccctgctgccccagcccaagaacctgactgtgaaggagaccaaccggctgctgctgccccacgccttcagcaggaagcccagtgatggcagcccagacaccaagcccagccggctggccagcaagaccaagaccagcagcctggcccctgtggtgggcaccaccaccaccacccccagccccagcgccatcaaggccgccgccaagtctgctgccctgcaggtgaccaagcagatcacccaggaggaggatgacagtgatgaggaggtggcccctgagaacttcttcagcctgcctgagaaggccgagcccccaggagtggagccctacccctaccccatccccaccgtgcctgaggagctgcccccaggcacagagcctgagcccgccttccaggatgatgctgccaatgcccccctggagttcaagatggctgctggcagcagcggggccccctggatgcccaagccaggagatgactacagctacaaccagttcagcacctatggagatgccaatgctgctggggcctactaccaggactactacagcggcggctactacccagcccaggaccctgccctggtgcccccccaggagatcgccccagatgccagcttcattgatgatgaggccttcaagaggctgcagggcaagaggaacagaggccgggaggagatcaactttgtggagatcaagggagatgaccagctgagcggggcccagcagtggatgaccaagagcctgacagaggagaagaccatgaagagcttcagcaagaagaagggggagcagcccaccggccagcagaggaggaagcaccagatcacctacctgatccaccaggccaaggagcgggagctggagctgaagaacacctggagcgagaacaagctgagccggcggcagacccaggccaagtatggcttctag

SEQ ID NO: 163254 - DNA, 1380 bp, Artificial Sequence
  Description of Artificial Sequence: Synthetic coding sequence
atgagcctggtggcctatgccagcagtgatgagagcgagccagatgaagctgagcctgagcctgaggaggaggaggccgtggcccccaccagcggccctgccctgggcggcctgtttgccagcctgcctgcccccaagggccctgccctgctgcccccaccaccccagatgctggccccagccttccccccacccctgctgctgcccccacccaccggggacccccggctgcagcccccaccacccctgcccttcggcctgggcggcttccccccacctcctggggtgtccccagctgaggccgccggcgtgggggagggcctgggcctgggcctgcccagcccccggggccctggcctgaacctgcccccacccatcggcggggccggcccccccctgggcctgcccaagcccaagaagaggaaggagcctgtgaagattgctgcccctgagctgcacaagggggacagcgacagtgaagaagatgagcccaccaagaagaagaccatcctgcagggcagcagcgagggcaccggcctgagcgccctgctgccccagcccaagaacctgactgtgaaggagaccaaccggctgctgctgccccacgccttcagcaggaagcccagtgatggcagcccagacaccaagcccagccggctggccagcaagaccaagaccagcagcctggcccctgtggtgggcaccaccaccaccacccccagccccagcgccatcaaggccgccgccaagtctgctgccctgcaggtgaccaagcagatcacccaggaggaggatgacagtgatgaggaggtggcccctgagaacttcttcagcctgcctgagaaggccgagcccccaggagtggagccctacccctaccccatccccaccgtgcctgaggagctgcccccaggcacagagcctgagcccgccttccaggatgatgctgccaatgcccccctggagttcaagatggctgctggcagcagcggggccccctggatgcccaagccaggagatgactacagctacaaccagttcagcacctatggagatgccaatgctgctggggcctactaccagttcaagaggctgcagggcaagaggaacagaggccgggaggagatcaactttgtggagatcaagggagatgaccagctgagcggggcccagcagtggatgaccaagagcctgacagaggagaagaccatgaagagcttcagcaagaagaagggggagcagcccaccggccagcagaggaggaagcaccagatcacctacctgatccaccaggccaaggagcgggagctggagctgaagaacacctggagcgagaacaagctgagccggcggcagacccaggccaagtatggcttctag

SEQ ID NO: 163255 - DNA, 1404 bp, Artificial Sequence
  Description of Artificial Sequence: Synthetic coding sequence
atgctggccccagccttccccccacccctgctgctgcccccacccaccggggacccccggctgcagcccccaccacccctgcccttcggcctgggcggcttccccccacctcctggggtgtccccagctgaggccgccggcgtgggggagggcctgggcctgggcctgcccagcccccggggccctggcctgaacctgcccccacccatcggcggggccggcccccccctgggcctgcccaagcccaagaagaggaaggagcctgtgaagattgctgcccctgagctgcacaagggggacagcgacagtgaagaagatgagcccaccaagaagaagaccatcctgcagggcagcagcgagggcaccggcctgagcgccctgctgccccagcccaagaacctgactgtgaaggagaccaaccggctgctgctgccccacgccttcagcaggaagcccagtgatggcagcccagacaccaagcccagccggctggccagcaagaccaagaccagcagcctggcccctgtggtgggcaccaccaccaccacccccagccccagcgccatcaaggccgccgccaagtctgctgccctgcaggtgaccaagcagatcacccaggaggaggatgacagtgatgaggaggtggcccctgagaacttcttcagcctgcctgagaaggccgagcccccaggagtggagccctacccctaccccatccccaccgtgcctgaggagctgcccccaggcacagagcctgagcccgccttccaggatgatgctgccaatgcccccctggagttcaagatggctgctggcagcagcggggccccctggatgcccaagccaggagatgactacagctacaaccagttcagcacctatggagatgccaatgctgctggggcctactaccagggcctgcagcagcacctgggccacagccccctgcggggcatcatgaggttcctgaacagcaagagcggcaagaggacctgctttgtgcccagctttgactactacagcggcggctactacccagcccaggaccctgccctggtgcccccccaggagatcgccccagatgccagcttcattgatgatgaggccttcaagaggctgcagggcaagaggaacagaggccgggaggagatcaactttgtggagatcaagggagatgaccagctgagcggggcccagcagtggatgaccaagagcctgacagaggagaagaccatgaagagcttcagcaagaagaagggggagcagcccaccggccagcagaggaggaagcaccagatcacctacctgatccaccaggccaaggagcgggagctggagctgaagaacacctggagcgagaacaagctgagccggcggcagacccaggccaagtatggcttctag

SEQ ID NO: 163256 - DNA, 3096 bp, Artificial Sequence
  Description of Artificial Sequence: Synthetic coding sequence
atgaaggtgacagtgtgctttggaagaaccagggtggtggtgccctgtggagatggccacatgaaggtgttcagcctcatccagcaggccgtgacccgctacaggaaggccatcgccaaggaccccaactactggatccaggtgcaccggctggagcacggagatggcggcatcctggacctggatgacatcctgtgtgatgtggctgatgacaaggaccggctggtggccgtgtttgatgagcaggacccccaccacggcggagatggcaccagcgccagcagcacaggcacccagagccctgagatcttcggcagcgagctgggcaccaacaacgtgtctgccttccagccctaccaggccaccagcgagattgaggtgacccccagcgtgctgcgggccaacatgcccctgcacgtgagaagaagcagtgaccctgccctgattggcctgagcacctctgtgtctgacagcaacttcagcagcgaggagcccagcaggaagaaccccacccgctggagcaccacagctggcttcctgaagcagaacacagctggcagccccaagacctgtgacaggaagaaggatgagaactaccgcagcctgccccgggacaccagcaactggagcaaccagttccagagggacaatgcccggagcagcctgagcgccagccaccccatggtgggcaagtggctggagaagcaggagcaggatgaagatggaacagaggaggacaacagccgggtggagcctgtgggccacgccgacaccggcctggagcacatccccaacttcagcctggatgacatggtgaagctggtggaggtgcccaatgatggcggccccctgggcatccacgtggtgcccttcagcgcccggggcggccgcaccctgggcctgctggtgaagaggctggagaagggcggcaaggccgagcatgaaaatctcttccgggagaatgactgcatcgtgcgcatcaatgatggagacctgaggaacagaagatttgagcaggcccagcacatgttccggcaggccatgaggacccccatcatctggttccacgtggtgcctgctgccaacaaggagcagtatgagcagctgagccagagcgagaagaacaactactacagcagccgcttctccccagacagccagtacatcgacaacagatctgtgaacagcgctggcctgcacacagtgcagagggccccccggctgaaccaccccccagagcagattgacagccacagccggctgccccacagcgcccaccccagcggcaagcccccatctgccccagccagcgccccccagaatgtgttcagcaccaccgtgagcagcggctacaacaccaagaagattggcaagaggctgaacatccagctgaagaagggcacagagggcctgggcttcagcatcaccagcagagatgtgaccatcggcggcagcgcccccatctacgtgaagaacatcctgcccaggggggccgccatccaggacggccgcctgaaggccggggacaggctcatcgaggtgaatggagtggacctggtgggcaagagccaggaggaggtggtgtccctgctgcggagcaccaagatggagggcaccgtgtccctgctggtgttccggcaggaggatgccttccacccccgggagctgaatgctgagcccagccagatgcagatccccaaggagaccaaggccgaggatgaggacatcgtgctgaccccagatggcacccgggagttcctgacctttgaggtgcccctgaatgacagcggcagcgctggcctgggcgtgtctgtgaagggcaacagaagcaaggagaaccacgccgacctgggcatctttgtgaagagcatcatcaatggaggagctgccagcaaggatggccgcctgcgggtgaatgaccagctgattgctgtgaatggagagagcctgctgggcaagaccaaccaggatgccatggagaccctgcggcgctccatgagcacagagggcaacaagaggggcatgatccagctgattgtggcccggcgcatcagcaagtgcaatgagctgaagagccctggcagccccccaggccctgagctgcccattgaaacagccctggatgaccgggagcggcgcatcagccacagcctgtacagcggcatcgagggcctggatgagagccccagcagaaatgctgccctgagccgcatcatgggcaagtaccagctgagccccaccgtgaacatgccccaggatgacaccgtcatcattgaagatgaccggctgcctgtgctgcccccccacctgagtgaccagagcagcagcagcagccatgatgatgtgggctttgtgacagcagatgctggcacctgggccaaggccgccatcagtgacagcgctgactgcagcctgagcccagatgtggaccctgtgctggccttccagcgggagggcttcggccggcagagcatgtctgagaagaggaccaagcagttcagtgatgccagccagctggactttgtgaagaccaggaagagcaagtccatggacctgggcattgctgatgagaccaagctgaacacagtggatgaccagaaggccggcagccccagcagagatgtgggccccagcctgggcctgaagaagagcagcagcctggagagcctgcagacagctgtggccgaggtgaccctgaatggagacatccccttccaccggccccggccccgcatcatccggggccggggctgcaatgaaagcttccgggccgccatcgacaagagctatgacaagccagctgtggatgatgatgatgagggcatggagaccctggaggaggacacagaggagagcagccgcagcggccgggagagcgtgtccacagccagtgaccagcccagccacagcctggagcggcagatgaatggaaaccaggagaagggggacaagacagacaggaagaaggacaagacaggcaaggagaagaagaaggaccgggacaaggagaaggacaagatgaaggccaagaagggcatgctgaagggcctgggggacatgttcagcctggccaagctgaagccagagaagaggtag

SEQ ID NO: 163257 - DNA, 3960 bp, Artificial Sequence
  Description of Artificial Sequence: Synthetic coding sequence
atgaaggtgacagtgtgctttggaagaaccagggtggtggtgccctgtggagatggccacatgaaggtgttcagcctcatccagcaggccgtgacccgctacaggaaggccatcgccaaggaccccaactactggatccaggtgcaccggctggagcacggagatggcggcatcctggacctggatgacatcctgtgtgatgtggctgatgacaaggaccggctggtggccgtgtttgatgagcaggacccccaccacggcggagatggcaccagcgccagcagcacaggcacccagagccctgagatcttcggcagcgagctgggcaccaacaacgtgtctgccttccagccctaccaggccaccagcgagattgaggtgacccccagcgtgctgcgggccaacatgcccctgcacgtgagaagaagcagtgaccctgccctgattggcctgagcacctctgtgtctgacagcaacttcagcagcgaggagcccagcaggaagaaccccacccgctggagcaccacagctggcttcctgaagcagaacacagctggcagccccaagacctgtgacaggaagaaggatgagaactaccgcagcctgccccgggacaccagcaactggagcaaccagttccagagggacaatgcccggagcagcctgagcgccagccaccccatggtgggcaagtggctggagaagcaggagcaggatgaagatggaacagaggaggacaacagccgggtggagcctgtgggccacgccgacaccggcctggagcacatccccaacttcagcctggatgacatggtgaagctggtggaggtgcccaatgatggcggccccctgggcatccacgtggtgcccttcagcgcccggggcggccgcaccctgggcctgctggtgaagaggctggagaagggcggcaaggccgagcatgaaaatctcttccgggagaatgactgcatcgtgcgcatcaatgatggagacctgaggaacagaagatttgagcaggcccagcacatgttccggcaggccatgaggacccccatcatctggttccacgtggtgcctgctgccaacaaggagcagtatgagcagctgagccagagcgagaagaacaactactacagcagccgcttctccccagacagccagtacatcgacaacagatctgtgaacagcgctggcctgcacacagtgcagagggccccccggctgaaccaccccccagagcagattgacagccacagccggctgccccacagcgcccaccccagcggcaagcccccatctgccccagccagcgccccccagaatgtgttcagcaccaccgtgagcagcggctacaacaccaagaagattggcaagaggctgaacatccagctgaagaagggcacagagggcctgggcttcagcatcaccagcagagatgtgaccatcggcggcagcgcccccatctacgtgaagaacatcctgcccaggggggccgccatccaggacggccgcctgaaggccggggacaggctcatcgaggtgaatggagtggacctggtgggcaagagccaggaggaggtggtgtccctgctgcggagcaccaagatggagggcaccgtgtccctgctggtgttccggcaggaggatgccttccacccccgggagctgaatgctgagcccagccagatgcagatccccaaggagaccaaggccgaggatgaggacatcgtgctgaccccagatggcacccgggagttcctgacctttgaggtgcccctgaatgacagcggcagcgctggcctgggcgtgtctgtgaagggcaacagaagcaaggagaaccacgccgacctgggcatctttgtgaagagcatcatcaatggaggagctgccagcaaggatggccgcctgcgggtgaatgaccagctgattgctgtgaatggagagagcctgctgggcaagaccaaccaggatgccatggagaccctgcggcgctccatgagcacagagggcaacaagaggggcatgatccagctgattgtggcccggcgcatcagcaagtgcaatgagctgaagagccctggcagccccccaggccctgagctgcccattgaaacagccctggatgaccgggagcggcgcatcagccacagcctgtacagcggcatcgagggcctggatgagagccccagcagaaatgctgccctgagccgcatcatgggagagagcggcaagtaccagctgagccccaccgtgaacatgccccaggatgacaccgtcatcattgaagatgaccggctgcctgtgctgcccccccacctgagtgaccagagcagcagcagcagccatgatgatgtgggctttgtgacagcagatgctggcacctgggccaaggccgccatcagtgacagcgctgactgcagcctgagcccagatgtggaccctgtgctggccttccagcgggagggcttcggccggcagagcatgtctgagaagaggaccaagcagttcagtgatgccagccagctggactttgtgaagaccaggaagagcaagtccatggacctgggcattgctgatgagaccaagctgaacacagtggatgaccagaaggccggcagccccagcagagatgtgggccccagcctgggcctgaagaagagcagcagcctggagagcctgcagacagctgtggccgaggtgaccctgaatggagacatccccttccaccggccccggccccgcatcatccggggccggggctgcaatgaaagcttccgggccgccatcgacaagagctatgacaagccagctgtggatgatgatgatgagggcatggagaccctggaggaggacacagaggagagcagccgcagcggccgggagagcgtgtccacagccagtgaccagcccagccacagcctggagcggcagatgaatggaaaccaggagaagggggacaagacagacaggaagaaggacaagacaggcaaggagaagaagaaggaccgggacaaggagaaggacaagatgaaggccaagaagggcatgctgaagggcctgggggacatgttccgcatccaggccaagacccgggagttccgggagcggcaggcccgggagcgggactatgcagagatccaggacttccacaggaccttcggctgtgatgatgagctgatgtatggaggagtgagcagctatgagggctccatggccctgaatgcccggccccagagcccccgggagggccacatgatggatgccctgtatgcccaggtgaagaagcccaggaacagcaagcccagccctgtggacagcaacagaagcacccccagcaaccacgaccgcatccagaggctgcggcaggagttccagcaggccaagcaggatgaagatgtggaggacagaagaaggacctacagctttgagcagccctggcccaatgcccggcctgccacccagagcggccgccacagcgtgtctgtggaggtgcagatgcagaggcagaggcaggaggagcgggagagcagccagcaggcccagaggcagtacagcagcctgccccggcagagcaggaagaatgccagctctgtgtcccaggacagctgggagcagaactacagccctggagagggcttccagagcgccaaggagaacccccgctacagcagctaccagggcagcagaaatggctacctgggcggccacggcttcaatgcccgggtgatgctggagacccaggagctgctgcggcaggagcagaggaggaaggagcagcagatgaagaagcagcccccatctgagggccccagcaactatgacagctacaagaaggtgcaggaccccagctatgccccacccaagggccccttccggcaggatgtgccccccagccccagccaggtggcccggctgaaccggctgcagaccccagagaagggccggcccttctacagctag

SEQ ID NO: 163258 - DNA, 3933 bp, Artificial Sequence
  Description of Artificial Sequence: Synthetic coding sequence
atgaaggtgacagtgtgctttggaagaaccagggtggtggtgccctgtggagatggccacatgaaggtgttcagcctcatccagcaggccgtgacccgctacaggaaggccatcgccaaggaccccaactactggatccaggtgcaccggctggagcacggagatggcggcatcctggacctggatgacatcctgtgtgatgtggctgatgacaaggaccggctggtggccgtgtttgatgagcaggacccccaccacggcggagatggcaccagcgccagcagcacaggcacccagagccctgagatcttcggcagcgagctgggcaccaacaacgtgtctgccttccagccctaccaggccaccagcgagattgaggtgacccccagcgtgctgcgggccaacatgcccctgcacgtgagaagaagcagtgaccctgccctgattggcctgagcacctctgtgtctgacagcaacttcagcagcgaggagcccagcaggaagaaccccacccgctggagcaccacagctggcttcctgaagcagaacacagctggcagccccaagacctgtgacaggaagaaggatgagaactaccgcagcctgccccgggacaccagcaactggagcaaccagttccagagggacaatgcccggagcagcctgagcgccagccaccccatggtgggcaagtggctggagaagcaggagcaggatgaagatggaacagaggaggacaacagccgggtggagcctgtgggccacgccgacaccggcctggagcacatccccaacttcagcctggatgacatggtgaagctggtggaggtgcccaatgatggcggccccctgggcatccacgtggtgcccttcagcgcccggggcggccgcaccctgggcctgctggtgaagaggctggagaagggcggcaaggccgagcatgaaaatctcttccgggagaatgactgcatcgtgcgcatcaatgatggagacctgaggaacagaagatttgagcaggcccagcacatgttccggcaggccatgaggacccccatcatctggttccacgtggtgcctgctgccaacaaggagcagtatgagcagctgagccagagcgagaagaacaactactacagcagccgcttctccccagacagccagtacatcgacaacagatctgtgaacagcgctggcctgcacacagtgcagagggccccccggctgaaccaccccccagagcagattgacagccacagccggctgccccacagcgcccaccccagcggcaagcccccatctgccccagccagcgccccccagaatgtgttcagcaccaccgtgagcagcggctacaacaccaagaagattggcaagaggctgaacatccagctgaagaagggcacagagggcctgggcttcagcatcaccagcagagatgtgaccatcggcggcagcgcccccatctacgtgaagaacatcctgcccaggggggccgccatccaggacggccgcctgaaggccggggacaggctcatcgaggtgaatggagtggacctggtgggcaagagccaggaggaggtggtgtccctgctgcggagcaccaagatggagggcaccgtgtccctgctggtgttccggcaggaggatgccttccacccccgggagctgaaggcagaagatgaagatattgtgctgaccccagatggcacccgggagttcctgacctttgaggtgcccctgaatgattctggcagcgctggcctgggcgtgtctgtgaagggcaacagaagcaaagaaaatcatgctgacctgggcatctttgtgaagagcatcatcaatggaggagctgccagcaaggatggccgcctgcgggtgaatgaccagctgattgctgtgaatggagagagcctgctgggcaagaccaaccaggatgccatggagaccctgcggcgctccatgagcacagagggcaacaagaggggcatgatccagctgattgtggcccggcgcatcagcaaatgtaatgagctgaagagccctggcagccccccaggccctgagctgcccatcgagacagccctggatgaccgggagcggcgcatcagccacagcctgtacagcggcatcgagggcctggatgagagccccagcagaaatgctgccctgagccgcatcatgggcaagtaccagctgagccccaccgtgaacatgccccaggatgacaccgtcatcattgaagatgaccggctgcctgtgctgcccccccacctgagtgaccagagcagcagcagcagccatgatgatgtgggctttgtgacagcagatgctggcacctgggccaaggccgccatcagtgacagcgctgactgcagcctgagcccagatgtggaccctgtgctggccttccagcgggagggcttcggccggcagattgctgatgagaccaagctgaacacagtggatgaccagaaggccggcagccccagcagagatgtgggccccagcctgggcctgaagaagagcagcagcctggagagcctgcagacagctgtggccgaggtgaccctgaatggagacatccccttccaccggccccggccccgcatcatccggggccggggctgcaatgaaagcttccgggccgccatcgacaagagctatgacaagccagctgtggatgatgatgatgagggcatggagaccctggaggaggacacagaggagagcagccgcagcggccgggagagcgtgtccacagccagtgaccagcccagccacagcctggagcggcagatgaatggaaaccaggagaagggggacaagacagacaggaagaaggacaagacaggcaaggagaagaagaaggaccgggacaaggagaaggacaagatgaaggccaagaagggcatgctgaagggcctgggggacatgttccgctttgggaagcacaggaaggatgacaagattgagaagacaggcaagatcaagatccaggagagcttcaccagcgaggaggagcgcatccgcatgaagcaggagcaggagcgcatccaggccaagacccgggagttccgggagcggcaggcccgggagcgggactatgcagagatccaggacttccacaggaccttcggctgtgatgatgagctgatgtatggaggagtgtcctcctatgagggctccatggccctgaatgcccggccccagagcccccgggagggccacatgatggatgccctgtatgcccaggtgaagaagcccaggaacagcaagcccagccctgtggacagcaacagaagcacccccagcaaccacgaccgcatccagaggctgcggcaggagttccagcaggccaagcaggatgaagatgtggaggacagaagaaggacctacagctttgagcagccctggcccaatgcccggcctgccacccagagcggccgccacagcgtgtctgtggaggtgcagatgcagaggcagaggcaggaggagcgggagagcagccagcaggcccagaggcagtacagcagcctgccccggcagagcaggaagaatgccagctctgtgtcccaggacagctgggagcagaactacagccctggagagggcttccagagcgccaaggagaacccccgctacagcagctaccagggcagcagaaatggctacctgggcggccacggcttcaatgcccgggtgatgctggagacccaggagctgctgcggcaggagcagaggaggaaggagcagcagatgaagaagcagccccccagcgagggccccagcaactatgacagctacaagaaggtgcaggaccccagctatgccccacccaagggccccttccggcaggatgtgccccccagccccagccaggtggcccggctgaaccggctgcagaccccagagaagggccggcccttctacagctag

SEQ ID NO: 163259 - DNA, 540 bp, Artificial Sequence
  Description of Artificial Sequence: Synthetic coding sequence
atgcagatccccaaggagaccaaggccgaggatgaggacatcgtgctgaccccagatggcacccgggagttcctgacctttgaggtgcccctgaatgacagcggcagcgctggcctgggcgtgtctgtgaagggcaacagaagcaaggagaaccacgccgacctgggcatctttgtgaagagcatcatcaatggaggagctgccagcaaggatggccgcctgcgggtgaatgaccagctgattgctgtgaatggagagagcctgctgggcaagaccaaccaggatgccatggagaccctgcggcgctccatgagcacagagggcaacaagaggggcatgatccagctgattgtggcccggcgcatcagcaagtgcaatgagctgaagagccctggcagccccccaggccctgagctgcccattgaaacagccctggatgaccgggagcggcgcatcagccacagcctgtacagcggcatcgagggcctggatgagagccccagcagaaatgctgccctgagccgcatcatgggcacctag

SEQ ID NO: 163260 - DNA, 3006 bp, Artificial Sequence
  Description of Artificial Sequence: Synthetic coding sequence
atgaaggtgacagtgtgctttggaagaaccagggtggtggtgccctgtggagatggccacatgaaggtgttcagcctcatccagcaggccgtgacccgctacaggaaggccatcgccaaggaccccaactactggatccaggtgcaccggctggagcacggagatggcggcatcctggacctggatgacatcctgtgtgatgtggctgatgacaaggaccggctggtggccgtgtttgatgagcaggacccccaccacggcggagatggcaccagcgccagcagcacaggcacccagagccctgagatcttcggcagcgagctgggcaccaacaacgtgtctgccttccagccctaccaggccaccagcgagattgaggtgacccccagcgtgctgcgggccaacatgcccctgcacgtgagaagaagcagtgaccctgccctgattggcctgagcacctctgtgtctgacagcaacttcagcagcgaggagcccagcaggaagaaccccacccgctggagcaccacagctggcttcctgaagcagaacacagctggcagccccaagacctgtgacaggaagaaggatgagaactaccgcagcctgccccgggacaccagcaactggagcaaccagttccagagggacaatgcccggagcagcctgagcgccagccaccccatggtgggcaagtggctggagaagcaggagcaggatgaagatggaacagaggaggacaacagccgggtggagcctgtgggccacgccgacaccggcctggagcacatccccaacttcagcctggatgacatggtgaagctggtggaggtgcccaatgatggcggccccctgggcatccacgtggtgcccttcagcgcccggggcggccgcaccctgggcctgctggtgaagaggctggagaagggcggcaaggccgagcatgaaaatctcttccgggagaatgactgcatcgtgcgcatcaatgatggagacctgaggaacagaagatttgagcaggcccagcacatgttccggcaggccatgaggacccccatcatctggttccacgtggtgcctgctgccaacaaggagcagtatgagcagctgagccagagcgagaagaacaactactacagcagccgcttctccccagacagccagtacatcgacaacagatctgtgaacagcgctggcctgcacacagtgcagagggccccccggctgaaccaccccccagagcagattgacagccacagccggctgccccacagcgcccaccccagcggcaagcccccatctgccccagccagcgccccccagaatgtgttcagcaccaccgtgagcagcggctacaacaccaagaagattggcaagaggctgaacatccagctgaagaagggcacagagggcctgggcttcagcatcaccagcagagatgtgaccatcggcggcagcgcccccatctacgtgaagaacatcctgcccaggggggccgccatccaggacggccgcctgaaggccggggacaggctcatcgaggtgaatggagtggacctggtgggcaagagccaggaggaggtggtgtccctgctgcggagcaccaagatggagggcaccgtgtccctgctggtgttccggcaggaggatgccttccacccccgggagctgaatgctgagcccagccagatgcagatccccaaggagaccaaggccgaggatgaggacatcgtgctgaccccagatggcacccgggagttcctgacctttgaggtgcccctgaatgacagcggcagcgctggcctgggcgtgtctgtgaagggcaacagaagcaaggagaaccacgccgacctgggcatctttgtgaagagcatcatcaatggaggagctgccagcaaggatggccgcctgcgggtgaatgaccagctgattgctgtgaatggagagagcctgctgggcaagaccaaccaggatgccatggagaccctgcggcgctccatgagcacagagggcaacaagaggggcatgatccagctgattgtggcccggcgcatcagcaagtgcaatgagctgaagagccctggcagccccccaggccctgagctgcccattgaaacagccctggatgaccgggagcggcgcatcagccacagcctgtacagcggcatcgagggcctggatgagagccccagcagaaatgctgccctgagccgcatcatgggcaagtaccagctgagccccaccgtgaacatgccccaggatgacaccgtcatcattgaagatgaccggctgcctgtgctgcccccccacctgagtgaccagagcagcagcagcagccatgatgatgtgggctttgtgacagcagatgctggcacctgggccaaggccgccatcagtgacagcgctgactgcagcctgagcccagatgtggaccctgtgctggccttccagcgggagggcttcggccggcagattgctgatgagaccaagctgaacacagtggatgaccagaaggccggcagccccagcagagatgtgggccccagcctgggcctgaagaagagcagcagcctggagagcctgcagacagctgtggccgaggtgaccctgaatggagacatccccttccaccggccccggccccgcatcatccggggccggggctgcaatgaaagcttccgggccgccatcgacaagagctatgacaagccagctgtggatgatgatgatgagggcatggagaccctggaggaggacacagaggagagcagccgcagcggccgggagagcgtgtccacagccagtgaccagcccagccacagcctggagcggcagatgaatggaaaccaggagaagggggacaagacagacaggaagaaggacaagacaggcaaggagaagaagaaggaccgggacaaggagaaggacaagatgaaggccaagaagggcatgctgaagggcctgggggacatgttcagcctggccaagctgaagccagagaagaggtag

SEQ ID NO: 163261 - DNA, 2967 bp, Artificial Sequence
  Description of Artificial Sequence: Synthetic coding sequence
atgaaggtgacagtgtgctttggaagaaccagggtggtggtgccctgtggagatggccacatgaaggtgttcagcctcatccagcaggccgtgacccgctacaggaaggccatcgccaaggaccccaactactggatccaggtgcaccggctggagcacggagatggcggcatcctggacctggatgacatcctgtgtgatgtggctgatgacaaggaccggctggtggccgtgtttgatgagcaggacccccaccacggcggagatggcaccagcgccagcagcacaggcacccagagccctgagatcttcggcagcgagctgggcaccaacaacgtgtctgccttccagccctaccaggccaccagcgagattgaggtgacccccagcgtgctgcgggccaacatgcccctgcacgtgagaagaagcagtgaccctgccctgattggcctgagcacctctgtgtctgacagcaacttcagcagcgaggagcccagcaggaagaaccccacccgctggagcaccacagctggcttcctgaagcagaacacagctggcagccccaagacctgtgacaggaagaaggatgagaactaccgcagcctgccccgggacaccagcaactggagcaaccagttccagagggacaatgcccggagcagcctgagcgccagccaccccatggtgggcaagtggctggagaagcaggagcaggatgaagatggaacagaggaggacaacagccgggtggagcctgtgggccacgccgacaccggcctggagcacatccccaacttcagcctggatgacatggtgaagctggtggaggtgcccaatgatggcggccccctgggcatccacgtggtgcccttcagcgcccggggcggccgcaccctgggcctgctggtgaagaggctggagaagggcggcaaggccgagcatgaaaatctcttccgggagaatgactgcatcgtgcgcatcaatgatggagacctgaggaacagaagatttgagcaggcccagcacatgttccggcaggccatgaggacccccatcatctggttccacgtggtgcctgctgccaacaaggagcagtatgagcagctgagccagagcgagaagaacaactactacagcagccgcttctccccagacagccagtacatcgacaacagatctgtgaacagcgctggcctgcacacagtgcagagggccccccggctgaaccaccccccagagcagattgacagccacagccggctgccccacagcgcccaccccagcggcaagcccccatctgccccagccagcgccccccagaatgtgttcagcaccaccgtgagcagcggctacaacaccaagaagattggcaagaggctgaacatccagctgaagaagggcacagagggcctgggcttcagcatcaccagcagagatgtgaccatcggcggcagcgcccccatctacgtgaagaacatcctgcccaggggggccgccatccaggacggccgcctgaaggccggggacaggctcatcgaggtgaatggagtggacctggtgggcaagagccaggaggaggtggtgtccctgctgcggagcaccaagatggagggcaccgtgtccctgctggtgttccggcaggaggatgccttccacccccgggagctgaaggcagaagatgaagatattgtgctgaccccagatggcacccgggagttcctgacctttgaggtgcccctgaatgattctggcagcgctggcctgggcgtgtctgtgaagggcaacagaagcaaagaaaatcatgctgacctgggcatctttgtgaagagcatcatcaatggaggagctgccagcaaggatggccgcctgcgggtgaatgaccagctgattgctgtgaatggagagagcctgctgggcaagaccaaccaggatgccatggagaccctgcggcgctccatgagcacagagggcaacaagaggggcatgatccagctgattgtggcccggcgcatcagcaaatgtaatgagctgaagagccctggcagccccccaggccctgagctgcccatcgagacagccctggatgaccgggagcggcgcatcagccacagcctgtacagcggcatcgagggcctggatgagagccccagcagaaatgctgccctgagccgcatcatgggcaagtaccagctgagccccaccgtgaacatgccccaggatgacaccgtcatcattgaagatgaccggctgcctgtgctgcccccccacctgagtgaccagagcagcagcagcagccatgatgatgtgggctttgtgacagcagatgctggcacctgggccaaggccgccatcagtgacagcgctgactgcagcctgagcccagatgtggaccctgtgctggccttccagcgggagggcttcggccggcagattgctgatgagaccaagctgaacacagtggatgaccagaaggccggcagccccagcagagatgtgggccccagcctgggcctgaagaagagcagcagcctggagagcctgcagacagctgtggccgaggtgaccctgaatggagacatccccttccaccggccccggccccgcatcatccggggccggggctgcaatgaaagcttccgggccgccatcgacaagagctatgacaagccagctgtggatgatgatgatgagggcatggagaccctggaggaggacacagaggagagcagccgcagcggccgggagagcgtgtccacagccagtgaccagcccagccacagcctggagcggcagatgaatggaaaccaggagaagggggacaagacagacaggaagaaggacaagacaggcaaggagaagaagaaggaccgggacaaggagaaggacaagatgaaggccaagaagggcatgctgaagggcctgggggacatgttcagcctggccaagctgaagccagagaagaggtag

SEQ ID NO: 163262 - DNA, 4062 bp, Artificial Sequence
  Description of Artificial Sequence: Synthetic coding sequence
atgaaggtgacagtgtgctttggaagaaccagggtggtggtgccctgtggagatggccacatgaaggtgttcagcctcatccagcaggccgtgacccgctacaggaaggccatcgccaaggaccccaactactggatccaggtgcaccggctggagcacggagatggcggcatcctggacctggatgacatcctgtgtgatgtggctgatgacaaggaccggctggtggccgtgtttgatgagcaggacccccaccacggcggagatggcaccagcgccagcagcacaggcacccagagccctgagatcttcggcagcgagctgggcaccaacaacgtgtctgccttccagccctaccaggccaccagcgagattgaggtgacccccagcgtgctgcgggccaacatgcccctgcacgtgagaagaagcagtgaccctgccctgattggcctgagcacctctgtgtctgacagcaacttcagcagcgaggagcccagcaggaagaaccccacccgctggagcaccacagctggcttcctgaagcagaacacagctggcagccccaagacctgtgacaggaagaaggatgagaactaccgcagcctgccccgggacaccagcaactggagcaaccagttccagagggacaatgcccggagcagcctgagcgccagccaccccatggtgggcaagtggctggagaagcaggagcaggatgaagatggaacagaggaggacaacagccgggtggagcctgtgggccacgccgacaccggcctggagcacatccccaacttcagcctggatgacatggtgaagctggtggaggtgcccaatgatggcggccccctgggcatccacgtggtgcccttcagcgcccggggcggccgcaccctgggcctgctggtgaagaggctggagaagggcggcaaggccgagcatgaaaatctcttccgggagaatgactgcatcgtgcgcatcaatgatggagacctgaggaacagaagatttgagcaggcccagcacatgttccggcaggccatgaggacccccatcatctggttccacgtggtgcctgctgccaacaaggagcagtatgagcagctgagccagagcgagaagaacaactactacagcagccgcttctccccagacagccagtacatcgacaacagatctgtgaacagcgctggcctgcacacagtgcagagggccccccggctgaaccaccccccagagcagattgacagccacagccggctgccccacagcgcccaccccagcggcaagcccccatctgccccagccagcgccccccagaatgtgttcagcaccaccgtgagcagcggctacaacaccaagaagattggcaagaggctgaacatccagctgaagaagggcacagagggcctgggcttcagcatcaccagcagagatgtgaccatcggcggcagcgcccccatctacgtgaagaacatcctgcccaggggggccgccatccaggacggccgcctgaaggccggggacaggctcatcgaggtgaatggagtggacctggtgggcaagagccaggaggaggtggtgtccctgctgcggagcaccaagatggagggcaccgtgtccctgctggtgttccggcaggaggatgccttccacccccgggagctgaatgctgagcccagccagatgcagatccccaaggagaccaaggccgaggatgaggacatcgtgctgaccccagatggcacccgggagttcctgacctttgaggtgcccctgaatgacagcggcagcgctggcctgggcgtgtctgtgaagggcaacagaagcaaggagaaccacgccgacctgggcatctttgtgaagagcatcatcaatggaggagctgccagcaaggatggccgcctgcgggtgaatgaccagctgattgctgtgaatggagagagcctgctgggcaagaccaaccaggatgccatggagaccctgcggcgctccatgagcacagagggcaacaagaggggcatgatccagctgattgtggcccggcgcatcagcaagtgcaatgagctgaagagccctggcagccccccaggccctgagctgcccattgaaacagccctggatgaccgggagcggcgcatcagccacagcctgtacagcggcatcgagggcctggatgagagccccagcagaaatgctgccctgagccgcatcatgggcaagtaccagctgagccccaccgtgaacatgccccaggatgacaccgtcatcattgaagatgaccggctgcctgtgctgcccccccacctgagtgaccagagcagcagcagcagccatgatgatgtgggctttgtgacagcagatgctggcacctgggccaaggccgccatcagtgacagcgctgactgcagcctgagcccagatgtggaccctgtgctggccttccagcgggagggcttcggccggcagagcatgtctgagaagaggaccaagcagttcagtgatgccagccagctggactttgtgaagaccaggaagagcaagtccatggacctgggcattgctgatgagaccaagctgaacacagtggatgaccagaaggccggcagccccagcagagatgtgggccccagcctgggcctgaagaagagcagcagcctggagagcctgcagacagctgtggccgaggtgaccctgaatggagacatccccttccaccggccccggccccgcatcatccggggccggggctgcaatgaaagcttccgggccgccatcgacaagagctatgacaagccagctgtggatgatgatgatgagggcatggagaccctggaggaggacacagaggagagcagccgcagcggccgggagagcgtgtccacagccagtgaccagcccagccacagcctggagcggcagatgaatggaaaccaggagaagggggacaagacagacaggaagaaggacaagacaggcaaggagaagaagaaggaccgggacaaggagaaggacaagatgaaggccaagaagggcatgctgaagggcctgggggacatgttccgctttgggaagcacaggaaggatgacaagattgagaagacaggcaagatcaagatccaggagagcttcaccagcgaggaggagcgcatccgcatgaagcaggagcaggagcgcatccaggccaagacccgggagttccgggagcggcaggcccgggagcgggactatgcagagatccaggacttccacaggaccttcggctgtgatgatgagctgatgtatggaggagtgagcagctatgagggctccatggccctgaatgcccggccccagagcccccgggagggccacatgatggatgccctgtatgcccaggtgaagaagcccaggaacagcaagcccagccctgtggacagcaacagaagcacccccagcaaccacgaccgcatccagaggctgcggcaggagttccagcaggccaagcaggatgaagatgtggaggacagaagaaggacctacagctttgagcagccctggcccaatgcccggcctgccacccagagcggccgccacagcgtgtctgtggaggtgcagatgcagaggcagaggcaggaggagcgggagagcagccagcaggcccagaggcagtacagcagcctgccccggcagagcaggaagaatgccagctctgtgtcccaggacagctgggagcagaactacagccctggagagggcttccagagcgccaaggagaacccccgctacagcagctaccagggcagcagaaatggctacctgggcggccacggcttcaatgcccgggtgatgctggagacccaggagctgctgcggcaggagcagaggaggaaggagcagcagatgaagaagcagcccccatctgagggccccagcaactatgacagctacaagaaggtgcaggaccccagctatgccccacccaagggccccttccggcaggatgtgccccccagccccagccaggtggcccggctgaaccggctgcagaccccagagaagggccggcccttctacagctag

SEQ ID NO: 163263 - DNA, 4071 bp, Artificial Sequence
  Description of Artificial Sequence: Synthetic coding sequence
atgaaggtgacagtgtgctttggaagaaccagggtggtggtgccctgtggagatggccacatgaaggtgttcagcctcatccagcaggccgtgacccgctacaggaaggccatcgccaaggaccccaactactggatccaggtgcaccggctggagcacggagatggcggcatcctggacctggatgacatcctgtgtgatgtggctgatgacaaggaccggctggtggccgtgtttgatgagcaggacccccaccacggcggagatggcaccagcgccagcagcacaggcacccagagccctgagatcttcggcagcgagctgggcaccaacaacgtgtctgccttccagccctaccaggccaccagcgagattgaggtgacccccagcgtgctgcgggccaacatgcccctgcacgtgagaagaagcagtgaccctgccctgattggcctgagcacctctgtgtctgacagcaacttcagcagcgaggagcccagcaggaagaaccccacccgctggagcaccacagctggcttcctgaagcagaacacagctggcagccccaagacctgtgacaggaagaaggatgagaactaccgcagcctgccccgggacaccagcaactggagcaaccagttccagagggacaatgcccggagcagcctgagcgccagccaccccatggtgggcaagtggctggagaagcaggagcaggatgaagatggaacagaggaggacaacagccgggtggagcctgtgggccacgccgacaccggcctggagcacatccccaacttcagcctggatgacatggtgaagctggtggaggtgcccaatgatggcggccccctgggcatccacgtggtgcccttcagcgcccggggcggccgcaccctgggcctgctggtgaagaggctggagaagggcggcaaggccgagcatgaaaatctcttccgggagaatgactgcatcgtgcgcatcaatgatggagacctgaggaacagaagatttgagcaggcccagcacatgttccggcaggccatgaggacccccatcatctggttccacgtggtgcctgctgccaacaaggagcagtatgagcagctgagccagagcgagaagaacaactactacagcagccgcttctccccagacagccagtacatcgacaacagatctgtgaacagcgctggcctgcacacagtgcagagggccccccggctgaaccaccccccagagcagattgacagccacagccggctgccccacagcgcccaccccagcggcaagcccccatctgccccagccagcgccccccagaatgtgttcagcaccaccgtgagcagcggctacaacaccaagaagattggcaagaggctgaacatccagctgaagaagggcacagagggcctgggcttcagcatcaccagcagagatgtgaccatcggcggcagcgcccccatctacgtgaagaacatcctgcccaggggggccgccatccaggacggccgcctgaaggccggggacaggctcatcgaggtgaatggagtggacctggtgggcaagagccaggaggaggtggtgtccctgctgcggagcaccaagatggagggcaccgtgtccctgctggtgttccggcaggaggatgccttccacccccgggagctgaatgctgagcccagccagatgcagatccccaaggagaccaaggccgaggatgaggacatcgtgctgaccccagatggcacccgggagttcctgacctttgaggtgcccctgaatgacagcggcagcgctggcctgggcgtgtctgtgaagggcaacagaagcaaggagaaccacgccgacctgggcatctttgtgaagagcatcatcaatggaggagctgccagcaaggatggccgcctgcgggtgaatgaccagctgattgctgtgaatggagagagcctgctgggcaagaccaaccaggatgccatggagaccctgcggcgctccatgagcacagagggcaacaagaggggcatgatccagctgattgtggcccggcgcatcagcaagtgcaatgagctgaagagccctggcagccccccaggccctgagctgcccattgaaacagccctggatgaccgggagcggcgcatcagccacagcctgtacagcggcatcgagggcctggatgagagccccagcagaaatgctgccctgagccgcatcatgggagagagcggcaagtaccagctgagccccaccgtgaacatgccccaggatgacaccgtcatcattgaagatgaccggctgcctgtgctgcccccccacctgagtgaccagagcagcagcagcagccatgatgatgtgggctttgtgacagcagatgctggcacctgggccaaggccgccatcagtgacagcgctgactgcagcctgagcccagatgtggaccctgtgctggccttccagcgggagggcttcggccggcagagcatgtctgagaagaggaccaagcagttcagtgatgccagccagctggactttgtgaagaccaggaagagcaagtccatggacctgggcattgctgatgagaccaagctgaacacagtggatgaccagaaggccggcagccccagcagagatgtgggccccagcctgggcctgaagaagagcagcagcctggagagcctgcagacagctgtggccgaggtgaccctgaatggagacatccccttccaccggccccggccccgcatcatccggggccggggctgcaatgaaagcttccgggccgccatcgacaagagctatgacaagccagctgtggatgatgatgatgagggcatggagaccctggaggaggacacagaggagagcagccgcagcggccgggagagcgtgtccacagccagtgaccagcccagccacagcctggagcggcagatgaatggaaaccaggagaagggggacaagacagacaggaagaaggacaagacaggcaaggagaagaagaaggaccgggacaaggagaaggacaagatgaaggccaagaagggcatgctgaagggcctgggggacatgttccgctttgggaagcacaggaaggatgacaagattgagaagacaggcaagatcaagatccaggagagcttcaccagcgaggaggagcgcatccgcatgaagcaggagcaggagcgcatccaggccaagacccgggagttccgggagcggcaggcccgggagcgggactatgcagagatccaggacttccacaggaccttcggctgtgatgatgagctgatgtatggaggagtgtcctcctatgagggctccatggccctgaatgcccggccccagagcccccgggagggccacatgatggatgccctgtatgcccaggtgaagaagcccaggaacagcaagcccagccctgtggacagcaacagaagcacccccagcaaccacgaccgcatccagaggctgcggcaggagttccagcaggccaagcaggatgaagatgtggaggacagaagaaggacctacagctttgagcagccctggcccaatgcccggcctgccacccagagcggccgccacagcgtgtctgtggaggtgcagatgcagaggcagaggcaggaggagcgggagagcagccagcaggcccagaggcagtacagcagcctgccccggcagagcaggaagaatgccagctctgtgtcccaggacagctgggagcagaactacagccctggagagggcttccagagcgccaaggagaacccccgctacagcagctaccagggcagcagaaatggctacctgggcggccacggcttcaatgcccgggtgatgctggagacccaggagctgctgcggcaggagcagaggaggaaggagcagcagatgaagaagcagccccccagcgagggccccagcaactatgacagctacaagaaggtgcaggaccccagctatgccccacccaagggccccttccggcaggatgtgccccccagccccagccaggtggcccggctgaaccggctgcagaccccagagaagggccggcccttctacagctag

SEQ ID NO: 163264 - DNA, 3891 bp, Artificial Sequence
  Description of Artificial Sequence: Synthetic coding sequence
atgaaggtgacagtgtgctttggaagaaccagggtggtggtgccctgtggagatggccacatgaaggtgttcagcctcatccagcaggccgtgacccgctacaggaaggccatcgccaaggaccccaactactggatccaggtgcaccggctggagcacggagatggcggcatcctggacctggatgacatcctgtgtgatgtggctgatgacaaggaccggctggtggccgtgtttgatgagcaggacccccaccacggcggagatggcaccagcgccagcagcacaggcacccagagccctgagatcttcggcagcgagctgggcaccaacaacgtgtctgccttccagccctaccaggccaccagcgagattgaggtgacccccagcgtgctgcgggccaacatgcccctgcacgtgagaagaagcagtgaccctgccctgattggcctgagcacctctgtgtctgacagcaacttcagcagcgaggagcccagcaggaagaaccccacccgctggagcaccacagctggcttcctgaagcagaacacagctggcagccccaagacctgtgacaggaaggatgaagatggaacagaggaggacaacagccgggtggagcctgtgggccacgccgacaccggcctggagcacatccccaacttcagcctggatgacatggtgaagctggtggaggtgcccaatgatggcggccccctgggcatccacgtggtgcccttcagcgcccggggcggccgcaccctgggcctgctggtgaagaggctggagaagggcggcaaggccgagcatgaaaatctcttccgggagaatgactgcatcgtgcgcatcaatgatggagacctgaggaacagaagatttgagcaggcccagcacatgttccggcaggccatgaggacccccatcatctggttccacgtggtgcctgctgccaacaaggagcagtatgagcagctgagccagagcgagaagaacaactactacagcagccgcttctccccagacagccagtacatcgacaacagatctgtgaacagcgctggcctgcacacagtgcagagggccccccggctgaaccaccccccagagcagattgacagccacagccggctgccccacagcgcccaccccagcggcaagcccccatctgccccagccagcgccccccagaatgtgttcagcaccaccgtgagcagcggctacaacaccaagaagattggcaagaggctgaacatccagctgaagaagggcacagagggcctgggcttcagcatcaccagcagagatgtgaccatcggcggcagcgcccccatctacgtgaagaacatcctgcccaggggggccgccatccaggacggccgcctgaaggccggggacaggctcatcgaggtgaatggagtggacctggtgggcaagagccaggaggaggtggtgtccctgctgcggagcaccaagatggagggcaccgtgtccctgctggtgttccggcaggaggatgccttccacccccgggagctgaaggcagaagatgaagatattgtgctgaccccagatggcacccgggagttcctgacctttgaggtgcccctgaatgattctggcagcgctggcctgggcgtgtctgtgaagggcaacagaagcaaagaaaatcatgctgacctgggcatctttgtgaagagcatcatcaatggaggagctgccagcaaggatggccgcctgcgggtgaatgaccagctgattgctgtgaatggagagagcctgctgggcaagaccaaccaggatgccatggagaccctgcggcgctccatgagcacagagggcaacaagaggggcatgatccagctgattgtggcccggcgcatcagcaaatgtaatgagctgaagagccctggcagccccccaggccctgagctgcccatcgagacagccctggatgaccgggagcggcgcatcagccacagcctgtacagcggcatcgagggcctggatgagagccccagcagaaatgctgccctgagccgcatcatgggcaagtaccagctgagccccaccgtgaacatgccccaggatgacaccgtcatcattgaagatgaccggctgcctgtgctgcccccccacctgagtgaccagagcagcagcagcagccatgatgatgtgggctttgtgacagcagatgctggcacctgggccaaggccgccatcagtgacagcgctgactgcagcctgagcccagatgtggaccctgtgctggccttccagcgggagggcttcggccggcagagcatgtctgagaagaggaccaagcagttcagtgatgccagccagctggactttgtgaagaccaggaagagcaagtccatggacctgggcattgctgatgagaccaagctgaacacagtggatgaccagaaggccggcagccccagcagagatgtgggccccagcctgggcctgaagaagagcagcagcctggagagcctgcagacagctgtggccgaggtgaccctgaatggagacatccccttccaccggccccggccccgcatcatccggggccggggctgcaatgaaagcttccgggccgccatcgacaagagctatgacaagccagctgtggatgatgatgatgagggcatggagaccctggaggaggacacagaggagagcagccgcagcggccgggagagcgtgtccacagccagtgaccagcccagccacagcctggagcggcagatgaatggaaaccaggagaagggggacaagacagacaggaagaaggacaagacaggcaaggagaagaagaaggaccgggacaaggagaaggacaagatgaaggccaagaagggcatgctgaagggcctgggggacatgttccgctttgggaagcacaggaaggatgacaagattgagaagacaggcaagatcaagatccaggagagcttcaccagcgaggaggagcgcatccgcatgaagcaggagcaggagcgcatccaggccaagacccgggagttccgggagcggcaggcccgggagcgggactatgcagagatccaggacttccacaggaccttcggctgtgatgatgagctgatgtatggaggagtgtcctcctatgagggctccatggccctgaatgcccggccccagagcccccgggagggccacatgatggatgccctgtatgcccaggtgaagaagcccaggaacagcaagcccagccctgtggacagcaacagaagcacccccagcaaccacgaccgcatccagaggctgcggcaggagttccagcaggccaagcaggatgaagatgtggaggacagaagaaggacctacagctttgagcagccctggcccaatgcccggcctgccacccagagcggccgccacagcgtgtctgtggaggtgcagatgcagaggcagaggcaggaggagcgggagagcagccagcaggcccagaggcagtacagcagcctgccccggcagagcaggaagaatgccagctctgtgtcccaggacagctgggagcagaactacagccctggagagggcttccagagcgccaaggagaacccccgctacagcagctaccagggcagcagaaatggctacctgggcggccacggcttcaatgcccgggtgatgctggagacccaggagctgctgcggcaggagcagaggaggaaggagcagcagatgaagaagcagccccccagcgagggccccagcaactatgacagctacaagaaggtgcaggaccccagctatgccccacccaagggccccttccggcaggatgtgccccccagccccagccaggtggcccggctgaaccggctgcagaccccagagaagggccggcccttctacagctag

SEQ ID NO: 163265 - DNA, 3735 bp, Artificial Sequence
  Description of Artificial Sequence: Synthetic coding sequence
atgaaggtgacagtgtgctttggaagaaccagggtggtggtgccctgtggagatggccacatgaaggtgttcagcctcatccagcaggccgtgacccgctacaggaaggccatcgccaaggaccccaactactggatccaggtgcaccggctggagcacggagatggcggcatcctggacctggatgacatcctgtgtgatgtggctgatgacaaggaccggctggtggccgtgtttgatgagcaggacccccaccacggcggagatggcaccagcgccagcagcacaggcacccagagccctgagatcttcggcagcgagctgggcaccaacaacgtgtctgccttccagccctaccaggccaccagcgagattgaggtgacccccagcgtgctgcgggccaacatgcccctgcacgtgagaagaagcagtgaccctgccctgattggcctgagcacctctgtgtctgacagcaacttcagcagcgaggagcccagcaggaagaaccccacccgctggagcaccacagctggcttcctgaagcagaacacagctggcagccccaagacctgtgacaggaaggatgaagatggaacagaggaggacaacagccgggtggagcctgtgggccacgccgacaccggcctggagcacatccccaacttcagcctggatgacatggtgaagctggtggaggtgcccaatgatggcggccccctgggcatccacgtggtgcccttcagcgcccggggcggccgcaccctgggcctgctggtgaagaggctggagaagggcggcaaggccgagcatgaaaatctcttccgggagaatgactgcatcgtgcgcatcaatgatggagacctgaggaacagaagatttgagcaggcccagcacatgttccggcaggccatgaggacccccatcatctggttccacgtggtgcctgctgccaacaaggagcagtatgagcagctgagccagagcgagaagaacaactactacagcagccgcttctccccagacagccagtacatcgacaacagatctgtgaacagcgctggcctgcacacagtgcagagggccccccggctgaaccaccccccagagcagattgacagccacagccggctgccccacagcgcccaccccagcggcaagcccccatctgccccagccagcgccccccagaatgtgttcagcaccaccgtgagcagcggctacaacaccaagaagattggcaagaggctgaacatccagctgaagaagggcacagagggcctgggcttcagcatcaccagcagagatgtgaccatcggcggcagcgcccccatctacgtgaagaacatcctgcccaggggggccgccatccaggacggccgcctgaaggccggggacaggctcatcgaggtgaatggagtggacctggtgggcaagagccaggaggaggtggtgtccctgctgcggagcaccaagatggagggcaccgtgtccctgctggtgttccggcaggaggatgccttccacccccgggagctgaaggcagaagatgaagatattgtgctgaccccagatggcacccgggagttcctgacctttgaggtgcccctgaatgattctggcagcgctggcctgggcgtgtctgtgaagggcaacagaagcaaagaaaatcatgctgacctgggcatctttgtgaagagcatcatcaatggaggagctgccagcaaggatggccgcctgcgggtgaatgaccagctgattgctgtgaatggagagagcctgctgggcaagaccaaccaggatgccatggagaccctgcggcgctccatgagcacagagggcaacaagaggggcatgatccagctgattgtggcccggcgcatcagcaaatgtaatgagctgaagagccctggcagccccccaggccctgagctgcccatcgagacagccctggatgaccgggagcggcgcatcagccacagcctgtacagcggcatcgagggcctggatgagagccccagcagaaatgctgccctgagccgcatcatgggcaagtaccagctgagccccaccgtgaacatgccccaggatgacaccgtcatcattgaagatgaccggctgcctgtgctgcccccccacctgagtgaccagagcagcagcagcagccatgatgatgtgggctttgtgacagcagatgctggcacctgggccaaggccgccatcagtgacagcgctgactgcagcctgagcccagatgtggaccctgtgctggccttccagcgggagggcttcggccggcagagcatgtctgagaagaggaccaagcagttcagtgatgccagccagctggactttgtgaagaccaggaagagcaagtccatggacctgggcagcagccccagcagagatgtgggccccagcctgggcctgaagaagagcagcagcctggagagcctgcagacagctgtggccgaggtgaccctgaatggagacatccccttccaccggccccggccccgcatcatccggggccggggctgcaatgaaagcttccgggccgccatcgacaagagctatgacaagccagctgtggatgatgatgatgagggcatggagaccctggaggaggacacagaggagagcagccgcagcggccgggagagcgtgtccacagccagtgaccagcccagccacagcctggagcggcagatgaatggaaaccaggagaagggggacaagacagacaggaagaaggacaagacaggcaaggagaagaagaaggaccgggacaaggagaaggacaagatgaaggccaagaagggcatgctgaagggcctgggggacatgttccgcatccaggccaagacccgggagttccgggagcggcaggcccgggagcgggactatgcagagatccaggacttccacaggaccttcggctgtgatgatgagctgatgtatggaggagtgtcctcctatgagggctccatggccctgaatgcccggccccagagcccccgggagggccacatgatggatgccctgtatgcccaggtgaagaagcccaggaacagcaagcccagccctgtggacagcaacagaagcacccccagcaaccacgaccgcatccagaggctgcggcaggagttccagcaggccaagcaggatgaagatgtggaggacagaagaaggacctacagctttgagcagccctggcccaatgcccggcctgccacccagagcggccgccacagcgtgtctgtggaggtgcagatgcagaggcagaggcaggaggagcgggagagcagccagcaggcccagaggcagtacagcagcctgccccggcagagcaggaagaatgccagctctgtgtcccaggacagctgggagcagaactacagccctggagagggcttccagagcgccaaggagaacccccgctacagcagctaccagggcagcagaaatggctacctgggcggccacggcttcaatgcccgggtgatgctggagacccaggagctgctgcggcaggagcagaggaggaaggagcagcagatgaagaagcagccccccagcgagggccccagcaactatgacagctacaagaaggtgcaggaccccagctatgccccacccaagggccccttccggcaggatgtgccccccagccccagccaggtggcccggctgaaccggctgcagaccccagagaagggccggcccttctacagctag

SEQ ID NO: 163266 - DNA, 2244 bp, Artificial Sequence
  Description of Artificial Sequence: Synthetic coding sequence
atggtgaagctggtggaggtgcccaatgatggcggccccctgggcatccacgtggtgcccttcagcgcccggggcggccgcaccctgggcctgctggtgaagaggctggagaagggcggcaaggccgagcatgaaaatctcttccgggagaatgactgcatcgtgcgcatcaatgatggagacctgaggaacagaagatttgagcaggcccagcacatgttccggcaggccatgaggacccccatcatctggttccacgtggtgcctgctgccaacaaggagcagtatgagcagctgagccagagcgagaagaacaactactacagcagccgcttctccccagacagccagtacatcgacaacagatctgtgaacagcgctggcctgcacacagtgcagagggccccccggctgaaccaccccccagagcagattgacagccacagccggctgccccacagcgcccaccccagcggcaagcccccatctgccccagccagcgccccccagaatgtgttcagcaccaccgtgagcagcggctacaacaccaagaagattggcaagaggctgaacatccagctgaagaagggcacagagggcctgggcttcagcatcaccagcagagatgtgaccatcggcggcagcgcccccatctacgtgaagaacatcctgcccaggggggccgccatccaggacggccgcctgaaggccggggacaggctcatcgaggtgaatggagtggacctggtgggcaagagccaggaggaggtggtgtccctgctgcggagcaccaagatggagggcaccgtgtccctgctggtgttccggcaggaggatgccttccacccccgggagctgaaggcagaagatgaagatattgtgctgaccccagatggcacccgggagttcctgacctttgaggtgcccctgaatgattctggcagcgctggcctgggcgtgtctgtgaagggcaacagaagcaaagaaaatcatgctgacctgggcatctttgtgaagagcatcatcaatggaggagctgccagcaaggatggccgcctgcgggtgaatgaccagctgattgctgtgaatggagagagcctgctgggcaagaccaaccaggatgccatggagaccctgcggcgctccatgagcacagagggcaacaagaggggcatgatccagctgattgtggcccggcgcatcagcaaatgtaatgagctgaagagccctggcagccccccaggccctgagctgcccatcgagacagccctggatgaccgggagcggcgcatcagccacagcctgtacagcggcatcgagggcctggatgagagccccagcagaaatgctgccctgagccgcatcatgggcaagtaccagctgagccccaccgtgaacatgccccaggatgacaccgtcatcattgaagatgaccggctgcctgtgctgcccccccacctgagtgaccagagcagcagcagcagccatgatgatgtgggctttgtgacagcagatgctggcacctgggccaaggccgccatcagtgacagcgctgactgcagcctgagcccagatgtggaccctgtgctggccttccagcgggagggcttcggccggcagagcatgtctgagaagaggaccaagcagttcagtgatgccagccagctggactttgtgaagaccaggaagagcaagtccatggacctggtggctgatgagaccaagctgaacacagtggatgaccagaaggccggcagccccagcagagatgtgggccccagcctgggcctgaagaagagcagcagcctggagagcctgcagacagctgtggccgaggtgaccctgaatggagacatccccttccaccggccccggccccgcatcatccggggccggggctgcaatgaaagcttccgggccgccatcgacaagagctatgacaagccagctgtggatgatgatgatgagggcatggagaccctggaggaggacacagaggagagcagccgcagcggccgggagagcgtgtccacagccagtgaccagcccagccacagcctggagcggcagatgaatggaaaccaggagaagggggacaagacagacaggaagaaggacaagacaggcaaggagaagaagaaggaccgggacaaggagaaggacaagatgaaggccaagaagggcatgctgaagggcctgggggacatgttcagcctggccaagctgaagccagagaagaggtag

SEQ ID NO: 163267 - DNA, 3801 bp, Artificial Sequence
  Description of Artificial Sequence: Synthetic coding sequence
atgaaggtgacagtgtgctttggaagaaccagggtggtggtgccctgtggagatggccacatgaaggtgttcagcctcatccagcaggccgtgacccgctacaggaaggccatcgccaaggaccccaactactggatccaggtgcaccggctggagcacggagatggcggcatcctggacctggatgacatcctgtgtgatgtggctgatgacaaggaccggctggtggccgtgtttgatgagcaggacccccaccacggcggagatggcaccagcgccagcagcacaggcacccagagccctgagatcttcggcagcgagctgggcaccaacaacgtgtctgccttccagccctaccaggccaccagcgagattgaggtgacccccagcgtgctgcgggccaacatgcccctgcacgtgagaagaagcagtgaccctgccctgattggcctgagcacctctgtgtctgacagcaacttcagcagcgaggagcccagcaggaagaaccccacccgctggagcaccacagctggcttcctgaagcagaacacagctggcagccccaagacctgtgacaggaaggatgaagatggaacagaggaggacaacagccgggtggagcctgtgggccacgccgacaccggcctggagcacatccccaacttcagcctggatgacatggtgaagctggtggaggtgcccaatgatggcggccccctgggcatccacgtggtgcccttcagcgcccggggcggccgcaccctgggcctgctggtgaagaggctggagaagggcggcaaggccgagcatgaaaatctcttccgggagaatgactgcatcgtgcgcatcaatgatggagacctgaggaacagaagatttgagcaggcccagcacatgttccggcaggccatgaggacccccatcatctggttccacgtggtgcctgctgccaacaaggagcagtatgagcagctgagccagagcgagaagaacaactactacagcagccgcttctccccagacagccagtacatcgacaacagatctgtgaacagcgctggcctgcacacagtgcagagggccccccggctgaaccaccccccagagcagattgacagccacagccggctgccccacagcgcccaccccagcggcaagcccccatctgccccagccagcgccccccagaatgtgttcagcaccaccgtgagcagcggctacaacaccaagaagattggcaagaggctgaacatccagctgaagaagggcacagagggcctgggcttcagcatcaccagcagagatgtgaccatcggcggcagcgcccccatctacgtgaagaacatcctgcccaggggggccgccatccaggacggccgcctgaaggccggggacaggctcatcgaggtgaatggagtggacctggtgggcaagagccaggaggaggtggtgtccctgctgcggagcaccaagatggagggcaccgtgtccctgctggtgttccggcaggaggatgccttccacccccgggagctgaaggcagaagatgaagatattgtgctgaccccagatggcacccgggagttcctgacctttgaggtgcccctgaatgattctggcagcgctggcctgggcgtgtctgtgaagggcaacagaagcaaagaaaatcatgctgacctgggcatctttgtgaagagcatcatcaatggaggagctgccagcaaggatggccgcctgcgggtgaatgaccagctgattgctgtgaatggagagagcctgctgggcaagaccaaccaggatgccatggagaccctgcggcgctccatgagcacagagggcaacaagaggggcatgatccagctgattgtggcccggcgcatcagcaaatgtaatgagctgaagagccctggcagccccccaggccctgagctgcccatcgagacagccctggatgaccgggagcggcgcatcagccacagcctgtacagcggcatcgagggcctggatgagagccccagcagaaatgctgccctgagccgcatcatgggcaagtaccagctgagccccaccgtgaacatgccccaggatgacaccgtcatcattgaagatgaccggctgcctgtgctgcccccccacctgagtgaccagagcagcagcagcagccatgatgatgtgggctttgtgacagcagatgctggcacctgggccaaggccgccatcagtgacagcgctgactgcagcctgagcccagatgtggaccctgtgctggccttccagcgggagggcttcggccggcagattgctgatgagaccaagctgaacacagtggatgaccagaaggccggcagccccagcagagatgtgggccccagcctgggcctgaagaagagcagcagcctggagagcctgcagacagctgtggccgaggtgaccctgaatggagacatccccttccaccggccccggccccgcatcatccggggccggggctgcaatgaaagcttccgggccgccatcgacaagagctatgacaagccagctgtggatgatgatgatgagggcatggagaccctggaggaggacacagaggagagcagccgcagcggccgggagagcgtgtccacagccagtgaccagcccagccacagcctggagcggcagatgaatggaaaccaggagaagggggacaagacagacaggaagaaggacaagacaggcaaggagaagaagaaggaccgggacaaggagaaggacaagatgaaggccaagaagggcatgctgaagggcctgggggacatgttccgctttgggaagcacaggaaggatgacaagattgagaagacaggcaagatcaagatccaggagagcttcaccagcgaggaggagcgcatccgcatgaagcaggagcaggagcgcatccaggccaagacccgggagttccgggagcggcaggcccgggagcgggactatgcagagatccaggacttccacaggaccttcggctgtgatgatgagctgatgtatggaggagtgtcctcctatgagggctccatggccctgaatgcccggccccagagcccccgggagggccacatgatggatgccctgtatgcccaggtgaagaagcccaggaacagcaagcccagccctgtggacagcaacagaagcacccccagcaaccacgaccgcatccagaggctgcggcaggagttccagcaggccaagcaggatgaagatgtggaggacagaagaaggacctacagctttgagcagccctggcccaatgcccggcctgccacccagagcggccgccacagcgtgtctgtggaggtgcagatgcagaggcagaggcaggaggagcgggagagcagccagcaggcccagaggcagtacagcagcctgccccggcagagcaggaagaatgccagctctgtgtcccaggacagctgggagcagaactacagccctggagagggcttccagagcgccaaggagaacccccgctacagcagctaccagggcagcagaaatggctacctgggcggccacggcttcaatgcccgggtgatgctggagacccaggagctgctgcggcaggagcagaggaggaaggagcagcagatgaagaagcagccccccagcgagggccccagcaactatgacagctacaagaaggtgcaggaccccagctatgccccacccaagggccccttccggcaggatgtgccccccagccccagccaggtggcccggctgaaccggctgcagaccccagagaagggccggcccttctacagctag

SEQ ID NO: 163268 - DNA, 4023 bp, Artificial Sequence
  Description of Artificial Sequence: Synthetic coding sequence
atgaaggtgacagtgtgctttggaagaaccagggtggtggtgccctgtggagatggccacatgaaggtgttcagcctcatccagcaggccgtgacccgctacaggaaggccatcgccaaggaccccaactactggatccaggtgcaccggctggagcacggagatggcggcatcctggacctggatgacatcctgtgtgatgtggctgatgacaaggaccggctggtggccgtgtttgatgagcaggacccccaccacggcggagatggcaccagcgccagcagcacaggcacccagagccctgagatcttcggcagcgagctgggcaccaacaacgtgtctgccttccagccctaccaggccaccagcgagattgaggtgacccccagcgtgctgcgggccaacatgcccctgcacgtgagaagaagcagtgaccctgccctgattggcctgagcacctctgtgtctgacagcaacttcagcagcgaggagcccagcaggaagaaccccacccgctggagcaccacagctggcttcctgaagcagaacacagctggcagccccaagacctgtgacaggaagaaggatgagaactaccgcagcctgccccgggacaccagcaactggagcaaccagttccagagggacaatgcccggagcagcctgagcgccagccaccccatggtgggcaagtggctggagaagcaggagcaggatgaagatggaacagaggaggacaacagccgggtggagcctgtgggccacgccgacaccggcctggagcacatccccaacttcagcctggatgacatggtgaagctggtggaggtgcccaatgatggcggccccctgggcatccacgtggtgcccttcagcgcccggggcggccgcaccctgggcctgctggtgaagaggctggagaagggcggcaaggccgagcatgaaaatctcttccgggagaatgactgcatcgtgcgcatcaatgatggagacctgaggaacagaagatttgagcaggcccagcacatgttccggcaggccatgaggacccccatcatctggttccacgtggtgcctgctgccaacaaggagcagtatgagcagctgagccagagcgagaagaacaactactacagcagccgcttctccccagacagccagtacatcgacaacagatctgtgaacagcgctggcctgcacacagtgcagagggccccccggctgaaccaccccccagagcagattgacagccacagccggctgccccacagcgcccaccccagcggcaagcccccatctgccccagccagcgccccccagaatgtgttcagcaccaccgtgagcagcggctacaacaccaagaagattggcaagaggctgaacatccagctgaagaagggcacagagggcctgggcttcagcatcaccagcagagatgtgaccatcggcggcagcgcccccatctacgtgaagaacatcctgcccaggggggccgccatccaggacggccgcctgaaggccggggacaggctcatcgaggtgaatggagtggacctggtgggcaagagccaggaggaggtggtgtccctgctgcggagcaccaagatggagggcaccgtgtccctgctggtgttccggcaggaggatgccttccacccccgggagctgaaggcagaagatgaagatattgtgctgaccccagatggcacccgggagttcctgacctttgaggtgcccctgaatgattctggcagcgctggcctgggcgtgtctgtgaagggcaacagaagcaaagaaaatcatgctgacctgggcatctttgtgaagagcatcatcaatggaggagctgccagcaaggatggccgcctgcgggtgaatgaccagctgattgctgtgaatggagagagcctgctgggcaagaccaaccaggatgccatggagaccctgcggcgctccatgagcacagagggcaacaagaggggcatgatccagctgattgtggcccggcgcatcagcaaatgtaatgagctgaagagccctggcagccccccaggccctgagctgcccatcgagacagccctggatgaccgggagcggcgcatcagccacagcctgtacagcggcatcgagggcctggatgagagccccagcagaaatgctgccctgagccgcatcatgggcaagtaccagctgagccccaccgtgaacatgccccaggatgacaccgtcatcattgaagatgaccggctgcctgtgctgcccccccacctgagtgaccagagcagcagcagcagccatgatgatgtgggctttgtgacagcagatgctggcacctgggccaaggccgccatcagtgacagcgctgactgcagcctgagcccagatgtggaccctgtgctggccttccagcgggagggcttcggccggcagagcatgtctgagaagaggaccaagcagttcagtgatgccagccagctggactttgtgaagaccaggaagagcaagtccatggacctgggcattgctgatgagaccaagctgaacacagtggatgaccagaaggccggcagccccagcagagatgtgggccccagcctgggcctgaagaagagcagcagcctggagagcctgcagacagctgtggccgaggtgaccctgaatggagacatccccttccaccggccccggccccgcatcatccggggccggggctgcaatgaaagcttccgggccgccatcgacaagagctatgacaagccagctgtggatgatgatgatgagggcatggagaccctggaggaggacacagaggagagcagccgcagcggccgggagagcgtgtccacagccagtgaccagcccagccacagcctggagcggcagatgaatggaaaccaggagaagggggacaagacagacaggaagaaggacaagacaggcaaggagaagaagaaggaccgggacaaggagaaggacaagatgaaggccaagaagggcatgctgaagggcctgggggacatgttccgctttgggaagcacaggaaggatgacaagattgagaagacaggcaagatcaagatccaggagagcttcaccagcgaggaggagcgcatccgcatgaagcaggagcaggagcgcatccaggccaagacccgggagttccgggagcggcaggcccgggagcgggactatgcagagatccaggacttccacaggaccttcggctgtgatgatgagctgatgtatggaggagtgtcctcctatgagggctccatggccctgaatgcccggccccagagcccccgggagggccacatgatggatgccctgtatgcccaggtgaagaagcccaggaacagcaagcccagccctgtggacagcaacagaagcacccccagcaaccacgaccgcatccagaggctgcggcaggagttccagcaggccaagcaggatgaagatgtggaggacagaagaaggacctacagctttgagcagccctggcccaatgcccggcctgccacccagagcggccgccacagcgtgtctgtggaggtgcagatgcagaggcagaggcaggaggagcgggagagcagccagcaggcccagaggcagtacagcagcctgccccggcagagcaggaagaatgccagctctgtgtcccaggacagctgggagcagaactacagccctggagagggcttccagagcgccaaggagaacccccgctacagcagctaccagggcagcagaaatggctacctgggcggccacggcttcaatgcccgggtgatgctggagacccaggagctgctgcggcaggagcagaggaggaaggagcagcagatgaagaagcagccccccagcgagggccccagcaactatgacagctacaagaaggtgcaggaccccagctatgccccacccaagggccccttccggcaggatgtgccccccagccccagccaggtggcccggctgaaccggctgcagaccccagagaagggccggcccttctacagctag

SEQ ID NO: 163269 - DNA, 1119 bp, Artificial Sequence
  Description of Artificial Sequence: Synthetic coding sequence
atgaacagaagccacagacatggagctggcagcggctgcctgggcaccatggaggtgaagagcaagtttggagctgagttccgccgcttcagcctggagaggagcaagccaggcaagtttgaggagttctacggcctgctgcagcacgtgcacaagatccccaacgtggatgtgctggtgggctatgctgacatccacggggacctgctgcccatcaacaatgatgacaactaccacaaggctgtgtccacagccaaccccctgctgcgcatcttcatccagaagaaggaggaggccgactacagcgccttcggcacagacaccctcatcaagaagaagaatgtgctgaccaacgtgctgcggccagacaaccacaggaagaagccccacatcgtcatctccatgccccaggacttccggcctgtgagcagcatcattgatgtggacatcctgcctgagacccaccggcgggtgcggctgtacaagtatggaacagagaagcccctgggcttctacatcagagatggcagctctgtgcgggtgaccccccacggcctggagaaggtgcccggcatcttcatcagccggctggtgcctgggggcctggcccagagcacaggcctgctggccgtgaatgatgaggtgctggaggtgaatggaattgaggtgtctgggaagagcctggaccaggtgacagacatgatgattgccaacagcaggaacctgatcatcaccgtgcggcctgccaaccagaggaacaacgtggtgaggaacagcaggaccagcggcagcagcggccagagcacagacaacagcctgctgggctacccccagcagatcgagcccagctttgagccagaagatgaagattctgaagaagatgacatcatcattgaagataatggagtgccccagcagatccccaaggctgtgcccaacacagagagcctggagagcctgacccagatcgagctgagctttgaaagtggccagaatggcttcatccccagcaatgaggtgtccctggccgccatcgccagcagcagcaacacagaatttgagacccacgccccagaccagaagctgctggaggaggatggcaccatcatcaccctgtag

SEQ ID NO: 163270 - DNA, 1131 bp, Artificial Sequence
  Description of Artificial Sequence: Synthetic coding sequence
atgaacagaagcttccacaagagccagaccctgcgcttctatgactgcagcgctgtggaggtgaagagcaagtttggagctgagttccgccgcttcagcctggacagacacaagccaggcaagtttgaggacttctacaagctggtggtgcacacccaccacatcagcaacagtgatgtgaccatcggctatgcagatgtgcacggggacctgctgcccatcaacaatgatgacaacttctgcaaggctgtgagcagcgccaaccccctgctgcgggtcttcatccagaagcgggaggaggccgagcggggcagcctgggcgccggcagcctgtgcagaagaagaagagccctgggcgccctgagagatgagggcccccggcggcgggcccacctggacatcggcctgccccgggacttccggcctgtgagcagcatcattgatgtggacctggtgcctgagacccacagaagagtgcggctgcaccgccacggctgtgagaagcccctgggcttctacatcagagatggagcctctgtgcgggtgacccctcatggcctggagaaggtgcccggcatcttcatcagcaggatggtgcctgggggcctggccgagagcacaggcctgctggccgtgaatgatgaggtgctggaggtgaatggcatcgaggtggccggcaagaccctggaccaggtgacagacatgatgattgccaacagccacaacctgattgtgacagtgaagccagccaaccagagaaataatgtggtgcggggcggccgggccctgggcagcagcggccccccatctgatggaacagctggctttgtgggccccccagccccccgggtgctgcagaacttccacccagatgaagctgagagtgatgaagataatgatgtggtgattgagggcaccctggagcccgcccggcccccccagacccctggggccccagctggcagcctgagccgggtgaatggagctggcctggcccagaggctgcagagggacctggccctggatggcggcctgcagaggctgctgagcagcctgcgggctgaccccaggcacagcctggccctgcccccaggcggcgtggaggagcacggccctgctgtgaccctgtag

SEQ ID NO: 163271 - DNA, 1236 bp, Artificial Sequence
  Description of Artificial Sequence: Synthetic coding sequence
atggccgaggccgagctgcacaaggagcggctgcaggccatcgccgagaagaggaagaggcagacagaaattgagggcaagaggcagcagctggatgagcagatcctgctgctgcagcacagcaagagcaaggtgctgcgggagaagtggctgctgcagggcatcccagctggaacagctgaggaggaggaggcccggcggcggcagagcgaggaggatgagttccgggtgaagcagctggaggacaacatccagaggctggagcaggagatccagaccctggagagcgaggagagccagatcagcgccaaggagcagatcatcctggagaagctgaaggagacagagaagagcttcaaggacttccagaagggcttcagcagcacagatggagatgctgtgaactacatcagcagccagctgcctgacctgcccatcctgtgcagcaggacagctgagcccagccctggccaggacggcaccagcagagctgctgctgtgtatgccatggagatcaacgtggagaaggacaagcagacaggagagaccaagatcctgagcaccagcaccatcggccctgagggcgtgcaccagaagggcgtgaaggtgtatgatgatggcaccaaggtggtgtatgaggtgcgcagcggcggcaccgtggtggagaatggagtgcacaagctgagcaccaaggatgtggaggagctgatccagaaggccggccagagcagcctgggcggcggccacgtgtctgagaggacagtgattgctgatggcagcctgagccaccccaaggagcacatgctgtgcaaggaggccaagctggagatggtgcacaagagcaggaaggaccacagcagcggcaaccctggccagcaggcccaggcccccagcgctgctggccctgaggccaacctggaccagcctgtgaccatgatcttcatgggctaccagaacattgaagatgaggaggagaccaagaaggtgctgggctatgatgagaccatcaaggccgagctggtgctgattgatgaagatgatgagaagagcctgcgggagaagacagtgacagatgtgtccaccattgatggaaatgctgctgagctggtgtctggccggcctgtgtctgacaccacagagcccagcagccctgagggcaaggaggagagcctggccacagagcccgcccctggcacccagaagaagaagcgctgccagtgctgcgtggtgatgtag

SEQ ID NO: 163272 - DNA, 1140 bp, Artificial Sequence
  Description of Artificial Sequence: Synthetic coding sequence
atggagatggccgaggccgagctgcacaaggagcggctgcaggccatcgccgagaagaggaagaggcagacagaaattgagggcaagaggcagcagctggatgagcagatcctgctgctgcagcacagcaagagcaaggtgctgcgggagaagtggctgctgcagggcatcccagctggaacagctgaggaggaggaggcccggcggcggcagagcgaggaggatgagttccgggtgaagcagctggaggacaacatccagaggctggagcaggagatccagaccctggagagcgaggagagccagatcagcgccaaggagcagatcatcctggagaagctgaaggagacagagaagagcttcaaggacttccagaagggcttcagcagcacagatggagctgtgtatgccatggagatcaacgtggagaaggacaagcagacaggagagaccaagatcctgagcaccagcaccatcggccctgagggcgtgcaccagaagggcgtgaaggtgtatgatgatggcaccaaggtggtgtatgaggtgcgcagcggcggcaccgtggtggagaatggagtgcacaagctgagcaccaaggatgtggaggagctgatccagaaggccggccagagcagcctgggcggcggccacgtgtctgagaggacagtgattgctgatggcagcctgagccaccccaaggagcacatgctgtgcaaggaggccaagctggagatggtgcacaagagcaggaaggaccacagcagcggcaaccctggccagcaggcccaggcccccagcgctgctggccctgaggccaacctggaccagcctgtgaccatgatcttcatgggctaccagaacattgaagatgaggaggagaccaagaaggtgctgggctatgatgagaccatcaaggccgagctggtgctgattgatgaagatgatgagaagagcctgcgggagaagacagtgacagatgtgtccaccattgatggaaatgctgctgagctggtgtctggccggcctgtgtctgacaccacagagcccagcagccctgagggcaaggaggagagcctggccacagagcccgcccctggcacccagaagaagaagcgctgccagtgctgcgtggtgatgtag

SEQ ID NO: 163273 - DNA, 1242 bp, Artificial Sequence
  Description of Artificial Sequence: Synthetic coding sequence
atggagatggccgaggccgagctgcacaaggagcggctgcaggccatcgccgagaagaggaagaggcagacagaaattgagggcaagaggcagcagctggatgagcagatcctgctgctgcagcacagcaagagcaaggtgctgcgggagaagtggctgctgcagggcatcccagctggaacagctgaggaggaggaggcccggcggcggcagagcgaggaggatgagttccgggtgaagcagctggaggacaacatccagaggctggagcaggagatccagaccctggagagcgaggagagccagatcagcgccaaggagcagatcatcctggagaagctgaaggagacagagaagagcttcaaggacttccagaagggcttcagcagcacagatggagatgctgtgaactacatcagcagccagctgcctgacctgcccatcctgtgcagcaggacagctgagcccagccctggccaggacggcaccagcagagctgctgctgtgtatgccatggagatcaacgtggagaaggacaagcagacaggagagaccaagatcctgagcaccagcaccatcggccctgagggcgtgcaccagaagggcgtgaaggtgtatgatgatggcaccaaggtggtgtatgaggtgcgcagcggcggcaccgtggtggagaatggagtgcacaagctgagcaccaaggatgtggaggagctgatccagaaggccggccagagcagcctgggcggcggccacgtgtctgagaggacagtgattgctgatggcagcctgagccaccccaaggagcacatgctgtgcaaggaggccaagctggagatggtgcacaagagcaggaaggaccacagcagcggcaaccctggccagcaggcccaggcccccagcgctgctggccctgaggccaacctggaccagcctgtgaccatgatcttcatgggctaccagaacattgaagatgaggaggagaccaagaaggtgctgggctatgatgagaccatcaaggccgagctggtgctgattgatgaagatgatgagaagagcctgcgggagaagacagtgacagatgtgtccaccattgatggaaatgctgctgagctggtgtctggccggcctgtgtctgacaccacagagcccagcagccctgagggcaaggaggagagcctggccacagagcccgcccctggcacccagaagaagaagcgctgccagtgctgcgtggtgatgtag

SEQ ID NO: 163274 - DNA, 1167 bp, Artificial Sequence
  Description of Artificial Sequence: Synthetic coding sequence
atgggccgggcccggcgcttccagtggcccctgctgctgctgtgggccgctgctgctggccctggagctggccaggaggtgcagacagaaaatgtgacagtggccgagggcggcgtggccgagatcacctgccgcctgcaccagtatgatggcagcatcgtggtgatccagaacccagcccggcagaccctcttcttcaacggcacccgggccctgaaggatgagcgcttccagctggaggagttcagccccaggagagtgcgcatccggctgagtgatgcccggctggaggatgagggcggctacttctgccagctgtacacagaggacacccaccaccagatcgccaccctgactgtgctggtggccccagaaaatcctgtggtggaggtgcgggagcaggccgtggagggcggggaggtggagctgagctgcctggtgcccaggagcaggcctgctgccaccctgcgctggtacagagacaggaaggagctgaagggcgtgagcagcagccaggagaatggcaaggtgtggagcgtggccagcacagtgcgcttccgggtggacaggaaggatgatggcggcatcatcatctgtgaggcccagaaccaggccctgcccagcggccacagcaagcagacccagtatgtgctggatgtgcagtacagccccacagcccgcatccacgccagccaggccgtggtgcgggagggggacaccctggtgctgacctgtgctgtgacaggcaacccccggcccaaccagatccgctggaacagaggaaatgaaagcctgcctgagagagctgaggccgtgggggagaccctgaccctgcccggcctggtgtctgctgacaatggcacctacacctgtgaggccagcaacaagcacggccacgcccgggccctgtatgtgctggtggtgtatgaccctggagctgtggtggaggcccagacctctgtgccctatgccatcgtgggcggcatcctggccctgctggtgttcctgatcatctgtgtgctggtgggcatggtgtggtgcagcgtgcggcagaagggcagctacctgacccatgaggccagcggcctggatgagcagggcgaggcccgggaggccttcctgaatggaagtgatggccacaagaggaaggaggagttcttcatctag

SEQ ID NO: 163275 - DNA, 1068 bp, Artificial Sequence
  Description of Artificial Sequence: Synthetic coding sequence
atgggcaagctggtggccctggtgctgctgggcgtgggcctgagcctggtgggggagatgttcctggccttccgggagcgggtgaatgccagccgggaggtggagcctgtggagcctgagaactgccacctgattgaggagctggagaccggcagcgaggacctggagatcctgcccaacggcctggccttcatcagcagcggcctgaagtacccaggcatcaagagcttcaaccccaacagccctgggaagatcctgctgatggacctgaatgaggaggaccccaccgtgctggagctgggcatcaccggcagcaagtttgatgtgtcctccttcaacccccacggcatcagcaccttcacagatgaagataatgccatgtacctgctggtggtgaaccacccagatgccaagagcacagtggagctgttcaagttccaggaggaggagaagagcctgctgcacctgaagaccatccgccacaagctgctgcccaacctgaatgacatcgtggccgtgggccctgagcacttctacggcaccaatgaccactacttcctggacccctacctgcagagctgggagatgtacctgggcctggcctggagctatgtggtgtactacagccccagcgaggtgcgggtggtggccgagggctttgattttgccaacggcatcaacatcagcccagatggcaagtatgtgtacatcgccgagctgctggcccacaagatccacgtgtatgagaagcacgccaactggaccctgacccccctgaagagcctggacttcaacaccctggtggacaacatctctgtggaccctgagactggagacctgtgggtgggctgccaccccaacggcatgaagatcttcttctatgacagtgaaaatcctccagccagcgaggtgctgcgcatccagaacatcctgacagaggagcccaaggtgacccaggtgtatgcagaaaatggcaccgtgctgcagggcagcacagtggcctctgtgtacaagggcaagctgctgattggaacagtgttccacaaggccctgtactgtgagctgtag

SEQ ID NO: 163276 - DNA, 1017 bp, Artificial Sequence
  Description of Artificial Sequence: Synthetic coding sequence
atggctgctggctgcagcgaggcccccaggcctgctgctgccagtgatggcagcctggtgggccaggccggcgtgctgccctgcctggagctgcccacctatgctgctgcctgtgccctggtgaacagccgctacagctgcctggtggccggcccccaccagaggcacatcgccctgagcccccgctacctgaacaggaagaggacaggcatccgggagcagctggatgctgagctgctgcgctacagcgagagcctgctgggcgtgcccatcgcctatgacaacatcaaggtggtgggggagctgggggacatctatgatgaccagggccacatccacctgaacatcgaggccgactttgtgatcttctgcccagagcccggccagaagctgatgggcatcgtgaacaaggtgagcagcagccacatcggctgcctggtgcacggctgcttcaatgccagcatccccaagccagagcagctgtctgctgagcagtggcagaccatggagatcaacatgggagatgagctggagtttgaggtgttccggctggacagtgatgctgctggggtcttctgcatccggggcaagctgaacatcaccagcctgcagttcaagaggtctgaggtgtctgaggaggtgacagaaaatggaacagaggaggccgccaagaagcccaagaagaagaagaagaagaaggaccctgagacctatgaggtggacagcggcaccaccaagctggctgatgatgctgatgacacccccatggaggagagcgccctgcagaacaccaacaatgccaacggcatctgggaggaggagcccaagaagaagaagaagaagaagaagcaccaggaggtgcaggaccaggaccccgtcttccagggcagtgacagcagcggctaccagagcgaccacaagaagaagaagaagaagaggaagcacagcgaggaggccgagttcaccccacccctgaagtgcagccccaagaggaagggcaagagcaacttcctgtag

SEQ ID NO: 163277 - DNA, 1059 bp, Artificial Sequence
  Description of Artificial Sequence: Synthetic coding sequence
ggggctgctgggggctgcggcctggccggggacagagctggcctgggggagcggctgctggccctgaggaaccggctgaaggccagccgggaggtggagagcgtggacctgccccactgccacctgatcaagggcatcgaggccggctctgaagatattgacatcctgcccaacggcctggccttcttctctgtgggcctgaagtttcctggcctgcacagctttgccccagacaagccaggcggcatcctgatgatggacctgaaggaggagaagccccgggcccgggagctgcgcatcagccggggctttgacctggccagcttcaacccccacggcatcagcaccttcatcgacaatgatgacacagtgtacctgtttgtggtgaaccaccctgagttcaagaacacagtggagatcttcaagtttgaggaggccgagaacagcctgctgcacctgaagacagtgaagcatgagctgctgcccagcgtgaatgacatcacagctgtgggccctgcccacttctacgccaccaatgaccactacttcagtgaccccttcctgaagtacctggagacctacctgaacctgcactgggccaacgtggtgtactacagccccaatgaggtgaaggtggtggccgagggctttgattctgccaacggcatcaacatcagcccagatgacaagtacatctacgtggccgacatcctggcccacgagatccacgtgctggagaagcacaccaacatgaacctgacccagctgaaggtgctggagctggacaccctggtggacaacctgagcattgaccccagcagcggggacatctgggtgggctgccaccccaacggccagaagctgtttgtgtatgaccccaacaacccccccagcagcgaggtgctgcgcatccagaacatcctgtctgagaagcccaccgtgaccaccgtgtatgccaacaatggatctgtgctgcagggcagctctgtggcctctgtgtatgatggcaagctgctgattggcaccctgtaccaccgggccctgtactgtgagctgtag

SEQ ID NO: 163278 - DNA, 1128 bp, Artificial Sequence
  Description of Artificial Sequence: Synthetic coding sequence
atggccccacccacagagctgctggcccggcctgagcggggcagcgcccctggcagccgggccatgggccgcctggtggccgtgggcctgctgggcatcgccctggccctgctgggggagcggctgctggccctgaggaaccggctgaaggccagccgggaggtggagagcgtggacctgccccactgccacctgatcaagggcattgaagctggcagcgaggacatcgacatcctgcccaacggcctggccttcttctctgtgggcctgaagtttcctggcctgcacagctttgccccagacaagccaggcggcatcctgatgatggacctgaaggaggagaagccccgggcccgggagctgcgcatcagccggggctttgacctggccagcttcaacccccacggcatcagcaccttcatcgacaatgatgacacagtgtacctgtttgtggtgaaccaccctgagttcaagaacacagtggagatcttcaagtttgaggaggccgagaacagcctgctgcacctgaagacagtgaagcatgagctgctgcccagcgtgaatgacatcacagctgtgggccctgcccacttctacgccaccaatgaccactacttcagtgaccccttcctgaagtacctggagacctacctgaacctgcactgggccaacgtggtgtactacagccccaatgaggtgaaggtggtggccgagggctttgacagcgccaacggcatcaacatcagcccagatgacaagtacatctacgtggccgacatcctggcccacgagatccacgtgctggagaagcacaccaacatgaacctgacccagctgaaggtgctggagctggacaccctggtggacaacctgagcattgaccccagcagcggggacatctgggtgggctgccaccccaacggccagaagctgtttgtgtatgaccccaacaacccccccagcagcgaggtgctgcgcatccagaacatcctgtctgagaagcccaccgtgaccaccgtgtatgccaacaacggctctgtgctgcagggcagctctgtggcctctgtgtatgatggcaagctgctgattggcaccctgtaccaccgggccctgtactgtgagctgtag

SEQ ID NO: 163279 - DNA, 1029 bp, Artificial Sequence
  Description of Artificial Sequence: Synthetic coding sequence
atgggccgcctggtggccgtgggcctgctgggcatcgccctggccctgctgggggagcggctgctggccctgaggaaccggctgaaggccagccgggaggtggagagcgtggacctgccccactgccacctgatcaagggcatcgaggccggctctgaagatattgacatcctgcccaacggcctggccttcttctctgtgggcctgaagtttcctggcctgcacagctttgccccagacaagccaggcggcatcctgatgatggacctgaaggaggagaagccccgggcccgggagctgcgcatcagccggggctttgacctggccagcttcaacccccacggcatcagcaccttcatcgacaatgagttcaagaacacagtggagatcttcaagtttgaggaggccgagaacagcctgctgcacctgaagacagtgaagcatgagctgctgcccagcgtgaatgacatcacagctgtgggccctgcccacttctacgccaccaatgaccactacttcagtgaccccttcctgaagtacctggagacctacctgaacctgcactgggccaacgtggtgtactacagccccaatgaggtgaaggtggtggccgagggctttgattctgccaacggcatcaacatcagcccagatgacaagtacatctacgtggccgacatcctggcccacgagatccacgtgctggagaagcacaccaacatgaacctgacccagctgaaggtgctggagctggacaccctggtggacaacctgagcattgaccccagcagcggggacatctgggtgggctgccaccccaacggccagaagctgtttgtgtatgaccccaacaacccccccagcagcgaggtgctgcgcatccagaacatcctgtctgagaagcccaccgtgaccaccgtgtatgccaacaatggatctgtgctgcagggcagctctgtggcctctgtgtatgatggcaagctgctgattggcaccctgtaccaccgggccctgtactgtgagctgtag

SEQ ID NO: 163280 - DNA, 1065 bp, Artificial Sequence
  Description of Artificial Sequence: Synthetic coding sequence
atgggcaagctggtggccctggtgctgctgggcgtgggcctgagcctggtgggggagatgttcctggccttccgggagcgggtgaatgccagccgggaggtggagcctgtggagcctgagaactgccacctgattgaggagctggagagcggctctgaagatattgacatcctgcccagcggcctggccttcatcagcagcggcctgaagtacccaggcatgcccaactttgccccagatgagcccgggaagatcttcctgatggacctgaatgagcagaacccccgggcccaggccctggagatcagcggcggctttgacaaggagctgttcaacccccacggcatcagcatcttcatcgacaaggacaacacagtgtacctgtatgtggtgaaccacccccacatgaagagcacagtggagatcttcaagtttgaggagcagcagaggagcctggtgtacctgaagaccatcaagcatgagctgctgaagtctgtgaatgacatcgtggtgctgggccctgagcagttctacgccacccgggaccactacttcaccaacagcctgctgtccttctttgagatgatcctggacctgcgctggacctacgtgctcttctacagcccccgggaggtgaaggtggtggccaagggcttctgcagcgccaacggcatcaccgtgtctgctgaccagaagtatgtgtatgtggctgatgtggccgccaagaacatccacatcatggagaagcatgacaactgggacctgacccagctgaaggtgatccagctgggcaccctggtggacaacctgactgtggaccctgccaccggggacatcctggccggctgccaccccaaccccatgaagctgctgaactacaaccctgaggaccccccaggcagcgaggtgctgcgcatccagaatgtgctgtctgagaagccccgggtgtccacagtgtatgccaacaatggatctgtgctgcagggcacctctgtggcctctgtgtaccacggcaagatcctgattggcaccgtcttccacaagaccctgtactgtgagctgtag

SEQ ID NO: 163281 - DNA, 1572 bp, Artificial Sequence
  Description of Artificial Sequence: Synthetic coding sequence
atgatgctgcggggcaacctgaagcaggtgcgcatcgagaagaacccagcccggctgcgggccctggagagcgctgtgggggagagcgagcctgctgctgctgctgccatggccctggccctggccggggagcccgcccccccagccccagcccctcctgaggaccacccagatgaggagatgggcttcaccatcgacatcaagagcttcctgaagccaggagagaagacctacacccagcgctgccgcctgtttgtgggcaacctgcccacagacatcacagaggaggacttcaagaggctgtttgaaagatatggagagcccagcgaggtgttcatcaacagagaccggggcttcggcttcatccggctggagagcaggaccctggccgagatcgccaaggccgagctggatggcaccatcctgaagagccggcccctgcgcatccgctttgccacccacggggccgccctgactgtgaagaacctgagccctgtggtgtccaatgagctgctggagcaggccttcagccagtttggacctgtggagaaggctgtggtggtggtggatgaccggggccgggccaccgggaagggctttgtggagtttgctgccaagcccccagccaggaaggccctggagcgctgtggagatggagccttcctgctgaccaccacccccaggcctgtgattgtggagcccatggagcagtttgatgatgaagatggcctgcctgagaagctgatgcagaagacccagcagtaccacaaggagcgggagcagccccccaggtttgcccagcccggcacctttgaatttgaatatgccagccgctggaaggccctggatgagatggagaagcagcagcgggagcaggtggacaggaacatccgggaggccaaggagaagctggaggccgagatggaggccgcccggcatgagcaccagctgatgctgatgaggcaggacctgatgaggcggcaggaggagctgcggcggctggaggagctgaggaaccaggagctgcagaagaggaagcagatccagctgcggcatgaggaggagcacagaagaagagaggaggagatgatccgccaccgggagcaggaggagctgcggcggcagcaggagggcttcaagcccaactacatggagaaccgggagcaggagatgaggatgggagacatgggccccaggggggccatcaacatgggagatgccttcagccctgccccagctggcaaccagggccccccacccatgatgggcatgaacatgaacaacagagccaccatccctggcccccccatgggccctggccctgccatgggccctgagggcgccgccaacatgggcacccccatgatgccagacaatggagctgtgcacaatgaccgcttcccccagggcccccccagccagatgggcagccccatgggcagcaggactggaagtgagaccccccaggcccccatgtctggagtgggccctgtgtctgggggccctgggggcttcggccggggcagccagggcggcaactttgagggccccaacaagagaagacgctactag

SEQ ID NO: 163282 - DNA, 1392 bp, Artificial Sequence
  Description of Artificial Sequence: Synthetic coding sequence
atgggcttcaccatcgacatcaagagcttcctgaagccaggagagaagacctacacccagcgctgccgcctgtttgtgggcaacctgcccacagacatcacagaggaggacttcaagaggctgtttgaaagatatggagagcccagcgaggtgttcatcaacagagaccggggcttcggcttcatccggctggagagcaggaccctggccgagatcgccaaggccgagctggatggcaccatcctgaagagccggcccctgcgcatccgctttgccacccacggggccgccctgactgtgaagaacctgagccctgtggtgtccaatgagctgctggagcaggccttcagccagtttggacctgtggagaaggctgtggtggtggtggatgaccggggccgggccaccgggaagggctttgtggagtttgctgccaagcccccagccaggaaggccctggagcgctgtggagatggagccttcctgctgaccaccacccccaggcctgtgattgtggagcccatggagcagtttgatgatgaagatggcctgcctgagaagctgatgcagaagacccagcagtaccacaaggagcgggagcagccccccaggtttgcccagcccggcacctttgaatttgaatatgccagccgctggaaggccctggatgagatggagaagcagcagcgggagcaggtggacaggaacatccgggaggccaaggagaagctggaggccgagatggaggccgcccggcatgagcaccagctgatgctgatgaggcaggacctgatgaggcggcaggaggagctgcggcggctggaggagctgaggaaccaggagctgcagaagaggaagcagatccagctgcggcatgaggaggagcacagaagaagagaggaggagatgatccgccaccgggagcaggaggagctgcggcggcagcaggagggcttcaagcccaactacatggagaaccgggagcaggagatgaggatgggagacatgggccccaggggggccatcaacatgggagatgccttcagccctgccccagctggcaaccagggccccccacccatgatgggcatgaacatgaacaacagagccaccatccctggcccccccatgggccctggccctgccatgggccctgagggcgccgccaacatgggcacccccatgatgccagacaatggagctgtgcacaatgaccgcttcccccagggcccccccagccagatgggcagccccatgggcagcaggactggaagtgagaccccccaggcccccatgtctggagtgggccctgtgtctgggggccctgggggcttcggccggggcagccagggcggcaactttgagggccccaacaagagaagacgctactag

SEQ ID NO: 163283 - DNA, 747 bp, Artificial Sequence
  Description of Artificial Sequence: Synthetic coding sequence
atgatgctgcggggcaacctgaagcaggtgcgcatcgagaagaacccagcccggctgcgggccctggagagcgctgtgggggagagcgagcctgctgctgctgctgccatggccctggccctggccggggagcccgcccccccagccccagcccctcctgaggaccacccagatgaggagatgggcttcaccatcgacatcaagagcttcctgaagccaggagagaagacctacacccagcgctgccgcctgtttgtgggcaacctgcccacagacatcacagaggaggacttcaagaggctgtttgaaagatatggagagcccagcgaggtgttcatcaacagagaccggggcttcggcttcatccggctggagagcaggaccctggccgagatcgccaaggccgagctggatggcaccatcctgaagagccggcccctgcgcatccgctttgccacccacggggccgccctgactgtgaagaacctgagccctgtggtgtccaatgagctgctggagcaggccttcagccagtttggacctgtggagaaggctgtggtggtggtggatgaccggggccgggccaccgggaagggctttgtggagtttgctgccaagcccccagccaggaaggccctggagcgctgtggagatggagccttcctgctgaccaccacccccaggcctgtgattgtggagcccatggagcagtttgatgatgaagatggcctgcctgagaagctgtag

SEQ ID NO: 163284 - DNA, 309 bp, Artificial Sequence
  Description of Artificial Sequence: Synthetic coding sequence
atgtctgagaagtctgtggaggccgctgctgagctgagcgccaaggacctgaaggagaagaaggagaaggtggaggagaaggccagcaggaaggagaggaagaaggaggtggtggaggaggaggagaatggagctgaggaggaggaggaggagacagcagaagatggagaggaggaggatgaaggagaggaggaggatgaggaggaggaggaggaggatgatgagggccctgccctgaagagagctgctgaggaggaggatgaagctgaccccaagaggcagaagacagaaaatggagccagcgcctag

SEQ ID NO: 163285 - DNA, 315 bp, Artificial Sequence
  Description of Artificial Sequence: Synthetic coding sequence
atgtctgagaagtctgtggaggccgctgctgagctgagcgccaaggacctgaaggagaagaaggagaaggtggaggagaaggccagcaggaaggagaggaagaaggaggtggtggaggcccctgtgcccctggtggtgatggtgggcaaggcctgcagccagcctgaggccacccccagccctggcccccacagaagaagaagaacaggcctgcggaggaagaagaagaagctgcccaggatggagaggaggaagatgaagggcaagaagaagatgaggaagaagaagaagaggatgatgaagggccccaggtag

SEQ ID NO: 163286 - DNA, 306 bp, Artificial Sequence
  Description of Artificial Sequence: Synthetic coding sequence
agccgggaccctgcctgcagagctgctgagctgagcgccaaggacctgaaggagaagaaggagaaggtggaggagaaggccagcaggaaggagaggaagaaggaggtggtggaggaggaggagaatggagctgaggaggaggaggaggagacagcagaagatggagaggaggaggatgaaggagaggaggaggatgaggaggaggaggaggaggatgatgagggccctgccctgaagagagctgctgaggaggaggatgaggccgaccccaagaggcagaagacagaaaatggagccagcgcctag

SEQ ID NO: 163287 - DNA, 528 bp, Artificial Sequence
  Description of Artificial Sequence: Synthetic coding sequence
atgcagaggcggctggtgcagcagtggagcgtggccgtgttcctgctgtcctatgctgtgcccagctgtggccgctctgtggagggcctgagccggcggctgaagagagctgtgtctgagcaccagctgctgcatgacaagggcaagagcatccaggacctgcggcggcgcttcttcctgcaccacctgattgctgagatccacacagctgagatccgggccaccagcgaggtgagccccaacagcaagcccagccccaacaccaagaaccaccctgtgcgctttggaagtgatgatgagggccgctacctgacccaggagaccaacaaggtggagacctacaaggagcagcccctgaagacccctgggaagaagaagaagggcaagccaggcaagaggaaggagcaggagaagaagaagaggaggaccaggtctgcctggctggacagcggcgtgactggaagtggcctggagggggaccacctgagtgacaccagcaccaccagcctggagctggacagcaggtag

SEQ ID NO: 163288 - DNA, 630 bp, Artificial Sequence
  Description of Artificial Sequence: Synthetic coding sequence
atgcagaggcggctggtgcagcagtggagcgtggccgtgttcctgctgtcctatgctgtgcccagctgtggccgctctgtggagggcctgagccggcggctgaagagagctgtgtctgagcaccagctgctgcatgacaagggcaagagcatccaggacctgcggcggcgcttcttcctgcaccacctgattgctgagatccacacagctgagatccgggccaccagcgaggtgagccccaacagcaagcccagccccaacaccaagaaccaccctgtgcgctttggaagtgatgatgagggccgctacctgacccaggagaccaacaaggtggagacctacaaggagcagcccctgaagacccctgggaagaagaagaagggcaagccaggcaagaggaaggagcaggagaagaagaagaggaggaccaggtctgcctggctggacagcggcgtgactggaagtggcctggagggggaccacctgagtgacaccagcaccaccagcctggagctggacagcaggacagccctgctgtggggcctgaagaagaagaaggagaacaacagaaggacccaccacatgcagctgatgatcagcctcttcaagagccccctgctgctgctgtag

SEQ ID NO: 163289 - DNA, 528 bp, Artificial Sequence; identical to SEQ ID NO: 163287
  Description of Artificial Sequence: Synthetic coding sequence

SEQ ID NO: 163290 - DNA, 534 bp, Artificial Sequence
  Description of Artificial Sequence: Synthetic coding sequence
atgcagaggcggctggtgcagcagtggagcgtggccgtgttcctgctgtcctatgctgtgcccagctgtggccgctctgtggagggcctgagccggcggctgaagagagctgtgtctgagcaccagctgctgcatgacaagggcaagagcatccaggacctgcggcggcgcttcttcctgcaccacctgattgctgagatccacacagctgagatccgggccaccagcgaggtgagccccaacagcaagcccagccccaacaccaagaaccaccctgtgcgctttggaagtgatgatgagggccgctacctgacccaggagaccaacaaggtggagacctacaaggagcagcccctgaagacccctgggaagaagaagaagggcaagccaggcaagaggaaggagcaggagaagaagaagaggaggaccaggtctgcctggctggacagcggcgtgactggaagtggcctggagggggaccacctgagtgacaccagcaccaccagcctggagctggacagcagaagacactag

SEQ ID NO: 163291 - DNA, 528 bp, Artificial Sequence; identical to SEQ ID NO: 163287
  Description of Artificial Sequence: Synthetic coding sequence

SEQ ID NO: 163292 - DNA, 81 bp, Artificial Sequence
  Description of Artificial Sequence: Synthetic coding sequence
acagccctgctgtggggcctgaagaagaagggcaagcagcagaagaacaccagctatgccaccaatgacctgatcatctag

SEQ ID NO: 163293 - DNA, 630 bp, Artificial Sequence; identical to SEQ ID NO: 163288
  Description of Artificial Sequence: Synthetic coding sequence

SEQ ID NO: 163294 - DNA, 534 bp, Artificial Sequence; identical to SEQ ID NO: 163290
  Description of Artificial Sequence: Synthetic coding sequence

SEQ ID NO: 163295 - DNA, 519 bp, Artificial Sequence
  Description of Artificial Sequence: Synthetic coding sequence
atgcagaggcggctggtgcagcagtggagcgtggccgtgttcctgctgtcctatgctgtgcccagctgtggccgctctgtggagggcctgagccggcggctgaagagagctgtgtctgagcaccagctgctgcatgacaagggcaagagcatccaggacctgcggcggcgcttcttcctgcaccacctgattgctgagatccacacagctgagatccgggccaccagcgaggtgagccccaacagcaagcccagccccaacaccaagaaccaccctgtgcgctttggaagtgatgatgagggccgctacctgacccaggagaccaacaaggtggagacctacaaggagcagcccctgaagacccctgggaagaagaagaagggcaagccaggcaagaggaaggagcaggagaagaagaagaggaggaccaggtctgcctggctggacagcggcgtgactggaagtggcctggagggggaccacctgagtgacaccagcaccaccagcctggagctgtag

SEQ ID NO: 163296 - DNA, 534 bp, Artificial Sequence; identical to SEQ ID NO: 163290
  Description of Artificial Sequence: Synthetic coding sequence

SEQ ID NO: 163297 - DNA, 891 bp, Artificial Sequence
  Description of Artificial Sequence: Synthetic coding sequence
atggtggccgagaaggagaccctgagcctgaacaagtgcccagacaagatgcccaagaggaccaagctgctggcccagcagcccctgcctgtgcaccagccccacagcctggtgtctgagggcttcaccgtgaaggccatgatgaagaacagcgtggtgcggggccccccagctgctggggccttcaaggagcggcccaccaagcccacagccttcaggaagttctatgaaagaggagacttccccatcgccctggagcatgacagcaagggcaacaagatcgcctggaaggtggagattgagaagctggactaccaccactacctgcccctcttctttgatggcctgtgtgagatgaccttcccctatgagttctttgcccggcagggcatccatgacatgctggagcacggcggcaacaagatcctgcctgtgctgccccagctgatcatccccatcaagaatgccctgaacctgaggaaccggcaggtgatctgtgtgaccctgaaggtgctgcagcacctggtggtgtctgctgagatggtgggcaaggccctggtgccctactaccggcagatcctgcctgtgctgaacatcttcaagaacatgaatggcagctacagcctgccccggctggagtgcagcggggccatcatggcccgctgcaacctggaccacctgggcagcagtgacccccccaccagcgccagccaggtggccgagatcatcgtgaacagcggagatggcatcgactacagccagcagaagcgggagaacatcggggacctgatccaggagaccctggaggcctttgaaagatatggaggagaaaatgccttcatcaacatcaagtatgtggtgcccacctatgagagctgcctgctgaactag

SEQ ID NO: 163298 - DNA, 774 bp, Artificial Sequence
  Description of Artificial Sequence: Synthetic coding sequence
atggtggccgagaaggagaccctgagcctgaacaagtgcccagacaagatgcccaagaggaccaagctgctggcccagcagcccctgcctgtgcaccagccccacagcctggtgtctgagggcttcaccgtgaaggccatgatgaagaacagcgtggtgcggggccccccagctgctggggccttcaaggagcggcccaccaagcccacagccttcaggaagttctatgaaagaggagacttccccatcgccctggagcatgacagcaagggcaacaagatcgcctggaaggtggagattgagaagctggactaccaccactacctgcccctcttctttgatggcctgtgtgagatgaccttcccctatgagttctttgcccggcagggcatccatgacatgctggagcacggcggcaacaagatcctgcctgtgctgccccagctgatcatccccatcaagaatgccctgaacctgaggaaccggcaggtgatctgtgtgaccctgaaggtgctgcagcacctggtggtgtctgctgagatggtgggcaaggccctggtgccctactaccggcagatcctgcctgtgctgaacatcttcaagaacatgaatgtgaacagcggagatggcatcgactacagccagcagaagagagaaaatattggagacctgatccaggagaccctggaggcctttgaaagatatggaggagaaaatgccttcatcaacatcaagtatgtggtgcccacctatgagagctgcctgctgaactag

SEQ ID NO: 163299 - DNA, 774 bp, Artificial Sequence; identical to SEQ ID NO: 163298
  Description of Artificial Sequence: Synthetic coding sequence

SEQ ID NO: 163300 - DNA, 825 bp, Artificial Sequence
  Description of Artificial Sequence: Synthetic coding sequence
atgtctggagagtgccagagcccccactgccccggcaccagcgctgagttcttcttcaagtgtggggcccaccccaccagtgacaaggagacctctgtggccctgcacctgattgccaccaacagcaggaacatcacctgcatcacctgcacagatgtgcgcagccctgtgctggtgttccagtgcaacagccgccacgtgatctgcctggactgcttccacctgtactgtgtgacccggctgaatgaccggcagtttgtgcatgacccccagctgggctacagcctgccctgtgtggccggctgccccaacagcctcatcaaggagctgcaccacttccgcatcctgggggaggagcagtacaaccgctaccagcagtatggagcagaagaatgtgtgctgcagatgggcggcgtgctgtgcccccggcccggctgtggggccggcctgctgcctgagccagaccagaggaaggtgacctgtgagggcggcaatggcctgggctgcggctttgccttctgccgggagtgcaaggaggcctaccacgagggagaatgttctgctgtgtttgaggccagcggcaccaccacccaggcctacagagtggatgaaagagctgctgagcaggcccgctgggaggccgccagcaaggagaccatcaagaagaccaccaagccctgcccccgctgccacgtgcctgtggagaagaatggaggctgcatgcacatgaagtgcccccagccccagtgccgcctggagtggtgctggaactgtggctgtgagtggaacagagtgtgcatgggagaccactggtttgatgtgtag

SEQ ID NO: 163301 - DNA, 1107 bp, Artificial Sequence
  Description of Artificial Sequence: Synthetic coding sequence
atgattgtgtttgtgcgcttcaacagcagccacggcttccctgtggaggtggacagcgacaccagcatcttccagctgaaggaggtggtggccaagaggcagggcgtgcctgctgaccagctgcgggtcatctttgctgggaaggagctgagaaatgactggacagtgcagaactgtgacctggaccagcagagcatcgtgcacatcgtgcagaggccctggaggaagggccaggagatgaatgccactggaggagatgaccccagaaatgctgctgggggctgtgagcgggagccccagagcctgaccagggtggacctgagcagctctgtgctgcccggggacagcgtgggcctggccgtcatcctgcacacagacagcaggaaggacagccccccagctggcagccctgctggccgcagcatctacaacagcttctacgtgtactgcaagggcccctgccagagggtgcagcccgggaagctgcgggtgcagtgcagcacctgccggcaggccaccctgaccctgacccagggccccagctgctgggatgatgtgctgatccccaacaggatgtctggagagtgccagagcccccactgccccggcaccagcgctgagttcttcttcaagtgtggggcccaccccaccagtgacaaggagacctctgtggccctgcacctgattgccaccaacagcaggaacatcacctgcatcacctgcacagatgtgcgcagccctgtgctggtgttccagtgcaacagcagacatgtgatctgcctggactgcttccacctgtactgtgtgacccggctgaatgaccggcagtttgtgcatgacccccagctgggctacagcctgccctgtgtggccggctgccccaacagcctcatcaaggagctgcaccacttccgcatcctgggggaggagcagtacaaccgctaccagcagtacggggctgaggagtgtgtgctgcagatgggcggcgtgctgtgccccaggcctggctgtggggccggcctgctgcctgagccagaccagaggaaggtgacctgtgagggcggcaatggcctgggctgcggctacggccagaggaggaccaagtag

SEQ ID NO: 163302 - DNA, 825 bp, Artificial Sequence; identical to SEQ ID NO: 163300
  Description of Artificial Sequence: Synthetic coding sequence

SEQ ID NO: 163303 - DNA, 657 bp, Artificial Sequence
  Description of Artificial Sequence: Synthetic coding sequence
atgaatgccactggaggagatgaccccagaaatgctgctgggggctgtgagcgggagccccagagcctgaccagggtggacctgagcagctctgtgctgcccggggacagcgtgggcctggccgtcatcctgcacacagacagcaggaaggacagccccccagctggcagccctgctggccgcagcatctacaacagcttctacgtgtactgcaagggcccctgccagagggtgcagcccgggaagctgcgggtgcagtgcagcacctgccggcaggccaccctgaccctgacccagggccccagctgctgggatgatgtgctgatccccaacaggatgtctggagagtgccagagcccccactgccccggcaccagcgctgagttcttcttcaagtgtggggcccaccccaccagtgacaaggagacctctgtggccctgcacctgattgccaccaacagcaggaacatcacctgcatcacctgcacagatgtgcgcagccctgtgctggtgttccagtgcaacagccgccacgtgatctgcctggactgcttccacctgtactgtgtgacccggctgaatgaccggcagtttgtgcatgacccccagctgggctacagcctgccctgtgtggtgtccctgctgcccagccagtag

SEQ ID NO: 163304 - DNA, 951 bp, Artificial Sequence
  Description of Artificial Sequence: Synthetic coding sequence
atgattgtgtttgtgcgcttcaacagcagccacggcttccctgtggaggtggacagcgacaccagcatcttccagctgaaggaggtggtggccaagaggcagggcgtgcctgctgaccagctgcgggtcatctttgctgggaaggagctgagaaatgactggacagtgcaggagttcttcttcaagtgtggggcccaccccaccagtgacaaggagacctctgtggccctgcacctgattgccaccaacagcaggaacatcacctgcatcacctgcacagatgtgcgcagccctgtgctggtgttccagtgcaacagccgccacgtgatctgcctggactgcttccacctgtactgtgtgacccggctgaatgaccggcagtttgtgcatgacccccagctgggctacagcctgccctgtgtggccggctgccccaacagcctcatcaaggagctgcaccacttccgcatcctgggggaggagcagtacaaccgctaccagcagtatggagcagaagaatgtgtgctgcagatgggcggcgtgctgtgcccccggcccggctgtggggccggcctgctgcctgagccagaccagaggaaggtgacctgtgagggcggcaatggcctgggctgcggctttgccttctgccgggagtgcaaggaggcctaccacgagggagaatgttctgctgtgtttgaggccagcggcaccaccacccaggcctacagagtggatgaaagagctgctgagcaggcccgctgggaggccgccagcaaggagaccatcaagaagaccaccaagccctgcccccgctgccacgtgcctgtggagaagaatggaggctgcatgcacatgaagtgcccccagccccagtgccgcctggagtggtgctggaactgtggctgtgagtggaacagagtgtgcatgggagaccactggtttgatgtgtag

SEQ ID NO: 163305 - DNA, 1314 bp, Artificial Sequence
  Description of Artificial Sequence: Synthetic coding sequence
atgattgtgtttgtgcgcttcaacagcagccacggcttccctgtggaggtggacagcgacaccagcatcttccagctgaaggaggtggtggccaagaggcagggcgtgcctgctgaccagctgcgggtcatctttgctgggaaggagctgagaaatgactggacagtgcagaactgtgacctggaccagcagagcatcgtgcacatcgtgcagaggccctggaggaagggccaggagatgaatgccactggaggagatgaccccagaaatgctgctgggggctgtgagcgggagccccagagcctgaccagggtggacctgagcagctctgtgctgcccggggacagcgtgggcctggccgtcatcctgcacacagacagcaggaaggacagccccccagctggcagccctgctggccgcagcatctacaacagcttctacgtgtactgcaagggcccctgccagagggtgcagcccgggaagctgcgggtgcagtgcagcacctgccggcaggccaccctgaccctgacccaggagttcttcttcaagtgtggggcccaccccaccagtgacaaggagacctctgtggccctgcacctgattgccaccaacagcaggaacatcacctgcatcacctgcacagatgtgcgcagccctgtgctggtgttccagtgcaacagcagacatgtgatctgcctggactgcttccacctgtactgtgtgacccggctgaatgaccggcagtttgtgcatgacccccagctgggctacagcctgccctgtgtggccggctgccccaacagcctcatcaaggagctgcaccacttccgcatcctgggggaggagcagtacaaccgctaccagcagtacggggctgaggagtgtgtgctgcagatgggcggcgtgctgtgccccaggcctggctgtggggccggcctgctgcctgagccagaccagaggaaggtgacctgtgagggcggcaatggcctgggctgcggctttgccttctgccgggagtgcaaggaggcctaccatgaaggagagtgcagcgctgtgtttgaggccagcggcaccaccacccaggcctacagagtggatgaaagagctgctgagcaggcccgctgggaggccgccagcaaggagaccatcaagaagaccaccaagccctgcccccgctgccacgtgcctgtggagaagaatggaggctgcatgcacatgaagtgcccccagccccagtgccgcctggagtggtgctggaactgtggctgtgagtggaacagagtgtgcatgggagaccactggtttgatgtgtag

SEQ ID NO: 163306 - DNA, 1398 bp, Artificial Sequence
  Description of Artificial Sequence: Synthetic coding sequence
atgattgtgtttgtgcgcttcaacagcagccacggcttccctgtggaggtggacagcgacaccagcatcttccagctgaaggaggtggtggccaagaggcagggcgtgcctgctgaccagctgcgggtcatctttgctgggaaggagctgagaaatgactggacagtgcagaactgtgacctggaccagcagagcatcgtgcacatcgtgcagaggccctggaggaagggccaggagatgaatgccactggaggagatgaccccagaaatgctgctgggggctgtgagcgggagccccagagcctgaccagggtggacctgagcagctctgtgctgcccggggacagcgtgggcctggccgtcatcctgcacacagacagcaggaaggacagccccccagctggcagccctgctggccgcagcatctacaacagcttctacgtgtactgcaagggcccctgccagagggtgcagcccgggaagctgcgggtgcagtgcagcacctgccggcaggccaccctgaccctgacccagggccccagctgctgggatgatgtgctgatccccaacaggatgtctggagagtgccagagcccccactgccccggcaccagcgctgagttcttcttcaagtgtggggcccaccccaccagtgacaaggagacctctgtggccctgcacctgattgccaccaacagcaggaacatcacctgcatcacctgcacagatgtgcgcagccctgtgctggtgttccagtgcaacagcagacatgtgatctgcctggactgcttccacctgtactgtgtgacccggctgaatgaccggcagtttgtgcatgacccccagctgggctacagcctgccctgtgtggccggctgccccaacagcctcatcaaggagctgcaccacttccgcatcctgggggaggagcagtacaaccgctaccagcagtacggggctgaggagtgtgtgctgcagatgggcggcgtgctgtgccccaggcctggctgtggggccggcctgctgcctgagccagaccagaggaaggtgacctgtgagggcggcaatggcctgggctgcggctttgccttctgccgggagtgcaaggaggcctaccatgaaggagagtgcagcgctgtgtttgaggccagcggcaccaccacccaggcctacagagtggatgaaagagctgctgagcaggcccgctgggaggccgccagcaaggagaccatcaagaagaccaccaagccctgcccccgctgccacgtgcctgtggagaagaatggaggctgcatgcacatgaagtgcccccagccccagtgccgcctggagtggtgctggaactgtggctgtgagtggaacagagtgtgcatgggagaccactggtttgatgtgtag

SEQ ID NO: 163307 - DNA, 612 bp, Artificial Sequence
  Description of Artificial Sequence: Synthetic coding sequence
atgtctggagagtgccagagcccccactgccccggcaccagcgctgagttcttcttcaagtgtggggcccaccccaccagtgacaaggagacctctgtggccctgcacctgattgccaccaacagcaggaacatcacctgcatcacctgcacagatgtgcgcagccctgtgctggtgttccagtgcaacagccgccacgtgatctgcctggactgcttccacctgtactgtgtgacccggctgaatgaccggcagtttgtgcatgacccccagctgggctacagcctgccctgtgtggccggctgccccaacagcctcatcaaggagctgcaccacttccgcatcctgggggaggagcagtacaaccgctaccagcagtatggagcagaagaatgtgtgctgcagatgggcggcgtgctgtgcccccggcccggctgtggggccggcctgctgcctgagccagaccagaggaaggtgacctgtgagggcggcaatggcctgggctgcggctttgccttctgccgggagtgcaaggaggcctaccacgagggagaatgttctgctgtgtttgaggccagcggcaccaccacccagcacagcggctgcacctag

SEQ ID NO: 163308 - DNA, 429 bp, Artificial Sequence
  Description of Artificial Sequence: Synthetic coding sequence
tctgtgtttgtgcgcttcaacagcagccacggcttccctgtggaggtggacagcgacaccagcatcttccagctgaaggaggtggtggccaagaggcagggcgtgcctgctgaccagctgcgggtcatctttgctgggaaggagctgagaaatgactggacagtgcagaactgtgacctggaccagcagagcatcgtgcacatcgtgcagaggccctggaggaagggccaggagatgaatgccactggaggagatgaccccagaaatgctgctgggggctgtgagcgggagccccagagcctgaccagggtggacctgagcagctctgtgctgcccggggacagcgtgggcctggccgtcatcctgcacacagacagcaggaaggacagccccccagctggcagccctggcaactgcctgcatggatag

SEQ ID NO: 163309 - DNA, 429 bp, Artificial Sequence
  Description of Artificial Sequence: Synthetic coding sequence
atggctgctgtggtggccgccacagccctgaagggccgcggggccagaaatgcccgggtgctgcggggcatcctggccggggccacagccaacaaggccagccacaacagaacccgggccctgcagagccacagcagccctgagggcaaggaggagcctgagcccctgagccctgagctggagtacatccccaggaagaggggcaagaaccccatgaaggctgtgggcctggcctgggccatcggcttcccctgtggcatcctgctcttcatcctgaccaagcgggaggtggacaaggacagagtgaagcagatgaaggcccggcagaacatgaggctgagcaacacaggagaatatgagagccagcgcttccgggccagcagccagagcgcccccagcccagatgtgggcagcggcgtgcagacctag

SEQ ID NO: 163310 - DNA, 1086 bp, Artificial Sequence
  Description of Artificial Sequence: Synthetic coding sequence
atggcctggcagggctggccagctgcctggcagtgggtggccggctgctggctgctgctggtgctggtgctggtgctgctggtgagcccccggggctgccgggcccggcggggcctgcggggcctgctgatggcccacagccagaggctgctcttccgcatcggctacagcctgtacaccaggacctggctgggctacctgttctaccggcagcagctgcggcgggccaggaaccgctaccccaagggccacagcaagacccagcccaggctcttcaatggagtgaaggtgctgcccatccctgtgctgagtgacaactacagctacctgatcatcgacacccaggcccagctggccgtggccgtggaccccagcgaccccagggctgtgcaggccagcattgagaaggagggcgtgaccctggtggccatcctgtgcacccacaagcactgggaccacagcggcggcaacagagacctgagccgccgccaccgggactgccgggtgtatggcagcccccaggacggcatcccctacctgacccaccccctgtgccaccaggatgtggtgtctgtgggccgcctgcagatccgggccctggccaccccaggccacacccagggccacctggtgtacctgctggatggagagccctacaagggccccagctgcctcttcagcggggacctgctcttcctgagcggctgcggccgcacctttgagggcaatgctgagaccatgctgagcagcctggacacagtgctgggcctgggagatgacaccctgctgtggccaggccatgaatatgcagaggagaacctgggctttgctggggtggtggagcctgagaacctggcccgggagaggaagatgcagtgggtgcagaggcagaggctggagaggaagggcacctgccccagcaccctgggggaggagaggagctacaaccccttcctgcggacccactgcctggccctgcaggaggccctgggccctggccctggccccactggagatgatgactacagccgggcccagctgctggaggagctgcggcggctgaaggacatgcacaagagcaagtag

SEQ ID NO: 163311 - DNA, 1158 bp, Artificial Sequence
  Description of Artificial Sequence: Synthetic coding sequence
atggctgctgtggtggccgccacagccctgaagggccgcggggccagaaatgcccgggtgctgcggggcatcctggccggggccacagccaacaaggccagccacaacagaacccgggccctgcagagccacagcagccctgagggcaaggaggagcctgagcccctgagccctgagctggagtacatccccaggaagaggggcaagaaccccatgaaggctgtgggcctggcctggtacagcctgtacaccaggacctggctgggctacctgttctaccggcagcagctgcggcgggccaggaaccgctaccccaagggccacagcaagacccagcccaggctcttcaatggagtgaaggtgctgcccatccctgtgctgagtgacaactacagctacctgatcatcgacacccaggcccagctggccgtggccgtggaccccagcgaccccagggctgtgcaggccagcattgagaaggagggcgtgaccctggtggccatcctgtgcacccacaagcactgggaccacagcggcggcaacagagacctgagccgccgccaccgggactgccgggtgtatggcagcccccaggacggcatcccctacctgacccaccccctgtgccaccaggatgtggtgtctgtgggccgcctgcagatccgggccctggccaccccaggccacacccagggccacctggtgtacctgctggatggagagccctacaagggccccagctgcctcttcagcggggacctgctcttcctgagcggctgcggccgcacctttgagggcaatgctgagaccatgctgagcagcctggacacagtgctgggcctgggagatgacaccctgctgtggccaggccatgaatatgcagaggagaacctgggctttgctggggtggtggagcctgagaacctggcccgggagaggaagatgcagtgggtgcagaggcagaggctggagaggaagggcacctgccccagcaccctgggggaggagaggagctacaaccccttcctgcggacccactgcctggccctgcaggaggccctgggccctggccctggccccactggagatgatgactacagccgggcccagctgctggaggagctgcggcggctgaaggacatgcacaagagcaagtag

SEQ ID NO: 163312 - DNA, 1455 bp, Artificial Sequence
  Description of Artificial Sequence: Synthetic coding sequence
atggctgctggaggagaccacggcagcccagacagctaccgcagccccctggccagccgctatgccagccctgagatgtgctttgtgttcagtgaccgctacaagttccgcacctggaggcagctgtggctgtggctggccgaggccgagcagaccctgggcctgcccatcacagatgagcagatccaggagatgaagagcaacctggagaacatcgacttcaagatggctgctgaggaggagaagaggctgcggcatgatgtgatggcccacgtgcacaccttcggccactgctgccccaaggctgctggcatcatccacctgggcgccaccagctgctacgtgggggacaacacagacctgatcatcctgagaaatgccctggacctgctgctgcccaagctggcccgggtcatcagccggctggccgactttgccaaggagcgggccagcctgcccaccctgggcttcacccacttccagcctgcccagctgaccaccgtgggcaagcgctgctgcctgtggatccaggacctgtgcatggacctgcagaacctgaagagggtgagagatgacctgcgcttccggggcgtgaagggcaccaccggcacccaggccagcttcctgcagctgtttgaaggagatgaccacaaggtggagcagctggacaagatggtgacagagaaggccggcttcaagagggccttcatcatcaccggccagacctacaccaggaaggtggacatcgaggtgctgtctgtgctggccagcctgggcgcctctgtgcacaagatctgcacagacatccggctgctggccaacctgaaggagatggaggagccctttgagaagcagcagatcggcagcagcgccatgccctacaagaggaaccccatgaggtctgagcgctgctgcagcctggcccggcacctgatgaccctggtgatggaccccctgcagacagcctctgtgcagtggtttgagaggaccctggatgacagcgccaacagacgcatctgcctggccgaggccttcctgacagctgacaccatcctgaacaccctgcagaacatcagcgagggcctggtggtgtaccccaaggtgattgaaagacgcatccggcaggagctgcccttcatggccacagagaacatcatcatggccatggtgaaggccggcggcagccggcaggactgccacgagaagatccgggtgctgagccagcaggccgcctctgtggtgaagcaggagggcggggacaatgacctgattgaaagaatccaggtggatgcctacttcagccccatccacagccagctggaccacctgctggaccccagcagcttcaccggccgggccagccagcaggtgcagcgcttcctggaggaggaggtgtaccccctgctgaagccctatgagagcgtgatgaaggtgaaggccgagctgtgcctgtag

SEQ ID NO: 163313 - DNA, 237 bp, Artificial Sequence
  Description of Artificial Sequence: Synthetic coding sequence
atggtgggcctgaagaagaagtctgcagatgatgtgaagaaggtgttccacatgctggacaaggacaagagcggcttcattgaagaagatgagctgggcttcatcctgaagggcttctccccagatgcccgggacctgagcgccaaggagaccaagatgctgatggctgctggggacaaggatggagatggcaagattggagtggatgagttcagcaccctggtggccgagagctag

SEQ ID NO: 163314 - DNA, 333 bp, Artificial Sequence
  Description of Artificial Sequence: Synthetic coding sequence
atgtccatgacagacctgctgaatgctgaggacatcaagaaggctgtgggcgccttcagcgccacagacagctttgaccacaagaagttcttccagatggtgggcctgaagaagaagtctgcagatgatgtgaagaaggtgttccacatgctggacaaggacaagagcggcttcattgaagaagatgagctgggcttcatcctgaagggcttctccccagatgcccgggacctgagcgccaaggagaccaagatgctgatggctgctggggacaaggatggagatggcaagattggagtggatgagttcagcaccctggtggccgagagctag

SEQ ID NO: 163315 - DNA, 306 bp, Artificial Sequence
  Description of Artificial Sequence: Synthetic coding sequence
atgtccatgacagacctgctgaatgctgaggacatcaagaaggctgtgggcgccttcagcgccacagacagctttgaccacaagaagttcttccagatggtgggcctgaagaagaagtctgcagatgatgtgaagaaggtgttccacatgctggacaaggacaagagcggcttcattgaagaagatgagctgggcttcatcctgaagggcttctccccagatgcccgggacctgagcgccaaggagaccaagatgctgatggctgctggggacaaggatggagatggcaagattggagtggactag

SEQ ID NO: 163316 - DNA, 984 bp, Artificial Sequence
  Description of Artificial Sequence: Synthetic coding sequence
atgtctgacctgcaggaggagggcaagaatgccatcaacagccccatgagccctgccctggtggatgtgcaccctgaggacacccagctggaggagaatgaggagaggaccatgattgaccccaccagcaaagaagaccccaagttcaaggagctggtgaaggtgctgctggactggatcaatgatgtgctggtggaggagcgcatcatcgtgaagcagctggaggaggacctgtatgatggccaggtgctgcagaagctgctggagaagctggccggctgcaagctgaatgtggccgaggtgacccagagcgagatcggccagaagcagaagctgcagacagtgctggaggccgtgcatgacctgctgcggccccggggctgggccctgcgctggagcgtggacagcatccacggcaagaacctggtggccatcctgcacctgctggtgtccctggccatgcacttccgggcccccatccggctgcctgagcacgtgacagtgcaggtggtggtggtgaggaagcgggagggcctgctgcacagcagccacatcagcgaggagctgaccaccaccacagagatgatgatgggccgctttgaaagagatgcctttgacaccctgtttgaccacgccccagacaagctgtctgtggtgaagaagagcctcatcacctttgtgaacaagcacctgaacaagctgaacctggaggtgacagagctggagacccagtttgctgatggagtgtacctggtgctgctgatgggcctgctggaggactactttgtgcccctgcaccacttctacctgaccccagagagctttgaccagaaggtgcacaacgtgtcctttgcctttgagctgatgctggatggcggcctgaagaagcccaaggcccggccagaagatgtggtgaacctggacctgaagagcaccctgcgggtgctgtacaacctcttcaccaagtacaagaatgtggagtag

SEQ ID NO: 163317 - DNA, 1239 bp, Artificial Sequence
  Description of Artificial Sequence: Synthetic coding sequence
atgctgggcatcatccccctgccctttgggaagccccagccccagagcagaagaagacccctgcggcccccatctgccagcagcgccagcaggcctgcccggggcagcctgcggcgggccatggccaccagcccccagaagagccccagcgtgcccaagagccccacccccaagagcccccccagcaggaagaaggatgacagcttcctgggcaagctgggcggcaccctggcccggaggaagaaggccaaggaggtgtctgagctgcaggaggagggcatgaatgccatcaacctgcccctgagccccatcccctttgagctggaccctgaggacaccatgctggaggagaatgaggtgaggaccatggtggaccccaacagcagaagtgaccccaagctgcaggagctgatgaaggtgctgattgactggatcaatgatgtgctggtgggggagcgcatcatcgtgaaggacctggccgaggacctgtatgatggccaggtgctgcagaagctgtttgagaagctggagagcgagaagctgaatgtggccgaggtgacccagagcgagatcgcccagaagcagaagctgcagacagtgctggagaagatcaatgagaccctgaagctgcccccaagaagcatcaagtggaatgtggacagcgtgcacgccaagagcctggtggccatcctgcacctgctggtggccctgagccagtacttccgggcccccatccggctgcctgaccacgtgtccatccaggtggtggtggtgcagaagcgggagggcatcctgcagagccggcagatccaggaggagatcactggaaacacagaggccctgagcggcagacatgaaagagatgcctttgacaccctgtttgaccacgccccagacaagctgaatgtggtgaagaagaccctcatcacctttgtgaacaagcacctgaacaagctgaacctggaggtgacagagctggagacccagtttgctgatggagtgtacctggtgctgctgatgggcctgctggagggctactttgtgcccctgcacagcttcttcctgaccccagacagctttgagcagaaggtgctgaatgtgtcctttgcctttgagctgatgcaggacggcggcctggagaagcccaagcccaggccagaagatattgtgaactgtgacctgaagagcaccctgcgggtgctgtacaacctcttcaccaagtacagaaatgtggagtag

SEQ ID NO: 163318 - DNA, 873 bp, Artificial Sequence
  Description of Artificial Sequence: Synthetic coding sequence
atgaatgccatcaacctgcccctgagccccatcccctttgagctggaccctgaggacaccatgctggaggagaatgaggtgaggaccatggtggaccccaacagcagaagtgaccccaagctgcaggagctgatgaaggtgctgattgactggatcaatgatgtgctggtgggggagcgcatcatcgtgaaggacctggccgaggacctgtatgatggccaggtgctgcagaagctgtttgagaagctggagagcgagaagctgaatgtggccgaggtgacccagagcgagatcgcccagaagcagaagctgcagacagtgctggagaagatcaatgagaccctgaagctgccccccaggagcatcaagtggaatgtggacagcgtgcacgccaagagcctggtggccatcctgcacctgctggtggccctgagccagtacttccgggcccccatccggctgcctgaccacgtgtccatccaggtggtggtggtgcagaagcgggagggcatcctgcagagccggcagatccaggaggagatcaccggcaacacagaggccctgagcggcagacatgaaagagatgcctttgacaccctgtttgaccacgccccagacaagctgaatgtggtgaagaaggtgggcaagggctgcctgggctggacagagggcagcgagatgcagcagaacatcggcaagacccacccctgcagcctgcgggccagctgccagaactggtggcaccacctgaccagcgcccacacaggcctgagccccctgcccagcatgtacctgtctgtgccccactggatgctgcacctgggcctcttccccagcatctccatgaacagcctgagcagccaccctggatag

SEQ ID NO: 163319 - DNA, 1119 bp, Artificial Sequence
  Description of Artificial Sequence: Synthetic coding sequence
atggccaccagcccccagaagagccccagcgtgcccaagagccccacccccaagagcccccccagcaggaagaaggatgacagcttcctgggcaagctgggcggcaccctggcccggaggaagaaggccaaggaggtgtctgagctgcaggaggagggcatgaatgccatcaacctgcccctgagccccatcccctttgagctggaccctgaggacaccatgctggaggagaatgaggtgaggaccatggtggaccccaacagcagaagtgaccccaagctgcaggagctgatgaaggtgctgattgactggatcaatgatgtgctggtgggggagcgcatcatcgtgaaggacctggccgaggacctgtatgatggccaggtgctgcagaagctgtttgagaagctggagagcgagaagctgaatgtggccgaggtgacccagagcgagatcgcccagaagcagaagctgcagacagtgctggagaagatcaatgagaccctgaagctgcccccaagaagcatcaagtggaatgtggacagcgtgcacgccaagagcctggtggccatcctgcacctgctggtggccctgagccagtacttccgggcccccatccggctgcctgaccacgtgtccatccaggtggtggtggtgcagaagcgggagggcatcctgcagagccggcagatccaggaggagatcactggaaacacagaatatgtgagcagccgccacaagagagatgcctttgacaccctgtttgaccacgccccagacaagctgaatgtggtgaagaagaccctcatcacctttgtgaacaagcacctgaacaagctgaacctggaggtgacagagctggagacccagtttgctgatggagtgtacctggtgctgctgatgggcctgctggagggctactttgtgcccctgcacagcttcttcctgaccccagacagctttgagcagaaggtgctgaatgtgtcctttgcctttgagctgatgcaggacggcggcctggagaagcccaagcccaggccagaagatattgtgaactgtgacctgaagagcaccctgcgggtgctgtacaacctcttcaccaagtacagaaatgtggagtag

SEQ ID NO: 163320 - DNA, 1119 bp, Artificial Sequence
  Description of Artificial Sequence: Synthetic coding sequence
atggccaccagcccccagaagagccccagcgtgcccaagagccccacccccaagagcccccccagcaggaagaaggatgacagcttcctgggcaagctgggcggcaccctggcccggaggaagaaggccaaggaggtgtctgagctgcaggaggagggcatgaatgccatcaacctgcccctgagccccatcccctttgagctggaccctgaggacaccatgctggaggagaatgaggtgaggaccatggtggaccccaacagcagaagtgaccccaagctgcaggagctgatgaaggtgctgattgactggatcaatgatgtgctggtgggggagcgcatcatcgtgaaggacctggccgaggacctgtatgatggccaggtgctgcagaagctgtttgagaagctggagagcgagaagctgaatgtggccgaggtgacccagagcgagatcgcccagaagcagaagctgcagacagtgctggagaagatcaatgagaccctgaagctgcccccaagaagcatcaagtggaatgtggacagcgtgcacgccaagagcctggtggccatcctgcacctgctggtggccctgagccagtacttccgggcccccatccggctgcctgaccacgtgtccatccaggtggtggtggtgcagaagcgggagggcatcctgcagagccggcagatccaggaggagatcactggaaacacagaggccctgagcggcagacatgaaagagatgcctttgacaccctgtttgaccacgccccagacaagctgaatgtggtgaagaagaccctcatcacctttgtgaacaagcacctgaacaagctgaacctggaggtgacagagctggagacccagtttgctgatggagtgtacctggtgctgctgatgggcctgctggagggctactttgtgcccctgcacagcttcttcctgaccccagacagctttgagcagaaggtgctgaatgtgtcctttgcctttgagctgatgcaggacggcggcctggagaagcccaagcccaggccagaagatattgtgaactgtgacctgaagagcaccctgcgggtgctgtacaacctcttcaccaagtacagaaatgtggagtag

SEQ ID NO: 163321 - DNA, 1095 bp, Artificial Sequence
  Description of Artificial Sequence: Synthetic coding sequence
atgagcagcgcccccaggagccccaccccccggcccaggaggatgaagaaggatgagagcttcctgggcaagctgggcggcaccctggccaggaagagaagagcccgggaggtgtctgacctgcaggaggagggcaagaatgccatcaacagccccatgagccctgccctggtggatgtgcaccctgaggacacccagctggaggagaatgaggagaggaccatgattgaccccaccagcaaggaggaccccaagttcaaggagctggtgaaggtgctgctggactggatcaatgatgtgctggtggaggagcgcatcatcgtgaagcagctggaggaggacctgtatgatggccaggtgctgcagaagctgctggagaagctggccggctgcaagctgaatgtggccgaggtgacccagagcgagatcggccagaagcagaagctgcagacagtgctggaggccgtgcatgacctgctgcggccccggggctgggccctgcgctggagcgtggacagcatccacggcaagaacctggtggccatcctgcacctgctggtgtccctggccatgcacttccgggcccccatccggctgcctgagcacgtgacagtgcaggtggtggtggtgaggaagcgggagggcctgctgcacagcagccacatcagcgaggagctgaccaccaccacagagatgatgatgggccgctttgaaagagatgcctttgacaccctgtttgaccacgccccagacaagctgtctgtggtgaagaagagcctcatcacctttgtgaacaagcacctgaacaagctgaacctggaggtgacagagctggagacccagtttgctgatggagtgtacctggtgctgctgatgggcctgctggaggactactttgtgcccctgcaccacttctacctgaccccagagagctttgaccagaaggtgcacaacgtgtcctttgcctttgagctgatgctggatggcggcctgaagaagcccaaggcccggccagaagatgtggtgaacctggacctgaagagcaccctgcgggtgctgtacaacctcttcaccaagtacaagaatgtggagtag

SEQ ID NO: 163322 - DNA, 1194 bp, Artificial Sequence
  Description of Artificial Sequence: Synthetic coding sequence
atgcaccacgtgttcaaggaccaccagagaggagagaagaggggcttcctgagccctgagaacaagaactgccggcggctggagctgcggcggggctgcagctgctcctggggcctgtgcagccaggccctgatggccagcctggccggcagcctgctgcccggcagtgacagaagtggagtggagaccagtgaatatgcccagggcggcgtgtctgacctgcaggaggagggcaagaatgccatcaacagccccatgagccctgccctggtggatgtgcaccctgaggacacccagctggaggagaatgaggagaggaccatgattgaccccaccagcaaagaagaccccaagttcaaggagctggtgaaggtgctgctggactggatcaatgatgtgctggtggaggagcgcatcatcgtgaagcagctggaggaggacctgtatgatggccaggtgctgcagaagctgctggagaagctggccggctgcaagctgaatgtggccgaggtgacccagagcgagatcggccagaagcagaagctgcagacagtgctggaggccgtgcatgacctgctgcggccccggggctgggccctgcgctggagcgtggacagcatccacggcaagaacctggtggccatcctgcacctgctggtgtccctggccatgcacttccgggcccccatccggctgcctgagcacgtgacagtgcaggtggtggtggtgaggaagcgggagggcctgctgcacagcagccacatcagcgaggagctgaccaccaccacagagatgatgatgggccgctttgaaagagatgcctttgacaccctgtttgaccacgccccagacaagctgtctgtggtgaagaagagcctcatcacctttgtgaacaagcacctgaacaagctgaacctggaggtgacagagctggagacccagtttgctgatggagtgtacctggtgctgctgatgggcctgctggaggactactttgtgcccctgcaccacttctacctgaccccagagagctttgaccagaaggtgcacaacgtgtcctttgcctttgagctgatgctggatggcggcctgaagaagcccaaggcccggccagaagatgtggtgaacctggacctgaagagcaccctgcgggtgctgtacaacctcttcaccaagtacaagaatgtggagtag

SEQ ID NO: 163323 - DNA, 996 bp, Artificial Sequence
  Description of Artificial Sequence: Synthetic coding sequence
atggagcctgagttcctgtatgacctgctgcagctgcccaagggcgtggagcccccagctgaggaggagctgagcaagggcggcaagaagaagtacctgccccccaccagcaggaaggaccccaagtttgaggagctgcagaaggtgctgatggagtggatcaatgccaccctgctgcctgagcacatcgtggtgcgcagcctggaggaggacatgtttgatggcctcatcctgcaccacctgttccagaggctggccgccctgaagctggaggctgaagatattgccctgacagccaccagccagaagcacaagctgactgtggtgctggaggccgtgaacagaagcctgcagctggaggagtggcaggccaagtggagcgtggagagcatcttcaacaaggacctgctgagcaccctgcacctgctggtggccctggccaagcgcttccagcctgacctgagcctgcccaccaacgtgcaggtggaggtgatcaccatcgagagcaccaagagcggcctgaagtctgagaagctggtggagcagctgacagagtacagcacagacaaggatgagccccccaaggatgtgtttgatgagctgttcaagctggcccctgagaaggtgaatgctgtgaaggaggccatcgtgaactttgtgaaccagaagctggaccggctgggcctgtctgtgcagaacctggacacccagtttgctgatggagtcatcctgctgctgctgattggccagctggagggcttcttcctgcacctgaaggagttctacctgacccccaacagccctgctgagatgctgcacaacgtgaccctggccctggagctgctgaaggatgagggcctgctgagctgccctgtgtccccagaagatattgtgaacaaggatgccaagagcaccctgcgggtgctgtatggcctcttctgcaagcacacccagaaggcccaccgggacaggacccctcatggagcccccaactag

SEQ ID NO: 163324 - DNA, 81 bp, Artificial Sequence
  Description of Artificial Sequence: Synthetic coding sequence
atggagcctgagttcctgtatgacctgctgcagctgcccaagggcgtggagcccccagctgaggaggagctgagcaagtag

SEQ ID NO: 163325 - DNA, 93 bp, Artificial Sequence
  Description of Artificial Sequence: Synthetic coding sequence
atggagcctgagttcctgtatgacctgctgcagctgcccaagggcgtggagcccccagctgaggaggagctgagcaagggcgtgtgcccctag

SEQ ID NO: 163326 - DNA, 996 bp, Artificial Sequence; identical to SEQ ID NO: 163323
  Description of Artificial Sequence: Synthetic coding sequence

SEQ ID NO: 163327 - DNA, 996 bp, Artificial Sequence; identical to SEQ ID NO: 163323
  Description of Artificial Sequence: Synthetic coding sequence

SEQ ID NO: 163328 - DNA, 414 bp, Artificial Sequence
  Description of Artificial Sequence: Synthetic coding sequence
atggtgcctgccaaggagcaggtgcccggccgctgtgacagcacccagcgctgcttccctggccccagcaactggacaggagctgggggccgggccggcagccagccctttgtgggagatggcaccctgggcacccccaacttctgctgggaccacaaggagaagagagctgctgagagccagctgcaggcctgggaggccatggagcctgagttcctgtatgacctgctgcagctgcccaagggcgtggagcccccagctgaggaggagctgagcaaaggaggcaagaagaagtacctgccccccaccagcaggaaggaccccaagtttgaggagctgcagaagcacacctggcccagccctgtgactggaactggagacaccatctgtggcctggccaggaagacctggtag

SEQ ID NO: 163329 - DNA, 1083 bp, Artificial Sequence
  Description of Artificial Sequence: Synthetic coding sequence
atggctgctgagagaggagctggccagcagcagagccaggagatgatggaggtggaccggcgggtggagagcgaggagagcggagatgaggagggcaagaagcacagcagcggcatcgtggccgacctgtctgagcagagcctgaaggatggagaggagcggggggaggaggaccctgaggaggagcacgagctgcctgtggacatggagaccatcaacctggacagagatgctgaagatgtggacctgaaccactaccgcatcggcaagattgagggctttgaggtgctgaagaaggtgaagaccctgtgcctgcggcagaacctgatcaagtgcatcgagaacctggaggagctgcagagcctgcgggagctggacctgtatgacaaccagatcaagaagattgagaacctggaggccctgacagagctggagatcctggacatctccttcaacctgctgagaaatattgaaggagtggacaagctgacccggctgaagaagctgttcctggtgaacaacaagatcagcaagattgagaacctgagcaacctgcaccagctgcagatgctggagctgggcagcaaccgcatccgggccatcgagaacatcgacaccctgaccaacctggagagcctcttcctgggcaagaacaagatcaccaagctgcagaacctggatgccctgaccaacctgactgtgctgtccatgcagagcaaccggctgaccaagattgagggcctgcagaacctggtgaacctgcgggagctgtacctgagccacaacggcatcgaggtgattgagggcctggagaacaacaacaagctgaccatgctggacatcgccagcaaccgcatcaagaagattgagaacatcagccacctgacagagctgcaggagttctggatgaatgacaacctgctggagagctggagcgacctggatgagctgaagggggcccggagcctggagaccgtgtacctggagaggaaccccctgcagaaggacccccagtacagaaggaaggtgatgctggccctgcccagcgtgcggcagattgatgccacctttgtgcgcttctag

SEQ ID NO: 163330 - DNA, 3993 bp, Artificial Sequence
  Description of Artificial Sequence: Synthetic coding sequence
atggaggatggcggcctgacagcctttgaggaggaccagcgctgcctgagccagagcctgcccctgcctgtgtctgctgagggccctgctgcccagaccacagctgagcccagccgctccttcagcagcgcccaccgccacctgagcagaagaaatggcctgagccggctgtgccagagcaggacagccctgtctgaggaccgctggagcagctactgcctgagcagcctggccgcccagaacatctgcaccagcaagctgcactgcccagctgcccctgagcacacagaccccagcgagccccggggctctgtgtcctgctgcagcctgctgcggggcctgagcagcggctggagcagccccctgctgcctgcccctgtgtgcaaccccaacaaggccatcttcaccgtggatgccaagaccacagagatcctggtggccaatgacaaggcctgtggcctgctgggctacagcagccaggacctgattggccagaagctgacccagttcttcctgcggagtgacagtgatgtggtggaggccctgtctgaggagcacatggaggctgatggccatgctgctgtggtgtttggaacagtggtggacatcatcagccgctctggagagaagatccctgtgtctgtgtggatgaagaggatgaggcaggagcggcggctgtgctgcgtggtggtgctggagcctgtggagcgggtgtccacctgggtggccttccagagtgatggcaccgtgaccagctgtgacagcctgtttgcccacctgcacggctacgtgtctggagaagatgtggccggccagcacatcacagacctgatccccagcgtgcagctgccccccagcggccagcacatccccaagaacctgaagatccagaggtctgtgggccgggccagagatggcaccaccttccccctgagcctgaagctgaagagccagcccagcagcgaggaggccaccaccggggaggccgcccctgtgtctggctaccgggcctctgtgtgggtgttctgcaccatcagcggcctcatcaccctgctgcctgatggcaccatccacggcatcaaccacagctttgccctgaccctgtttggctacggcaagacagagctgctgggcaagaacatcaccttcctgatccctggcttctacagctacatggacctggcctacaacagcagcctgcagctgcctgacctggccagctgcctggatgtgggcaatgaaagtggctgtggggagaggaccctggacccctggcagggccaggaccctgctgagggcggccaggacccccgcatcaacgtggtgctggccggcggccacgtggtgcccagagatgagatcaggaagctgatggagagccaggacatcttcaccggcacccagacagagctgattgctgggggccagctgctgagctgcctgagcccccagcctgcccctggggtggacaacgtgcctgagggcagcctgcctgtgcacggggagcaggccctgcccaaggaccagcagatcacagccctgggccgggaggagcctgtggccatcgagagccctggccaggacctgctgggggagagccgctctgagcctgtggatgtgaagccctttgccagctgtgaagattctgaggcccctgtgcctgcagaagatggcggcagtgatgctggcatgtgtggcctgtgccagaaggcccagctggagaggatgggcgtgtctggccccagcggcagtgacctgtgggccggggctgctgtggccaagccccaggccaagggccagctggccggcggcagcctgctgatgcactgcccctgctacggcagcgagtggggcctgtggtggaggagccaggacctggcccccagccccagcggcatggccggcctgagctttggcacccccaccctggatgagccctggctgggcgtggagaatgaccgggaggagctgcagacctgcctgatcaaggagcagctgagccagctgagcctggccggggccctggatgtgccccacgccgagctggtgcccacagagtgccaggccgtgacagcccctgtgagcagctgtgacctgggcggccgggacctgtgtggcggctgcaccggcagcagcagcgcctgctacgccctggccacagacctgcccggcggcctggaggccgtggaggcccaggaggtggatgtgaacagcttctcctggaacctgaaggagctgttcttcagtgaccagacagaccagaccagcagcaactgcagctgtgccaccagcgagctgcgggagacccccagcagcctggccgtgggcagtgaccctgatgtgggcagcctgcaggagcagggcagctgtgtgctggatgaccgggagctgctgctgctgaccggcacctgtgtggacctgggccagggccgccgcttccgggagagctgtgtgggccatgaccccacagagcccctggaggtgtgcctggtgtcctctgagcactatgctgccagtgaccgggagagccctggccacgtgcccagcaccctggatgctggccctgaggacacctgccccagcgctgaggagccccggctgaatgtgcaggtgaccagcacccctgtgattgtgatgagaggagctgctggcctgcagcgggagatccaggagggcgcctacagcggcagctgctaccacagagatggcctgcggctgagcatccagtttgaggtgagaagagtggagctgcagggccccacccccctcttctgctgctggctggtgaaggacctgctgcacagccagagggacagcgctgcccggaccaggctcttcctggccagcctgcccggcagcacccacagcacagctgctgagctgaccggccccagcctggtggaggtgctgcgggcccggccctggtttgaggagccccccaaggctgtggagctggagggcctggccgcctgtgagggggagtacagccagaagtacagcaccatgagccccctgggcagcggggccttcggctttgtgtggacagctgtggacaaggagaagaacaaggaggtggtggtgaagttcatcaagaaggagaaggtgctggaggactgctggattgaggaccccaagctgggcaaggtgaccctggagatcgccatcctgagccgggtggagcacgccaacatcatcaaggtgctggacatctttgagaaccagggcttcttccagctggtgatggagaagcacggcagcggcctggacctgtttgccttcatcgacagacacccccggctggatgagcccctggccagctacatcttccggcaggtgcgggccggccagagccggctggtgtctgctgtgggctacctgcggctgaaggacatcatccaccgggacatcaaggatgaaaatattgtgattgctgaggacttcaccatcaagctgattgactttggcagcgctgcctacctggagcggggcaagctgttctacaccttctgtggcaccatcgagtactgtgcccctgaggtgctgatgggcaacccctaccggggccctgagctggagatgtggagcctgggcgtgaccctgtacaccctggtgtttgaggagaaccccttctgtgagctggaggagaccgtggaggccgccatccaccccccctacctggtgtccaaggagctgatgagcctggtgtctggcctgctgcagcctgtgcctgagaggaggaccaccctggagaagctggtgacagacccctgggtgacccagcctgtgaacctggccgactacacctgggaggaggtgttccgggtgaacaagccagagagcggcgtgctgtctgctgccagcctggagatgggcaacagaagcctgagtgatgtggcccaggcccaggagctgtgtggcggccctgtgcctggagaggccccaaatggccagggctgcctgcaccctggggacccccggctgctgaccagctag

SEQ ID NO: 163331 - DNA, 3972 bp, Artificial Sequence
  Description of Artificial Sequence: Synthetic coding sequence
atggaggatggcggcctgacagcctttgaggaggaccagcgctgcctgagccagagcctgcccctgcctgtgtctgctgagggccctgctgcccagaccacagctgagcccagccgctccttcagcagcgcccaccgccacctgagcagaagaaatggcctgagccggctgtgccagagcaggacagccctgtctgaggaccgctggagcagctactgcctgagcagcctggccgcccagaacatctgcaccagcaagctgcactgcccagctgcccctgagcacacagaccccagcgagccccggggctctgtgtcctgctgcagcctgctgcggggcctgagcagcggctggagcagccccctgctgcctgcccctgtgtgcaaccccaacaaggccatcttcaccgtggatgccaagaccacagagatcctggtggccaatgacaaggcctgtggcctgctgggctacagcagccaggacctgattggccagaagctgacccagttcttcctgcggagtgacagtgatgtggtggaggccctgtctgaggagcacatggaggctgatggccatgctgctgtggtgtttggaacagtggtggacatcatcagccgctctggagagaagatccctgtgtctgtgtggatgaagaggatgaggcaggagcggcggctgtgctgcgtggtggtgctggagcctgtggagcgggtgtccacctgggtggccttccagagtgatggcaccgtgaccagctgtgacagcctgtttgcccacctgcacggctacgtgtctggagaagatgtggccggccagcacatcacagacctgatccccagcgtgcagctgccccccagcggccagcacatccccaagaacctgaagatccagaggtctgtgggccgggccagagatggcaccaccttccccctgagcctgaagctgaagagccagcccagcagcgaggaggccaccaccggggaggccgcccctgtgtctggctaccgggcctctgtgtgggtgttctgcaccatcagcggcctcatcaccctgctgcctgatggcaccatccacggcatcaaccacagctttgccctgaccctgtttggctacggcaagacagagctgctgggcaagaacatcaccttcctgatccctggcttctacagctacatggacctggcctacaacagcagcctgcagctgcctgacctggccagctgcctggatgtgggcaatgaaagtggctgtggggagaggaccctggacccctggcagggccaggaccctgctgagggcggccaggacccccgcatcaacgtggtgctggccggcggccacgtggtgcccagagatgagatcaggaagctgatggagagccaggacatcttcaccggcacccagacagagctgattgctgggggccagctgctgagctgcctgagcccccagcctgcccctggggtggacaacgtgcctgagggcagcctgcctgtgcacggggagcaggccctgcccaaggaccagcagatcacagccctgggccgggaggagcctgtggccatcgagagccctggccaggacctgctgggggagagccgctctgagcctgtggatgtgaagccctttgccagctgtgaagattctgaggcccctgtgcctgcagaagatggcggcagtgatgctggcatgtgtggcctgtgccagaaggcccagctggagaggatgggcgtgtctggccccagcggcagtgacctgtgggccggggctgctgtggccaagccccaggccaagggccagctggccggcggcagcctgctgatgcactgcccctgctacggcagcgagtggggcctgtggtggaggagccaggacctggcccccagccccagcggcatggccggcctgagctttggcacccccaccctggatgagccctggctgggcgtggagaatgaccgggaggagctgcagacctgcctgatcaaggagcagctgagccagctgagcctggccggggccctggatgtgccccacgccgagctggtgcccacagagtgccaggccgtgacagcccctgtgagcagctgtgacctgggcggccgggacctgtgtggcggctgcaccggcagcagcagcgcctgctacgccctggccacagacctgcccggcggcctggaggccgtggaggcccaggaggtggatgtgaacagcttctcctggaacctgaaggagctgttcttcagtgaccagacagaccagaccagcagcaactgcagctgtgccaccagcgagctgcgggagacccccagcagcctggccgtgggcagtgaccctgatgtgggcagcctgcaggagcagggcagctgtgtgctggatgaccgggagctgctgctgctgaccggcacctgtgtggacctgggccagggccgccgcttccgggagagctgtgtgggccatgaccccacagagcccctggaggtgtgcctggtgtcctctgagcactatgctgccagtgaccgggagagccctggccacgtgcccagcaccctggatgctggccctgaggacacctgccccagcgctgaggagccccggctgaatgtgcaggtgaccagcacccctgtgattgtgatgagaggagctgctggcctgcagcgggagatccaggagggcgcctacagcggcagctgctaccacagagatggcctgcggctgagcatccagtttgaggtgagaagagtggagctgcagggccccacccccctcttctgctgctggctggtgaaggacctgctgcacagccagagggacagcgctgcccggaccaggctcttcctggccagcctgcccggcagcacccacagcacagctgctgagctgaccggccccagcctggtggaggtgctgcgggcccggccctggtttgaggagccccccaaggctgtggagctggagggcctggccgcctgtgagggggagtacagccagaagtacagcaccatgagccccctgggcagcggggccttcggctttgtgtggacagctgtggacaaggagaagaacaaggaggtggtggtgaagttcatcaagaaggagaaggtgctggaggactgctggattgaggaccccaagctgggcaaggtgaccctggagatcgccatcctgagccgggtggagcacgccaacatcatcaaggtgctggacatctttgagaaccagggcttcttccagctggtgatggagaagcacggcagcggcctggacctgtttgccttcatcgacagacacccccggctggatgagcccctggccagctacatcttccggcagctggtgtctgctgtgggctacctgcggctgaaggacatcatccaccgggacatcaaggatgagaacatcgtgattgctgaggacttcaccatcaagctgattgactttggatctgctgcctacctggagcggggcaagctgttctacaccttctgtggcaccatcgagtactgtgcccctgaggtgctgatgggcaacccctaccggggccctgagctggagatgtggagcctgggcgtgaccctgtacaccctggtgtttgaggagaaccccttctgtgagctggaggagaccgtggaggccgccatccaccccccctacctggtgtccaaggagctgatgagcctggtgtctggcctgctgcagcctgtgcctgagaggaggaccaccctggagaagctggtgacagacccctgggtgacccagcctgtgaacctggccgactacacctgggaggaggtgttccgggtgaacaagccagagagcggcgtgctgtctgctgccagcctggagatgggcaacagaagcctgagtgatgtggcccaggcccaggagctgtgtggcggccctgtgcctggagaggcccccaacggccagggctgcctgcaccctggggacccccggctgctgaccagctag

SEQ ID NO: 163332 - DNA, 378 bp, Artificial Sequence
  Description of Artificial Sequence: Synthetic coding sequence
atggaggatggcggcctgacagcctttgaggaggaccagcgctgcctgagccagagcctgcccctgcctgtgtctgctgagggccctgctgcccagaccacagctgagcccagccgctccttcagcagcgcccaccgccacctgagcagaagaaatggcctgagccggctgtgccagagcaggacagccctgtctgaggaccgctggagcagctactgcctgagcagcctggccgcccagaacatctgcaccagcaagctgcactgcccagctgcccctgagcacacagaccccagcgagccccggggctctgtgtcctgctgcagcctgctgcggggcctgagcagcggctggagcagccccctgctgcctgcctag

SEQ ID NO: 163333 - DNA, 3324 bp, Artificial Sequence
  Description of Artificial Sequence: Synthetic coding sequence
atgaagaggatgaggcaggagcggcggctgtgctgcgtggtggtgctggagcctgtggagcgggtgtccacctgggtggccttccagagtgatggcaccgtgaccagctgtgacagcctgtttgcccacctgcacggctacgtgtctggagaagatgtggccggccagcacatcacagacctgatccccagcgtgcagctgccccccagcggccagcacatccccaagaacctgaagatccagaggtctgtgggccgggccagagatggcaccaccttccccctgagcctgaagctgaagagccagcccagcagcgaggaggccaccaccggggaggccgcccctgtgtctggctaccgggcctctgtgtgggtgttctgcaccatcagcggcctcatcaccctgctgcctgatggcaccatccacggcatcaaccacagctttgccctgaccctgtttggctacggcaagacagagctgctgggcaagaacatcaccttcctgatccctggcttctacagctacatggacctggcctacaacagcagcctgcagctgcctgacctggccagctgcctggatgtgggcaatgaaagtggctgtggggagaggaccctggacccctggcagggccaggaccctgctgagggcggccaggacccccgcatcaacgtggtgctggccggcggccacgtggtgcccagagatgagatcaggaagctgatggagagccaggacatcttcaccggcacccagacagagctgattgctgggggccagctgctgagctgcctgagcccccagcctgcccctggggtggacaacgtgcctgagggcagcctgcctgtgcacggggagcaggccctgcccaaggaccagcagatcacagccctgggccgggaggagcctgtggccatcgagagccctggccaggacctgctgggggagagccgctctgagcctgtggatgtgaagccctttgccagctgtgaagattctgaggcccctgtgcctgcagaagatggcggcagtgatgctggcatgtgtggcctgtgccagaaggcccagctggagaggatgggcgtgtctggccccagcggcagtgacctgtgggccggggctgctgtggccaagccccaggccaagggccagctggccggcggcagcctgctgatgcactgcccctgctacggcagcgagtggggcctgtggtggaggagccaggacctggcccccagccccagcggcatggccggcctgagctttggcacccccaccctggatgagccctggctgggcgtggagaatgaccgggaggagctgcagacctgcctgatcaaggagcagctgagccagctgagcctggccggggccctggatgtgccccacgccgagctggtgcccacagagtgccaggccgtgacagcccctgtgagcagctgtgacctgggcggccgggacctgtgtggcggctgcaccggcagcagcagcgcctgctacgccctggccacagacctgcccggcggcctggaggccgtggaggcccaggaggtggatgtgaacagcttctcctggaacctgaaggagctgttcttcagtgaccagacagaccagaccagcagcaactgcagctgtgccaccagcgagctgcgggagacccccagcagcctggccgtgggcagtgaccctgatgtgggcagcctgcaggagcagggcagctgtgtgctggatgaccgggagctgctgctgctgaccggcacctgtgtggacctgggccagggccgccgcttccgggagagctgtgtgggccatgaccccacagagcccctggaggtgtgcctggtgtcctctgagcactatgctgccagtgaccgggagagccctggccacgtgcccagcaccctggatgctggccctgaggacacctgccccagcgctgaggagccccggctgaatgtgcaggtgaccagcacccctgtgattgtgatgagaggagctgctggcctgcagcgggagatccaggagggcgcctacagcggcagctgctaccacagagatggcctgcggctgagcatccagtttgaggtgagaagagtggagctgcagggccccacccccctcttctgctgctggctggtgaaggacctgctgcacagccagagggacagcgctgcccggaccaggctcttcctggccagcctgcccggcagcacccacagcacagctgctgagctgaccggccccagcctggtggaggtgctgcgggcccggccctggtttgaggagccccccaaggctgtggagctggagggcctggccgcctgtgagggggagtacagccagaagtacagcaccatgagccccctgggcagcggggccttcggctttgtgtggacagctgtggacaaggagaagaacaaggaggtggtggtgaagttcatcaagaaggagaaggtgctggaggactgctggattgaggaccccaagctgggcaaggtgaccctggagatcgccatcctgagccgggtggagcacgccaacatcatcaaggtgctggacatctttgagaaccagggcttcttccagctggtgatggagaagcacggcagcggcctggacctgtttgccttcatcgacagacacccccggctggatgagcccctggccagctacatcttccggcagctggtgtctgctgtgggctacctgcggctgaaggacatcatccaccgggacatcaaggatgagaacatcgtgattgctgaggacttcaccatcaagctgattgactttggatctgctgcctacctggagcggggcaagctgttctacaccttctgtggcaccatcgagtactgtgcccctgaggtgctgatgggcaacccctaccggggccctgagctggagatgtggagcctgggcgtgaccctgtacaccctggtgtttgaggagaaccccttctgtgagctggaggagaccgtggaggccgccatccaccccccctacctggtgtccaaggagctgatgagcctggtgtctggcctgctgcagcctgtgcctgagaggaggaccaccctggagaagctggtgacagacccctgggtgacccagcctgtgaacctggccgactacacctgggaggaggtgttccgggtgaacaagccagagagcggcgtgctgtctgctgccagcctggagatgggcaacagaagcctgagtgatgtggcccaggcccaggagctgtgtggcggccctgtgcctggagaggcccccaacggccagggctgcctgcaccctggggacccccggctgctgaccagctag

SEQ ID NO: 163334 - DNA, 3414 bp, Artificial Sequence
  Description of Artificial Sequence: Synthetic coding sequence
atgggcttcccagacagcgcccgggccggccagaggagcctggtggacatcatcagccgctctggagagaagatccctgtgtctgtgtggatgaagaggatgaggcaggagcggcggctgtgctgcgtggtggtgctggagcctgtggagcgggtgtccacctgggtggccttccagagtgatggcaccgtgaccagctgtgacagcctgtttgcccacctgcacggctacgtgtctggagaagatgtggccggccagcacatcacagacctgatccccagcgtgcagctgccccccagcggccagcacatccccaagaacctgaagatccagaggtctgtgggccgggccagagatggcaccaccttccccctgagcctgaagctgaagagccagcccagcagcgaggaggccaccaccggggaggccgcccctgtgtctggctaccgggcctctgtgtgggtgttctgcaccatcagcggcctcatcaccctgctgcctgatggcaccatccacggcatcaaccacagctttgccctgaccctgtttggctacggcaagacagagctgctgggcaagaacatcaccttcctgatccctggcttctacagctacatggacctggcctacaacagcagcctgcagctgcctgacctggccagctgcctggatgtgggcaatgaaagtggctgtggggagaggaccctggacccctggcagggccaggaccctgctgagggcggccaggacccccgcatcaacgtggtgctggccggcggccacgtggtgcccagagatgagatcaggaagctgatggagagccaggacatcttcaccggcacccagacagagctgattgctgggggccagctgctgagctgcctgagcccccagcctgcccctggggtggacaacgtgcctgagggcagcctgcctgtgcacggggagcaggccctgcccaaggaccagcagatcacagccctgggccgggaggagcctgtggccatcgagagccctggccaggacctgctgggggagagccgctctgagcctgtggatgtgaagccctttgccagctgtgaagattctgaggcccctgtgcctgcagaagatggcggcagtgatgctggcatgtgtggcctgtgccagaaggcccagctggagaggatgggcgtgtctggccccagcggcagtgacctgtgggccggggctgctgtggccaagccccaggccaagggccagctggccggcggcagcctgctgatgcactgcccctgctacggcagcgagtggggcctgtggtggaggagccaggacctggcccccagccccagcggcatggccggcctgagctttggcacccccaccctggatgagccctggctgggcgtggagaatgaccgggaggagctgcagacctgcctgatcaaggagcagctgagccagctgagcctggccggggccctggatgtgccccacgccgagctggtgcccacagagtgccaggccgtgacagcccctgtgagcagctgtgacctgggcggccgggacctgtgtggcggctgcaccggcagcagcagcgcctgctacgccctggccacagacctgcccggcggcctggaggccgtggaggcccaggaggtggatgtgaacagcttctcctggaacctgaaggagctgttcttcagtgaccagacagaccagaccagcagcaactgcagctgtgccaccagcgagctgcgggagacccccagcagcctggccgtgggcagtgaccctgatgtgggcagcctgcaggagcagggcagctgtgtgctggatgaccgggagctgctgctgctgaccggcacctgtgtggacctgggccagggccgccgcttccgggagagctgtgtgggccatgaccccacagagcccctggaggtgtgcctggtgtcctctgagcactatgctgccagtgaccgggagagccctggccacgtgcccagcaccctggatgctggccctgaggacacctgccccagcgctgaggagccccggctgaatgtgcaggtgaccagcacccctgtgattgtgatgagaggagctgctggcctgcagcgggagatccaggagggcgcctacagcggcagctgctaccacagagatggcctgcggctgagcatccagtttgaggtgagaagagtggagctgcagggccccacccccctcttctgctgctggctggtgaaggacctgctgcacagccagagggacagcgctgcccggaccaggctcttcctggccagcctgcccggcagcacccacagcacagctgctgagctgaccggccccagcctggtggaggtgctgcgggcccggccctggtttgaggagccccccaaggctgtggagctggagggcctggccgcctgtgagggggagtacagccagaagtacagcaccatgagccccctgggcagcggggccttcggctttgtgtggacagctgtggacaaggagaagaacaaggaggtggtggtgaagttcatcaagaaggagaaggtgctggaggactgctggattgaggaccccaagctgggcaaggtgaccctggagatcgccatcctgagccgggtggagcacgccaacatcatcaaggtgctggacatctttgagaaccagggcttcttccagctggtgatggagaagcacggcagcggcctggacctgtttgccttcatcgacagacacccccggctggatgagcccctggccagctacatcttccggcagctggtgtctgctgtgggctacctgcggctgaaggacatcatccaccgggacatcaaggatgagaacatcgtgattgctgaggacttcaccatcaagctgattgactttggatctgctgcctacctggagcggggcaagctgttctacaccttctgtggcaccatcgagtactgtgcccctgaggtgctgatgggcaacccctaccggggccctgagctggagatgtggagcctgggcgtgaccctgtacaccctggtgtttgaggagaaccccttctgtgagctggaggagaccgtggaggccgccatccaccccccctacctggtgtccaaggagctgatgagcctggtgtctggcctgctgcagcctgtgcctgagaggaggaccaccctggagaagctggtgacagacccctgggtgacccagcctgtgaacctggccgactacacctgggaggaggtgttccgggtgaacaagccagagagcggcgtgctgtctgctgccagcctggagatgggcaacagaagcctgagtgatgtggcccaggcccaggagctgtgtggcggccctgtgcctggagaggcccccaacggccagggctgcctgcaccctggggacccccggctgctgaccagctag

SEQ ID NO: 163335 - DNA, 3432 bp, Artificial Sequence
  Description of Artificial Sequence: Synthetic coding sequence
atggaggatggcggcctgacagcctttgaggaggaccagcgctgcctgagccagagcctgcccctgcctgtgtctgctgagggccctgctgcccagaccacagctgagcccagccgctccttcagcagcgcccaccgccacctgagcagaagaaatggcctgagccggctgtgccagagcaggacagccctgtctgaggaccgctggagcagctactgcctgagcagcctggccgcccagaacatctgcaccagcaagctgcactgcccagctgcccctgagcacacagaccccagcgagccccggggctctgtgtcctgctgcagcctgctgcggggcctgagcagcggctggagcagccccctgctgcctgcccctgtgtgcaaccccaacaaggccatcttcaccgtggatgccaagaccacagagatcctggtggccaatgacaaggcctgtggcctgctgggctacagcagccaggacctgattggccagaagctgacccagttcttcctgcggagtgacagtgatgtggtggaggccctgtctgaggagcacatggaggctgatggccatgctgctgtggtgtttggaacagtggtggacatcatcagccgctctggagagaagatccctgtgtctgtgtggatgaagaggatgaggcaggagcggcggctgtgctgcgtggtggtgctggagcctgtggagcgggtgtccacctgggtggccttccagagtgatggcaccgtgaccagctgtgacagcctgtttgcccacctgcacggctacgtgtctggagaagatgtggccggccagcacatcacagacctgatccccagcgtgcagctgccccccagcggccagcacatccccaagaacctgaagatccagaggtctgtgggccgggccagagatggcaccaccttccccctgagcctgaagctgaagagccagcccagcagcgaggaggccaccaccggggaggccgcccctgtgtctggctaccgggcctctgtgtgggtgttctgcaccatcagcggcctcatcaccctgctgcctgatggcaccatccacggcatcaaccacagctttgccctgaccctgtttggctacggcaagacagagctgctgggcaagaacatcaccttcctgatccctggcttctacagctacatggacctggcctacaacagcagcctgcagctgcctgacctggccagctgcctggatgtgggcaatgaaagtggctgtggggagaggaccctggacccctggcagggccaggaccctgctgagggcggccaggacccccgcatcaacgtggtgctggccggcggccacgtggtgcccagagatgagatcaggaagctgatggagagccaggacatcttcaccggcacccagacagagctgattgctgggggccagctgctgagctgcctgagcccccagcctgcccctggggtggacaacgtgcctgagggcagcctgcctgtgcacggggagcaggccctgcccaaggaccagcagatcacagccctgggccgggaggagcctgtggccatcgagagccctggccaggacctgctgggggagagccgctctgagcctgtggatgtgaagccctttgccagctgtgaagattctgaggcccctgtgcctgcagaagatggcggcagtgatgctggcatgtgtggcctgtgccagaaggcccagctggagaggatgggcgtgtctggccccagcggcagtgacctgtgggccggggctgctgtggccaagccccaggccaagggccagctggccggcggcagcctgctgatgcactgcccctgctacggcagcgagtggggcctgtggtggaggagccaggacctggcccccagccccagcggcatggccggcctgagctttggcacccccaccctggatgagccctggctgggcgtggagaatgaccgggaggagctgcagacctgcctgatcaaggagcagctgagccagctgagcctggccggggccctggatgtgccccacgccgagctggtgcccacagagtgccaggccgtgacagcccctgtgagcagctgtgacctgggcggccgggacctgtgtggcggctgcaccggcagcagcagcgcctgctacgccctggccacagacctgcccggcggcctggaggccgtggaggcccaggaggtggatgtgaacagcttctcctggaacctgaaggagctgttcttcagtgaccagacagaccagaccagcagcaactgcagctgtgccaccagcgagctgcgggagacccccagcagcctggccgtgggcagtgaccctgatgtgggcagcctgcaggagcagggcagctgtgtgctggatgaccgggagctgctgctgctgaccggcacctgtgtggacctgggccagggccgccgcttccgggagagctgtgtgggccatgaccccacagagcccctggaggtgtgcctggtgtcctctgagcactatgctgccagtgaccgggagagccctggccacgtgcccagcaccctggatgctggccctgaggacacctgccccagcgctgaggagccccggctgaatgtgcaggtgaccagcacccctgtgattgtgatgagaggagctgctggcctgcagcgggagatccaggagggcgcctacagcggcagctgctaccacagagatggcctgcggctgagcatccagtttgaggtgagaagagtggagctgcagggccccacccccctcttctgctgctggctggtgaaggacctgctgcacagccagagggacagcgctgcccggaccaggctcttcctggccagcctgcccggcagcacccacagcacagctgctgagctgaccggccccagcctggtggaggtgctgcgggcccggccctggtttgaggagccccccaaggctgtggagctggagggcctggccgcctgtgagggggagtacagccagaagtacagcaccatgagccccctgggcagcggggccttcggctttgtgtggacagctgtggacaaggagaagaacaaggaggtggtggtgaagttcatcaagaaggagaaggtgctggaggactgctggattgaggaccccaagctgggcaaggtgaccctggagatcgccatcctgagccgggtggagcacgccaacatcatcaaggtgctggacatctttgagaaccagggcttcttccagctggtgatggagaagcacggcagcggcctggacctgtttgccttcatcgacagacacccccggctggatgagcccctggccagctacatcttccggcaggtgcgggccggccagagccgggtgtctgtgaatgccggcctgggcgcctgggtgcgctggctgcagaggagcgtcatccacacccgcttcagcctgtag

SEQ ID NO: 163336 - DNA, 1314 bp, Artificial Sequence
  Description of Artificial Sequence: Synthetic coding sequence
atggtgcagatgatgaggcagttcctgtacagagtgctgcctgaagattcctacaaggtgaccaccgggaagctgcacgtgtccctgacccggctgacagatggagaaaatgtggtggtgtctgagttcaccagcaaggaggagctgattgaggccctgtactgcagctgctttgtgcctgtgtactgcggcctcatcccccccacctaccggggcgtgcgctacattgatggcggcttcaccggcatgcagccctgtgccttctggacagatgccatcaccatcagcaccttcagcggccagcaggacatctgcccccgggactgcccagccatcttccatgacttcaggatgttcaactgcagcttccagttcagcctggagaacatcgccaggatgacccacgccctcttccccccagacctggtgatcctgcatgactactactaccggggctatgaagatgctgtgctgtacctgcggcggctgaatgctgtgtacctgaacagcagcagcaagagggtcatcttcccccgggtggaggtgtactgccagatcgagctggccctgggcaatgaatgtcctgagaggagccagcccagcctgcgggcccggcaggccagcctggagggcgccacccagccccacaaggagtgggtgcccaagggagatggccggggcagccacggcccccctgtgtcccagcctgtgcagaccctggagttcacctgtgagagccctgtgtctgcccctgtgagccccctggagcagcccccagcccagcccctggccagcagcacccccctgagcctgagcggcatgcctcctgtgtccttccctgctgtgcacaagccacccagcagcaccccaggcagcagcctgcccaccccacctcctggcctgagccccctgagcccccagcagcaggtgcagcccagcggcagccctgcccggagcctgcacagccaggcccccaccagcccccggcccagcctgggccccagcacagtgggcgccccccagaccctgcccaggagcagcctgagcgccttccctgcccagccccctgtggaggagctgggccaggagcagccccaggccgtggccctgctggtgagcagcaagcccaagtctgctgtgcccctggtgcacgtgaaggagaccgtgtccaagccctacgtgacagagagccctgctgaggacagcaactgggtgaacaaggtgttcaagaagaacaagcagaagaccagcggcaccaggaagggcttccccaggcacagcggcagcaagaagcccagcagcaaggtgcagtag

SEQ ID NO: 163337 - DNA, 1599 bp, Artificial Sequence
  Description of Artificial Sequence: Synthetic coding sequence
atggaggagcaggtgttcaagggggaccctgacaccccccacagcatctccttcagcggcagcggcttcctgtccttctaccaggccggggctgtggatgccctgcgggacctggcccccaggatgctggagacagcccacagatttgctggcaccagcgctggagctgtgattgctgccctggccatctgtggcatcgagatggatgagtacctgcgggtgctgaatgtgggcgtggccgaggtgaagaagagcttcctgggccccctgagccccagctgcaagatggtgcagatgatgaggcagttcctgtacagagtgctgcctgaggacagctacaaggtgaccaccgggaagctgcacgtgtccctgacccggctgacagatggagaaaatgtggtggtgtctgagttcaccagcaaggaggagctgattgaggccctgtactgcagctgctttgtgcctgtgtactgcggcctcatcccccccacctacagaggagtgcgctacattgatggcggcttcaccggcatgcagccctgtgccttctggacagatgccatcaccatcagcaccttcagcggccagcaggacatctgcccccgggactgcccagccatcttccatgacttcaggatgttcaactgcagcttccagttcagcctggagaacatcgccaggatgacccacgccctcttccccccagacctggtgatcctgcatgactactactaccggggctatgaagatgctgtgctgtacctgcggcggctgaatgctgtgtacctgaacagcagcagcaagagggtcatcttcccccgggtggaggtgtactgccagatcgagctggccctgggcaatgaatgtcctgagaggagccagcccagcctgcgggcccggcaggccagcctggagggcgccacccagccccacaaggagtgggtgcccaagggagatggccggggcagccacggcccccctgtgtcccagcctgtgcagaccctggagttcacctgtgagagccctgtgtctgcccctgtgagccccctggagcagcccccagcccagcccctggccagcagcacccccctgagcctgagcggcatgcctcctgtgtccttccctgctgtgcacaagccacccagcagcaccccaggcagcagcctgcccaccccacctcctggcctgagccccctgagcccccagcagcaggtgcagcccagcggcagccctgcccggagcctgcacagccaggcccccaccagcccccggcccagcctgggccccagcacagtgggcgccccccagaccctgcccaggagcagcctgagcgccttccctgcccagccccctgtggaggagctgggccaggagcagccccaggccgtggccctgctggtgagcagcaagcccaagtctgctgtgcccctggtgcacgtgaaggagaccgtgtccaagccctacgtgacagagagccctgctgaggacagcaactgggtgaacaaggtgttcaagaagaacaagcagaagaccagcggcaccaggaagggcttccccaggcacagcggcagcaagaagcccagcagcaaggtgcagtag

SEQ ID NO: 163338 - DNA, 1602 bp, Artificial Sequence
  Description of Artificial Sequence: Synthetic coding sequence
atggaggagcaggtgttcaagggggaccctgacaccccccacagcatctccttcagcggcagcggcttcctgtccttctaccaggccggggctgtggatgccctgcgggacctggcccccaggatgctggagacagcccacagatttgctggcaccagcgctggagctgtgattgctgccctggccatctgtggcatcgagatggatgagtacctgcgggtgctgaatgtgggcgtggccgaggtgaagaagagcttcctgggccccctgagccccagctgcaagatggtgcagatgatgaggcagttcctgtacagagtgctgcctgaggacagctacaaggtgaccaccgggaagctgcacgtgtccctgacccggctgacagatggagaaaatgtggtggtgtctgagttcaccagcaaggaggagctgattgaagctgccctgtactgcagctgctttgtgcctgtgtactgcggcctcatcccccccacctaccggggcgtgcgctacattgatggcggcttcaccggcatgcagccctgtgccttctggacagatgccatcaccatcagcaccttcagcggccagcaggacatctgcccccgggactgcccagccatcttccatgacttcaggatgttcaactgcagcttccagttcagcctggagaacatcgccaggatgacccacgccctcttccccccagacctggtgatcctgcatgactactactaccggggctatgaagatgctgtgctgtacctgcggcggctgaatgctgtgtacctgaacagcagcagcaagagggtcatcttcccccgggtggaggtgtactgccagatcgagctggccctgggcaatgaatgtcctgagaggagccagcccagcctgcgggcccggcaggccagcctggagggcgccacccagccccacaaggagtgggtgcccaagggagatggccggggcagccacggcccccctgtgtcccagcctgtgcagaccctggagttcacctgtgagagccctgtgtctgcccctgtgagccccctggagcagcccccagcccagcccctggccagcagcacccccctgagcctgagcggcatgcctcctgtgtccttccctgctgtgcacaagccacccagcagcaccccaggcagcagcctgcccaccccacctcctggcctgagccccctgagcccccagcagcaggtgcagcccagcggcagccctgcccggagcctgcacagccaggcccccaccagcccccggcccagcctgggccccagcacagtgggcgccccccagaccctgcccaggagcagcctgagcgccttccctgcccagccccctgtggaggagctgggccaggagcagccccaggccgtggccctgctggtgagcagcaagcccaagtctgctgtgcccctggtgcacgtgaaggagaccgtgtccaagccctacgtgacagagagccctgctgaggacagcaactgggtgaacaaggtgttcaagaagaacaagcagaagaccagcggcaccaggaagggcttccccaggcacagcggcagcaagaagcccagcagcaaggtgcagtag

SEQ ID NO: 163339 - DNA, 1341 bp, Artificial Sequence
  Description of Artificial Sequence: Synthetic coding sequence
atggtgcagatgatgaggcagttcctgtacagagtgctgcctgaagattcctacaaggtgaccaccgggaagctgcacgtgtccctgacccggctgacagatggagaaaatgtggtggtgtctgagttcaccagcaaggaggagctgattgaggccctgtactgcagctgctttgtgcctgtgtactgcggcctcatcccccccacctaccggggcgtgtgggccttcctgaccctgcccccccagcgctacattgatggcggcttcaccggcatgcagccctgtgccttctggacagatgccatcaccatcagcaccttcagcggccagcaggacatctgcccccgggactgcccagccatcttccatgacttcaggatgttcaactgcagcttccagttcagcctggagaacatcgccaggatgacccacgccctcttccccccagacctggtgatcctgcatgactactactaccggggctatgaagatgctgtgctgtacctgcggcggctgaatgctgtgtacctgaacagcagcagcaagagggtcatcttcccccgggtggaggtgtactgccagatcgagctggccctgggcaatgaatgtcctgagaggagccagcccagcctgcgggcccggcaggccagcctggagggcgccacccagccccacaaggagtgggtgcccaagggagatggccggggcagccacggcccccctgtgtcccagcctgtgcagaccctggagttcacctgtgagagccctgtgtctgcccctgtgagccccctggagcagcccccagcccagcccctggccagcagcacccccctgagcctgagcggcatgcctcctgtgtccttccctgctgtgcacaagccacccagcagcaccccaggcagcagcctgcccaccccacctcctggcctgagccccctgagcccccagcagcaggtgcagcccagcggcagccctgcccggagcctgcacagccaggcccccaccagcccccggcccagcctgggccccagcacagtgggcgccccccagaccctgcccaggagcagcctgagcgccttccctgcccagccccctgtggaggagctgggccaggagcagccccaggccgtggccctgctggtgagcagcaagcccaagtctgctgtgcccctggtgcacgtgaaggagaccgtgtccaagccctacgtgacagagagccctgctgaggacagcaactgggtgaacaaggtgttcaagaagaacaagcagaagaccagcggcaccaggaagggcttccccaggcacagcggcagcaagaagcccagcagcaaggtgcagtag

SEQ ID NO: 163340 - DNA, 1515 bp, Artificial Sequence
  Description of Artificial Sequence: Synthetic coding sequence
atgttcccccgggagaagacctggaacatcagctttgctggctgcggcttcctgggcgtgtactacgtgggcgtggccagctgcctgcgggagcacgcccccttcctggtggccaatgccacccacatctacggggccagcgctggggccctgacagccacagccctggtgactggagtgtgcctgggggaggccggggccaagttcatcgaggtgtccaaggaggccaggaagcgcttcctgggccccctgcaccccagcttcaacctggtgaagatcatccgctccttcctgctgaaggtgctgcctgctgacagccatgaacatgccagcggccgcctgggcatcagcctgaccagggtgtctgatggagaaaatgtcatcatcagccacttcaacagcaaggatgagctgatccaggccaacgtgtgcagcggcttcatccctgtgtactgcggcctcatcccccccagcctgcagggcgtgcgctacgtggatggcggcatcagtgacaacctgcccctgtatgagctgaagaacaccatcaccgtgagccccttcagcggggagagtgacatctgcccccaggacagcagcaccaacatccacgagctgcgggtgaccaacaccagcatccagttcaacctgaggaacctgtaccgcctgagcaaggccctcttccccccagagcccctggtgctgcgggagatgtgcaagcagggctacagagatggcctgcgcttcctgcagagaaatggcctgctgaaccggcccaaccccctgctggccctgcccccagcccggccccacggccctgaggacaaggaccaggccgtggagagcgcccaggccgaggactacagccagctgcctggagaggaccacatcctggagcacctgcctgcccggctgaatgaggccctgctggaggcctgtgtggagcccacagacctgctgaccaccctgagcaacatgctgcctgtgcggctggccacagccatgatggtgccctacaccctgcccctggagagcgccctgtccttcaccatccggctgctggagtggctgcctgatgtgcctgaggacatccgctggatgaaggagcagacaggcagcatctgccagtacctggtgatgagggccaagaggaagctgggccgccacctgcccagccggctgcctgagcaggtggagctgcggcgggtgcagagcctgcccagcgtgcccctgagctgtgccgcctaccgggaggccctgcccggctggatgaggaacaacctgagcctgggagatgccctggccaagtgggaggagtgccagaggcagctgctgctgggcctcttctgcaccaacgtggccttccccccagaggccctgaggatgagggccccagctgaccctgccccagccccagctgaccctgccagcccccagcaccagctggccggccctgcccccctgctgagcaccccagcccctgaggcccggcctgtgattggagccctgggcctgtag

SEQ ID NO: 163341 - DNA, 1290 bp, Artificial Sequence
  Description of Artificial Sequence: Synthetic coding sequence
atgggcttcctggaggaggagggccgctggaacctgtccttctctggagctggctacctgggcgcccaccacgtgggcgccacagaatgtctgcggcagagggccccccggctgctgcagggcgcccggcgcatctacggcagcagcagcggggccctgaatgctgtgtccatcgtgtgtgggaagtctgtggacttctgctgcagccacctgctgggcatggtgggccagctggagcggctgagcctgagcatcctgcacccagcctatgcccccattgaacatgtgaagcagcagctgcaggatgccctgcccccagatgcccacgtgctggccagccagaggctgggcatcagcctgacccgctggccagatggaagaaacttcctggtgacagactttgccacctgtgatgagctgatccaggccctggtgtgcaccctgtacttccccttctactgcggcctcatccccccagagttccggggggagcgctacattgatggagccctgagcaacaacctgccctttgctgactgccccagcaccatcaccgtgagccccttccacggcaccgtggacatctgcccccagagcaccagccccaacctgcacgagctgaatgtgttcaacttctccttccagatcagcacagagaacttcttcctgggcctcatctgcctgatcccccccagcctggaggtggtggccgacaactgccggcagggctacctggatgccctgcgcttcctggagcggcggggcctgaccaaggagcctgtgctgtggaccctggtgtccaaggagcccccagccccagcagatggcaactgggatgctggctgtgaccagcgctggaagggcggcctgagcctgaactggaaggtgccccacgtgcaggtgaaggatgtgcccaactttgagcagctgagccctgagctggaggccgccctgaagaaggcctgcacccgggaccccagccgctgggcccgcttctggcacagcggccctggccaggtgctgacctacctgctgctgccctgcaccctgccctttgagtacatctacttccgcagccggcggctggtggtgtggctgcctgatgtgcctgctgacctgtggtggatgcagggcctgctgaggaacatggccctggaggtgttcagcaggaccaaggcccagctgctgggccccatcagccccccagccaccagggtgctggagaccagccccctgcagccccagatcgccccccaccgggaggagctgggccccacccaccaggcctag

SEQ ID NO: 163342 - DNA, 1515 bp, Artificial Sequence
  Description of Artificial Sequence: Synthetic coding sequence
atggccgcccagaggaggagcctgctgcagagcgagcagcagcccagctggacagatgacctgcccctgtgccacctgtctggagtgggcagcgccagcaacagaagctacagcgcagatggcaagggcacagagagccaccccccagaggacagctggctgaagttccgctctgagaacaactgcttcctgtatggagtcttcaacggctatgatggcaacagagtgaccaactttgtggcccagaggctgtctgctgagctgctgctgggccagctgaatgctgagcacgccgaggctgatgtgagaagagtgctgctgcaggcctttgatgtggtggagaggagcttcctggagagcattgatgatgccctggccgagaaggccagcctgcagagccagctgcctgagggcgtgccccagcaccagctgcccccccagtaccagaagatcctggagcggctgaagaccctggagcgggagatctctggaggagccatggctgtggtggccgtgctgctgaacaacaagctgtatgtggccaacgtgggcaccaacagagccctgctgtgcaagagcacagtggatggcctgcaggtgacccagctgaatgtggaccacaccacagaaaatgaagatgagctgttccggctgagccagctgggcctggatgctgggaagatcaagcaggtgggcatcatctgtggccaggagagcaccaggagaattggagactacaaggtgaagtatggctacacagacatcgacctgctgtctgctgccaagagcaagcccatcatcgccgagcctgagatccatggagcccagcccctggatggagtgacaggcttcctggtgctgatgtctgagggcctgtacaaggccctggaggccgcccacggccctggccaggccaaccaggagattgctgccatgattgacacagaatttgccaagcagaccagcctggatgctgtggcccaggccgtggtggacagagtgaagaggatccacagcgacacctttgccagcggcggggagcgggcccgcttctgccccaggcatgaggacatgaccctgctggtgaggaactttggctaccccctgggggagatgagccagcccacccccagccctgccccagctgctgggggccgggtgtaccctgtgtctgtgccctacagcagcgcccagagcaccagcaagacctctgtgaccctgagcctggtgatgcccagccagggccagatggtgaatggagcccacagcgccagcaccctggatgaggccacccccaccctgaccaaccagagccccaccctgaccctgcagagcaccaacacccacacccagagcagcagcagcagcagtgatggcggcctcttccgcagcaggcctgcccacagcctgcccccaggagaagatggccgggtggagccctacgtggactttgctgagttctaccgcctgtggagcgtggaccatggagagcagagcgtggtgacagccccctag

SEQ ID NO: 163343 - DNA, 948 bp, Artificial Sequence
  Description of Artificial Sequence: Synthetic coding sequence
atgggcttcctggaggaggagggccgctggaacctgtccttctctggagctggctacctgggcgcccaccacgtgggcgccacagaatgtctgcggcagagggccccccggctgctgcagggcgcccggcgcatctacggcagcagcagcggggccctgaatgctgtgtccatcgtgtgtgggaagtctgtggactgccccagcaccatcaccgtgagccccttccacggcaccgtggacatctgcccccagagcaccagccccaacctgcacgagctgaatgtgttcaacttctccttccagatcagcacagagaacttcttcctgggcctcatctgcctgatcccccccagcctggaggtggtggccgacaactgccggcagggctacctggatgccctgcgcttcctggagcggcggggcctgaccaaggagcctgtgctgtggaccctggtgtccaaggagcccccagccccagcagatggcaactgggatgctggctgtgaccagcgctggaagggcggcctgagcctgaactggaaggtgccccacgtgcaggtgaaggatgtgcccaactttgagcagctgagccctgagctggaggccgccctgaagaaggcctgcacccgggaccccagccgctgggcccgcttctggcacagcggccctggccaggtgctgacctacctgctgctgccctgcaccctgccctttgagtacatctacttccgcagccggcggctggtggtgtggctgcctgatgtgcctgctgacctgtggtggatgcagggcctgctgaggaacatggccctggaggtgttcagcaggaccaaggcccagctgctgggccccatcagccccccagccaccagggtgctggagaccagccccctgcagccccagatcgccccccaccgggaggagctgggccccacccaccaggcctag

SEQ ID NO: 163344 - DNA, 807 bp, Artificial Sequence
  Description of Artificial Sequence: Synthetic coding sequence
atgggcttcctggaggaggagggccgctggaacctgtccttctctggagctggctacctgggcgcccaccacgtgggcgccacagaatgtctgcggcagagggccccccggctgctgcagggcgcccggcgcatctacggcagcagcagcggggccctgaatgctgtgtccatcgtgtgtgggaagtctgtggacttctgctgcagccacctgctgggcatggtgggccagctggagcggctgagcctgagcatcctgcacccagcctatgcccccattgaacatgtgaagcagcagctgcaggatgccctgcccccagatgcccacgtgctggccagccagaggctgggcatcagcctgacccgctggccagatggaagaaacttcctggtgacagactttgccacctgtgatgagctgatccaggtggtggccgacaactgccggcagggctacctggatgccctgcgcttcctggagcggcggggcctgaccaaggagcctgtgctgtggaccctggtgtccaaggagcccccagccccagcagatggcaactgggatgctggctgtgaccagcgctggaagggcggcctgagcctgaactggaaggtgccccacgtgcaggtgaaggatgtgcccaactttgagcagctgagccctgagctggaggccgccctgaagaaggcctgcacccgggaccccagccgctgggcccgcttctggcacagcggccctggccaggtgctgacctacctgctgctgccctgcaccctgccctttgagtacatctacttccgcagcaggtag

SEQ ID NO: 163345 - DNA, 948 bp, Artificial Sequence; identical to SEQ ID NO: 163343
  Description of Artificial Sequence: Synthetic coding sequence

SEQ ID NO: 163346 - DNA, 708 bp, Artificial Sequence
  Description of Artificial Sequence: Synthetic coding sequence
atggaggaggagacccacacagatgccaagatccgggcagaaaatggaacaggcagcagcccccggggccctggctgcagcctgcggcactttgcctgtgagcagaacctgctgagcaggccagatggcagcgccagcttcctgcagggcgacacctctgtgctggccggcgtgtatggccctgctgaggtgaaggtgtccaaggagatcttcaacaaggccaccctggaggtgatcctgcggcccaagattggcctgcccggggtggccgagaagagccgggagcggctcatccggaacacctgtgaggccgtggtgctgggcaccctgcaccccaggaccagcatcaccgtggtgctgcaggtggtgtctgatgctggcagcctgctggcctgctgcctgaatgctgcctgcatggccctggtggatgctggggtgcccatgagggccctcttctgtggggtggcctgtgccctggacagtgatggcaccctggtgctggaccccaccagcaagcaggagaaggaggcccgggctgtgctgacctttgccctggacagcgtggagaggaagctgctgatgagcagcaccaagggcctgtacagcgacacagagctgcagcagtgcctggccgccgcccaggccgccagccagcacgtgttccgcttctaccgggagagcctgcagaggcgctacagcaagagctag

SEQ ID NO: 163347 - DNA, 4128 bp, Artificial Sequence
  Description of Artificial Sequence: Synthetic coding sequence
atggaggcccccctgcagacaggcatgatgggcaccagcagccacggcctggccaccaacagcagcggggccaaggtggccgagagagatggcttccaggatgtgctggcccctggagagggcagcgctggccgcatctgtggggcccagcctgtgccctttgtgccccaggtgctgggcgtgatgattggagctggggtggccgtggtggtgacagctgtgctgatcctgctggtggtgcggcggctgcgggtgcccaagaccccagccccagatggcccccgctaccgcttcaggaagagggacaaggtgctcttctacggcaggaagatcatgaggaaggtgtcccagagcaccagcagcctggtggacacctctgtgtctgccaccagccggcccaggatgaggaagaagctgaagatgctgaacatcgccaagaagatcctgcgcatccagaaggagacccccaccctgcagaggaaggagcccccacctgctgtgctggaggccgacctgacagaaggagacctggccaacagccacctgcccagcgaggtgctgtacatgctgaagaatgtgcgggtgctgggccactttgagaagcccctcttcctggagctgtgccgccacatggtgttccagaggctgggccagggcgactatgtgttccggcccggccagccagatgccagcatctacgtggtgcaggacggcctgctggagctgtgcctgcccggcccagatggcaaggaatgtgtggtgaaggaggtggtgcctggggacagcgtgaacagcctgctgagcatcctggatgtgatcaccggccaccagcacccccagaggacagtgtctgcccgggccgcccgggacagcacagtgctgcggctgcctgtggaggccttctctgctgtgttcaccaagtacccagagagcctggtgcgggtggtgcagatcatcatggtgcggctgcagagggtgaccttcctggccctgcacaactacctgggcctgaccaatgaactcttcagccatgagatccagcccctgcggctcttccccagccctggcctgcccaccaggaccagccctgtgcggggcagcaagaggatggtgtccaccagcgccacagatgagccccgggagaccccaggccggcccccagaccccaccggggcccccctgcccggccccaccggggaccctgtgaagcccaccagcctggagaccccatctgcccccctgctgagccgctgtgtgtccatgcctggggacatcagcggcctgcagggcggccccaggagtgactttgacatggcctatgaaagaggccgcatctctgtgtccctgcaggaggaggccagcggcggcagcctggccgccccagcccggacccccacccaggagccccgggagcagcctgctggggcctgtgagtacagctactgtgaagatgagagcgccaccggcggctgccccttcggcccctaccagggccggcagaccagcagcatctttgaagctgccaagcaggagctggccaagctgatgagaattgaggaccccagcctgctgaacagccgggtgctgctgcaccacgccaaggccggcaccatcatcgcccggcagggcgaccaggatgtgtccctgcactttgtgctgtggggctgcctgcacgtgtaccagaggatgattgacaaggccgaggatgtgtgcctgtttgtggcccagcctggagagctggtgggccagctggccgtgctgaccggggagcccctcatcttcaccctgcgggcccagagggactgcaccttcctgcgcatcagcaagagtgacttctatgagatcatgagggcccagcccagcgtggtgctgtctgctgcccacacagtggccgccaggatgagcccctttgtgcggcagatggactttgccatcgactggacagctgtggaggccggccgggccctgtaccggcagggcgacagaagtgactgcacctacatcgtgctgaatggccgcctgcggagcgtcatccagaggggcagcggcaagaaggagctggtgggggagtatggccgcggggacctgattggagtggtggaggccctgacccggcagccccgggccaccaccgtgcatgctgtgcgggacacagagctggccaagctgcctgagggcaccctgggccacatcaagaggcgctacccccaggtggtgaccaggctcatccacctgctgagccagaagatcctgggcaacctgcagcagctgcagggccccttccctgctggcagcggcctgggcgtgcccccccacagcgagctgaccaacccagccagcaacctggccaccgtggccatcctgcctgtgtgtgccgaggtgcccatggtggccttcaccctggagctgcagcacgccctgcaggccatcggccccaccctgctgctgaacagcgacatcatccgggcccggctgggcgccagcgccctggacagcatccaggagttccggctgagcggctggctggcccagcaggaggatgcccacagaattgtgctgtaccagacagatgccagcctgaccccctggacagtgcgctgcctgcggcaggccgactgcatcctgattgtgggcctgggggaccaggagcccaccctgggccagctggagcagatgctggagaacacagctgtgcgggccctgaagcagctggtgctgctgcaccgggaggagggcgccggccccaccaggacagtggagtggctgaacatgaggtcctggtgcagcggccacctgcacctgcgctgcccccggcggctcttcagcagaagaagccctgccaagctgcacgagctgtatgagaaggtgttcagcagaagagctgacagacacagcgacttcagccggctggcccgggtgctgactggaaacaccatcgccctggtgctgggcggcggcggggcccggggctgcagccacatcggcgtgctgaaggccctggaggaggccggcgtgcctgtggacctggtgggcggcaccagcatcggcagcttcatcggggccctgtatgcagaggagaggtctgccagcaggaccaagcagagggcccgggagtgggccaagtccatgacctctgtgctggagcctgtgctggacctgacctaccctgtgacctccatgttcaccggcagcgccttcaacagaagcatccacagggtcttccaggacaagcagatcgaggacctgtggctgccctacttcaacgtgaccacagacatcacagccagcgccatgagggtgcacaaggatggcagcctgtggaggtatgtgcgggcctccatgaccctgagcggctacctgccccccctgtgtgaccccaaggatggccacctgctgatggatggcggctacatcaacaacctgcctgctgacatcgcccgctccatgggcgccaagacagtgattgccattgatgtgggcagccaggatgaaacagacctgagcacctacggggacagcctgagcggctggtggctgctgtggaagaggctgaacccctgggccgacaaggtgaaggtgcctgacatggccgagatccagagccggctggcctacgtgtcctgtgtgcggcagctggaggtggtgaagagcagcagctactgtgagtacctgcggccccccatcgactgcttcaagaccatggactttgggaagtttgaccagatctatgatgtgggctaccagtatggcaaggctgtgtttggaggctggagcagaggaaatgtgattgagaagatgctgacagaccggcgcagcacagacctgaatgaaagcagaagagcagatgtgctggccttccccagcagcggcttcacagacctggccgagatcgtgtccagaattgagccccccaccagctatgtgtctgatggctgtgctgatggagaggagagtgactgcctgacagaatatgaggaggatgctggccctgactgcagcagagatgaaggaggcagccctgagggcgccagccccagcacagccagcgagatggaggaggagaagagcatcctgcggcagaggcgctgcctgccccaggagcccccaggcagcgccacagatgcctag

SEQ ID NO: 163348 - DNA, 3984 bp, Artificial Sequence
  Description of Artificial Sequence: Synthetic coding sequence
atggaggcccccctgcagacaggcatggtgctgggcgtgatgattggagctggggtggccgtggtggtgacagctgtgctgatcctgctggtggtgcggcggctgcgggtgcccaagaccccagccccagatggcccccgctaccgcttcaggaagagggacaaggtgctcttctacggcaggaagatcatgaggaaggtgtcccagagcaccagcagcctggtggacacctctgtgtctgccaccagccggcccaggatgaggaagaagctgaagatgctgaacatcgccaagaagatcctgcgcatccagaaggagacccccaccctgcagaggaaggagcccccacctgctgtgctggaggccgacctgacagaaggagacctggccaacagccacctgcccagcgaggtgctgtacatgctgaagaatgtgcgggtgctgggccactttgagaagcccctcttcctggagctgtgccgccacatggtgttccagaggctgggccagggcgactatgtgttccggcccggccagccagatgccagcatctacgtggtgcaggacggcctgctggagctgtgcctgcccggcccagatggcaaggaatgtgtggtgaaggaggtggtgcctggggacagcgtgaacagcctgctgagcatcctggatgtgatcaccggccaccagcacccccagaggacagtgtctgcccgggccgcccgggacagcacagtgctgcggctgcctgtggaggccttctctgctgtgttcaccaagtacccagagagcctggtgcgggtggtgcagatcatcatggtgcggctgcagagggtgaccttcctggccctgcacaactacctgggcctgaccaatgaactcttcagccatgagatccagcccctgcggctcttccccagccctggcctgcccaccaggaccagccctgtgcggggcagcaagaggatggtgtccaccagcgccacagatgagccccgggagaccccaggccggcccccagaccccaccggggcccccctgcccggccccaccggggaccctgtgaagcccaccagcctggagaccccatctgcccccctgctgagccgctgtgtgtccatgcctggggacatcagcggcctgcagggcggccccaggagtgactttgacatggcctatgaaagaggccgcatctctgtgtccctgcaggaggaggccagcggcggcagcctggccgccccagcccggacccccacccaggagccccgggagcagcctgctggggcctgtgagtacagctactgtgaagatgagagcgccaccggcggctgccccttcggcccctaccagggccggcagaccagcagcatctttgaagctgccaagcaggagctggccaagctgatgagaattgaggaccccagcctgctgaacagccgggtgctgctgcaccacgccaaggccggcaccatcatcgcccggcagggcgaccaggatgtgtccctgcactttgtgctgtggggctgcctgcacgtgtaccagaggatgattgacaaggccgaggatgtgtgcctgtttgtggcccagcctggagagctggtgggccagctggccgtgctgaccggggagcccctcatcttcaccctgcgggcccagagggactgcaccttcctgcgcatcagcaagagtgacttctatgagatcatgagggcccagcccagcgtggtgctgtctgctgcccacacagtggccgccaggatgagcccctttgtgcggcagatggactttgccatcgactggacagctgtggaggccggccgggccctgtaccggcagggcgacagaagtgactgcacctacatcgtgctgaatggccgcctgcggagcgtcatccagaggggcagcggcaagaaggagctggtgggggagtatggccgcggggacctgattggagtggtggaggccctgacccggcagccccgggccaccaccgtgcatgctgtgcgggacacagagctggccaagctgcctgagggcaccctgggccacatcaagaggcgctacccccaggtggtgaccaggctcatccacctgctgagccagaagatcctgggcaacctgcagcagctgcagggccccttccctgctggcagcggcctgggcgtgcccccccacagcgagctgaccaacccagccagcaacctggccaccgtggccatcctgcctgtgtgtgccgaggtgcccatggtggccttcaccctggagctgcagcacgccctgcaggccatcggccccaccctgctgctgaacagcgacatcatccgggcccggctgggcgccagcgccctggacagcatccaggagttccggctgagcggctggctggcccagcaggaggatgcccacagaattgtgctgtaccagacagatgccagcctgaccccctggacagtgcgctgcctgcggcaggccgactgcatcctgattgtgggcctgggggaccaggagcccaccctgggccagctggagcagatgctggagaacacagctgtgcgggccctgaagcagctggtgctgctgcaccgggaggagggcgccggccccaccaggacagtggagtggctgaacatgaggtcctggtgcagcggccacctgcacctgcgctgcccccggcggctcttcagcagaagaagccctgccaagctgcacgagctgtatgagaaggtgttcagcagaagagctgacagacacagcgacttcagccggctggcccgggtgctgactggaaacaccatcgccctggtgctgggcggcggcggggcccggggctgcagccacatcggcgtgctgaaggccctggaggaggccggcgtgcctgtggacctggtgggcggcaccagcatcggcagcttcatcggggccctgtatgcagaggagaggtctgccagcaggaccaagcagagggcccgggagtgggccaagtccatgacctctgtgctggagcctgtgctggacctgacctaccctgtgacctccatgttcaccggcagcgccttcaacagaagcatccacagggtcttccaggacaagcagatcgaggacctgtggctgccctacttcaacgtgaccacagacatcacagccagcgccatgagggtgcacaaggatggcagcctgtggaggtatgtgcgggcctccatgaccctgagcggctacctgccccccctgtgtgaccccaaggatggccacctgctgatggatggcggctacatcaacaacctgcctgctgacatcgcccgctccatgggcgccaagacagtgattgccattgatgtgggcagccaggatgaaacagacctgagcacctacggggacagcctgagcggctggtggctgctgtggaagaggctgaacccctgggccgacaaggtgaaggtgcctgacatggccgagatccagagccggctggcctacgtgtcctgtgtgcggcagctggaggtggtgaagagcagcagctactgtgagtacctgcggccccccatcgactgcttcaagaccatggactttgggaagtttgaccagatctatgatgtgggctaccagtatggcaaggctgtgtttggaggctggagcagaggaaatgtgattgagaagatgctgacagaccggcgcagcacagacctgaatgaaagcagaagagcagatgtgctggccttccccagcagcggcttcacagacctggccgagatcgtgtccagaattgagccccccaccagctatgtgtctgatggctgtgctgatggagaggagagtgactgcctgacagaatatgaggaggatgctggccctgactgcagcagagatgaaggaggcagccctgagggcgccagccccagcacagccagcgagatggaggaggagaagagcatcctgcggcagaggcgctgcctgccccaggagcccccaggcagcgccacagatgcctag

SEQ ID NO: 163349 - DNA, 1371 bp, Artificial Sequence
  Description of Artificial Sequence: Synthetic coding sequence
atgaggaaggtgtcccagagcaccagcagcctggtggacacctctgtgtctgccaccagccggcccaggatgaggaagaagctgaagatgctgaacatcgccaagaagatcctgcgcatccagaaggagacccccaccctgcagaggaaggagcccccacctgctgtgctggaggccgacctgacagaaggagacctggccaacagccacctgcccagcgaggtgctgtacatgctgaagaatgtgcgggtgctgggccactttgagaagcccctcttcctggagctgtgccgccacatggtgttccagaggctgggccagggcgactatgtgttccggcccggccagccagatgccagcatctacgtggtgcaggacggcctgctggagctgtgcctgcccggcccagatggcaaggaatgtgtggtgaaggaggtggtgcctggggacagcgtgaacagcctgctgagcatcctggatgtgatcaccggccaccagcacccccagaggacagtgtctgcccgggccgcccgggacagcacagtgctgcggctgcctgtggaggccttctctgctgtgttcaccaagtacccagagagcctggtgcgggtggtgcagatcatcatggtgcggctgcagagggtgaccttcctggccctgcacaactacctgggcctgaccaatgagctgttcagccatgagatccagcccctgcggctcttccccagccctggcctgcccaccaggaccagccctgtgcggggcagcaagaggatggtgtccaccagcgccacagatgagccccgggagaccccaggccggcccccagaccccactggagcccccctgcccggccccactggagaccctgtgaagcccaccagcctggagacccccagcgcccccctgctgagccgctgtgtgtccatgcctggggacatcagcggcctgcagggcggccccaggagtgactttgacatggcctatgagcggggccgcatctctgtgtccctgcaggaggaggccagcggcggcagcctggccgccccagcccggacccccacccaggagccccgggagcagcctgctggggcctgtgagtacagctactgtgaagatgaaagtgccactggaggctgccccttcggcccctaccagggccggcagaccagcagcatctttgaggccgccaagcaggagctggccaagctgatgagaattgaggaccccagcctgctgaacagccgggtgctgctgcaccacgccaaggccggcaccatcatcgcccggcagggcgaccaggatgtgtctggcccccacacaggcctgacctgcccagagcggggctgcagcgtggccctgatgacctag

SEQ ID NO: 163350 - DNA, 3903 bp, Artificial Sequence
  Description of Artificial Sequence: Synthetic coding sequence
atggaggcccccctgcagacaggcatggtgctgggcgtgatgattggagctggggtggccgtggtggtgacagctgtgctgatcctgctggtggtgcggcggctgcgggtgcccaagaccccagccccagatggcccccgctaccgcttcaggaagagggacaaggtgctcttctacggcaggaagatcatgaggaaggtgtcccagagcaccagcagcctggtggacacctctgtgtctgccaccagccggcccaggatgaggaagaagctgaagatgctgaacatcgccaagaagatcctgcgcatccagaaggagacccccaccctgcagaggaaggagcccccacctgctgtgctggaggccgacctgacagaaggagacctggccaacagccacctgcccagcgaggtgctgtacatgctgaagaatgtgcgggtgctgggccactttgagaagcccctcttcctggagctgtgccgccacatggtgttccagaggctgggccagggcgactatgtgttccggcccggccagccagatgccagcatctacgtggtgcaggacggcctgctggagctgtgcctgcccggcccagatggcaaggaatgtgtggtgaaggaggtggtgcctggggacagcgtgaacagcctgctgagcatcctggatgtgatcaccggccaccagcacccccagaggacagtgtctgcccgggccgcccgggacagcacagtgctgcggctgcctgtggaggccttctctgctgtgttcaccaagtacccagagagcctggtgcgggtggtgcagatcatcatggtgcggctgcagagggtgaccttcctggccctgcacaactacctgggcctgaccaatgaactcttcagccatgagatccagcccctgcggctcttccccagccctggcctgcccaccaggaccagccctgtgcggggcagcaagaggatggtgtccaccagcgccacagatgagccccgggagaccccaggccggcccccagaccccaccggggcccccctgcccggccccaccggggaccctgtgaagcccaccagcctggagaccccatctgcccccctgctgagccgctgtgtgtccatgcctggggacatcagcggcctgcagggcggccccaggagtgactttgacatggcctatgaaagaggccgcatctctgtgtccctgcaggaggaggccagcggcggcagcctggccgccccagcccggacccccacccaggagccccgggagcagcctgctggggcctgtgagtacagctactgtgaagatgagagcgccaccggcggctgccccttcggcccctaccagggccggcagaccagcagcatctttgaagctgccaagcaggagctggccaagctgatgagaattgaagatgtgtccctgcactttgtgctgtggggctgcctgcacgtgtaccagaggatgattgacaaggccgaggatgtgtgcctgtttgtggcccagcctggagagctggtgggccagctggccgtgctgaccggggagcccctcatcttcaccctgcgggcccagagggactgcaccttcctgcgcatcagcaagagtgacttctatgagatcatgagggcccagcccagcgtggtgctgtctgctgcccacacagtggccgccaggatgagcccctttgtgcggcagatggactttgccatcgactggacagctgtggaggccggccgggccctgtaccggcagggcgacagaagtgactgcacctacatcgtgctgaatggccgcctgcggagcgtcatccagaggggcagcggcaagaaggagctggtgggggagtatggccgcggggacctgattggagtggtggaggccctgacccggcagccccgggccaccaccgtgcatgctgtgcgggacacagagctggccaagctgcctgagggcaccctgggccacatcaagaggcgctacccccaggtggtgaccaggctcatccacctgctgagccagaagatcctgggcaacctgcagcagctgcagggccccttccctggcagcggcctgggcgtgcccccccacagcgagctgaccaacccagccagcaacctggccaccgtggccatcctgcctgtgtgtgccgaggtgcccatggtggccttcaccctggagctgcagcacgccctgcaggccatcggccccaccctgctgctgaacagcgacatcatccgggcccggctgggcgccagcgccctggacagcatccaggagttccggctgagcggctggctggcccagcaggaggatgcccaccgcatcgtgctgtaccagacagatgccagcctgaccccctggacagtgcgctgcctgcggcaggccgactgcatcctgattgtgggcctgggggaccaggagcccaccctgggccagctggagcagatgctggagaacacagctgtgcgggccctgaagcagctggtgctgctgcaccgggaggagggcgccggccccaccaggacagtggagtggctgaacatgaggtcctggtgcagcggccacctgcacctgcgctgccccaggaggctcttcagccgccgcagccctgccaagctgcacgagctgtatgagaaggtgttcagccggcgggctgacagacacagcgacttcagccggctggcccgggtgctgaccggcaacaccatcgccctggtgctgggcggcggcggggcccggggctgcagccacatcggcgtgctgaaggccctggaggaggccggcgtgcctgtggacctggtgggcggcaccagcatcggcagcttcatcggggccctgtatgcagaggagaggtctgccagcaggaccaagcagagggcccgggagtgggccaagtccatgacctctgtgctggagcctgtgctggacctgacctaccctgtgacctccatgttcaccggcagcgccttcaacagaagcatccacagggtcttccaggacaagcagatcgaggacctgtggctgccctacttcaacgtgaccacagacatcacagccagcgccatgagggtgcacaaggatggcagcctgtggaggtatgtgcgggcctccatgaccctgagcggctacctgccccccctgtgtgaccccaaggatggccacctgctgatggatggcggctacatcaacaacctgcctgctgacatcgcccgctccatgggcgccaagacagtcatcgccattgatgtgggcagccaggatgaaacagacctgagcacctatggagacagcctgagcggctggtggctgctgtggaagaggctgaacccctgggccgacaaggtgaaggtgcctgacatggccgagatccagagccggctggcctacgtgtcctgtgtgcggcagctggaggtggtgaagagcagcagctactgtgagtacctgcggccccccatcgactgcttcaagaccatggactttgggaagtttgaccagatctatgatgtgggctaccagtatggcaaggctgtgtttggaggctggagcagaggaaatgtcatcgagaagatgctgacagacagaagaagcacagacctgaatgaaagccggcgggcagatgtgctggccttccccagcagcggcttcacagacctggccgagatcgtgagccgcatcgagccccccaccagctatgtgtctgatggctgtgctgatggagaggagagtgactgcctgacagaatatgaagaagatgctggccctgactgcagcagagatgagggcggcagccctgagggcgccagccccagcacagccagcgagatggaggaggagaagagcatcctgcggcagaggcgctgcctgccccaggagcccccaggcagcgccacagatgcctag

SEQ ID NO: 163351 - DNA, 3954 bp, Artificial Sequence
  Description of Artificial Sequence: Synthetic coding sequence
atggaggaggagaaggatgacagcccccagctgaccggcattgctgtgggcgccctgctggccctggccctggtgggcgtgctgatcctcttcatgttccggcggctgcggcagttccggcaggcccagcccaccccccagtaccgcttcaggaagagggacaaggtgatgttttatggcaggaagatcatgaggaaggtgaccaccctgcccaacaccctggtggagaacacagccctgccccggcagagggccaggaagaggaccaaggtgctgagcctggccaagaggatcctgcgcttcaagaaggagtacccagccctgcagcccaaggagcccccacccagcctgctggaggccgacctgacagaatttgatgtgaagaacagccacctgcccagcgaggtgctgtacatgctgaagaatgtgcgggtgctgggccactttgagaagcccctcttcctggagctgtgcaagcacatcgtgtttgtgcagctgcaggagggggagcacgtgttccagccccgggagccagaccccagcatctgtgtggtgcaggacggccgcctggaggtgtgcatccaggacacagatggaacagaggtggtggtgaaggaggtgctggccggggacagcgtgcacagcctgctgagcatcctggacatcatcaccggccatgctgccccctacaagacagtgtctgtgcgggccgccatccccagcaccatcctgcggctgcctgctgctgccttccacggcgtgtttgagaagtacccagagaccctggtgcgggtggtgcagatcatcatggtgcggctgcagagggtgaccttcctggccctgcacaactacctgggcctgaccacagagctgttcaatgctgagagccaggccatccccctggtgtctgtggcctctgtggccgccggcaaggccaagaagcaggtgttctacggggaggaggagcggctgaagaagccaccccggctgcaggagagctgtgacagcgaccacggcggcggccggcctgctgctgctggccccctgctgaagaggagccacagcgtgcctgcccccagcatcaggaagcagatcctggaggagctggagaagccaggggccggggaccctgaccccagcgccccccagggcggccctggcagcgccaccagtgacctgggcatggcctgtgaccgggcccgggtcttcctgcacagtgatgagcaccctggcagctctgtggccagcaagagcaggaagtctgtgatggtggccgagatccccagcacagtgtcccagcacagcgagagccacacagatgagaccctggccagcaggaagagtgatgccatcttccgggccgccaagaaggacctgctgaccctgatgaagctggaggacagcagcctgctggatggccgggtggccctgctgcacgtgcctgctggcaccgtggtgtcccggcagggcgaccaggatgccagcatcctgtttgtggtgtctggcctgctgcacgtgtaccagaggaagattggcagccaggaggacacctgcctcttcctgaccaggcctggagagatggtgggccagctggccgtgctgactggagagcccctcatcttcaccgtgaaggccaacagagactgcagcttcctgagcatcagcaaggcccacttctatgagatcatgaggaagcagcccaccgtggtgctgggcgtggcccacacagtggtgaagaggatgagcagctttgtgcggcagattgactttgccctggactgggtggaggtggaggccggccgggccatctaccggcagggcgacaagagtgactgcacctacatcatgctgagcggccgcctgcggagcgtcatcaggaaggatgatggcaagaagaggctggccggggagtatggccgcggggacctggtgggcgtggtggagaccctgacccaccaggcccgggccaccaccgtgcatgctgtgcgggacagcgagctggccaagctgcctgctggggccctgaccagcatcaagaggcgctacccccaggtggtgaccaggctcatccacctgctgggggagaagatcctgggcagcctgcagcagggccctgtgacaggccaccagctgggcctgcccacagagggcagcaagtgggacctgggcaacccagctgtgaacctgagcacagtggccgtgatgcctgtgtctgaggaggtgcccctgacagcctttgccctggagctggagcacgccctgagcgccatcggccccaccctgctgctgaccagtgacaacatcaagaggcggctgggcagcgctgccctggacagcgtgcatgagtaccgcctgagctcctggctgggccagcaggaggacacccaccgcatcgtgctgtaccaggtggatggcaccctgaccccctggacccagagatgtgtgcggcaggccgactgcatcctgattgtgggcctgggggaccaggagcccaccgtgggggagctggagaggatgctggagagcacagctgtgcgggcccagaagcagctgatcctgctgcaccgggaggagggccctgccccagccaggacagtggagtggctgaacatgaggtcctggtgcagcggccacctgcacctgtgctgccccaggagggtcttcagccgccgcagcctgcccaagctggtggagatgtacaagcacgtgttccagaggcccccagacagacacagcgacttcagccggctggcccgggtgctgactggaaatgccatcgccctggtgctgggcggcggcggggcccggggctgtgcccaggtgggcgtgctgaaggccctggctgaatgtggcatccctgtggacatggtgggcggcaccagcatcggggcctttgtgggcgccctgtacagcgaggagaggaactacagccagatgaggatccgggccaagcagtgggccgagggcatgaccagcctgatgaaggccgccctggacctgacctaccccatcacctccatgttttctggagctggcttcaacagcagcatcttctctgtgttcaaggaccagcagatcgaggacctgtggatcccctactttgccatcaccacagacatcacagccagcgccatgagggtgcacacagatggcagcctgtggtggtacgtgcgggcctccatgagcctgagcggctacatgccacccctgtgtgaccccaaggatggccacctgctgatggatggcggctacatcaacaacctgcctgcagatgtggcccgctccatgggcgccaaggtggtgattgccattgatgtgggcagcagagatgaaacagacctgaccaactatggagatgccctgagcggctggtggctgctgtggaagcgctggaaccccctggccaccaaggtgaaggtgctgaacatggccgagatccagacccggctggcctacgtgtgctgcgtgcggcagctggaggtggtgaagagcagtgactactgtgagtacctgcggccccccatcgacagctacagcaccctggactttgggaagttcaatgagatctgtgaggtgggctaccagcacggccgcacagtgtttgacatctggggccgctctggagtgctggagaagatgctgcgggaccagcagggccccagcaagaagccagccagcgctgtgctgacctgccccaatgccagcttcacagacctggccgagatcgtgagccgcatcgagcccgccaagccagccatggtggatgatgaaagtgactaccagacagaatatgaggaggagctgctggatgtgcccagagatgcctatgctgacttccagagcaccagcgcccagcagggcagtgacctggaggatgagagcagcctgcggcaccgccaccccagcctggccttccccaagctgtctgagggcagcagtgaccaggacggctag

SEQ ID NO: 163352 - DNA, 2178 bp, Artificial Sequence
  Description of Artificial Sequence: Synthetic coding sequence
atggtgcggctgcagagggtgaccttcctggccctgcacaactacctgggcctgaccacagagctgttcaatgctgagagccaggccatccccctggtgtctgtggcctctgtggccgccggcaaggccaagaagcaggtgttctatggagaggaggagcggctgaagaagccaccccggctgcaggagagctgtgacagcgctgaccacggcggcggccggcctgctgctgctggccccctgctgaagaggagccacagcgtgcctgcccccagcatcaggaagcagatcctggaggagctggagaagccaggggccggggaccctgaccccagcgccccccagggccaccagctgggcctgcccacagagggcagcaagtgggacctgggcaacccagctgtgaacctgagcacagtggccgtgatgcctgtgtctgaggaggtgcccctgacagcctttgccctggagctggagcacgccctgagcgccatcggccccaccctgctgctgaccagtgacaacatcaagaggcggctgggcagcgctgccctggacagcgtgcatgagtaccgcctgagctcctggctgggccagcaggaggacacccaccgcatcgtgctgtaccaggtggatggcaccctgaccccctggacccagagatgtgtgcggcaggccgactgcatcctgattgtgggcctgggggaccaggagcccaccgtgggggagctggagaggatgctggagagcacagctgtgcgggcccagaagcagctgatcctgctgcaccgggaggagggccctgccccagccaggacagtggagtggctgaacatgaggtcctggtgcagcggccacctgcacctgtgctgccccaggagggtcttcagccgccgcagcctgcccaagctggtggagatgtacaagcacgtgttccagaggcccccagacagacacagcgacttcagccggctggcccgggtgctgactggaaatgccatcgccctggtgctgggcggcggcggggcccggggctgtgcccaggtgggcgtgctgaaggccctggctgaatgtggcatccctgtggacatggtgggcggcaccagcatcggggcctttgtgggcgccctgtacagcgaggagaggaactacagccagatgaggatccgggccaagcagtgggccgagggcatgaccagcctgatgaaggccgccctggacctgacctaccccatcacctccatgttttctggagctggcttcaacagcagcatcttctctgtgttcaaggaccagcagatcgaggacctgtggatcccctactttgccatcaccacagacatcacagccagcgccatgagggtgcacacagatggcagcctgtggtggtacgtgcgggcctccatgagcctgagcggctacatgccacccctgtgtgaccccaaggatggccacctgctgatggatggcggctacatcaacaacctgcctgcagatgtggcccgctccatgggcgccaaggtggtgattgccattgatgtgggcagcagagatgaaacagacctgaccaactatggagatgccctgagcggctggtggctgctgtggaagcgctggaaccccctggccaccaaggtgaaggtgctgaacatggccgagatccagacccggctggcctacgtgtgctgcgtgcggcagctggaggtggtgaagagcagtgactactgtgagtacctgcggccccccatcgacagctacagcaccctggactttgggaagttcaatgagatctgtgaggtgggctaccagcacggccgcacagtgtttgacatctggggccgctctggagtgctggagaagatgctgcgggaccagcagggccccagcaagaagccagccagcgctgtgctgacctgccccaatgccagcttcacagacctggccgagatcgtgagccgcatcgagcccgccaagccagccatggtggatgatgaaagtgactaccagacagaatatgaggaggagctgctggatgtgcccagagatgcctatgctgacttccagagcaccagcgcccagcagggcagtgacctggaggatgagagcagcctgcggcaccgccaccccagcctggccttccccaagctgtctgagggcagcagtgaccaggacggctag

SEQ ID NO: 163353 - DNA, 1377 bp, Artificial Sequence
  Description of Artificial Sequence: Synthetic coding sequence
atggaggaggagaaggatgacagcccccaggccgacttctgcctgggcacagccctgcacagctggggcctgtggttcacagaggagggcagccccagcaccatgctgactggaattgctgtgggcgccctgctggccctggccctggtgggcgtgctgatcctcttcatgttccggcggctgcggcagttccggcaggcccagcccaccccccagtaccgcttcaggaagagggacaaggtgatgttctacggcaggaagatcatgaggaaggtgaccaccctgcccaacaccctggtggagaacacagccctgccccggcagagggccaggaagaggaccaaggtgctgagcctggccaagaggatcctgcgcttcaagaaggagtacccagccctgcagcccaaggagcccccacccagcctgctggaggccgacctgacagaatttgatgtgaagaacagccacctgcccagcgaggtgctgtacatgctgaagaatgtgcgggtgctgggccactttgagaagcccctcttcctggagctgtgcaagcacatcgtgtttgtgcagctgcaggagggggagcacgtgttccagccccgggagccagaccccagcatctgtgtggtgcaggacggccgcctggaggtgtgcatccaggacacagatggaacagaggtggtggtgaaggaggtgctggccggggacagcgtgcacagcctgctgagcatcctggacatcatcactggacatgctgccccctacaagacagtgtctgtgcgggccgccatccccagcaccatcctgcggctgcctgctgctgccttccatggagtgtttgagaagtacccagagaccctggtgcgggtggtgcagatcatcatggtgcggctgcagagggtgaccttcctggccctgcacaactacctgggcctgaccacagagctgttcaatgctgagagccaggccatccccctggtgtctgtggcctctgtggccgccggcaaggccaagaagcaggtgttctatggagaggaggagcggctgaagaagccaccccggctgcaggagagctgtgacagcgaccatggaggcggccggcctgctgctgctggccccctgctgaagaggagccacagcgtgcctgcccccagcatcaggaagcagatcctggaggagctggagaagccaggagctggggaccctgaccccagcgccccccaggcccgggtgctgtgcctgctgccccagtgcctgggcggcctgcccccaacagacacctctgtgtacagcagcgccagcagtgactgctgcggctgcagcatgcctgtgctgtgcatcatgggccacaagccccacgtgacagtggacacctag

SEQ ID NO: 163354 - DNA, 3765 bp, Artificial Sequence
  Description of Artificial Sequence: Synthetic coding sequence
atggaggaggagaaggatgacagcccccagctgaccggcattgctgtgggcgccctgctggccctggccctggtgggcgtgctgatcctcttcatgttccggcggctgcggcagttccggcaggcccagcccaccccccagtaccgcttcaggaagagggacaaggtgatgttttatggcaggaagatcatgaggaaggtgaccaccctgcccaacaccctggtggagaacacagccctgccccggcagagggccaggaagaggaccaaggtgctgagcctggccaagaggatcctgcgcttcaagaaggagtacccagccctgcagcccaaggagcccccacccagcctgctggaggccgacctgacagaatttgatgtgaagaacagccacctgcccagcgaggtgctgtacatgctgaagaatgtgcgggtgctgggccactttgagaagcccctcttcctggagctgtgcaagcacatcgtgtttgtgcagctgcaggagggggagcacgtgttccagccccgggagccagaccccagcatctgtgtggtgcaggacggccgcctggaggtgtgcatccaggacacagatggaacagaggtggtggtgaaggaggtgctggccggggacagcgtgcacagcctgctgagcatcctggacatcatcaccggccatgctgccccctacaagacagtgtctgtgcgggccgccatccccagcaccatcctgcggctgcctgctgctgccttccacggcgtgtttgagaagtacccagagaccctggtgcgggtggtgcagatcatcatggtgcggctgcagagggtgaccttcctggccctgcacaactacctgggcctgaccacagagctgttcaatgctgagagccaggccatccccctggtgtctgtggcctctgtggccgccggcaaggccaagaagcaggtgttctacggggaggaggagcggctgaagaagccaccccggctgcaggagagctgtgacagcgaccacggcggcggccggcctgctgctgctggccccctgctgaagaggagccacagcgtgcctgcccccagcatcaggaagcagatcctggaggagctggagaagccaggggccggggaccctgaccccagcgccccccagggcggccctggcagcgccaccagtgacctgggcatggcctgtgaccgggcccgggtcttcctgcacagtgatgagcaccctggcagctctgtggccagcaagagcaggaagtctgtgatggtggccgagatccccagcacagtgtcccagcacagcgagagccacacagatgagaccctggccagcaggaagagtgatgccatcttccgggccgccaagaaggacctgctgaccctgatgaagctggaggacagcagcctgctggatggccgggtggccctgctgcacgtgcctgctggcaccgtggtgtcccggcagggcgaccaggatgccagcatcctgtttgtggtgtctggcctgctgcacgtgtaccagaggaagattggcagccaggaggacacctgcctcttcctgaccaggcctggagagatggtgggccagctggccgtgctgactggagagcccctcatcttcaccgtgaaggccaacagagactgcagcttcctgagcatcagcaaggcccacttctatgagatcatgaggaagcagcccaccgtggtgctgggcgtggcccacacagtggtgaagaggatgagcagctttgtgcggcagattgactttgccctggactgggtggaggtggaggccggccgggccatctaccggcagggcgacaagagtgactgcacctacatcatgctgagcggccgcctgcggagcgtcatcaggaaggatgatggcaagaagaggctggccggggagtatggccgcggggacctggtgggcgtggtggagaccctgacccaccaggcccgggccaccaccgtgcatgctgtgcgggacagcgagctggccaagctgcctgctggggccctgaccagcatcaagaggcgctacccccaggtggtgaccaggctcatccacctgctgggggagaagatcctgggcagcctgcagcagggccctgtgacaggccaccagctgggcctgcccacagagggcagcaagtgggacctgggcaacccagctgtgaacctgagcacagtggccgtgatgcctgtgtctgaggaggtgcccctgacagcctttgccctggagctggagcacgccctgagcgccatcggccccaccctgctgctgaccagtgacaacatcaagaggcggctgggcagcgctgccctggacagcgtgcatgagtaccgcctgagctcctggctgggccagcaggaggacacccaccgcatcgtgctgtaccaggtggatggcaccctgaccccctggacccagagatgtgtgcggcaggccgactgcatcctgattgtgggcctgggggaccaggagcccaccgtgggggagctggagaggatgctggagagcacagctgtgcgggcccagaagcagctgatcctgctgcaccgggaggagggccctgccccagccaggacagtggagtggctgaacatgaggtcctggtgcagcggccacctgcacctgtgctgccccaggagggtcttcagccgccgcagcctgcccaagctggtggagatgtacaagcacgtgttccagaggcccccagacagacacagcgacttcagccggctggcccgggtgctgactggaaatgccatcgccctggtgctgggcggcggcggggcccggggctgtgcccaggtgggcgtgctgaaggccctggctgaatgtggcatccctgtggacatggtgggcggcaccagcatcggggcctttgtgggcgccctgtacagcgaggagaggaactacagccagatgaggatccgggccaagcagtgggccgagggcatgaccagcctgatgaaggccgccctggacctgacctaccccatcacctccatgttttctggagctggcttcaacagcagcatcttctctgtgttcaaggaccagcagatcgaggacctgtggatcccctactttgccatcaccacagacatcacagccagcgccatgagggtgcacacagatggcagcctgtggtggtacgtgcgggcctccatgagcctgagcggctacatgccacccctgtgtgaccccaaggatggccacctgctgatggatggcggctacatcaacaacctgcctgcagatgtggcccgctccatgggcgccaaggtggtgattgccattgatgtgggcagcagagatgaaacagacctgaccaactatggagatgccctgagcggctggtggctgctgtggaagcgctggaaccccctggccaccaaggtgaaggtgctgaacatggccgagatccagacccggctggcctacgtgtgctgcgtgcggcagctggaggtggtgaagagcagtgactactgtgagtacctgcggccccccatcgacagctacagcaccctggactttgggaagttcaatgagatctgtgtgcctgatgaaagtgactaccagacagaatatgaggaggagctgctggatgtgcccagagatgcctatgctgacttccagagcaccagcgcccagcagggcagtgacctggaggatgagagcagcctgcggcaccgccaccccagcctggccttccccaagctgtctgagggcagcagtgaccaggatggatag

SEQ ID NO: 163355 - DNA, 2772 bp, Artificial Sequence
  Description of Artificial Sequence: Synthetic coding sequence
atggcctgtgaccgggcccgggtcttcctgcacagtgatgagcaccctggcagctctgtggccagcaagagcaggaagtctgtgatggtggccgagatccccagcacagtgtcccagcacagcgagagccacacagatgagaccctggccagcaggaagagtgatgccatcttccgggccgccaagaaggacctgctgaccctgatgaagctggaggacagcagcctgctggatggccgggtggccctgctgcacgtgcctgctggcaccgtggtgtcccggcagggcgaccaggatgccagcatcctgtttgtggtgtctggcctgctgcacgtgtaccagaggaagattggcagccaggaggacacctgcctcttcctgaccaggcctggagagatggtgggccagctggccgtgctgactggagagcccctcatcttcaccgtgaaggccaacagagactgcagcttcctgagcatcagcaaggcccacttctatgagatcatgaggaagcagcccaccgtggtgctgggcgtggcccacacagtggtgaagaggatgagcagctttgtgcggcagattgactttgccctggactgggtggaggtggaggccggccgggccatctaccggcagggcgacaagagtgactgcacctacatcatgctgagcggccgcctgcggagcgtcatcaggaaggatgatggcaagaagaggctggccggggagtatggccgcggggacctggtgggcgtggtggagaccctgacccaccaggcccgggccaccaccgtgcatgctgtgcgggacagcgagctggccaagctgcctgctggggccctgaccagcatcaagaggcgctacccccaggtggtgaccaggctcatccacctgctgggggagaagatcctgggcagcctgcagcagggccctgtgacaggccaccagctgggcctgcccacagagggcagcaagtgggacctgggcaacccagctgtgaacctgagcacagtggccgtgatgcctgtgtctgaggaggtgcccctgacagcctttgccctggagctggagcacgccctgagcgccatcggccccaccctgctgctgaccagtgacaacatcaagaggcggctgggcagcgctgccctggacagcgtgcatgagtaccgcctgagctcctggctgggccagcaggaggacacccaccgcatcgtgctgtaccaggtggatggcaccctgaccccctggacccagagatgtgtgcggcaggccgactgcatcctgattgtgggcctgggggaccaggagcccaccgtgggggagctggagaggatgctggagagcacagctgtgcgggcccagaagcagctgatcctgctgcaccgggaggagggccctgccccagccaggacagtggagtggctgaacatgaggtcctggtgcagcggccacctgcacctgtgctgccccaggagggtcttcagccgccgcagcctgcccaagctggtggagatgtacaagcacgtgttccagaggcccccagacagacacagcgacttcagccggctggcccgggtgctgactggaaatgccatcgccctggtgctgggcggcggcggggcccggggctgtgcccaggtgggcgtgctgaaggccctggctgaatgtggcatccctgtggacatggtgggcggcaccagcatcggggcctttgtgggcgccctgtacagcgaggagaggaactacagccagatgaggatccgggccaagcagtgggccgagggcatgaccagcctgatgaaggccgccctggacctgacctaccccatcacctccatgttttctggagctggcttcaacagcagcatcttctctgtgttcaaggaccagcagatcgaggacctgtggatcccctactttgccatcaccacagacatcacagccagcgccatgagggtgcacacagatggcagcctgtggtggtacgtgcgggcctccatgagcctgagcggctacatgccacccctgtgtgaccccaaggatggccacctgctgatggatggcggctacatcaacaacctgcctgcagatgtggcccgctccatgggcgccaaggtggtgattgccattgatgtgggcagcagagatgaaacagacctgaccaactatggagatgccctgagcggctggtggctgctgtggaagcgctggaaccccctggccaccaaggtgaaggtgctgaacatggccgagatccagacccggctggcctacgtgtgctgcgtgcggcagctggaggtggtgaagagcagtgactactgtgagtacctgcggccccccatcgacagctacagcaccctggactttgggaagttcaatgagatctgtgaggtgggctaccagcacggccgcacagtgtttgacatctggggccgctctggagtgctggagaagatgctgcgggaccagcagggccccagcaagaagccagccagcgctgtgctgacctgccccaatgccagcttcacagacctggccgagatcgtgagccgcatcgagcccgccaagccagccatggtggatgatgaaagtgactaccagacagaatatgaggaggagctgctggatgtgcccagagatgcctatgctgacttccagagcaccagcgcccagcagggcagtgacctggaggatgagagcagcctgcggcaccgccaccccagcctggccttccccaagctgtctgagggcagcagtgaccaggacggctag

SEQ ID NO: 163356 - DNA, 4029 bp, Artificial Sequence
  Description of Artificial Sequence: Synthetic coding sequence
atggaggaggagaaggatgacagcccccaggccgacttctgcctgggcacagccctgcacagctggggcctgtggttcacagaggagggcagccccagcaccatgctgactggaattgctgtgggcgccctgctggccctggccctggtgggcgtgctgatcctcttcatgttccggcggctgcggcagttccggcaggcccagcccaccccccagtaccgcttcaggaagagggacaaggtgatgttctacggcaggaagatcatgaggaaggtgaccaccctgcccaacaccctggtggagaacacagccctgccccggcagagggccaggaagaggaccaaggtgctgagcctggccaagaggatcctgcgcttcaagaaggagtacccagccctgcagcccaaggagcccccacccagcctgctggaggccgacctgacagaatttgatgtgaagaacagccacctgcccagcgaggtgctgtacatgctgaagaatgtgcgggtgctgggccactttgagaagcccctcttcctggagctgtgcaagcacatcgtgtttgtgcagctgcaggagggggagcacgtgttccagccccgggagccagaccccagcatctgtgtggtgcaggacggccgcctggaggtgtgcatccaggacacagatggaacagaggtggtggtgaaggaggtgctggccggggacagcgtgcacagcctgctgagcatcctggacatcatcactggacatgctgccccctacaagacagtgtctgtgcgggccgccatccccagcaccatcctgcggctgcctgctgctgccttccatggagtgtttgagaagtacccagagaccctggtgcgggtggtgcagatcatcatggtgcggctgcagagggtgaccttcctggccctgcacaactacctgggcctgaccacagagctgttcaatgctgagagccaggccatccccctggtgtctgtggcctctgtggccgccggcaaggccaagaagcaggtgttctatggagaggaggagcggctgaagaagccaccccggctgcaggagagctgtgacagcgaccatggaggcggccggcctgctgctgctggccccctgctgaagaggagccacagcgtgcctgcccccagcatcaggaagcagatcctggaggagctggagaagccaggagctggggaccctgaccccagcgccccccagggcggccctggcagcgccaccagtgacctgggcatggcctgtgaccgggcccgggtcttcctgcacagtgatgagcaccctggcagctctgtggccagcaagagcaggaagtctgtgatggtggccgagatccccagcacagtgtcccagcacagcgagagccacacagatgagaccctggccagcaggaagagtgatgccatcttccgggccgccaagaaggacctgctgaccctgatgaagctggaggacagcagcctgctggatggccgggtggccctgctgcacgtgcctgctggcaccgtggtgtcccggcagggcgaccaggatgccagcatcctgtttgtggtgtctggcctgctgcacgtgtaccagaggaagattggcagccaggaggacacctgcctcttcctgaccaggcctggagagatggtgggccagctggccgtgctgaccggggagcccctcatcttcaccgtgaaggccaacagagactgcagcttcctgagcatcagcaaggcccacttctatgagatcatgaggaagcagcccaccgtggtgctgggcgtggcccacacagtggtgaagaggatgagcagctttgtgcggcagattgactttgccctggactgggtggaggtggaggccggccgggccatctaccggcagggcgacaagagtgactgcacctacatcatgctgagcggccgcctgcggagcgtcatcaggaaggatgatggcaagaagaggctggccggggagtatggccgcggggacctggtgggcgtggtggagaccctgacccaccaggcccgggccaccaccgtgcatgctgtgcgggacagcgagctggccaagctgcctgctggggccctgaccagcatcaagaggcgctacccccaggtggtgaccaggctcatccacctgctgggggagaagatcctgggcagcctgcagcagggccctgtgacaggccaccagctgggcctgcccacagagggcagcaagtgggacctgggcaacccagctgtgaacctgagcacagtggccgtgatgcctgtgtctgaggaggtgcccctgacagcctttgccctggagctggagcacgccctgagcgccatcggccccaccctgctgctgaccagtgacaacatcaagaggcggctgggcagcgctgccctggacagcgtgcatgagtaccgcctgagctcctggctgggccagcaggaggacacccacagaattgtgctgtaccaggtggatggcaccctgaccccctggacccagagatgtgtgcggcaggccgactgcatcctgattgtgggcctgggggaccaggagcccaccgtgggggagctggagaggatgctggagagcacagctgtgcgggcccagaagcagctgatcctgctgcaccgggaggagggccctgccccagccaggacagtggagtggctgaacatgaggtcctggtgcagcggccacctgcacctgtgctgcccccggcgggtcttcagcagaagaagcctgcccaagctggtggagatgtacaagcacgtgttccagaggcccccagacagacacagcgacttcagccggctggcccgggtgctgactggaaatgccatcgccctggtgctgggcggcggcggggcccggggctgtgcccaggtgggcgtgctgaaggccctggccgagtgtggcatccctgtggacatggtgggcggcaccagcattggagcctttgtgggcgccctgtacagcgaggagaggaactacagccagatgaggatccgggccaagcagtgggccgagggcatgaccagcctgatgaaggccgccctggacctgacctaccccatcacctccatgttcagcggggccggcttcaacagcagcatcttcagcgtcttcaaggaccagcagatcgaggacctgtggatcccctactttgccatcaccacagacatcacagccagcgccatgagggtgcacacagatggcagcctgtggtggtacgtgcgggcctccatgagcctgagcggctacatgccacccctgtgtgaccccaaggatggccacctgctgatggatggcggctacatcaacaacctgcctgcagatgtggcccgctccatgggcgccaaggtggtgattgccattgatgtgggcagcagagatgaaacagacctgaccaactatggagatgccctgagcggctggtggctgctgtggaagcgctggaaccccctggccaccaaggtgaaggtgctgaacatggccgagatccagacccggctggcctacgtgtgctgcgtgcggcagctggaggtggtgaagagcagtgactactgtgagtacctgcggccccccatcgacagctacagcaccctggactttgggaagttcaatgagatctgtgaggtgggctaccagcacggccgcacagtgtttgacatctggggccgcagcggcgtgctggagaagatgctgcgggaccagcagggccccagcaagaagccagccagcgctgtgctgacctgccccaatgccagcttcacagacctggccgagatcgtgtccagaattgaaccagccaagccagccatggtggatgatgaaagtgactaccagacagaatatgaggaggagctgctggatgtgcccagagatgcctatgctgacttccagagcaccagcgcccagcagggcagtgacctggaggatgagagcagcctgcggcaccgccaccccagcctggccttccccaagctgtctgagggcagcagtgaccaggatggatag

SEQ ID NO: 163357 - DNA, 3846 bp, Artificial Sequence
  Description of Artificial Sequence: Synthetic coding sequence
atgctgactggaattgctgtgggcgccctgctggccctggccctggtgggcgtgctgatcctcttcatgttccggcggctgcggcagttccggcaggcccagcccaccccccagtaccgcttcaggaagagggacaaggtgatgttctacggcaggaagatcatgaggaaggtgaccaccctgcccaacaccctggtggagaacacagccctgccccggcagagggccaggaagaggaccaaggtgctgagcctggccaagaggatcctgcgcttcaagaaggagtacccagccctgcagcccaaggagcccccacccagcctgctggaggccgacctgacagaatttgatgtgaagaacagccacctgcccagcgaggtgctgtacatgctgaagaatgtgcgggtgctgggccactttgagaagcccctcttcctggagctgtgcaagcacatcgtgtttgtgcagctgcaggagggggagcacgtgttccagccccgggagccagaccccagcatctgtgtggtgcaggacggccgcctggaggtgtgcatccaggacacagatggaacagaggtggtggtgaaggaggtgctggccggggacagcgtgcacagcctgctgagcatcctggacatcatcactggacatgctgccccctacaagacagtgtctgtgcgggccgccatccccagcaccatcctgcggctgcctgctgctgccttccatggagtgtttgagaagtacccagagaccctggtgcgggtggtgcagatcatcatggtgcggctgcagagggtgaccttcctggccctgcacaactacctgggcctgaccacagagctgttcaatgctgagagccaggccatccccctggtgtctgtggcctctgtggccgccggcaaggccaagaagcaggtgttctatggagaggaggagcggctgaagaagccaccccggctgcaggagagctgtgacagcgaccatggaggcggccggcctgctgctgctggccccctgctgaagaggagccacagcgtgcctgcccccagcatcaggaagcagatcctggaggagctggagaagccaggagctggggaccctgaccccagcgccccccagggcggccctggcagcgccaccagtgacctgggcatggcctgtgaccgggcccgggtcttcctgcacagtgatgagcaccctggcagctctgtggccagcaagagcaggaagtctgtgatggtggccgagatccccagcacagtgtcccagcacagcgagagccacacagatgagaccctggccagcaggaagagtgatgccatcttccgggccgccaagaaggacctgctgaccctgatgaagctggaggacagcagcctgctggatggccgggtggccctgctgcacgtgcctgctggcaccgtggtgtcccggcagggcgaccaggatgccagcatcctgtttgtggtgtctggcctgctgcacgtgtaccagaggaagattggcagccaggaggacacctgcctcttcctgaccaggcctggagagatggtgggccagctggccgtgctgaccggggagcccctcatcttcaccgtgaaggccaacagagactgcagcttcctgagcatcagcaaggcccacttctatgagatcatgaggaagcagcccaccgtggtgctgggcgtggcccacacagtggtgaagaggatgagcagctttgtgcggcagattgactttgccctggactgggtggaggtggaggccggccgggccatctaccggcagggcgacaagagtgactgcacctacatcatgctgagcggccgcctgcggagcgtcatcaggaaggatgatggcaagaagaggctggccggggagtatggccgcggggacctggtgggcgtggtggagaccctgacccaccaggcccgggccaccaccgtgcatgctgtgcgggacagcgagctggccaagctgcctgctggggccctgaccagcatcaagaggcgctacccccaggtggtgaccaggctcatccacctgctgggggagaagatcctgggcagcctgcagcagggccctgtgacaggccaccagctgggcctgcccacagagggcagcaagtgggacctgggcaacccagctgtgaacctgagcacagtggccgtgatgcctgtgtctgaggaggtgcccctgacagcctttgccctggagctggagcacgccctgagcgccatcggccccaccctgctgctgaccagtgacaacatcaagaggcggctgggcagcgctgccctggacagcgtgcatgagtaccgcctgagctcctggctgggccagcaggaggacacccacagaattgtgctgtaccaggtggatggcaccctgaccccctggacccagagatgtgtgcggcaggccgactgcatcctgattgtgggcctgggggaccaggagcccaccgtgggggagctggagaggatgctggagagcacagctgtgcgggcccagaagcagctgatcctgctgcaccgggaggagggccctgccccagccaggacagtggagtggctgaacatgaggtcctggtgcagcggccacctgcacctgtgctgcccccggcgggtcttcagcagaagaagcctgcccaagctggtggagatgtacaagcacgtgttccagaggcccccagacagacacagcgacttcagccggctggcccgggtgctgactggaaatgccatcgccctggtgctgggcggcggcggggcccggggctgtgcccaggtgggcgtgctgaaggccctggccgagtgtggcatccctgtggacatggtgggcggcaccagcattggagcctttgtgggcgccctgtacagcgaggagaggaactacagccagatgaggatccgggccaagcagtgggccgagggcatgaccagcctgatgaaggccgccctggacctgacctaccccatcacctccatgttcagcggggccggcttcaacagcagcatcttcagcgtcttcaaggaccagcagatcgaggacctgtggatcccctactttgccatcaccacagacatcacagccagcgccatgagggtgcacacagatggcagcctgtggtggtacgtgcgggcctccatgagcctgagcggctacatgccacccctgtgtgaccccaaggatggccacctgctgatggatggcggctacatcaacaacctgcctgcagatgtggcccgctccatgggcgccaaggtggtgattgccattgatgtgggcagcagagatgaaacagacctgaccaactatggagatgccctgagcggctggtggctgctgtggaagcgctggaaccccctggccaccaaggtgaaggtgctgaacatggccgagatccagacccggctggcctacgtgtgctgcgtgcggcagctggaggtggtgaagagcagtgactactgtgagtacctgcggccccccatcgacagctacagcaccctggactttgggaagttcaatgagatctgtgaggtgggctaccagcacggccgcacagtgtttgacatctggggccgcagcggcgtgctggagaagatgctgcgggaccagcagggccccagcaagaagccagccagcgctgtgctgacctgccccaatgccagcttcacagacctggccgagatcgtgtccagaattgaaccagccaagccagccatggtggatgatgaaagtgactaccagacagaatatgaggaggagctgctggatgtgcccagagatgcctatgctgacttccagagcaccagcgcccagcagggcagtgacctgtag

SEQ ID NO: 163358 - DNA, 2349 bp, Artificial Sequence
  Description of Artificial Sequence: Synthetic coding sequence
atgagcatcaacctgactgtggacatctacatctacctgctgagcaatgcccggtctgtgtgtgggaagcagaggagcaagcagctgtacttcctgttcagccccaagcactactggaggatcagccacatcagcctgcagaggggcttccacaccaacatcatccgctgcaagtggaccaagtctgaggcccacagctgcagcaagcactgctacagccccagcaaccacggcctgcacatcggcatcctgaagctgagcaccagcgcccccaagggcctgaccaaggtgaacatctgcatgagccgcatcaagagcaccctgaacagcgtgtccaaggctgtgtttggaaaccagaatgagatgatcagccggctggcccagttcaagcccagcagccagatcctgaggaaggtgtctgacagcggctggctgaagcagaagaacatcaagcaggccatcaagagcctgaagaagtacagcgacaagtctgctgagaagagccccttccctgaggagaagagccacatcatcgacaaggaggaggacatcggcaagaggagcctcttccactacaccagcagcatcaccaccaagtttggagacagcttctacttcctgagcaaccacatcaacagctacttcaagaggaaggagaagatgagccagcagaaggaaaatgagcacttccgggacaagtctgagctggaggacaagaaggtggaggagggcaagctgcggagcccagaccccggcatcctggcctacaagccaggcagcgagagcgtgcacacagtggacaagcccaccagccccagcgccatcccagatgtgctgcaggtgtccaccaagcagagcatcgccaacttcctgagccggcccacagaaggagtgcaggccctggtgggcggctacatcggcggcctggtgcccaagctgaagtatgacagcaagagccagagcgaggagcaggaggagcccgccaagacagaccaggccgtgtccaaggacagaaatgctgaggagaagaagaggctgagcctgcagcgggagaagatcatcgcccgggtgtccattgacaacagaacccgggccctggtgcaggccctgcggaggaccacagaccccaagctgtgcatcaccagggtggaggagctgaccttccacctgctggagttccctgagggcaaaggagtggccgtgaaggagcgcatcatcccctacctgctgcggctgcggcagatcaaggatgagaccctgcaggccgctgtgcgggagatcctggccctgattggctacgtggaccctgtgaagggccggggcatccgcatcctgagcattgatggcggcggcacccggggcgtggtggccctgcagaccctgaggaagctggtggagctgacccagaagcctgtgcaccagctgtttgactacatctgtggggtgtccactggagccatcctggccttcatgctgggcctcttccacatgcccctggatgaatgtgaggagctgtacaggaagctgggcagtgatgtgttcagccagaatgtgattgtgggcaccgtgaagatgtcctggagccacgccttctatgacagccagacctgggagaacatcctgaaggacaggatgggcagcgccctgatgattgaaacagccaggaaccccacctgccccaaggtggccgctgtgtccaccatcgtgaacagaggcatcacccccaaggcctttgtgttcagaaattatggccacttccctggcatcaacagccactacctgggcggctgccagtacaagatgtggcaggccatccgggccagcagcgctgcccctggctactttgctgaatatgccctgggcaatgacctgcaccaggacggcggcctgctgctgaacaaccccagcgccctggccatgcatgagtgcaagtgcctgtggccagatgtgcccctggagtgcatcgtgtccctgggcaccggccgctatgaaagtgatgtgaggaacacagtgacctacaccagcctgaagaccaagctgagcaatgtcatcaacagcgccacagacacagaggaggtgcacatcatgctggatggcctgctgcccccagacacctacttccgcttcaaccctgtgatgtgtgagaacatccccctggatgagagcagaaatgagaagctggaccagctgcagctggagggcctgaagtacatcgagagaaatgagcagaagatgaagaaggtggccaagatcctgagccaggagaagaccaccctgcagaagatcaatgactggatcaagctgaagacagacatgtatgagggcctgcccttcttcagcaagctgtag

SEQ ID NO: 163359 - DNA, 2163 bp, Artificial Sequence
  Description of Artificial Sequence: Synthetic coding sequence
atgagcatcaacctgactgtggacatctacatctacctgctgagcaatgcccggtctgtgtgtgggaagcagaggagcaagcagctgtacttcctgttcagccccaagcactactggaggatcagccacatcagcctgcagaggggcttccacaccaacatcatccgctgcaagtggaccaagtctgaggcccacagctgcagcaagcactgctacagccccagcaaccacggcctgcacatcggcatcctgaagctgagcaccagcgcccccaagggcctgaccaaggtgaacatctgcatgagccgcatcaagagcaccctgaacagcgtgtccaaggctgtgtttggaaaccagaatgagatgatcagccggctggcccagttcaagcccagcagccagatcctgaggaaggtgtctgacagcggctggctgaagcagaagaacatcaagcaggccatcaagagcctgaagaagtacagcgacaagtctgctgagaagagccccttccctgaggagaagagccacatcatcgacaaggaggaggacatcggcaagaggagcctcttccactacaccagcagcatcaccaccaagtttggagacagcttctacttcctgagcaaccacatcaacagctacttcaagaggaaggagaagatgagccagcagaaggaaaatgagcacttccgggacaagtctgagctggaggacaagaaggtggaggagggcaagctgcggagcccagaccccggcatcctggcctacaagccaggcagcgagagcgtgcacacagtggacaagcccaccagccccagcgccatcccagatgtgctgcaggtgtccaccaagcagagcatcgccaacttcctgagccggcccacagaaggagtgcaggccctggtgggcggctacatcggcggcctggtgcccaagctgaagtatgacagcaagagccagagcgaggagcaggaggagcccgccaagacagaccaggccgtgtccaaggacagaaatgctgaggagaagaagaggctgagcctgcagcgggagaagatcatcgcccgggtgtccattgacaacagaacccgggccctggtgcaggccctgcggaggaccacagaccccaagctgtgcatcaccagggtggaggagctgaccttccacctgctggagttccctgagggcaaaggagtggccgtgaaggagcgcatcatcccctacctgctgcggctgcggcagatcaaggatgagaccctgcaggccgctgtgcgggagatcctggccctgattggctacgtggaccctgtgaagggccggggcatccgcatcctgagcattgatggcggcggcacccggggcgtggtggccctgcagaccctgaggaagctggtggagctgacccagaagcctgtgcaccagctgtttgactacatctgtggggtgtccactggagccatcctggccttcatgctgggcctcttccacatgcccctggatgaatgtgaggagctgtacaggaagctgggcagtgatgtgttcagccagaatgtgattgtgggcaccgtgaagatgtcctggagccacgccttctatgacagccagacctgggagaacatcctgaaggacaggatgggcagcgccctgatgattgaaacagccaggaaccccacctgccccaaggtgaggaaggatggcggcctgctgctgaacaaccccagcgccctggccatgcatgagtgcaagtgcctgtggccagatgtgcccctggagtgcatcgtgtccctgggcaccggccgctatgaaagtgatgtgaggaacacagtgacctacaccagcctgaagaccaagctgagcaatgtcatcaacagcgccacagacacagaggaggtgcacatcatgctggatggcctgctgcccccagacacctacttccgcttcaaccctgtgatgtgtgagaacatccccctggatgagagcagaaatgagaagctggaccagctgcagctggagggcctgaagtacatcgagagaaatgagcagaagatgaagaaggtggccaagatcctgagccaggagaagaccaccctgcagaagatcaatgactggatcaagctgaagacagacatgtatgagggcctgcccttcttcagcaagctgtag

SEQ ID NO: 163360 - DNA, 168 bp, Artificial Sequence
  Description of Artificial Sequence: Synthetic coding sequence
atgagcatcaacctgactgtggacatctacatctacctgctgagcaatgcccggtctgtgtgtgggaagcagaggagcaagcagctgtacttcctgttcagccccaagcactactggaggatcagccacatcagcctgcagaggggcttccacaccaacatcatctag

SEQ ID NO: 163361 - DNA, 2349 bp, Artificial Sequence; identical to SEQ ID NO: 163358
  Description of Artificial Sequence: Synthetic coding sequence

SEQ ID NO: 163362 - DNA, 582 bp, Artificial Sequence
  Description of Artificial Sequence: Synthetic coding sequence
atgagcatcaacctgactgtggacatctacatctacctgctgagcaatgcccggtctgtgtgtgggaagcagaggagcaagcagctgtacttcctgttcagccccaagcactactggaggatcagccacatcagcctgcagaggggcttccacaccaacatcatccgctgcaagtggaccaagtctgaggcccacagctgcagcaagcactgctacagccccagcaaccacggcctgcacatcggcatcctgaagctgagcaccagcgcccccaagggcctgaccaaggtgaacatctgcatgagccgcatcaagagcaccctgaacagcgtgtccaaggctgtgtttggaaaccagaatgagatgatcagccggctggcccagttcaagcccagcagccagatcctgaggaaggtgtctgacagcggctggctgaagcagaagaacatcaagcaggccatcaagagcctgaagaagtacagcgacaagtctgctgagaagagccccttccctgaggagaagagccacatcatcgacaaggaggaggacatcggcaagaggagcctcttccactacacctag

SEQ ID NO: 163363 - DNA, 2349 bp, Artificial Sequence; identical to SEQ ID NO: 163358
  Description of Artificial Sequence: Synthetic coding sequence

SEQ ID NO: 163364 - DNA, 2154 bp, Artificial Sequence
  Description of Artificial Sequence: Synthetic coding sequence
atgagcatcaacctgactgtggacatctacatctacctgctgagcaatgcccggtctgtgtgtgggaagcagaggagcaagcagctgtacttcctgttcagccccaagcactactggaggatcagccacatcagcctgcagaggggcttccacaccaacatcatccgctgcaagtggaccaagtctgaggcccacagctgcagcaagcactgctacagccccagcaaccacggcctgcacatcggcatcctgaagctgagcaccagcgcccccaagggcctgaccaaggtgaacatctgcatgagccgcatcaagagcaccctgaacagcgtgtccaaggctgtgtttggaaaccagaatgagatgatcagccggctggcccagttcaagcccagcagccagatcctgaggaaggtgtctgacagcggctggctgaagcagaagaacatcaagcaggccatcaagagcctgaagaagtacagcgacaagtctgctgagaagagccccttccctgaggagaagagccacatcatcgacaaggaggaggacatcggcaagaggagcctcttccactacaccagcagcatcaccaccaagtttggagacagcttctacttcctgagcaaccacatcaacagctacttcaagaggaaggagaagatgagccagcagaaggaaaatgagcacttccgggacaagtctgagctggaggacaagaaggtggaggagggcaagctgcggagcccagaccccggcatcctggcctacaagccaggcagcgagagcgtgcacacagtggacaagcccaccagccccagcgccatcccagatgtgctgcaggtgtccaccaagcagagcatcgccaacttcctgagccggcccacagaaggagtgcaggccctggtgggcggctacatcggcggcctggtgcccaagctgaagtatgacagcaagagccagagcgaggagcaggaggagcccgccaagacagaccaggccgtgtccaaggacagaaatgctgaggagaagaagaggctgagcctgcagcgggagaagatcatcgcccgggtgtccattgacaacagaacccgggccctggtgcaggccctgcggaggaccacagaccccaagctgtgcatcaccagggtggaggagctgaccttccacctgctggagttccctgagggcaaaggagtggccgtgaaggagcgcatcatcccctacctgctgcggctgcggcagatcaaggatgagaccctgcaggccgctgtgcgggagatcctggccctgattggctacgtggaccctgtgaagggccggggcatccgcatcctgagcattgatggcggcggcacccggggcgtggtggccctgcagaccctgaggaagctggtggagctgacccagaagcctgtgcaccagctgtttgactacatctgtggggtgtccactggagccatcctggccttcatgctgggcctcttccacatgcccctggatgaatgtgaggagctgtacaggaagctgggcagtgatgtgttcagccagaatgtgattgtgggcaccgtgaagatgtcctggagccacgccttctatgacagccagacctgggagaacatcctgaaggacaggatgggcagcgccctgatgattgaaacagccaggaaccccacctgccccaaggatggcggcctgctgctgaacaaccccagcgccctggccatgcatgagtgcaagtgcctgtggccagatgtgcccctggagtgcatcgtgtccctgggcaccggccgctatgaaagtgatgtgaggaacacagtgacctacaccagcctgaagaccaagctgagcaatgtcatcaacagcgccacagacacagaggaggtgcacatcatgctggatggcctgctgcccccagacacctacttccgcttcaaccctgtgatgtgtgagaacatccccctggatgagagcagaaatgagaagctggaccagctgcagctggagggcctgaagtacattgaaagaaatgagcagaagatgaagaaggtggccaagatcctgagccaggagaagaccaccctgcagaagatcaatgactggatcaagctgaagacagacatgtatgagggcctgcccttcttcagcaagctgtag

SEQ ID NO: 163365 - DNA, 2049 bp, Artificial Sequence
  Description of Artificial Sequence: Synthetic coding sequence
atgagccgcatcaagagcaccctgaacagcgtgtccaaggctgtgtttggaaaccagaatgagatgatcagccggctggcccagttcaagcccagcagccagatcctgaggaaggtgtctgacagcggctggctgaagcagaagaacatcaagcaggccatcaagagcctgaagaagtacagcgacaagtctgctgagaagagccccttccctgaggagaagagccacatcatcgacaaggaggaggacatcggcaagaggagcctcttccactacaccagcagcatcaccaccaagtttggagacagcttctacttcctgagcaaccacatcaacagctacttcaagaggaaggagaagatgagccagcagaaggaaaatgagcacttccgggacaagtctgagctggaggacaagaaggtggaggagggcaagctgcggagcccagaccccggcatcctggcctacaagccaggcagcgagagcgtgcacacagtggacaagcccaccagccccagcgccatcccagatgtgctgcaggtgtccaccaagcagagcatcgccaacttcctgagccggcccacagaaggagtgcaggccctggtgggcggctacatcggcggcctggtgcccaagctgaagtatgacagcaagagccagagcgaggagcaggaggagcccgccaagacagaccaggccgtgtccaaggacagaaatgctgaggagaagaagaggctgagcctgcagcgggagaagatcatcgcccgggtgtccattgacaacagaacccgggccctggtgcaggccctgcggaggaccacagaccccaagctgtgcatcaccagggtggaggagctgaccttccacctgctggagttccctgagggcaaaggagtggccgtgaaggagcgcatcatcccctacctgctgcggctgcggcagatcaaggatgagaccctgcaggccgctgtgcgggagatcctggccctgattggctacgtggaccctgtgaagggccggggcatccgcatcctgagcattgatggcggcggcacccggggcgtggtggccctgcagaccctgaggaagctggtggagctgacccagaagcctgtgcaccagctgtttgactacatctgtggggtgtccactggagccatcctggccttcatgctgggcctcttccacatgcccctggatgaatgtgaggagctgtacaggaagctgggcagtgatgtgttcagccagaatgtgattgtgggcaccgtgaagatgtcctggagccacgccttctatgacagccagacctgggagaacatcctgaaggacaggatgggcagcgccctgatgattgaaacagccaggaaccccacctgccccaaggtggccgctgtgtccaccatcgtgaacagaggcatcacccccaaggcctttgtgttcagaaattatggccacttccctggcatcaacagccactacctgggcggctgccagtacaagatgtggcaggccatccgggccagcagcgctgcccctggctactttgctgaatatgccctgggcaatgacctgcaccaggacggcggcctgctgctgaacaaccccagcgccctggccatgcatgagtgcaagtgcctgtggccagatgtgcccctggagtgcatcgtgtccctgggcaccggccgctatgaaagtgatgtgaggaacacagtgacctacaccagcctgaagaccaagctgagcaatgtcatcaacagcgccacagacacagaggaggtgcacatcatgctggatggcctgctgcccccagacacctacttccgcttcaaccctgtgatgtgtgagaacatccccctggatgagagcagaaatgagaagctggaccagctgcagctggagggcctgaagtacatcgagagaaatgagcagaagatgaagaaggtggccaagatcctgagccaggagaagaccaccctgcagaagatcaatgactggatcaagctgaagacagacatgtatgagggcctgcccttcttcagcaagctgtag

SEQ ID NO: 163366 - DNA, 3612 bp, Artificial Sequence
  Description of Artificial Sequence: Synthetic coding sequence
atgaccaggagcccccccctgcgggagctgcccccatcctacaccccaccagccaggacagctgccccccagatcctggccggcagcctgaaggcccccctgtggctgcgggcctacttccagggcctgctcttcagcctgggctgcggcatccagaggcactgcggcaaggtgctcttcctgggcctgctggccttcggggccctggccctgggcctgaggatggccatcatcgagaccaacctggagcagctgtgggtggaggtgggcagccgggtgtcccaggagctgcactacaccaaggagaagctgggggaggaggccgcctacaccagccagatgctgatccagacagcccggcaggagggggagaacatcctgaccccagaggccctgggcctgcacctgcaggccgccctgacagccagcaaggtgcaggtgtccctgtatggcaagtcctgggacctgaacaagatctgctacaagtctggagtgcccctgattgaaaatggcatgattgaaagaatgattgagaagctgttcccctgtgtgatcctgacccccctggactgcttctgggagggcgccaagctgcagggcggcagcgcctacctgcccggccgcccagacatccagtggaccaacctggaccctgagcagctgctggaggagctgggcccctttgccagcctggagggcttccgggagctgctggacaaggcccaggtgggccaggcctacgtgggccggccctgcctgcacccagatgacctgcactgccccccatctgcccccaaccaccacagccggcaggcccccaacgtggcccacgagctgagcggcggctgccacggcttcagccacaagttcatgcactggcaggaggagctgctgctgggcggcatggcccgggacccccagggcgagctgctgcgggcagaggccctgcagagcaccttcctgctgatgagcccccggcagctgtatgagcacttccggggggactaccagacccatgacatcggctggagcgaggagcaggccagcacagtgctgcaggcctggcagaggagatttgtgcagctggcccaggaggccctgcctgaaaatgccagccagcagatccacgccttcagcagcaccaccctggatgacatcctgcacgccttcagcgaggtgtctgctgcccgggtggtgggcggctacctgctgatgctggcctatgcctgtgtgaccatgctgcgctgggactgtgcccagagccagggctctgtgggcctggccggcgtgctgctggtggccctggccgtggccagcggcctgggcctgtgtgccctgctgggcatcaccttcaatgctgccaccacccaggtgctgcccttcctggccctgggcatcggcgtggatgatgtgttcctgctggcccacgccttcacagaggccctgcccggcacccccctgcaggagaggatgggagaatgtctgcagaggacaggcacctctgtggtgctgaccagcatcaacaacatggccgccttcctgatggccgccctggtgcccatcccagccctgcgggccttcagcctgcaggccgccatcgtggtgggctgcacctttgtggccgtgatgctggtgtttcctgccatcctgagcctggacctgcggcggcggcactgccagaggctggatgtgctgtgctgcttcagcagcccctgcagcgcccaggtgatccagatcctgccccaggagctgggagatggcaccgtgcctgtgggcatcgcccacctgacagccaccgtgcaggccttcacccactgtgaggccagcagccagcacgtggtgaccatcctgcccccccaggcccacctggtgcccccacccagcgaccccctgggcagcgagctgttcagccctgggggcagcacccgggacctgctgggccaggaggaggagacccggcagaaggccgcctgcaagagcctgccctgtgcccgctggaacctggcccactttgcccgctaccagtttgcccccctgctgctgcagagccacgccaaggccatcgtgctggtgctgtttggagccctgctgggcctgagcctgtatggagccaccctggtgcaggacggcctggccctgacagatgtggtgccccggggcaccaaggagcacgccttcctgagcgcccagctgcgctacttcagcctgtatgaggtggccctggtgacccagggcggctttgattatgcccacagccagagggccctgtttgacctgcaccagcgcttcagcagcctgaaggctgtgctgcccccaccagccacccaggcccccaggacctggctgcactactacagaaactggctgcagggcatccaggccgcctttgaccaggactgggccagcggccgcatcaccaggcacagctacagaaatggaagtgaagatggagccctggcctacaagctgctgatccagacaggagatgcccaggagcccctggacttcagccagctgaccaccaggaagctggtggaccgggagggcctcatccccccagagctgttctacatgggcctgactgtgtgggtgtccagtgaccccctgggcctggccgccagccaggccaacttctacccacctcctcctgagtggctgcatgacaagtatgacaccactggagagaacctgcgcatccccccagcccagcccctggagtttgcccagttccccttcctgctgcggggcctgcagaagacagctgactttgtggaggccattgaaggagcccgggccgcctgtgccgaggccggccaggccggcgtgcacgcctaccccagcggcagccccttcctgttctgggagcagtacctgggcctgcggcgctgcttcctgctggccgtgtgcatcctgctggtgtgcaccttcctggtgtgtgccctgctgctgctgaacccctggacagctggcctcatcgtgctggtgctggccatgatgacagtggagctgtttggcatcatgggcttcctgggcatcaagctgagcgccatccctgtggtgatcctggtggcctctgtgggcatcggcgtggagttcaccgtgcacgtggccctgggcttcctgaccacccagggcagcaggaacctgcgggccgcccacgccctggagcacacctttgcccctgtgacagatggagccatcagcaccctgctgggcctgctgatgctggccggcagccactttgacttcatcgtgcgctacttctttgctgccctgactgtgctgaccctgctgggcctgctgcacggcctggtgctgctgcctgtgctgctgagcatcctgggccccccacctgaggtgatccagatgtacaaggagagccctgagatcctgagccccccagccccccagggcggcggcctgcgctggggcgccagcagcagcctgccccagagctttgcccgggtgaccacctccatgacagtggccatccaccccccacccctgcccggggcctacatccacccagccccagatgagcccccctggagccctgctgccaccagcagcggcaacctgagcagccggggccctggccctgccaccggctag

SEQ ID NO: 163367 - DNA, 267 bp, Artificial Sequence
  Description of Artificial Sequence: Synthetic coding sequence
tgatttgacttcatcgtgcgctacttctttgctgccctgactgtgctgaccctgctgggcctgctgcacggcctggtgctgctgcctgtgctgctgagcatcctgggccccccacctgaggtgatccagatgtacaaggagagccctgagatcctgagccccccagccccccagggcggcggcctgcgggtgggcagcctgcaggtgaacatctcctactggaaggagctgctgtggtgccaggacctgcggcctgaggagatctag

SEQ ID NO: 163368 - DNA, 3441 bp, Artificial Sequence
  Description of Artificial Sequence: Synthetic coding sequence
atgaccaggagcccccccctgcgggagctgcccccatcctacaccccaccagccaggacagctgccccccagatcctggccggcagcctgaaggcccccctgtggctgcgggcctacttccagggcctgctcttcagcctgggctgcggcatccagaggcactgcggcaaggtgctcttcctgggcctgctggccttcggggccctggccctgggcctgaggatggccatcatcgagaccaacctggagcagctgtgggtggaggtgggcagccgggtgtcccaggagctgcactacaccaaggagaagctgggggaggaggccgcctacaccagccagatgctgatccagacagcccggcaggagggggagaacatcctgaccccagaggccctgggcctgcacctgcaggccgccctgacagccagcaaggtgcaggtgtccctgtatggcaagtcctgggacctgaacaagatctgctacaagtctggagtgcccctgattgaaaatggcatgattgaaagaatgattgagaagctgttcccctgtgtgatcctgacccccctggactgcttctgggagggcgccaagctgcagggcggcagcgcctacctgcccggccgcccagacatccagtggaccaacctggaccctgagcagctgctggaggagctgggcccctttgccagcctggagggcttccgggagctgctggacaaggcccaggtgggccaggcctacgtgggccggccctgcctgcacccagatgacctgcactgccccccatctgcccccaaccaccacagccggcaggcccccaacgtggcccacgagctgagcggcggctgccacggcttcagccacaagttcatgcactggcaggaggagctgctgctgggcggcatggcccgggacccccagggcgagctgctgcgggcagaggccctgcagagcaccttcctgctgatgagcccccggcagctgtatgagcacttccggggggactaccagacccatgacatcggctggagcgaggagcaggccagcacagtgctgcaggcctggcagaggagatttgtgcagctggcccaggaggccctgcctgaaaatgccagccagcagatccacgccttcagcagcaccaccctggatgacatcctgcacgccttcagcgaggtgtctgctgcccgggtggtgggcggctacctgctgatgctggcctatgcctgtgtgaccatgctgcgctgggactgtgcccagagccagggctctgtgggcctggccggcgtgctgctggtggccctggccgtggccagcggcctgggcctgtgtgccctgctgggcatcaccttcaatgctgccaccacccaggtgctgcccttcctggccctgggcatcggcgtggatgatgtgttcctgctggcccacgccttcacagaggccctgcccggcacccccctgcaggagaggatgggagaatgtctgcagaggacaggcacctctgtggtgctgaccagcatcaacaacatggccgccttcctgatggccgccctggtgcccatcccagccctgcgggccttcagcctgcaggccgccatcgtggtgggctgcacctttgtggccgtgatgctggtgtttcctgccatcctgagcctggacctgcggcggcggcactgccagaggctggatgtgctgtgctgcttcagcagcccctgcagcgcccaggtgatccagatcctgccccaggagctgggagatggcaccgtgcctgtgggcatcgcccacctgacagccaccgtgcaggccttcacccactgtgaggccagcagccagcacgtggtgaccatcctgcccccccaggcccacctggtgcccccacccagcgaccccctgggcagcgagctgttcagccctgggggcagcacccgggacctgctgggccaggaggaggagacccggcagaaggccgcctgcaagagcctgccctgtgcccgctggaacctggcccactttgcccgctaccagtttgcccccctgctgctgcagagccacgccaaggccatcgtgctggtgctgtttggagccctgctgggcctgagcctgtatggagccaccctggtgcaggacggcctggccctgacagatgtggtgccccggggcaccaaggagcacgccttcctgagcgcccagctgcgctacttcagcctgtatgaggtggccctggtgacccagggcggctttgattatgcccacagccagagggccctgtttgacctgcaccagcgcttcagcagcctgaaggctgtgctgcccccaccagccacccaggcccccaggacctggctgcactactacagaaactggctgcagggcatccaggccgcctttgaccaggactgggccagcggccgcatcaccaggcacagctacagaaatggaagtgaagatggagccctggcctacaagctgctgatccagacaggagatgcccaggagcccctggacttcagccagctgaccaccaggaagctggtggaccgggagggcctcatccccccagagctgttctacatgggcctgactgtgtgggtgtccagtgaccccctgggcctggccgccagccaggccaacttctacccacctcctcctgagtggctgcatgacaagtatgacaccactggagagaacctgcgcatccccccagcccagcccctggagtttgcccagttccccttcctgctgcggggcctgcagaagacagctgactttgtggaggccattgaaggagcccgggccgcctgtgccgaggccggccaggccggcgtgcacgcctaccccagcggcagccccttcctgttctgggagcagtacctgggcctgcggcgctgcttcctgctggccgtgtgcatcctgctggtgtgcaccttcctggtgtgtgccctgctgctgctgaacccctggacagctggcctcatcgtgctggtgctggccatgatgacagtggagctgtttggcatcatgggcttcctgggcatcaagctgagcgccatccctgtggtgatcctggtggcctctgtgggcatcggcgtggagttcaccgtgcacgtggccctgggcttcctgaccacccagggcagcaggaacctgcgggccgcccacgccctggagcacacctttgcccctgtgacagatggagccatcagcaccctgctgggcctgctgatgctggccggcagccactttgacttcatcgtgcgctacttctttgctgccctgactgtgctgaccctgctgggcctgctgcacggcctggtgctgctgcctgtgctgctgagcatcctgggccccccacctgaggtgatccagatgtacaaggagagccctgagatcctgagccccccagccccccagggcggcggcctgcggcctgaggagatctag

SEQ ID NO: 163369 - DNA, 2667 bp, Artificial Sequence
  Description of Artificial Sequence: Synthetic coding sequence
atgctgcggcaggtgctgcaccggggcctgcggacctgcttcagccggctgggccacttcatcgccagccaccctgtgttctttgccagcgcccctgtgctgatcagcatcctgctgggcgccagcttcagccgctaccaggtggaggagagcgtggagcacctgctggccccccagcacagcctggccaagattgaaagaaacctggtgaacagcctcttccctgtgaacagaagcaagcaccggctgtacagcgacctgcagaccccaggccgctatggccgggtgattgtgaccagcttccagaaggccaacatgctggaccagcaccacacagacctgatcctgaagctgcacgccgctgtgaccaagatccaggtgccccggcccggcttcaactacacctttgcccacatctgcatcctgaacaatgacaagacctgcatcgtggatgacatcgtgcacgtgctggaggagctgaagaatgcccgggccaccaacagaaccaactttgccatcacctaccccatcacccacctgaaggatggccgggctgtgtacaacggccaccagctgggcggcgtgacagtgcacagcaaggacagagtgaagtctgctgaggccatccagctgacctactacctgcagagcatcaacagcctgaatgacatggtggccgagcgctgggagagcagcttctgtgacacagtgcggctcttccagaagagcaacagcaaggtgaagatgtacccctacaccagcagcagcctgcgggaggacttccagaagaccagccgggtgtctgagcgctacctggtgaccagcctcatcctggtggtgaccatggccatcctgtgctgcagcatgcaggactgtgtgcgcagcaagccctggctgggcctgctgggcctggtgaccatcagcctggccaccctgacagctgctggcatcatcaacctgactggaggcaagtacaacagcaccttcctgggcgtgccctttgtgatgctgggccacggcctgtatggcacctttgagatgctgagctcctggaggaagacccgggaggaccagcacgtgaaggagaggacagctgctgtgtatgctgacagcatgctgtccttcagcctgaccacagccatgtacctggtgaccttcggcatcggggccagccccttcaccaacatcgaggccgcccgcatcttctgctgcaacagctgcatcgccatcttcttcaactacctgtatgtgctgtccttctacggcagcagcctggtgttcaccggctacatcgagaacaactaccagcacagcatcttctgcaggaaggtgcccaagccagaggccctgcaggagaagccagcctggtaccgcttcctgctgacagcccgcttcagcgaggacacagctgagggggaggaggccaacacctatgagagccacctgctggtgtgcttcctgaagcgctactactgtgactggatcaccaacacctacgtgaagccctttgtggtgctcttctacctgatctacatcagctttgccctgatgggctacctgcaggtgtctgagggcagtgacctgagcaacatcgtggccacagccacccagaccatcgagtacaccacagcccagcagaagtacttcagcaactacagccctgtgattggcttctacatctatgagagcattgagtactggaacacctctgtgcaggaggatgtgctggagtacaccaagggctttgtgcgcatctcctggtttgagagctacctgaactacctgaggaagctgaatgtgtccacaggcctgcccaagaagaacttcacagacatgctgaggaacagcttcctgaaggccccccagttcagccacttccaggaggacatcatcttcagcaagaagtacaatgatgaggtggatgtggtggccagcaggatgttcctggtggccaagaccatggagaccaaccgggaggagctgtatgacctgctggagaccctgcggcggctgtctgtgaccagcaaggtgaagttcatcgtgttcaaccccagctttgtgtacatggacagatatgccagcagcctgggcgcccccctgcacaacagctgcatcagcgccctcttcctgctcttcttcagcgccttcctggtggccgacagcctcatcaacgtgtggatcaccctgactgtggtgtctgtggagtttggagtgattggcttcatgaccctgtggaaggtggagctggactgcatctctgtgctgtgcctgatctacggcatcaactacaccatcgacaactgtgcccccatgctgagcacctttgtgctgggcaaggacttcaccaggaccaagtgggtgaagaatgccctggaggtgcacggcgtggccatcctgcagagctacctgtgctacatcgtgggcctcatccccctggccgctgtgcccagcaacctgacctgcaccctcttccgctgcctcttcctgattgcctttgtgaccttcttccactgctttgccatcctgcctgtgatcctgaccttcctgccccccagcaagaagaagaggaaggagaagaagaacccagaaaatcgggaggagattgaatgtgtggagatggtggacatcgacagcaccagggtggtggaccagatcaccaccgtgtag

SEQ ID NO: 163370 - DNA, 4179 bp, Artificial Sequence
  Description of Artificial Sequence: Synthetic coding sequence
atggacacagaagatgaccccctgctgcaggatgtgtggctggaggaggagcaggaggaggaggaggccaccggggagaccttcctgggcgcccagaagccaggcccccagcccggggccggcggccagtgctgctggaggcactggcccctggccagccggcccccagccagcggcttctggagcaccctgggctgggccttcaccaacccctgctgtgccggcctggtgctcttcctgggctgcagcatccccatggccctgagcgccttcatgttcctgtactacccacccctggacatcgacatctcctacaatgcctttgagatcagaaatcatgaggccagccagagatttgatgccctgaccctggccctgaagagccagtttggctcctggggcaggaacagaagagacctggccgacttcaccagcgagaccctgcagaggctcatcagcgagcagctgcagcagctgcacctgggcaacagaagccggcaggccagccgggcccccagggtcatcccagctgccagcctgggcggccctggcccctacagagacaccagcgctgcccagaagcccacagccaacagaagtggccgcctgcggcgggagaccccacccctggaggacctggccgccaaccagagcgaggaccccaggaaccagaggctgagcaagaatggccgctaccagcccagcatcccccctcatgctgctgtggccgccaaccagagccgggcccggcggggggccagccgctgggactacagccgggcctacgtgtctgccaacacccagacccacgcccactggagaattgagctgatcttcctggcccggggagatgctgagaggaacatcttcaccagcgagcggctggtgaccatccatgaaattgaaaggaagatcatggaccaccctggcttccgggagttctgctggaagccccatgaggtgctgaaggacctgcccctgggcagctacagctactgcagcccccccagcagcctgatgacctacttcttccccacagagcggggcggcaagatctactatgatggcatgggccaggacctggccgacatccggggcagcctggagctggccatgacccaccctgagttctactggtacgtggatgagggcctgtctgctgacaacctgaagagcagcctgctgcggtctgagatcctgtttggagcccccctgcccaactactacagcgtggatgaccgctgggaggagcagagggccaagttccagagctttgtggtgacctacgtggccatgctggccaagcagagcaccagcaaggtgcaggtgctgtatggaggaacagacctgtttgattatgaggtgcggaggaccttcaacaatgacatgctgctggccttcatcagcagcagctgcatcgccgccctggtgtacatcctgaccagctgcagcgtcttcctgtccttcttcggcatcgccagcatcggcctgagctgcctggtggccctcttcctgtaccacgtggtgtttggcatccagtacctgggcatcctgaatggagtggccgccttcgtcatcgtgggcattggagtggatgatgtgtttgtgttcatcaacacctaccggcaggccacccacctggaggacccccagctgaggatgatccacacagtgcagacagctgggaaggccaccttcttcaccagcctgaccacagctgctgcctatgctgccaacgtgttcagccagatcccagctgtgcatgactttggcctcttcatgagcctgattgtgtcctgctgctggctggccgtgctggtgaccatgcctgctgccctgggcctgtggagcctgtacctggcccccctggagagcagctgccagaccagctgccaccagaactgcagcaggaagaccagcctgcacttccctggagatgtgtttgctgcccctgagcaggtgggcggcagccctgcccagggccccatcccctacctggatgatgacatccccctgctggaggtggaggaggagcctgtgtccctggagctgggagatgtgtccctggtgtctgtgtccccagagggcctgcagcctgccagcaacacaggcagccggggccacctgattgtgcagctgcaggagctgctgcaccactgggtgctgtggagcgctgtgaagagccgctgggtgattgtgggcctgtttgtgtccatcctgatcctgagcctggtgtttgccagccggctgcggcctgccagccgggcccccctgctcttccggccagacaccaacatccaggtgctgctggacctgaagtacaacctgtctgctgagggcatcagctgcatcacctgcagcggcctcttccaggagaagccccacagcctgcagaacaacatccgcaccagcctggagaagaagagaagaggcagcggcgtgccctgggccagcaggcctgaggccaccctgcaggacttccctggcaccgtgtacatcagcaaggtgaagagccagggccaccctgctgtgtaccgcctgagcctgaatgccagcctgcctgccccctggcaggccgtgtccccaggagatggagaggtgcccagcttccaggtgtaccgggccccctttggaaacttcaccaagaagctgacagcctgcatgagcacagtgggcctgctgcaggccgccagccccagcaggaagtggatgctgaccaccctggcctgtgatgccaagaggggctggaagtttgacttctccttctacgtggccaccaaggagcagcagcacaccaggaagctgtactttgcccagagccacaagccacccttccacggccgggtgtgcatggcccctcctggctgcctgctgagcagcagcccagatggccccaccaagggcttcttctttgtgcccagcgagaaggtgcccaaggcccggctgagcgccaccttcggcttcaacccctgtgtgaacacaggctgtgggaagccagctgtgcggcccctggtggacacaggagccatggtgtttgtggtgtttggcatcatcggcgtgaacagaacccggcaggtggacaaccacgtgattggagaccccggctctgtggtgtatgacagcagctttgacctcttcaaggagatcggccacctgtgccacctgtgcaaggccatcgccgccaacagcgagctggtgaagccaggaggagcccagtgcctgcccagcggctacagcatcagcagcttcctgcagatgctgcaccctgagtgcaaggagctgcctgagcccaacctgctgcccggccagctgagccacggggctgtgggcgtgcgggagggccgggtgcagtggatctccatggcctttgagagcaccacctacaagggcaagagcagcttccagacctacagcgactacctgcgctgggagagcttcctgcagcagcagctgcaggccctgcctgagggctctgtgctgcggcggggcttccagacctgtgagcactggaagcagatcttcatggagatcgtgggcgtgcagagcgccctgtgtggcctggtgctgagcctgctgatctgtgtggccgctgtggccgtgttcaccacccacatcctgctgctgctgcctgtgctgctgagcatcctgggcatcgtgtgcctggtggtgaccatcatgtactggagcggctgggagatgggcgctgtggaggccatcagcctgagcatcctggtgggcagctctgtggactactgtgtgcacctggtggagggctacctgctggccggggagaacctgcccccccaccaggccgaggatgcccggacccagaggcagtggaggaccctggaggccgtgcgccacgtgggcgtggccatcgtgagcagcgccctgaccaccgtcatcgccaccgtgcccctcttcttctgcatcatcgccccctttgccaagtttgggaagatcgtggccctgaacacaggagtgtccatcctgtacaccctgactgtgtccacagccctgctgggcatcatggcccccagcagcttcaccaggaccaggaccagcttcctgaaggccctgggcgctgtgctgctggccggggccctgggcctgggcgcctgcctggtgctgctgcagagcggctacaagatccccctgcctgctggggccagcctgtag

SEQ ID NO: 163371 - DNA, 4179 bp, Artificial Sequence
  Description of Artificial Sequence: Synthetic coding sequence
atggacacagaagatgaccccctgctgcaggatgtgtggctggaggaggagcaggaggaggaggaggccaccggggagaccttcctgggcgcccagaagccaggcccccagcccggggccggcggccagtgctgctggaggcactggcccctggccagccggcccccagccagcggcttctggagcaccctgggctgggccttcaccaacccctgctgtgccggcctggtgctcttcctgggctgcagcatccccatggccctgagcgccttcatgttcctgtactacccacccctggacatcgacatctcctacaatgcctttgagatcagaaatcatgaggccagccagagatttgatgccctgaccctggccctgaagagccagtttggctcctggggcaggaacagaagagacctggccgacttcaccagcgagaccctgcagaggctcatcagcgagcagctgcagcagctgcacctgggcaacagaagccggcaggccagccgggcccccagggtcatcccagctgccagcctgggcggccctggcccctacagagacaccagcgctgcccagaagcccacagccaacagaagtggccgcctgcggcgggagaccccacccctggaggacctggccgccaaccagagcgaggaccccaggaaccagaggctgagcaagaatggccgctaccagcccagcatcccccctcatgctgctgtggccgccaaccagagccgggcccggcggggggccagccgctgggactacagccgggcctacgtgtctgccaacacccagacccacgcccactggagaattgagctgatcttcctggcccggggagatgctgagaggaacatcttcaccagcgagcggctggtgaccatccatgaaattgaaaggaagatcatggaccaccctggcttccgggagttctgctggaagccccatgaggtgctgaaggacctgcccctgggcagctacagctactgcagcccccccagcagcctgatgacctacttcttccccacagagcggggcggcaagatctactatgatggcatgggccaggacctggccgacatccggggcagcctggagctggccatgacccaccctgagttctactggtacgtggatgagggcctgtctgctgacaacctgaagagcagcctgctgcggtctgagatcctgtttggagcccccctgcccaactactacagcgtggatgaccgctgggaggagcagagggccaagttccagagctttgtggtgacctacgtggccatgctggccaagcagagcaccagcaaggtgcaggtgctgtatggaggaacagacctgtttgattatgaggtgcggaggaccttcaacaatgacatgctgctggccttcatcagcagcagctgcatcgccgccctggtgtacatcctgaccagctgcagcgtcttcctgtccttcttcggcatcgccagcatcggcctgagctgcctggtggccctcttcctgtaccacgtggtgtttggcatccagtacctgggcatcctgaatggagtggccgccttcgtcatcgtgggcattggagtggatgatgtgtttgtgttcatcaacacctaccggcaggccacccacctggaggacccccagctgaggatgatccacacagtgcagacagctgggaaggccaccttcttcaccagcctgaccacagctgctgcctatgctgccaacgtgttcagccagatcccagctgtgcatgactttggcctcttcatgagcctgattgtgtcctgctgctggctggccgtgctggtgaccatgcctgctgccctgggcctgtggagcctgtacctggcccccctggagagcagctgccagaccagctgccaccagaactgcagcaggaagaccagcctgcacttccctggagatgtgtttgctgcccctgagcaggtgggcggcagccctgcccagggccccatcccctacctggatgatgacatccccctgctggaggtggaggaggagcctgtgtccctggagctgggagatgtgtccctggtgtctgtgtccccagagggcctgcagcctgccagcaacacaggcagccggggccacctgattgtgcagctgcaggagctgctgcaccactgggtgctgtggagcgctgtgaagagccgctgggtgattgtgggcctgtttgtgtccatcctgatcctgagcctggtgtttgccagccggctgcggcctgccagccgggcccccctgctcttccggccagacaccaacatccaggtgctgctggacctgaagtacaacctgtctgctgagggcatcagctgcatcacctgcagcggcctcttccaggagaagccccacagcctgcagaacaacatccgcaccagcctggagaagaagagaagaggcagcggcgtgccctgggccagcaggcctgaggccaccctgcaggacttccctggcaccgtgtacatcagcaaggtgaagagccagggccaccctgctgtgtaccgcctgagcctgaatgccagcctgcctgccccctggcaggccgtgtccccaggagatggagaggtgcccagcttccaggtgtaccgggccccctttggaaacttcaccaagaagctgacagcctgcatgagcacagtgggcctgctgcaggccgccagccccagcaggaagtggatgctgaccaccctggcctgtgatgccaagaggggctggaagtttgacttctccttctacgtggccaccaaggagcagcagcacaccaggaagctgtactttgcccagagccacaagccacccttccacggccgggtgtgcatggcccctcctggctgcctgctgagcagcagcccagatggccccaccaagggcttcttctttgtgcccagcgagaaggtgcccaaggcccggctgagcgccaccttcggcttcaacccctgtgtgaacacaggctgtgggaagccagctgtgcggcccctggtggacacaggagccatggtgtttgtggtgtttggcatcatcggcgtgaacagaacccggcaggtggacaaccacgtgattggagaccccggctctgtggtgtatgacagcagctttgacctcttcaaggagatcggccacctgtgccacctgtgcaaggccatcgccgccaacagcgagctggtgaagccaggaggagcccagtgcctgcccagcggctacagcatcagcagcttcctgcagatgctgcaccctgagtgcaaggagctgcctgagcccaacctgctgcccggccagctgagccacggggctgtgggcgtgcgggagggccgggtgcagtggatctccatggcctttgagagcaccacctacaagggcaagagcagcttccagacctacagcgactacctgcgctgggagagcttcctgcagcagcagctgcaggccctgcctgagggctctgtgctgcggcggggcttccagacctgtgagcactggaagcagatcttcatggagattgctggggtgcagagcgccctgtgtggcctggtgctgagcctgctgatctgtgtggccgctgtggccgtgttcaccacccacatcctgctgctgctgcctgtgctgctgagcatcctgggcatcgtgtgcctggtggtgaccatcatgtactggagcggctgggagatgggcgctgtggaggccatcagcctgagcatcctggtgggcagctctgtggactactgtgtgcacctggtggagggctacctgctggccggggagaacctgcccccccaccaggccgaggatgcccggacccagaggcagtggaggaccctggaggccgtgcgccacgtgggcgtggccatcgtgagcagcgccctgaccaccgtcatcgccaccgtgcccctcttcttctgcatcatcgccccctttgccaagtttgggaagatcgtggccctgaacacaggagtgtccatcctgtacaccctgactgtgtccacagccctgctgggcatcatggcccccagcagcttcaccaggaccaggaccagcttcctgaaggccctgggcgctgtgctgctggccggggccctgggcctgggcgcctgcctggtgctgctgcagagcggctacaagatccccctgcctgctggggccagcctgtag

SEQ ID NO: 163372 - DNA, 2304 bp, Artificial Sequence
  Description of Artificial Sequence: Synthetic coding sequence
atgccctgggtggagcccaagccccggcccggccctgagcagaagcccaagctgaccaagccagattctgccaccggcccccagtggtaccaggagagccaggagagcgagagcgagggcaagcagcccccacctggccccctggccccacccaagagccctgagcccagcggccccctggccagcgagcaggatgcccccctgcctgaaggagatgatgccccaccccggcccagcatgctggatgatgccccccggctgcccctggagctggatgatgcccccctgcctgaggaggagaccccagagcccacagccatctgccgccaccgccaccgctgccacacagactgcctggagggcctgctgagcaggaccttccagtggctgggctggcaggtgggcgcccacccctggatcttcctgctggcccccctgatgctgacagctgccctgggcaccggcttcctgtacctgcccaaggatgaggaggaggacctggaggagcactacacccctgtgggcagccctgccaaggccgagaggagatttgtgcagggccacttcaccaccaatgacagctaccgcttcagcgccagcagaagaagcacagaggccaactttgtgtccctgctggtggtgtcctacagcgacagcctgctggaccctgccacctttgctgaggtgtccaagctggatggagctgtgcaggacctgcgggtggcccgggagaagggcagccagatccagtaccagcaggtgtgtgcccgctaccgggccctgtgtgtgccccccaaccccatcctgtatgcctggcaggtgaacaagaccctgaacctgagcagcatctccttccctgcctacaaccacggccgccaccccctgtacctgaccggcttctttggaggctacatcctgggcggcagcctgggcatgggccagctgctgctgcgggccaaggccatgaggctgctgtactacctgaagacagaagatcctgaatatgatgtgcagagcaagcagtggctgacccacctgctggaccagttcaccaacatcaagaacatcctggccctgaagaagattgaggtggtgcacttcaccagcctgagccggcagctggagtttgaggccacctctgtgaccgtcatccctgtgttccacctggcctacatcctgatcatcctgtttgctgtgaccagctgcttccgctttgactgcatccggaacaagatgtgtgtggccgcctttggagtcatcagcgccttcctggccgtggtgtctggcttcggcctgctgctgcacatcggcgtgcccttcgtcatcatcgtggccaacagccccttcctgatcctgggcgtgggcgtggatgacatgttcatcatgatcagcgcctggcacaagaccaacctggctgatgacatccgggagaggatgagcaatgtgtacagcaaggctgctgtgtccatcaccatcaccaccatcaccaacatcctggccctgtacacaggcatcatgagcagcttccgctctgtgcagtgcttctgcatctacacaggcatgaccctgctcttctgctacttctacaacatcacctgcttcggggccttcatggccctggatggcaagcgggaggtggtgtgcctgtgctggctgaagaaggctgaccccaagtggcccagcttcaagaagttctgctgcttccccttcggctctgtgcctgatgaacatggaacagacatccaccccatcagcctcttcttccgggactacttcggccccttcctgaccaggtctgagagcaagtactttgtggtgttcatctacgtgctgtacatcatcagcagcatctacggctgcttccacgtgcaggagggcctggacctgaggaacctggccagtgatgacagctacatcaccccctacttcaacgtggaggagaactacttcagtgactatggcccccgggtgatggtgattgtgaccaagaaggtggactactgggacaaggatgtgcggcagaagctggagaactgcaccaagatctttgagaagaatgtgtatgtggacaagaacctgacagagttctggctggatgcctacgtgcagtacctgaagggcaacagccaggaccccaatgagaagaacaccttcatgaacaacatcccagacttcctgagcaacttccccaacttccagcacgacatcaacatcagcagcagcaatgagatcatcagcagccggggcttcatccagaccacagatgtgagcagcagcgccaagaagaagatcctgctcttctag

SEQ ID NO: 163373 - DNA, 978 bp, Artificial Sequence
  Description of Artificial Sequence: Synthetic coding sequence
atgacagagaggagaagagatgagctgtctgaggagatcaacaacctgcgggagaaggtgatgaagcagagcgaggagaacaacaacctgcagagccaggtgcagaagctgacagaggagaacaccaccctgcgggagcaggtggagcccaccccagaagatgaagatgatgacatcgagctgcggggagctgctgctgctgctgcccctcctccacccatcgaggaggagtgcccagaggacctgcctgagaagtttgatggcaacccagacatgctggcccccttcatggcccagtgccagatcttcatggagaagagcacccgggacttctctgtggacagagtgcgggtgtgctttgtgacctccatgatgacaggccgggccgcccgctgggccagcgccaagctggagaggagccactacctgatgcacaactacccagccttcatgatggagatgaagcacgtgtttgaggacccccagaggcgggaggtggccaagaggaagatccggcggctgcggcagggcatgggcagcgtcatcgactacagcaatgccttccagatgattgcccaggacctggactggaatgagcccgccctgattgaccagtaccacgagggcctgagtgaccacatccaggaggagctgagccacctggaggtggccaagagcctgagcgccctgattggccagtgcatccacattgaaagaaggctggcccgggctgctgctgccaggaagcccaggagccccccccgggccctggtgctgccccacatcgccagccaccaccaggtggaccccacagagcctgtgggcggggccaggatgaggctgacccaggaggagaaggagaggaggaggaagctgaacctgtgcctgtactgcggcaccggcggccactatgctgacaactgcccagccaaggccagcaagagcagccctgctggcaacagccctgcccccctgtag

SEQ ID NO: 163374 - DNA, 978 bp, Artificial Sequence; identical to SEQ ID NO: 163373
  Description of Artificial Sequence: Synthetic coding sequence

SEQ ID NO: 163375 - DNA, 1311 bp, Artificial Sequence
  Description of Artificial Sequence: Synthetic coding sequence
atgatggccacccagaccctgagcattgacagctaccaggacggccagcagatgcaggtggtgacagagctgaagacagagcaggaccccaactgcagcgagccagatgctgagggcgtgagccccccacctgtggagagccagacccccatggatgtggacaagcaggccatctaccgccaccccctcttccccctgctggccctgctgtttgagaagtgtgagcagagcacccagggcagcgagggcaccaccagcgccagctttgatgtggacatcgagaactttgtgaggaagcaggagaaggagggcaagcccttcttctgtgaggaccctgagacagacaacctgatggtgaaggccatccaggtgctgcgcatccacctgctggagctggagaaggtgaatgagctgtgcaaggacttctgcagccgctacatcgcctgcctgaagaccaagatgaacagcgagaccctgctgtctggagagcccggcagcccctacagccctgtgcagagccagcagatccagagcgccatcaccggcaccatcagcccccagggcatcgtggtgcctgccagcgccctgcagcagggcaatgtggccatggccaccgtggccggcggcaccgtgtaccagcctgtgacagtggtgaccccccagggccaggtggtgacccagaccctgagccctggcaccatccgcatccagaacagccagctgcagctgcagctgaaccaggacctgagcatcctgcaccaggatgatggcagcagcaagaacaagaggggcgtgctgcccaagcacgccaccaacgtgatgaggtcctggctgttccagcacatcggccacccctaccccacagaagatgagaagaagcagattgctgcccagaccaacctgaccctgctgcaggtgaacaactggttcatcaatgcccggcggcgcatcctgcagcccatgctggacagcagctgcagcgagacccccaagaccaagaagaagacagcccagaacagacctgtgcagcgcttctggccagacagcatcgccagcggcgtggcccagcccccacccagcgagctgaccatgtctgagggcgctgtggtgaccatcaccacccctgtgaacatgaatgtggacagcctgcagagcctgagcagtgatggagccaccctggccgtgcagcaggtgatgatggccggccagagtgaagatgagagcgtggacagcacagaggaggatgctggggccctggccccagcccacatcagcggcctggtgctggagaacagcgacagcctgcagtag

SEQ ID NO: 163376 - DNA, 960 bp, Artificial Sequence
  Description of Artificial Sequence: Synthetic coding sequence
atggtgaaggccatccaggtgctgcgcatccacctgctggagctggagaaggtgaatgagctgtgcaaggacttctgcagccgctacatcgcctgcctgaagaccaagatgaacagcgagaccctgctgagcggggagcccggcagcccctacagccctgtgcagagccagcagatccagagcgccatcaccggcaccatcagcccccagggcatcgtggtgcctgccagcgccctgcagcagggcaatgtggccatggccaccgtggccggcggcaccgtgtaccagcctgtgacagtggtgaccccccagggccaggtggtgacccagaccctgagccctggcaccatccgcatccagaacagccagctgcagctgcagctgaaccaggacctgagcatcctgcaccaggatgatggcagcagcaagaacaagaggggcgtgctgcccaagcacgccaccaacgtgatgaggtcctggctgttccagcacatcggccacccctaccccacagaagatgagaagaagcagattgctgcccagaccaacctgaccctgctgcaggtgaacaactggttcatcaatgcccggcggcgcatcctgcagcccatgctggacagcagctgcagcgagacccccaagaccaagaagaagacagcccagaacagacctgtgcagcgcttctggccagacagcatcgccagcggcgtggcccagcccccaccttctgagctgaccatgtctgagggcgctgtggtgaccatcaccacccctgtgaacatgaatgtggacagcctgcagagcctgagcagtgatggagccaccctggccgtgcagcaggtgatgatggccggccagagtgaagatgaatctgtggacagcacagaagaagatgctggggccctggccccagcccacatcagcggcctggtgctggagaacagcgacagcctgcagtag

SEQ ID NO: 163377 - DNA, 1260 bp, Artificial Sequence
  Description of Artificial Sequence: Synthetic coding sequence
atgatggccacccagaccctgagcattgacagctaccaggacggccagcagatgcaggtggtgacagagctgaagacagagcaggaccccaactgcagcgagccagatgctgagggcgtgagccccccacctgtggagagccagacccccatggatgtggacaagcaggccatctaccgccaccccctcttccccctgctggccctgctgtttgagaagtgtgagcagagcacccagggcagcgagggcaccaccagcgccagctttgatgtggacatcgagaactttgtgaggaagcaggagaaggagggcaagcccttcttctgtgaggaccctgagacagacaacctgatggtgaaggccatccaggtgctgcgcatccacctgctggagctggagaaggtgaatgagctgtgcaaggacttctgcagccgctacatcgcctgcctgaagaccaagatgaacagcgagaccctgctgtctggagagcccggcagcccctacagccctgtgcagagccagcagatccagagcgccatcaccggcaccatcagcccccagggcatcgtggtgcctgccagcgccctgcagcagggcaatgtggccatggccaccgtggccggcggcaccgtgtaccagcctgtgacagtggtgaccccccagggccaggtggtgacccagaccctgagccctggcaccatccgcatccagaacagccagctgcagctgcagctgaaccaggacctgagcatcctgcaccaggatgatggcagcagcaagaacaagaggggcgtgctgcccaagcacgccaccaacgtgatgaggtcctggctgttccagcacatcggccacccctaccccacagaagatgagaagaagcagattgctgcccagaccaacctgaccctgctgcaggtgaacaactggttcatcaatgcccggcggcgcatcctgcagcccatgctggacagcagctgcagcgagacccccaagaccaagaagaagacagcccagaacagacctgtgcagcgcttctggccagacagcatcgccagcggcgtggcccagcccccacccagcgagctgaccatgtctgagggcaccggcggccggcccaggccagacatggtggaccatggagtgggcatcatgaacaagaggcctggcagcggcctgctggccccacccaggcctgcagaaaatgacatcctgaagccacccctgcggagcagctttgtgaactgcctgctgatcttctag

SEQ ID NO: 163378 - DNA, 1419 bp, Artificial Sequence
  Description of Artificial Sequence: Synthetic coding sequence
atgatgcagcacgccagccctgccccagccctgaccatgatggccacccagaatgtgcccccaccaccctaccaggacagcccccagatgacagccacagcccagccccccagcaaggcccaggccgtgcacatcagcgcccccagcgctgctgccagcacccctgtgcccagcgcccccatcgacccccaggcccagctggaggccgacaagagagctgtgtaccgccaccccctcttccccctgctgaccctgctgtttgagaagtgtgagcaggccacccagggcagcgagtgcatcaccagcgccagctttgatgtggacatcgagaactttgtgcaccagcaggagcaggagcacaagcccttcttcagtgatgatcctgagctggacaacctgatggtgaaggccatccaggtgctgcgcatccacctgctggagctggagaaggtgaatgagctgtgcaaggacttctgcaaccgctacatcacctgcctgaagaccaagatgcacagcgacaacctgctgagaaatgacctgggcggcccctacagccccaaccagcccagcatcaacctgcacagccaggacctgctgcagaacagccccaacagcatgtctggagtgagcaacaacccccagggcatcgtggtgcctgccagcgccctgcagcagggcaacatcgccatgaccaccgtgaacagccaggtggtgtctggaggagccctgtaccagcctgtgaccatggtgaccagccagggccaggtggtgacccaggccatcccccagggcgccatccagatccagaacacccaggtgaacctggacctgaccagcctgctggacaatgaagacaagaagagcaagaacaagaggggcgtgctgcccaagcacgccaccaacatcatgaggtcctggctgttccagcacctgatgcacccctaccccacagaagatgagaagaggcagattgctgcccagaccaacctgaccctgctgcaggtgaacaactggttcatcaatgcccggcggcgcatcctgcagcccatgctggatgccagcaacccagaccctgcccccaaggccaagaagatcaagagccagcaccggcccacccagcgcttctggcccaacagcattgctgctggggtgctgcagcagcagggcggggcccctggcaccaacccagatggcagcatcaacctggacaacctgcagagcctgagcagtgacagcgccaccatggccatgcagcaggccatgatggccgcccatgatgacagcctggatggaacagaggaggaggatgaagatgagatggaggaggaggaggaggaggagctggaggaggaggtggatgagctgcagaccaccaacgtgtctgacctgggcctggagcacagcgacagcctggagtag

SEQ ID NO: 163379 - DNA, 120 bp, Artificial Sequence
  Description of Artificial Sequence: Synthetic coding sequence
atgatgcagcacgccagccctgccccagccctgaccatgatggccacccagaatgtgcccccaccaccctaccaggacagcccccagatgacagccacagcccagccccccagcaagtag

SEQ ID NO: 163380 - DNA, 1332 bp, Artificial Sequence
  Description of Artificial Sequence: Synthetic coding sequence
atgacagccacagcccagccccccagcaaggcccaggccgtgcacatcagcgcccccagcgctgctgccagcacccctgtgcccagcgcccccatcgacccccaggcccagctggaggccgacaagagagctgtgtaccgccaccccctcttccccctgctgaccctgctgtttgagaagtgtgagcaggccacccagggcagcgagtgcatcaccagcgccagctttgatgtggacattgaaaattttgtgcaccagcaggagcaggagcacaagcccttcttcagtgatgatcctgagctggacaacctgatggtgaaggccatccaggtgctgcgcatccacctgctggagctggagaaggtgaatgagctgtgcaaggacttctgcaaccgctacatcacctgcctgaagaccaagatgcacagcgacaacctgctgagaaatgacctgggcggcccctacagccccaaccagcccagcatcaacctgcacagccaggacctgctgcagaacagccccaacagcatgtctggagtgagcaacaacccccagggcatcgtggtgcctgccagcgccctgcagcagggcaacatcgccatgaccaccgtgaacagccaggtggtgtctgggggcgccctgtaccagcctgtgaccatggtgaccagccagggccaggtggtgacccaggccatcccccagggcgccatccagatccagaacacccaggtgaacctggacctgaccagcctgctggacaatgaagacaagaagagcaagaacaagaggggcgtgctgcccaagcacgccaccaacatcatgaggtcctggctgttccagcacctgatgcacccctaccccacagaagatgagaagaggcagattgctgcccagaccaacctgaccctgctgcaggtgaacaactggttcatcaatgcccggcggcgcatcctgcagcccatgctggatgccagcaacccagaccctgcccccaaggccaagaagatcaagagccagcaccggcccacccagcgcttctggcccaacagcattgctgctggggtgctgcagcagcagggcggggcccctggcaccaacccagatggcagcatcaacctggacaacctgcagagcctgagcagtgacagcgccaccatggccatgcagcaggccatgatggccgcccatgatgacagcctggatggaacagaggaggaggatgaagatgagatggaggaggaggaggaggaggagctggaggaggaggtggatgagctgcagaccaccaacgtgtctgacctgggcctggagcacagcgacagcctggagtag

SEQ ID NO: 163381 - DNA, 1332 bp, Artificial Sequence; identical to SEQ ID NO: 163380
  Description of Artificial Sequence: Synthetic coding sequence

SEQ ID NO: 163382 - DNA, 123 bp, Artificial Sequence
  Description of Artificial Sequence: Synthetic coding sequence
atgatgcagcacgccagccctgccccagccctgaccatgatggccacccagaatgtgcccccaccaccctaccaggacagcccccagatgacagccacagcccagccccccagcaaggcctag

SEQ ID NO: 163383 - DNA, 921 bp, Artificial Sequence
  Description of Artificial Sequence: Synthetic coding sequence
atgatggccacccagaatgtgcccccaccaccctaccaggacagcccccagatgacagccacagcccagccccccagcaaggcccaggccgtgcacatcagcgcccccagcgctgctgccagcacccctgtgcccagcgcccccatcgacccccaggcccagctggaggccgacaagagagctgtgtaccgccaccccctcttccccctgctgaccctgctgtttgagaagtgtgagcaggccacccagggcagcgagtgcatcaccagcgccagctttgatgtggacatcgagaactttgtgcaccagcaggagcaggagcacaagcccttcttcagtgatgatcctgagctggacaacctgatggtgaaggccatccaggtgctgcgcatccacctgctggagctggagaaggtgaatgagctgtgcaaggacttctgcaaccgctacatcacctgcctgaagaccaagatgcacagcgacaacctgctgagaaatgacctgggcggcccctacagccccaaccagcccagcatcaacctgcacagccaggacctgctgcagaacagccccaacagcatgtctggagtgagcaacaacccccagggcatcgtggtgcctgccagcgccctgcagcagggcaacatcgccatgaccaccgtgaacagccaggtggtgtctggaggagccctgtaccagcctgtgaccatggtgaccagccagggccaggtggtgacccaggccatcccccagggcgccatccagatccagaacacccaggtgaacctggacctgaccagcctgctggacaatgaagacaagaagagcaagaacaagaggggcgtgctgcccaagcacgccaccaacatcatgaggtcctggctgttccagcaccacgcccccctgccccacggcggctag

SEQ ID NO: 163384 - DNA, 1227 bp, Artificial Sequence
  Description of Artificial Sequence: Synthetic coding sequence
atgagccggccccaccccaccaggacagcccaccgccaccccctcttccccctgctgaccctgctgtttgagaagtgtgagcaggccacccagggcagcgagtgcatcaccagcgccagctttgatgtggacatcgagaactttgtgcaccagcaggagcaggagcacaagcccttcttcagtgatgatcctgagctggacaacctgatggtgaaggccatccaggtgctgcgcatccacctgctggagctggagaaggtgaatgagctgtgcaaggacttctgcaaccgctacatcacctgcctgaagaccaagatgcacagcgacaacctgctgagaaatgacctgggcggcccctacagccccaaccagcccagcatcaacctgcacagccaggacctgctgcagaacagccccaacagcatgtctggagtgagcaacaacccccagggcatcgtggtgcctgccagcgccctgcagcagggcaacatcgccatgaccaccgtgaacagccaggtggtgtctggaggagccctgtaccagcctgtgaccatggtgaccagccagggccaggtggtgacccaggccatcccccagggcgccatccagatccagaacacccaggtgaacctggacctgaccagcctgctggacaatgaagacaagaagagcaagaacaagaggggcgtgctgcccaagcacgccaccaacatcatgaggtcctggctgttccagcacctgatgcacccctaccccacagaagatgagaagaggcagattgctgcccagaccaacctgaccctgctgcaggtgaacaactggttcatcaatgcccggcggcgcatcctgcagcccatgctggatgccagcaacccagaccctgcccccaaggccaagaagatcaagagccagcaccggcccacccagcgcttctggcccaacagcattgctgctggggtgctgcagcagcagggcggggcccctggcaccaacccagatggcagcatcaacctggacaacctgcagagcctgagcagtgacagcgccaccatggccatgcagcaggccatgatggccgcccatgatgacagcctggatggaacagaggaggaggatgaagatgagatggaggaggaggaggaggaggagctggaggaggaggtggatgagctgcagaccaccaacgtgtctgacctgggcctggagcacagcgacagcctggagtag

SEQ ID NO: 163385 - DNA, 297 bp, Artificial Sequence
  Description of Artificial Sequence: Synthetic coding sequence
atgatgcagcacgccagccctgccccagccctgaccatgatggccacccagaatgtgcccccaccaccctaccaggacagcccccagatgacagccacagcccagccccccagcaaggcccaggccgtgcacatcagcgcccccagcgctgctgccagcacccctgtgcccagcgcccccatcgacccccaggcccagctggaggccgacaagagagctgtgtaccgccaccccctcttccccctgctgaccctgctgtttgagaagtgtgagcaggccacccagggcagcgagtag

SEQ ID NO: 163386 - DNA, 234 bp, Artificial Sequence
  Description of Artificial Sequence: Synthetic coding sequence
atgatgcagcacgccagccctgccccagccctgaccatgatggccacccagaatgtgcccccaccaccctaccaggacagcccccagatgacagccacagcccagccccccagcaaggcccaggccgtgcacatcagcgcccccagcgctgctgccagcacccctgtgcccagcgcccccatcgacccccaggcccagctggaggccgacaagagagctgtgtaccgctggtag

SEQ ID NO: 163387 - DNA, 990 bp, Artificial Sequence
  Description of Artificial Sequence: Synthetic coding sequence
atgacccgggacttcaagccaggggacctgatctttgccaagatgaagggctacccccactggccagcccgggtggatgaggtgcctgatggagctgtgaagccacccaccaacaagctgcccatcttcttcttcggcacccatgaaacagccttcctgggccccaaggacatcttcccctacagcgagaacaaggagaagtatggcaagcccaacaagaggaagggcttcaatgaaggcctgtgggagattgacaacaaccccaaggtgaagttcagcagccagcaggccgccaccaagcagagcaatgccagcagtgatgtggaggtggaggagaaggagacctctgtgtccaaggaggacacagaccacgaggagaaggccagcaatgaagatgtgaccaaggctgtggacatcaccacccccaaggccgcccggcggggcaggaagaggaaggccgagaagcaggtggagacagaggaggccggcgtggtgaccacagccacagcctctgtgaacctgaaggtgagccccaagaggggccggcctgctgccacagaggtgaagatccccaagccccggggccggcccaagatggtgaagcagccctgccccagcgagagtgacatcatcacagaggaggacaagagcaagaagaagggccaggaggagaagcagcccaagaagcagcccaagaaggatgaggagggccagaaggaggaggacaagcccaggaaggagccagacaagaaggagggcaagaaggaggtggagagcaagaggaagaacctggccaagacaggagtgaccagcaccagtgacagcgaggaggagggagatgaccaggagggggagaagaagaggaaaggaggcaggaacttccagacagcccacagaagaaacatgctgaagggccagcacgagaaggaggccgctgacaggaagaggaagcaggaggagcagatggagacagagcactttgccctgtag

SEQ ID NO: 163388 - DNA, 1002 bp, Artificial Sequence
  Description of Artificial Sequence: Synthetic coding sequence
atgacccgggacttcaagccaggggacctgatctttgccaagatgaagggctacccccactggccagcccgggtggatgaggtgcctgatggagctgtgaagccacccaccaacaagctgcccatcttcttcttcggcacccatgaaacagccttcctgggccccaaggacatcttcccctacagcgagaacaaggagaagtatggcaagcccaacaagaggaagggcttcaatgaaggcctgtgggagattgacaacaaccccaaggtgaagttcagcagccagcaggccgccaccaagcagagcaatgccagcagtgatgtggaggtggaggagaaggagacctctgtgtccaaggaggacacagaccacgaggagaaggccagcaatgaagatgtgaccaaggctgtggacatcaccacccccaaggccgcccggcggggcaggaagaggaaggccgagaagcaggtggagacagaggaggccggcgtggtgaccacagccacagcctctgtgaacctgaaggtgagccccaagaggggccggcctgctgccacagaggtgaagatccccaagccccggggccggcccaagatggtgaagcagccctgccccagcgagagtgacatcatcacagaggaggacaagagcaagaagaagggccaggaggagaagcagcccaagaagcagcccaagaaggatgaggagggccagaaggaggaggacaagcccaggaaggagccagacaagaaggagggcaagaaggaggtggagagcaagaggaagaacctggccaagacaggagtgaccagcaccagtgacagcgaggaggagggagatgaccaggagggggagaagaagaggaaaggaggcaggaacttccagacagcccacagaagaaacatgctgaagggccagcacgagaaggaggccgctgacaggaagaggaagcaggaggagcagatggagacagagcaccagaccacctgcaacctgcagtag

SEQ ID NO: 163389 - DNA, 1593 bp, Artificial Sequence
  Description of Artificial Sequence: Synthetic coding sequence
atgacccgggacttcaagccaggggacctgatctttgccaagatgaagggctacccccactggccagcccgggtggatgaggtgcctgatggagctgtgaagccacccaccaacaagctgcccatcttcttcttcggcacccatgaaacagccttcctgggccccaaggacatcttcccctacagcgagaacaaggagaagtatggcaagcccaacaagaggaagggcttcaatgaaggcctgtgggagattgacaacaaccccaaggtgaagttcagcagccagcaggccgccaccaagcagagcaatgccagcagtgatgtggaggtggaggagaaggagacctctgtgtccaaggaggacacagaccacgaggagaaggccagcaatgaagatgtgaccaaggctgtggacatcaccacccccaaggccgcccggcggggcaggaagaggaaggccgagaagcaggtggagacagaggaggccggcgtggtgaccacagccacagcctctgtgaacctgaaggtgagccccaagaggggccggcctgctgccacagaggtgaagatccccaagccccggggccggcccaagatggtgaagcagccctgccccagcgagagtgacatcatcacagaggaggacaagagcaagaagaagggccaggaggagaagcagcccaagaagcagcccaagaaggatgaggagggccagaaggaggaggacaagcccaggaaggagccagacaagaaggagggcaagaaggaggtggagagcaagaggaagaacctggccaagacaggagtgaccagcaccagtgacagcgaggaggagggagatgaccaggagggggagaagaagaggaaaggaggcaggaacttccagacagcccacagaagaaacatgctgaagggccagcacgagaaggaggccgctgacaggaagaggaagcaggaggagcagatggagacagagcagcagaacaaggatgagggcaagaagccagaggtgaagaaggtggagaagaagcgggagacctccatggacagccggctgcagagaattcatgctgagatcaagaacagcctgaagattgacaacctggatgtgaaccgctgcatcgaggccctggatgagctggccagcctgcaggtgaccatgcagcaggcccagaagcacacagagatgatcaccaccctgaagaagatccgccgcttcaaggtgtcccaggtgatcatggagaagagcaccatgctgtacaacaagttcaagaacatgttcctggtgggggagggggacagcgtcatcacccaggtgctgaacaagagcctggccgagcagaggcagcacgaggaggccaacaagaccaaggaccagggcaagaagggccccaacaagaagctggagaaggagcagacaggcagcaagaccctgaatggaggcagtgatgcccaggacggcaaccagccccagcacaatggagagagcaatgaagacagcaaggacaaccacgaggccagcaccaagaagaagcccagcagcgaggagcgggagacagagatcagcctgaaggacagcaccctggacaactag

SEQ ID NO: 163390 - DNA, 1593 bp, Artificial Sequence; identical to SEQ ID NO: 163389
  Description of Artificial Sequence: Synthetic coding sequence

SEQ ID NO: 163391 - DNA, 1002 bp, Artificial Sequence; identical to SEQ ID NO: 163388
  Description of Artificial Sequence: Synthetic coding sequence

SEQ ID NO: 163392 - DNA, 1362 bp, Artificial Sequence
  Description of Artificial Sequence: Synthetic coding sequence
atggcccacatcaccatcaaccagtacctgcagcaggtgtatgaggccatcgacagcagagatggagccagctgtgccgagctggtgtccttcaagcacccccacgtggccaacccccggctgcagatggccagccctgaggagaagtgccagcaggtgctggagcccccctatgatgagatgtttgctgcccacctgcgctgcacctatgctgtgggcaaccacgacttcatcgaggcctacaagtgccagacagtgattgtgcagtaccccctgtccttcatggctgctgtgccccacaggacccatgctgtggactacctgggcctggagaccaggaagcactgggccagctgcagcttcctgcagctggagagaaatgattctgtgctggagcagaagctggtgtctgccctgagcctgggcaccagcttcctgcgggccttccaggcccacaaggaggagaactgggccctgcctgtgatgtatgctgtggccctggacctgcgggtgtttgccaacaatgctgaccagcagctggtgaagaagggcaagagcaaggtgggggacatgctggagaaggctgctgagctgctgatgagctgcttccgggtgtgtgccagtgacacccgggccggcatcgaggacagcaagaagtggggcatgctgttcctggtgaaccagctgttcaagatctacttcaagatcaacaagctgcacctgtgcaagcccctcatccgggccatcgacagcagcaacctgaaggatgactacagcacagcccagagggtgacctacaagtactacgtgggcaggaaggccatgtttgacagcgacttcaagcaggccgaggagtacctgagctttgcctttgagcactgccacaggagcagccagaagaacaagaggatgatcctgatctacctgctgcctgtgaagatgctgctgggccacatgcccaccgtggagctgctgaagaagtaccacctgatgcagtttgctgaggtgaccagggctgtgtctgagggcaacctgctgctgctgcacgaggccctggccaagcatgaggccttcttcatccgctgtggcatcttcctgatcctggagaagctgaagatcatcacctacagaaacctcttcaagaaggtgtacctgctgctgaagacccaccagctgagcctggatgccttcctggtggccctgaagttcatgcaggtggaggatgtggacattgatgaggtgcagtgcatcctggccaacctgatctacatgggccacgtgaagggctacatcagccaccagcaccagaagctggtggtgtccaagcagaaccccttcccccccctgagcacagtgtgctag

SEQ ID NO: 163393 - DNA, 1200 bp, Artificial Sequence
  Description of Artificial Sequence: Synthetic coding sequence
atgaggctgacagatgtggtgcagcagctggtgtatgaggccatcgacagcagagatggagccagctgtgccgagctggtgtccttcaagcacccccacgtggccaacccccggctgcagatggccagccctgaggagaagtgccagcaggtgctggagcccccctatgatgagatgtttgctgcccacctgcgctgcacctatgctgtgggcaaccacgacttcatcgaggcctacaagtgccagacagtgattgtgcagtacaccagcttcctgcgggccttccaggcccacaaggaggagaactgggccctgcctgtgatgtatgctgtggccctggacctgcgggtgtttgccaacaatgctgaccagcagctggtgaagaagggcaagagcaaggtgggggacatgctggagaaggctgctgagctgctgatgagctgcttccgggtgtgtgccagtgacacccgggccggcatcgaggacagcaagaagtggggcatgctgttcctggtgaaccagctgttcaagatctacttcaagatcaacaagctgcacctgtgcaagcccctcatccgggccatcgacagcagcaacctgaaggatgactacagcacagcccagagggtgacctacaagtactacgtgggcaggaaggccatgtttgacagcgacttcaagcaggccgaggagtacctgagctttgcctttgagcactgccacaggagcagccagaagaacaagaggatgatcctgatctacctgctgcctgtgaagatgctgctgggccacatgcccaccgtggagctgctgaagaagtaccacctgatgcagtttgctgaggtgaccagggctgtgtctgagggcaacctgctgctgctgcacgaggccctggccaagcatgaggccttcttcatccgctgtggcatcttcctgatcctggagaagctgaagatcatcacctacagaaacctcttcaagaaggtgtacctgctgctgaagacccaccagctgagcctggatgccttcctggtggccctgaagttcatgcaggtggaggatgtggacattgatgaggtgcagtgcatcctggccaacctgatctacatgggccacgtgaagggctacatcagccaccagcaccagaagctggtggtgtccaagcagaaccccttcccccccctgagcacagtgtgctag

SEQ ID NO: 163394 - DNA, 1200 bp, Artificial Sequence
  Description of Artificial Sequence: Synthetic coding sequence
atggcccacatcaccatcaaccagtacctgcagcaggtgtatgaggccatcgacagcagagatggagccagctgtgccgagctggtgtccttcaagcacccccacgtggccaacccccggctgcagatggccagccctgaggagaagtgccagcaggtgctggagcccccctatgatgagatgtttgctgcccacctgcgctgcacctatgctgtgggcaaccacgacttcatcgaggcctacaagtgccagacagtgattgtgcagagcttcctgcgggccttccaggcccacaaggaggagaactgggccctgcctgtgatgtatgctgtggccctggacctgcgggtgtttgccaacaatgctgaccagcagctggtgaagaagggcaagagcaaggtgggggacatgctggagaaggctgctgagctgctgatgagctgcttccgggtgtgtgccagtgacacccgggccggcatcgaggacagcaagaagtggggcatgctgttcctggtgaaccagctgttcaagatctacttcaagatcaacaagctgcacctgtgcaagcccctcatccgggccatcgacagcagcaacctgaaggatgactacagcacagcccagagggtgacctacaagtactacgtgggcaggaaggccatgtttgacagcgacttcaagcaggccgaggagtacctgagctttgcctttgagcactgccacaggagcagccagaagaacaagaggatgatcctgatctacctgctgcctgtgaagatgctgctgggccacatgcccaccgtggagctgctgaagaagtaccacctgatgcagtttgctgaggtgaccagggctgtgtctgagggcaacctgctgctgctgcacgaggccctggccaagcatgaggccttcttcatccgctgtggcatcttcctgatcctggagaagctgaagatcatcacctacagaaacctcttcaagaaggtgtacctgctgctgaagacccaccagctgagcctggatgccttcctggtggccctgaagttcatgcaggtggaggatgtggacattgatgaggtgcagtgcatcctggccaacctgatctacatgggccacgtgaagggctacatcagccaccagcaccagaagctggtggtgtccaagcagaaccccttcccccccctgagcacagtgtgctag

SEQ ID NO: 163395 - DNA, 1131 bp, Artificial Sequence
  Description of Artificial Sequence: Synthetic coding sequence
atggcccacatcaccatcaaccagtacctgcagcaggtgtatgaggccatcgacagcagagatggagccagctgtgccgagctggtgtccttcaagcacccccacgtggccaacccccggctgcagatggccagccctgaggagaagtgccagcaggtgctggagcccccctatgatgagatgtttgctgcccacctgcgctgcacctatgctgtgggcaaccacgacttcatcgaggcctacaagtgccagacagtgattgtgcagtaccccctgtccttcatggctgctgtggccgaccagcagctggtgaagaagggcaagagcaaggtgggggacatgctggagaaggctgctgagctgctgatgagctgcttccgggtgtgtgccagtgacaccagggctggcatcgaggacagcaagaagtggggcatgctgttcctggtgaaccagctgttcaagatctacttcaagatcaacaagctgcacctgtgcaagcccctcatccgggccatcgacagcagcaacctgaaggatgactacagcacagcccagagggtgacctacaagtactacgtgggcaggaaggccatgtttgacagcgacttcaagcaggccgaggagtacctgagctttgcctttgagcactgccacaggagcagccagaagaacaagaggatgatcctgatctacctgctgcctgtgaagatgctgctgggccacatgcccaccgtggagctgctgaagaagtaccacctgatgcagtttgctgaggtgaccagggctgtgtctgagggcaacctgctgctgctgcacgaggccctggccaagcatgaggccttcttcatccgctgtggcatcttcctgatcctggagaagctgaagatcatcacctacagaaacctcttcaagaaggtgtacctgctgctgaagacccaccagctgagcctggatgccttcctggtggccctgaagttcatgcaggtggaggatgtggacattgatgaggtgcagtgcatcctggccaacctgatctacatgggccacgtgaagggctacatcagccaccagcaccagaagctggtggtgtccaagcagaaccccttcccccccctgagcacagtgtgctag

SEQ ID NO: 163396 - DNA, 1200 bp, Artificial Sequence; identical to SEQ ID NO: 163394
  Description of Artificial Sequence: Synthetic coding sequence

SEQ ID NO: 163397 - DNA, 1200 bp, Artificial Sequence; identical to SEQ ID NO: 163394
  Description of Artificial Sequence: Synthetic coding sequence

SEQ ID NO: 163398 - DNA, 1194 bp, Artificial Sequence
  Description of Artificial Sequence: Synthetic coding sequence
atgaggctgacagatgtggtgcagcagctggtgtatgaggccatcgacagcagagatggagccagctgtgccgagctggtgtccttcaagcacccccacgtggccaacccccggctgcagatggccagccctgaggagaagtgccagcaggtgctggagcccccctatgatgagatgtttgctgcccacctgcgctgcacctatgctgtgggcaaccacgacttcatcgaggcctacaagtgccagacagtgattgtgcagagcttcctgcgggccttccaggcccacaaggaggagaactgggccctgcctgtgatgtatgctgtggccctggacctgcgggtgtttgccaacaatgctgaccagcagctggtgaagaagggcaagagcaaggtgggggacatgctggagaaggctgctgagctgctgatgagctgcttccgggtgtgtgccagtgacacccgggccggcatcgaggacagcaagaagtggggcatgctgttcctggtgaaccagctgttcaagatctacttcaagatcaacaagctgcacctgtgcaagcccctcatccgggccatcgacagcagcaacctgaaggatgactacagcacagcccagagggtgacctacaagtactacgtgggcaggaaggccatgtttgacagcgacttcaagcaggccgaggagtacctgagctttgcctttgagcactgccacaggagcagccagaagaacaagaggatgatcctgatctacctgctgcctgtgaagatgctgctgggccacatgcccaccgtggagctgctgaagaagtaccacctgatgcagtttgctgaggtgaccagggctgtgtctgagggcaacctgctgctgctgcacgaggccctggccaagcatgaggccttcttcatccgctgtggcatcttcctgatcctggagaagctgaagatcatcacctacagaaacctcttcaagaaggtgtacctgctgctgaagacccaccagctgagcctggatgccttcctggtggccctgaagttcatgcaggtggaggatgtggacattgatgaggtgcagtgcatcctggccaacctgatctacatgggccacgtgaagggctacatcagccaccagcaccagaagctggtggtgtccaagcagaaccccttcccccccctgagcacagtgtgctag

SEQ ID NO: 163399 - DNA, 546 bp, Artificial Sequence
  Description of Artificial Sequence: Synthetic coding sequence
atgcccaagggcggcaggaaaggaggccacaagggccgggcccggcagtacaccagccctgaggagattgatgcccagctgcaggccgagaagcagaaggcccgggaggaggaggagcagaaggagggcggagatggagctgctggggaccccaagaaggagaagaagagcctggacagtgatgaaagtgaagatgaagaagatgactaccagcagaagaggaaaggagtggagggcctgattgatattgagaaccccaacagagtggcccagaccaccaagaaggtgacccagctggacctggatggccccaaggagctgagcagaagagagcgggaggagattgagaagcagaaggccaaggagcgctacatgaagatgcacctggccggcaagacagagcaggccaaggctgacctggcccggctggccatcatcaggaagcagcgggaggaggccgccaggaagaaggaggaggagaggaaggccaaggatgatgccaccctgagcggcaagaggatgcagagcctgagcctgaacaagtag

SEQ ID NO: 163400 - DNA, 1026 bp, Artificial Sequence
  Description of Artificial Sequence: Synthetic coding sequence
atggtgagcagccagcccaagtatgacctgatccgggaggtgggccggggcagctatggagtggtgtatgaagctgtgatcaggaagaccagcgcccgggtggccgtgaagaagatccgctgccacgccccagaaaatgtggagctggccctgcgggagttctgggccctgagcagcatcaagagccagcaccccaacgtcatccacctggaggagtgcatcctgcagaaggatggcatggtgcagaagatgagccacggcagcaacagcagcctgtacctgcagctggtggagaccagcctgaagggggagatcgcctttgaccccaggtctgcctactacctgtggtttgtgatggacttctgtgatggaggagacatgaatgagtacctgctgagcaggaagcccaacaggaagaccaacaccagcttcatgctgcagctgagcagcgccctggccttcctgcacaagaaccagatcatccaccgggacctgaagccagacaacatcctgatcagccagacccggctggacaccagtgacctggagcccaccctgaaggtggccgactttggcctgagcaaggtgtgcagcgccagcggccagaaccctgaggagcctgtgtctgtgaacaagtgcttcctgagcacagcctgtggcacagacttctacatggcccctgaggtgtgggagggccactacacagccaaggctgacatctttgccctgggcatcatcatctgggccatgctggagcgcatcaccttcatcgacacagagaccaagaaggagctgctgggcagctatgtgaagcagggcacagagatcgtgcctgtgggggaggccctgctggagaaccccaagatggagctgctgatccctgtgaagaagaagtccatgaatggaaggatgaagcagctgatcaaggagatgctggccgccaacccccaggacagaccagatgcctttgagctggagctgcggctggtgcagatcgccttcaaggacagctcctgggagacctag

SEQ ID NO: 163401 - DNA, 1026 bp, Artificial Sequence; identical to SEQ ID NO: 163400
  Description of Artificial Sequence: Synthetic coding sequence

SEQ ID NO: 163402 - DNA, 576 bp, Artificial Sequence
  Description of Artificial Sequence: Synthetic coding sequence
atggtgagcagccagcccaagtatgacctgatccgggaggtgggccggggcagctatggagtggtgtatgaagctgtgatcaggaagaccagcgcccgggtggccgtgaagaagatccgctgccacgccccagaaaatgtggagctggccctgcgggagttctgggccctgagcagcatcaagagccagcaccccaacgtcatccacctggaggagtgcatcctgcagaaggatggcatggtgcagaagatgagccacggcagcaacagcagcctgtacctgcagctggtggagaccagcctgaagggggagatcgcctttgaccccaggtctgcctactacctgtggtttgtgatggacttctgtgatggaggagacatgaatgagtacctgctgagcaggaagcccaacaggaagaccaacaccagcttcatgctgcagctgagcagcgccctggccttcctgcacaagaaccagatcatccaccgggacctgaagccagacaacatcctgatcagccagacccggctggacaccagtgacctggagcccaccctgaaggtggccgacttctag

SEQ ID NO: 163403 - DNA, 4014 bp, Artificial Sequence
  Description of Artificial Sequence: Synthetic coding sequence
atggacttcaccgcccagcccaagccagccacagccctgtgtggggtggtgtctgcagatggcaagatcgcctacccacctggggtgaaggagatcacagacaagatcaccacagatgagatgatcaagaggctgaagatggtggtgaagaccttcatggacatggaccaggacagtgaagatgagaagcagcagtacctgcccctggccctgcacctggccagcgagttcttcctgaggaaccccaacaaggatgtgcggctgctggtggcctgctgcctggccgacatcttccgcatctatgcccctgaggccccctacaccagccatgacaagctgaaggacatcttcctgttcatcacccggcagctgaagggcctggaggacaccaagagcccccagttcaaccgctacttctacctgctggagaacctggcctgggtgaagagctacaacatctgctttgagctggaggactgcaatgagatcttcatccagctgttccgcaccctcttcagcgtcatcaacaacagccacaacaagaaggtgcagatgcacatgctggacctgatgagcagcatcatcatggagggagatggagtgacccaggagctgctggacagcatcctgatcaacctgatcccagcccacaagaacctgaacaagcagagctttgacctggccaaggtgctgctgaagaggacagtgcagaccatcgaggcctgcatcgccaacttcttcaaccaggtgctggtgctgggccgcagctctgtgtctgacctgtctgagcacgtgtttgacctgatccaggagctgtttgccatcgacccccacctgctgctgtctgtgatgccccagctggagttcaagctgaagagcaatgatggagaggagcggctggccgtggtgcggctgctggccaagctgtttggcagcaaggacagcgacctggccacccagaaccggcccctgtggcagtgcttcctgggccgcttcaatgacatccacgtgcctgtgcggctggagagcgtgaagtttgccagccactgcctgatgaaccacccagacctggccaaggacctgacagagtacctgaaggtgcgcagccatgaccctgaggaggccatcagacatgatgtgattgtgaccatcatcacagctgccaagagggacctggccctggtgaatgaccagctgctgggctttgtgcgggagaggaccctggacaagcgctggagggtgaggaaggaggccatgatgggcctggcccagctgtacaagaagtactgcctgcacggggaggccggcaaggaggccgctgagaaggtgtcctggatcaaggacaagctgctgcacatctactaccagaacagcattgatgacaagctgctggtggagaagatctttgcccagtacctggtgccccacaacctggagacagaggagaggatgaagtgcctgtactacctgtatgccagcctggaccccaatgctgtgaaggccctgaatgagatgtggaagtgccagaacatgctgcggagccacgtgcgggagctgctggacctgcacaagcagcccaccagcgaggccaactgcagcgccatgtttgggaagctgatgaccatcgccaagaacctgcctgaccccgggaaggcccaggactttgtgaagaagttcaaccaggtgctgggagatgatgagaagctgcggagccagctggagctgctgatcagccccacctgcagctgcaagcaggccgacatctgtgtgcgggagatcgccaggaagctggccaaccccaagcagcccaccaaccccttcctggagatggtgaagttcctgctggagcgcatcgcccctgtgcacattgattctgaggccatcagcgccctggtgaagctgatgaacaagagcattgagggcacagcagatgatgaggaggagggcgtgtccccagacacagccatccgcagcggcctggagctgctgaaggtgctgtccttcacccaccccaccagcttccacagcgctgagacctatgagagcctgctgcagtgcctgaggatggaggatgacaaggtggccgaggccgccatccagatcttcaggaacacaggccacaagattgaaacagacctgccccagatccgcagcaccctcatccccatcctgcaccagaaggccaagaggggcaccccccaccaggccaagcaggccgtgcactgcatccacgccatcttcaccaacaaggaggtgcagctggcccagatctttgagcccctgagccgcagcctgaatgctgatgtgcctgagcagctgatcacccccctggtgtccctgggccacatctccatgctggccccagaccagtttgccagccccatgaagtctgtggtggccaacttcatcgtgaaggacctgctgatgaatgacaggagcactggagagaagaatggcaagctgtggagcccagatgaggaggtgtccccagaggtgctggccaaggtgcaggccatcaagctgctggtgcgctggctgctgggcatgaagaacaaccagagcaagagcgccaacagcaccctgcggctgctgagcgccatgctggtgtctgagggggacctgacagagcagaagaggatcagcaagagtgacatgagccggctgcggctggccgccggcagcgccatcatgaagctggcccaggagccctgctaccacgagatcatcaccccagagcagttccagctgtgtgccctggtgatcaatgatgagtgctaccaggtgcggcagatctttgcccagaagctgcacaaggccctggtgaagctgctgctgcccctggagtacatggccatctttgccctgtgtgccaaggaccctgtgaaggagcggcgggcccacgcccggcagtgcctgctgaagaacatcagcatcagaagagagtacatcaagcagaaccccatggccacagagaagctgctgagcctgctgcctgaatatgtggtgccctacatgatccacctgctggcccatgaccctgacttcaccaggagccaggatgtggaccagctgcgggacatcaaggaatgtctgtggttcatgctggaggtgctgatgaccaagaatgaaaacaacagccacgccttcatgaagaagatggccgagaacatcaagctgaccagagatgcccagagcccagatgagagcaagaccaatgagaagctgtacacagtgtgtgatgtggccctgtgtgtgatcaacagcaagagcgccctgtgcaatgctgacagccccaaggaccctgtgctgcccatgaagttcttcacccagcctgagaaggacttctgcaatgacaagagctacatcagcgaggagaccagggtgctgctgctgaccgggaagcccaagccagctggggtgctgggcgctgtgaacaagcccctgagcgccactggaaggaagccctacgtgcgcagcactggaacagagaccggcagcaacatcaacgtgaacagcgagctgaaccccagcacaggcaacagaagccgggagcagagcagcgaggccgctgagaccggggtgtctgaaaatgaagaaaatcctgtgcgcatcatctctgtgacccctgtgaagaacattgatcctgtgaagaacaaggagatcaacagcgaccaggccacccagggcaacatcagcagtgaccggggcaagaagaggacagtgacagctgctggagctgagaacatccagcagaagacagatgagaaggtggatgagagcggccccccagcccccagcaagccccggcggggccggcggcccaagtctgagagccagggcaatgccaccaagaatgatgacctgaacaagcccatcaacaagggcaggaagagagctgctgtgggccaggagagccctgggggcctggaggccggaaatgccaaggcccccaagctgcaggacctggccaagaaggccgccccagctgagcggcagattgacctgcagaggtag

SEQ ID NO: 163404 - DNA, 1803 bp, Artificial Sequence
  Description of Artificial Sequence: Synthetic coding sequence
atggacttcaccgcccagcccaagccagccacagccctgtgtggggtggtgtctgcagatggcaagatcgcctacccacctggggtgaaggagatcacagacaagatcaccacagatgagatgatcaagaggctgaagatggtggtgaagaccttcatggacatggaccaggacagtgaagatgagaagcagcagtacctgcccctggccctgcacctggccagcgagttcttcctgaggaaccccaacaaggatgtgcggctgctggtggcctgctgcctggccgacatcttccgcatctatgcccctgaggccccctacaccagccatgacaagctgaaggacatcttcctgttcatcacccggcagctgaagggcctggaggacaccaagagcccccagttcaaccgctacttctacctgctggagaacctggcctgggtgaagagctacaacatctgctttgagctggaggactgcaatgagatcttcatccagctgttccgcaccctcttcagcgtcatcaacaacagccacaacaagaaggtgcagatgcacatgctggacctgatgagcagcatcatcatggagggagatggagtgacccaggagctgctggacagcatcctgatcaacctgatcccagcccacaagaacctgaacaagcagagctttgacctggccaaggtgctgctgaagaggacagtgcagaccatcgaggcctgcatcgccaacttcttcaaccaggtgctggtgctgggccgcagctctgtgtctgacctgtctgagcacgtgtttgacctgatccaggagctgtttgccatcgacccccacctgctgctgtctgtgatgccccagctggagttcaagctgaagagcaatgatggagaggagcggctggccgtggtgcggctgctggccaagctgtttggcagcaaggacagcgacctggccacccagaaccggcccctgtggcagtgcttcctgggccgcttcaatgacatccacgtgcctgtgcggctggagagcgtgaagtttgccagccactgcctgatgaaccacccagacctggccaaggacctgacagagtacctgaaggtgcgcagccatgaccctgaggaggccatcagacatgatgtgattgtgaccatcatcacagctgccaagagggacctggccctggtgaatgaccagctgctgggctttgtgcgggagaggaccctggacaagcgctggagggtgaggaaggaggccatgatgggcctggcccagctgtacaagaagtactgcctgcacggggaggccggcaaggaggccgctgagaaggtgtcctggatcaaggacaagctgctgcacatctactaccagaacagcattgatgacaagctgctggtggagaagatctttgcccagtacctggtgccccacaacctggagacagaggagaggatgaagtgcctgtactacctgtatgccagcctggaccccaatgctgtgaaggccctgaatgagatgtggaagtgccagaacatgctgcggagccacgtgcgggagctgctggacctgcacaagcagcccaccagcgaggccaactgcagcgccatgtttgggaagctgatgaccatcgccaagaacctgcctgaccccgggaaggcccaggactttgtgaagaagttcaaccaggtgctgggagatgatgagaagctgcggagccagctggagctgctgatcagccccacctgcagctgcaagcaggccgacatctgtgtggtgtccaagagctacttcaccctcttcctgtag

SEQ ID NO: 163405 - DNA, 990 bp, Artificial Sequence
  Description of Artificial Sequence: Synthetic coding sequence
atgaccacccagcagattgacctgcagggccctggcccctggggcttccggctggtgggcggcaaggactttgagcagcccctggccatcagccgggtgaccccaggcagcaaggccgccctggccaacctgtgcattggagatgtgatcacagccattgatggagagaacaccagcaacatgacccacctggaggcccagaaccgcatcaagggctgcacagacaacctgaccctgactgtggcccggtctgagcacaaggtgtggagccccctggtgacagaggagggcaagaggcacccctacaagatgaacctggccagcgagccccaggaggtgctgcacatcggcagcgcccacaacagaagtgccatgcccttcaccgccagccctgccagcagcaccacagcccgggtcatcaccaaccagtacaacaacccagctggcctgtacagcagcgagaacatcagcaacttcaacaatgccctggagagcaagacagctgccagcggcgtggaggccaacagccggcccctggaccacgcccagccccccagcagcctggtgattgacaaggagagcgaggtgtacaagatgctgcaggagaagcaggagctgaatgaaccacccaagcagagcaccagcttcctggtgctgcaggagatcctggagagcgaggagaagggggaccccaacaagcccagcggcttccgctctgtgaaggcccctgtgaccaaggtggccgccagcattggaaatgcccagaagctgcccatgtgtgacaagtgtggcactggaattgtgggcgtgtttgtgaagctgcgggacagacaccgccaccctgagtgctacgtgtgcacagactgtggcaccaacctgaagcagaagggccacttctttgtggaggaccagatctactgtgagaagcacgcccgggagcgggtgaccccacctgagggctatgaggtggtgacagtgttccccaagtag

SEQ ID NO: 163406 - DNA, 1101 bp, Artificial Sequence
  Description of Artificial Sequence: Synthetic coding sequence
atggccctgactgtggatgtggccggccctgccccctggggcttccgcatcaccggcggccgggacttccacacccccatcatggtgaccaaggtggccgagcggggcaaggccaaggatgctgacctgcggcctggggacatcatcgtggccatcaatggagagagcgctgagggcatgctgcatgctgaggcccagagcaagatccggcagagccccagccccctgcggctgcagctggacaggagccaggccaccagccctggccagaccaacggggacagcagcctggaggtgctggccacccgcttccagggctctgtgaggacctacacagagagccagagcagcctgcggagcagctacagcagccccaccagcctgagcccccgggccggcagccccttcagccccccacccagcagcagcagcctgaccggggaggccgccatcagccgctccttccagagcctggcctgcagccctggcctgcctgctgctgaccggctgagctacagcggccggcccggcagccggcaggccggcctgggccgggccggggacagcgctgtgctggtgctgccccccagccctggccccaggagcagccggcccagcatggattctgagggcggcagcctgctgctggatgaggacagcgaggtgttcaagatgctgcaggagaaccgggagggccgggccgccccccggcagagcagcagcttccggctgctgcaggaggccctggaggccgaggagcggggcggcaccccagccttcctgcccagcagcctgagcccccagagcagcctgcctgccagccgggccctggccaccccacccaagctgcacacctgtgagaagtgcagcaccagcatcgccaaccaggccgtgcgcatccaggagggccgctaccgccaccctggctgctacacctgtgccgactgtggcctgaacctgaagatgaggggccacttctgggaggatgcctgtgccatggagggcatgaggctgagcctggaggccctggagggcatggtggagggcgccaagaggcgggacaggaggaagacccggcggcccatccagcccagctggtag

SEQ ID NO: 163407 - DNA, 1809 bp, Artificial Sequence
  Description of Artificial Sequence: Synthetic coding sequence
atgagaggaggccgggcccggcctgcctgggagagcttcatgggcctgcccccaagaagcagcgccaagtggggcgccggccagagcctggaccggctgtgctgtgcccctggcagccggggcctggccggggcccctggccgcatgagggcccccccagctggccgcagccagcctgctgggggccctggggacagcctgccccaccccccaggcggcctgggccctgggggcagcgcctgggccaggagagctgaggccgccgccagccgggcccggggcggcggccggggcggccctggcatcacctgggccgaggccggccctggggcccctgggggcctgagccctgagagcggccggcggcagcgggagcgctggaggctgcctgccttcccccccagccgggcctgggcccccagcaggactggagagcggcagcccggggagcgggcccacctgcggctgagcgcccggcctgccctgcctggagctggcctgctgagcgcccccctgagcgccagaaatcctggcctggtgcggggccctgccccctggagcctggccagcgctggggccccacccagggctgccctgagccctgctggggccctgctgctgcagcccccagcccggcgggtgctgtgccccaggtctgagggcggcagcaggacaggccgggccggccccagcggctgggccccacccaggggggcccggtctgctgagagcacagaccggctgaagggcatggccctgactgtggatgtggccggccctgccccctggggcttccgcatcaccggcggccgggacttccacacccccatcatggtgaccaaggtggccgagcggggcaaggccaaggatgctgacctgcggcctggggacatcatcgtggccatcaatggagagagcgctgagggcatgctgcatgctgaggcccagagcaagatccggcagagccccagccccctgcggctgcagctggacaggagccaggccaccagccctggccagaccaacggggacagcagcctggaggtgctggccacccgcttccagggctctgtgaggacctacacagagagccagagcagcctgcggagcagctacagcagccccaccagcctgagcccccgggccggcagccccttcagccccccacccagcagcagcagcctgaccggggaggccgccatcagccgctccttccagagcctggcctgcagccctggcctgcctgctgctgaccggctgagctacagcggccggcccggcagccggcaggccggcctgggccgggccggggacagcgctgtgctggtgctgccccccagccctggccccaggagcagccggcccagcatggattctgagggcggcagcctgctgctggatgaggacagcgaggtgttcaagatgctgcaggagaaccgggagggccgggccgccccccggcagagcagcagcttccggctgctgcaggaggccctggaggccgaggagcggggcggcaccccagccttcctgcccagcagcctgagcccccagagcagcctgcctgccagccgggccctggccaccccacccaagctgcacacctgtgagaagtgcagcaccagcatcgccaaccaggccgtgcgcatccaggagggccgctaccgccaccctggctgctacacctgtgccgactgtggcctgaacctgaagatgaggggccacttctgggtgggagatgagctgtactgtgagaagcacgcccggcagcgctacagcgccccagccaccctgagcagccgggcctag

SEQ ID NO: 163408 - DNA, 837 bp, Artificial Sequence
  Description of Artificial Sequence: Synthetic coding sequence
atggccctgactgtggatgtggccggccctgccccctggggcttccgcatcaccggcggccgggacttccacacccccatcatggtgaccaaggtggccgagcggggcaaggccaaggatgctgacctgcggcctggggacatcatcgtggccatcaatggagagagcgctgagggcatgctgcatgctgaggcccagagcaagatccggcagagccccagccccctgcggctgcagctggacaggagccaggccaccagccctggccagaccaacggggacagcagcctggaggtgctggccacccgcttccagggctctgtgaggacctacacagagagccagagcagcctgcggagcagctacagcagccccaccagcctgagcccccgggccggcagccccttcagccccccacccagcagcagcagcctgaccggggaggccgccatcagccgctccttccagagcctggcctgcagccctggcctgcctgctgctgaccggctgagctacagcggccggcccggcagccggcaggccggcctgggccgggccggggacagcgctgtgctggtgctgccccccagccctggccccaggagcagccggcccagcatggattctgagggcggcagcctgctgctggatgaggacagcgaggtgttcaagatgctgcaggagaaccgggagggccgggccgccccccggcagagcagcagcttccggctgctgcaggaggccctggaggccgaggagcggggcacccggctgtgtgccagccggcgggccggcacagccaccccagctgccacccctgtgcccaccgtgggctag

SEQ ID NO: 163409 - DNA, 675 bp, Artificial Sequence
  Description of Artificial Sequence: Synthetic coding sequence
atggccctgactgtggatgtggccggccctgccccctggggcttccgcatcaccggcggccgggacttccacacccccatcatggtgaccaaggtggccgagcggggcaaggccaaggatgctgacctgcggcctggggacatcatcgtggccatcaatggagagagcgctgagggcatgctgcatgctgaggcccagagcaagatccggcagagccccagccccctgcggctgcagctggacaggagccaggccaccagccctggccagaccaacggggacagcagcctggaggtgctggccacccgcttccagggctctgtgaggacctacacagagagccagagcagcctgcggagcagctacagcagccccaccagcctgagcccccgggccggcagccccttcagccccccacccagcagcagcagcctgaccggggaggccgccatcagccgcagccggccccggccccgctggaggctgggcggggccggggccgccgccttccctggccccagcttcctgcaggcccagcacggcctgggccggggcaagcccccacctggccggggcctgggcagcctgcaggatgctgctgggaagagccggggcaccggcggccccccaacagtgcagctgctgagcgccctggccggcagccctgggggctag

SEQ ID NO: 163410 - DNA, 1059 bp, Artificial Sequence
  Description of Artificial Sequence: Synthetic coding sequence
atggccctgactgtggatgtggccggccctgccccctggggcttccgcatcaccggcggccgggacttccacacccccatcatggtgaccaaggtggccgagcggggcaaggccaaggatgctgacctgcggcctggggacatcatcgtggccatcaatggagagagcgctgagggcatgctgcatgctgaggcccagagcaagatccggcagagccccagccccctgcggctgcagctggacaggagccaggccaccagccctggccagaccaacggggacagcagcctggaggtgctggccacccgcttccagggctctgtgaggacctacacagagagccagagcagcctgcggagcagctacagcagccccaccagcctgagcccccgggccggcagccccttcagccccccacccagcagcagcagcctgaccggggaggccgccatcagccgctccttccagagcctggcctgcagccctggcctgcctgctgctgaccggctgagctacagcggccggcccggcagccggcaggccggcctgggccgggccggggacagcgctgtgctggtgctgccccccagccctggccccaggagcagccggcccagcatggattctgagggcggcagcctgctgctggatgaggacagcgaggtgttcaagatgctgcaggagaaccgggagggccgggccgccccccggcagagcagcagcttccggctgctgcaggaggccctggaggccgaggagcggggcggcaccccagccttcctgcccagcagcctgagcccccagagcagcctgcctgccagccgggccctggccaccccacccaagctgcacacctgtgagaagtgcagcaccagcatcgccaaccaggccgtgcgcatccaggagggccgctaccgccaccctggctgctacacctgtgccgactgtggcctgaacctgaagatgaggggccacttctgggtgggagatgagctgtactgtgagaagcacgcccggcagcgctacagcgccccagccaccctgagcagccgggcctag

SEQ ID NO: 163411 - DNA, 1059 bp, Artificial Sequence; identical to SEQ ID NO: 163410
  Description of Artificial Sequence: Synthetic coding sequence

SEQ ID NO: 163412 - DNA, 837 bp, Artificial Sequence; identical to SEQ ID NO: 163408
  Description of Artificial Sequence: Synthetic coding sequence

SEQ ID NO: 163413 - DNA, 1059 bp, Artificial Sequence; identical to SEQ ID NO: 163410
  Description of Artificial Sequence: Synthetic coding sequence

SEQ ID NO: 163414 - DNA, 1560 bp, Artificial Sequence
  Description of Artificial Sequence: Synthetic coding sequence
atgaccagcaccttcaacccccgggagtgcaagctgagcaagcaggagggccagaactacggcttcttcctgcgcatcgagaaggacacagagggccacctggtgcgggtggtggagaagtgcagccctgctgagaaggccggcctgcaggatggagacagagtgctgcgcatcaatggagtgtttgtggacaaggaggagcacatgcaggtggtggacctggtgaggaagagcggcaacagcgtgaccctgctggtgctggatggagacagctatgagaaggctgtgaagaccagggtggacctgaaggagctgggccagagccagaaggagcagggcctgagtgacaacatcctgagccctgtgatgaatggaggagtgcagacctggacccagccccggctgtgctacctggtgaaggagggcggcagctatggcttcagcctgaagacagtgcagggcaagaagggcgtgtacatgacagacatcaccccccagggcgtggccatgagagctggggtgctggctgatgaccacctgattgaggtgaatggagaaaatgtggaggatgccagccatgaggaggtggtggagaaggtgaagaagagcggcagccgggtgatgttcctgctggtggacaaggagacagacaagagacatgtggagcagaagatccagttcaagcgggagacagccagcctgaagctgctgccccaccagcccagaattgtggagatgaagaagggcagcaatggctacggcttctacctgcgggccggcagcgagcagaagggccagatcatcaaggacattgattctggcagccctgctgaggaggccggcctgaagaacaatgacctggtggtggccgtgaatggagagagcgtggagaccctggaccatgattctgtggtggagatgatcaggaagggcggggaccagaccagcctgctggtggtggacaaggagacagacaacatgtaccgcctggcccacttcagccccttcctgtactaccagagccaggagctgcccaacggctctgtgaaggaggccccagcccccacccccaccagcctggaggtgagcagccccccagacaccacagaggaggtggaccacaagcccaagctgtgccgcctggccaagggagaaaatggctacggcttccacctgaatgccatccggggcctgcccggcagcttcatcaaggaggtgcagaagggcggccctgctgacctggccggcctggaggatgaagatgtgatcatcgaggtgaatggagtgaatgtgctggatgagccctatgagaaggtggtggaccgcatccagagcagcggcaagaatgtgaccctgctggtgtgtgggaagaaggcctatgactacttccaggccaagaagatccccatcgtgagcagcctggccgaccccctggacaccccaccagacagcaaggagggcatcgtggtggagagcaaccacgacagccacatggccaaggagcgggcccacagcacagccagccacagcagcagcaacagcgaggacacagagatgtag

SEQ ID NO: 163415 - DNA, 1560 bp, Artificial Sequence; identical to SEQ ID NO: 163414
  Description of Artificial Sequence: Synthetic coding sequence

SEQ ID NO: 163416 - DNA, 795 bp, Artificial Sequence
  Description of Artificial Sequence: Synthetic coding sequence
atgaccagcaccttcaacccccgggagtgcaagctgagcaagcaggagggccagaactacggcttcttcctgcgcatcgagaaggacacagagggccacctggtgcgggtggtggagaagtgcagccctgctgagaaggccggcctgcaggatggagacagagtgctgcgcatcaatggagtgtttgtggacaaggaggagcacatgcaggtggtggacctggtgaggaagagcggcaacagcgtgaccctgctggtgctggatggagacagctatgagaaggctgtgaagaccagggtggacctgaaggagctgggccagagccagaaggagcagggcctgagtgacaacatcctgagccctgtgatgaatggaggagtgcagacctggacccagccccggctgtgctacctggtgaaggagggcggcagctatggcttcagcctgaagacagtgcagggcaagaagggcgtgtacatgacagacatcaccccccagggcgtggccatgagagctggggtgctggctgatgaccacctgattgaggtgaatggagaaaatgtggaggatgccagccatgaggaggtggtggagaaggtgaagaagagcggcagccgggtgatgttcctgctggtggacaaggagacagacaagagacatgtggagcagaagatccagttcaagcgggagacagccagcctgaagctgctgccccaccagcccagaattgtggagatgaagaagggcagcaatggctacggcttctacctgcgggccggcagcgagcagaagtag

SEQ ID NO: 163417 - DNA, 1227 bp, Artificial Sequence
  Description of Artificial Sequence: Synthetic coding sequence
atgaccagcaccttcaacccccgggagtgcaagctgagcaagcaggagggccagaactacggcttcttcctgcgcatcgagaaggacacagagggccacctggtgcgggtggtggagaagtgcagccctgctgagaaggccggcctgcaggatggagacagagtgctgcgcatcaatggagtgtttgtggacaaggaggagcacatgcaggtggtggacctggtgaggaagagcggcaacagcgtgaccctgctggtgctggatggagacagctatgagaaggctgtgaagaccagggtggacctgaaggagctgggccagagccagaaggagcagggcctgagtgacaacatcctgagccctgtgatgaatggaggagtgcagacctggacccagccccggctgtgctacctggtgaaggagggcggcagctatggcttcagcctgaagacagtgcagggccagatcatcaaggacatcgacagcggcagccctgctgaggaggccggcctgaagaacaatgacctggtggtggccgtgaatggagagagcgtggagaccctggaccatgacagcgtggtggagatgatcagaaaaggaggagaccagaccagcctgctggtggtggacaaggagacagacaacatgtaccgcctggcccacttcagccccttcctgtactaccagagccaggagctgcccaatggatctgtgaaggaggccccagcccccacccccaccagcctggaggtgagcagccccccagacaccacagaggaggtggaccacaagcccaagctgtgccgcctggccaagggggagaatggctacggcttccacctgaatgccatccggggcctgcccggcagcttcatcaaggaggtgcagaagggcggccctgctgacctggccggcctggaggatgaagatgtgatcatcgaggtgaatggagtgaatgtgctggatgagccctatgagaaggtggtggaccgcatccagagcagcggcaagaatgtgaccctgctggtgtgtgggaagaaggcctatgactacttccaggccaagaagatccccatcgtgagcagcctggccgaccccctggacaccccaccagacagcaaggagggcatcgtggtggagagcaaccacgacagccacatggccaaggagcgggcccacagcacagccagccacagcagcagcaacagcgaggacacagagatgtag

SEQ ID NO: 163418 - DNA, 423 bp, Artificial Sequence
  Description of Artificial Sequence: Synthetic coding sequence
atggacagccgcatcccctatgatgactaccctgtggtgttcctgcctgcctatgaaaatcctccagcctggatcccccctcatgagcgggtgcaccacccagactacaacaatgagctgacccagttcctgcccaggaccatcaccctgaagaagcccccaggggcccagctgggcttcaacatccggggcggcaaggccagccagctgggcatcttcatcagcaaggtgatcccagacagtgatgcccaccgggccggcctgcaggagggggaccaggtgctggccgtgaatgatgtggacttccaggacatcgagcacagcaaggctgtggagatcctgaagacagcccgggagatctccatgagggtgcgcttcttcccctacaactaccaccggcagaaggagaggacagtgcactag

SEQ ID NO: 163419 - DNA, 423 bp, Artificial Sequence; identical to SEQ ID NO: 163418
  Description of Artificial Sequence: Synthetic coding sequence

SEQ ID NO: 163420 - DNA, 8520 bp, Artificial Sequence
  Description of Artificial Sequence: Synthetic coding sequence
atgcccatcacccaggacaatgctgtgctgcacctgcccctgctgtaccagtggctgcagaacagcctgcaggagggcggagatggccctgagcagaggctgtgccaggccgccatccagaagctgcaggagtacatccagctgaactttgctgtggatgagagcacagtgcccccagaccacagccccccagagatggagatctgcaccgtgtacctgaccaaggagctgggggacacagagaccgtgggcctgagctttggaaacatccctgtgtttggagactatggagagaagaggcggggcggcaagaagaggaagacccaccagggccctgtgctggatgtgggctgcatctgggtgacagagctgaggaagaacagccctgctgggaagagcggcaaggtgcggctgagagatgagatcctgagcctgaatggccagctgatggtgggcgtggatgtgtctggggccagctacctggccgagcagtgctggaatggaggcttcatctacctgatcatgctgcggcgcttcaagcacaaggcccacagcacctacaacggcaacagcagcaacagcagcgagcctggagagacccccaccctggagctgggggacagaacagccaagaagggcaagaggaccaggaagtttggagtcatcagccggcccccagccaacaaggcccctgaggagagcaaaggatctgctggctgtgaggtgtccagtgaccccagcacagagctggagaatggaccagaccctgagctgggcaatggccacgtgttccagctggagaatggaccagacagcctgaaggaggtggccggcccccacctggagaggtctgaggtggaccggggcacagagcaccgcatccccaagacagatgcccccctgaccaccagcaatgacaagaggcgcttcagcaagggcggcaagacagacttccagagcagtgactgcctggcccgggaggaggtgggccgcatctggaagatggagctgctgaaggagagtgatggcctgggcatccaggtgtctgggggccggggcagcaagaggagcccccacgccatcgtggtgacccaggtgaaggagggcggggccgcccacagagatggccgcctgagcctgggagatgagctgctggtgatcaatggccacctgctggtgggcctgagccatgaggaggccgtggccatcctgcggagcgccaccggcatggtgcagctggtggtggccagcaaagaaaattctgctgaggacctgctgcggctgaccagcaagagcctgcctgacctgaccagctctgtggaggatgtgtcctcctggacagacaatgaagaccaggaggctgatggagaggaggatgagggcaccagcagctctgtgcagagggccatgcctggaacagatgagccccaggatgtgtgtggggctgaggagagcaagggcaacctggagagccccaagcagggcagcaacaagatcaagctgaagagccggctgagcggcggcgtgcaccggctggagagcgtggaggagtacaatgagctgatggtgagaaatggagacccccgcatccgcatgctggaggtgtccagagatggcaggaagcacagcctgccccagctgctggacagcagcagcgccagccaggagtaccacatcgtgaagaagagcaccaggagcctgagcaccacccaggtggagagcccctggaggctcatccggcccagcgtcatcagcatcatcggcctgtacaaggagaagggcaagggcctgggcttcagcattgctgggggccgggactgcatccggggccagatgggcatctttgtgaagaccatcttccccaacggcagcgctgctgaagatggccgcctgaaggagggagatgagatcctggatgtgaatggcatccccatcaagggcctgaccttccaggaggccatccacaccttcaagcagatccgcagcggcctgtttgtgctgactgtgaggaccaagctggtgagccccagcctgaccccctgcagcacccccacccacatgagccgcagcgccagccccaacttcaacaccagcggcggggccagcgctgggggcagtgatgagggcagcagcagcagcctgggcaggaagaccccaggccccaaggacagaattgtgatggaggtgaccctgaacaaggagccccgggtgggcctgggcattggagcctgctgcctggccctggagaacagccccccaggcatctacatccacagcctggcccctggctctgtggccaagatggagagcaacctgagcagaggagaccagatcctggaggtgaacagcgtgaatgtgagacatgctgccctgagcaaggtgcacgccatcctgagcaagtgccccccaggccctgtgcggctggtgattggccgccaccccaaccccaaggtgtctgagcaggagatggatgaggtgattgcccggagcacctaccaggagagcaaggaggccaacagcagccctggcctgggcacccccctgaagagccccagcctggccaagaaggacagcctcatcagcgagagcgagctgagccagtactttgcccatgatgtgcccggccccctgagtgacttcatggtggccggctctgaagatgaggaccaccctggcagcggctgcagcaccagcgaggagggcagcctgccccccagcaccagcacccacaaggagcccgggaagccccgggccaacagcctggtgaccctgggcagccaccgggccagcggcctcttccacaagcaggtgacagtggcccggcaggccagcctgcccggcagcccccaggccctgaggaaccccctgctgcggcagaggaaggtgggctgctatgatgccaatgatgccagtgatgaggaggagtttgaccgggagggggactgcatcagcctgcccggggccctgcccggccccatccggcccctgtctgaagatgacccccggcgggtgtccatcagcagcagcaagggcatggatgtgcacaaccaggaggagcggcccaggaagaccctggtgtccaaggccatcagcgcccccctgctgggcagctctgtggacctggaggagagcatccctgagggcatggtggatgctgccagctatgctgccaacctgacagacagcgctgaggcccccaagggcagccctggctcctggtggaagaaggagctgagcggcagcagcagcgcccccaagctggagtacacagtgaggacagacacccagagccccaccaacacaggcagccccagcagcccccagcagaagtctgagggcctgggcagccgccacaggcctgtggcccgggtgagcccccactgcaagaggtctgaggccgaggccaagcccagcggcagccagacagtgaacctgaccggccgggccaatgacccctgtgacctggacagccgggtgcaggccacctctgtgaaggtgacagtggccggcttccagcctggaggagctgtggagaaggagagcctgggcaagctgaccactggagatgcctgtgtgtccaccagctgtgagctggccagcgccctgagccacctggatgccagccacctgacagagaacctgcccaaggccgccagcgagctgggccagcagcccatgacagagctggacagcagcagtgacctgatcagcagccctgggaagaagggggccgcccacccagaccccagcaagacctctgtggacaccggccaggtgtccaggcctgagaaccccagccagcctgccagcccccgggtgaccaagtgcaaggcccggagccctgtgcggctgccccatgagggcagccccagccctggagagaaggctgctgcccccccagactacagcaagaccaggtctgccagcgagaccagcaccccccacaacacccggcgggtggccgccctgcggggggccggccctggagctgagggcatgaccccagctggagctgtgctgcccggggaccccctgaccagccaggagcagaggcagggcgcccctggcaaccacagcaaggccctggagatgacaggcatccacgcccctgagagcagccaggagcccagcctgctggagggcgctgacagcgtgagcagccgggccccccaggccagcctgtccatgctgcccagcacagacaacaccaaggaggcctgtggccacgtgtctggccactgctgccctgggggcagccgggagagccctgtgacagacatcgacagcttcatcaaggagctggatgccagcgctgcccggagccccagcagccagacaggagacagcggcagccaggagggcagcgcccagggccaccccccagctggggccggcggcggcagcagctgcagagctgagcctgtgcctgggggccagaccagcagcccccggcgggcctgggccgccggggccccagcctacccccagtgggccagccagcccagcgtgctggacagcatcaacccagacaagcacttcaccgtgaacaagaacttcctgagcaactacagcaggaacttcagcagcttccacgaggacagcaccagcctgagcggcctgggggacagcacagagcccagcctgagctccatgtatggagatgctgaggacagcagcagtgaccctgagagcctgacagaggccccccgggccagcgccagagatggctggagccccccaagaagccgggtgtccctgcacaaggaggaccccagcgagagcgaggaggagcagatcgagatctgcagcacccggggctgccccaacccccccagcagccctgcccacctgcccacccaggccgccatctgcccagccagcgccaaggtgctgagcctgaagtacagcaccccccgggagagcgtggccagcccccgggagaaggccgcctgcctgcccggcagctacaccagcggccctgacagcagccagcccagcagcctgctggagatgagcagccaggagcacgagacccacgccgacatcagcaccagccagaaccaccggcccagctgtgccgaggagaccacagaggtgaccagcgccagcagcgccatggagaacagccccctgagcaaggtggcccggcacttccacagcccccccatcatcctgagcagccccaacatggtgaatggcctggagcatgacctgctggatgatgagaccctgaaccagtatgagaccagcatcaatgctgctgccagcctgagcagcttctctgtggatgtgcccaagaatggagagagcgtgctggagaacctgcacatcagcgagagccaggacctggatgacctgctgcagaagcccaagatgattgcccggcggcccatcatggcctggttcaaggagatcaacaagcacaaccagggcacccacctgcggagcaagacagagaaggagcagcccctgatgcctgcccggagcccagacagcaagatccagatggtgagcagcagccagaagaagggcgtgacagtgccccacagccccccccagcccaagaccaacctggagaacaaggacctgagcaagaagagccctgctgagatgctgctgaccaacggccagaaggccaagtgtggccccaagctgaagaggctgagcctgaagggcaaggccaaggtgaacagcgaggccccagctgccaatgctgtgaaggccggcggcacagaccacaggaagcccctcatcagcccccagaccagccacaagaccctgagcaaggctgtgtcccagaggctgcacgtggccgaccatgaagatcctgacaggaacaccacagctgcccccaggagcccccagtgtgtgctggagagcaagccacccctggccaccagcggccccctgaagcccagcgtgtctgacaccagcatccgcacctttgtgagccccctgaccagccccaagcctgtgcctgagcagggcatgtggagccgcttccacatggctgtgctgtctgagccagaccggggctgccccaccacccccaagagccccaagtgcagagctgagggccgggcccccagggctgacagcggccctgtgtccccagctgccagcagaaatggcatgtctgtggccggcaaccggcagagcgagccccggctggccagccacgtggccgctgacacagcccagccccggcccactggagagaagggcggcaacatcatggccagtgaccggctggagaggaccaaccagctgaagatcgtggagatctctgctgaggccgtgtctgaaacagtgtgtggcaacaagccagctgagagtgaccggcggggcggctgcctggcccagggcaactgccaggagaagtctgagatccggctgtaccggcaggtggccgagagcagcaccagccaccccagcagcctgcccagccacgccagccaggccgagcaggagatgagccgctccttctccatggccaagctggccagcagcagcagcagcctgcagacagccatcaggaaggccgagtacagccagggcaagagcagcctgatgtctgacagccggggcgtgcccagaaattccatccctgggggccccagcggggaggaccacctgtacttcacccccaggcctgccaccaggacctacagcatgcctgcccagttcagcagccacttcggccgggagggccaccccccccacagcctgggccgcagccgggacagccaggtgcctgtgaccagctctgtggtgcctgaggccaaggccagccggggcggcctgcccagcctggccaacggccagggcatctacagcgtgaagcccctgctggacaccagcaggaacctgcctgccacagatgaaggagacatcatctctgtgcaggagaccagctgcctggtgacagacaagatcaaggtgacccggcggcactactgctatgagcagaactggccccatgagagcaccagcttcttctctgtgaagcagaggatcaagagctttgagaacctggccaatgctgacaggcctgtggccaagagcggggccagccccttcctgtctgtgagcagcaagccacccatcggcagaagaagcagcggcagcatcgtgtctggcagcctgggccaccctggagatgctgctgcccggctgctgcggcgcagcctgagcagctgcagcgagaaccagagcgaggccggcaccctgctgccccagatggccaagagccccagcatcatgaccctgaccatcagccggcagaaccccccagagaccagcagcaagggcagtgacagcgagctgaagaagagcctgggccccctgggcatccccacccccaccatgaccctggccagccctgtgaagaggaacaagagctctgtgcgccacacccagcccagccctgtgagccgcagcaagctgcaggagctgcgggccctgtccatgccagacctggacaagctgtgcagcgaggactacagcgctggccccagcgctgtgctcttcaagacagagctggagatcaccccaagaagaagccctggccccccagctgggggcgtgtcctgcccagagaagggcggcaacagagcctgccctgggggcagcggccccaagaccagcgctgctgagacccccagcagcgccagtgacaccggggaggccgcccaggacctgcccttccgccgctcctggagcgtgaacctggaccagctgctggtgtctgctggggaccagcagaggctgcagagcgtgctgagctctgtgggcagcaagagcaccatcctgaccctcatccaggaggccaaggcccagagtgaaaatgaggaggatgtgtgcttcatcgtgctgaacaggaaggagggcagcggcctgggcttctctgtggccggcggcacagatgtggagcccaagagcatcaccgtgcacagggtcttcagccagggcgccgccagccaggagggcaccatgaacagaggagacttcctgctgtctgtgaatggagccagcctggccggcctggcccacggcaatgtgctgaaggtgctgcaccaggcccagctgcacaaggatgccctggtggtgatcaagaagggcatggaccagccccggcccagcgcccggcaggagcccccaacagccaacgggaagggcctgctgagcaggaagaccatccccctggagcccggcatcggccgctctgtggccgtgcatgatgccctgtgtgtggaggtgctgaagaccagcgctggcctgggcctgagcctggatggcggcaagagctctgtgactggagatggccccctggtgatcaagagggtgtacaagggcggcgctgctgagcaggccggcatcatcgaggccggagatgagatcctggccatcaacgggaagcccctggtgggcctgatgcactttgatgcctggaacatcatgaagtctgtgcctgagggccctgtgcagctgctgatcaggaagcacaggaacagcagctag

SEQ ID NO: 163421 - DNA, 7923 bp, Artificial Sequence
  Description of Artificial Sequence: Synthetic coding sequence
atgcccatcacccaggacaatgctgtgctgcacctgcccctgctgtaccagtggctgcagaacagcctgcaggagggcggagatggccctgagcagaggctgtgccaggccgccatccagaagctgcaggagtacatccagctgaactttgctgtggatgagagcacagtgcccccagaccacagccccccagagatggagatctgcaccgtgtacctgaccaaggagctgggggacacagagaccgtgggcctgagctttggaaacatccctgtgtttggagactatggagagaagaggcggggcggcaagaagaggaagacccaccagggccctgtgctggatgtgggctgcatctgggtgacagagctgaggaagaacagccctgctgggaagagcggcaaggtgcggctgagagatgagatcctgagcctgaatggccagctgatggtgggcgtggatgtgtctggggccagctacctggccgagcagtgctggaatggaggcttcatctacctgatcatgctgcggcgcttcaagcacaaggcccacagcacctacaacggcaacagcagcaacagcagcgagcctggagagacccccaccctggagctgggggacagaacagccaagaagggcaagaggaccaggaagtttggagtcatcagccggcccccagccaacaaggcccctgaggagagcaaaggatctgctggctgtgaggtgtccagtgaccccagcacagagctggagaatggaccagaccctgagctgggcaatggccacgtgttccagctggagaatggaccagacagcctgaaggaggtggccggcccccacctggagaggtctgaggtggaccggggcacagagcaccgcatccccaagacagatgcccccctgaccaccagcaatgacaagaggcgcttcagcaagggcggcaagacagacttccagagcagtgactgcctggcccgggaggaggtgggccgcatctggaagatggagctgctgaaggagagtgatggcctgggcatccaggtgtctgggggccggggcagcaagaggagcccccacgccatcgtggtgacccaggtgaaggagggcggggccgcccaccgggagtaccacatcgtgaagaagagcaccaggagcctgagcaccacccaggtggagagcccctggaggctcatccggcccagcgtcatcagcatcatcggcctgtacaaggagaagggcaagggcctgggcttcagcattgctgggggccgggactgcatccggggccagatgggcatctttgtgaagaccatcttccccaatggatctgctgctgaagatggccgcctgaaggagggagatgagatcctggatgtgaatggcatccccatcaagggcctgaccttccaggaggccatccacaccttcaagcagatccgcagcggcctgtttgtgctgactgtgaggaccaagctggtgagccccagcctgaccccctgcagcacccccacccacatgagccgcagcgccagccccaacttcaacaccagcggcggggccagcgctgggggcagtgatgagggcagcagcagcagcctgggcaggaagaccccaggccccaaggaccgcatcgtgatggaggtgaccctgaacaaggagccccgggtgggcctgggcatcggggcctgctgcctggccctggagaacagccccccaggcatctacatccacagcctggcccctggctctgtggccaagatggagagcaacctgagcagaggagaccagatcctggaggtgaacagcgtgaatgtgagacatgctgccctgagcaaggtgcacgccatcctgagcaaatgtcctgtgtctgagcaggagatggatgaggtgattgcccggagcacctaccaggagagcaaggaggccaacagcagccctggcctgggcacccccctgaagagccccagcctggccaagaaggacagcctcatcagcgagagcgagctgagccagtactttgcccatgatgtgcccggccccctgagtgacttcatggtggccggctctgaagatgaggaccaccctggcagcggctgcagcaccagcgaggagggcagcctgccccccagcaccagcaaggagcccgggaagccccgggccaacagcctggtgaccctgggcagccaccgggccagcggcctcttccacaagcaggtgacagtggcccggcaggccagcctgcccggcagcccccaggccctgaggaaccccctgctgcggcagaggaaggtgggctgctatgatgccaatgatgccagtgatgaggaggagtttgaccgggagggggactgcatcagcctgcccggggccctgcccggccccatccggcccctgtctgaagatgacccccggcgggtgtccatcagcagcagcaagggcatggatgtgcacaaccaggaggagcggcccaggaagaccctggtgtccaaggccatcagcgcccccctgctgggcagctctgtggacctggaggagagcatccctgagggcatggtggatgctgccagctatgctgccaacctgacagacagcgctgaggcccccaagggcagccctggctcctggtggaagaaggagctgagcggcagcagcagcgcccccaagctggagtacacagtgaggacagacacccagagccccaccaacacaggcagccccagcagcccccagcagaagtctgagggcctgggcagccgccacaggcctgtggcccgggtgagcccccactgcaagaggtctgaggccgaggccaagcccagcggcagccagacagtgaacctgaccggccgggccaatgacccctgtgacctggacagccgggtgcaggccacctctgtgaaggtgacagtggccggcttccagcctggaggagctgtggagaagctgtgccaggagagcctgggcaagctgaccactggagatgcctgtgtgtccaccagctgtgagctggccagcgccctgagccacctggatgccagccacctgacagagaacctgcccaaggccgccagcgagctgggccagcagcccatgacagccagtgacctgatcagcagccctgggaagaagggagctgcccacccagaccccagcaagacctctgtggacaccggccaggtgtccaggcctgagaaccccagccagcctgccagcccccgggtgaccaagtgcaaggcccggagccctgtgcggctgccccatgagggcagccccagccctggagagaaggccgccgcccccccagactacagcaagaccaggtctgccagcgagaccagcaccccccacaacaccaggagagtggccgccctgcggggagctggccctggagctgagggcatgaccccagctggagctgtgctgcccggggaccccctgaccagccaggagcagaggcagggcgcccctggcaaccacagcaaggccctggagatgacaggcatccacgcccctgagagcagccaggagcccagcctgctggagggcgctgacagcgtgagcagccgggccccccaggccagcctgtccatgctgcccagcacagacaacaccaaggaggcctgtggccacgtgtctggccactgctgccctgggggcagccgggagagccctgtgacagacatcgacagcttcatcaaggagctggatgccagcgctgcccggagccccagcagccagacaggagacagcggcagccaggagggcagcgcccagggccaccccccagctggagctgggggcggcagcagctgcagagctgagcctgtgcctgggggccagaccagcagcccccggcgggcctgggccgccggggccccagcctacccccagtgggccagccagcccagcgtgctggacagcatcaacccagacaagcacttcaccgtgaacaagaacttcctgagcaactacagcaggaacttcagcagcttccacgaggacagcaccagcctgagcggcctgggggacagcacagagcccagcctgagctccatgtatggagatgctgaggacagcagcagtgaccctgagagcctgacagaggccccccgggccagcgccagagatggctggagcccccccaggagccgggtgtccctgcacaaggaggaccccagcgagagcgaggaggagcagatcgagatctgcagcacccggggctgccccaacccccccagcagccctgcccacctgcccacccaggccgccatctgcccagccagcgccaaggtgctgagcctgaagtacagcaccccccgggagagcgtggccagcccccgggagaaggccgcctgcctgcccggcagctacaccagcggccctgacagcagccagcccagcagcctgctggagatgagcagccaggagcacgagacccatgctgacatcagcaccagccagaaccaccggcccagctgtgccgaggagaccacagaggtgaccagcgccagcagcgccatggagaacagccccctgagcaaggtggcccggcacttccacagcccccccatcatcctgagcagccccaacatggtgaatggcctggagcatgacctgctggatgatgagaccctgaaccagtatgagaccagcatcaatgctgctgccagcctgagcagcttctctgtggatgtgcccaagaatggagagagcgtgctggagaacctgcacatcagcgagagccaggacctggatgacctgctgcagaagcccaagatgattgcccggcggcccatcatggcctggttcaaggagatcaacaagcacaaccagggcacccacctgcggagcaagacagagaaggagcagcccctgatgcctgcccggagcccagacagcaagatccagatggtgagcagcagccagaagaagggcgtgacagtgccccacagccccccccagcccaagaccaacctggagaacaaggacctgagcaagaagagccctgctgagatgctgctgaccaacggccagaaggccaagtgtggccccaagctgaagaggctgagcctgaagggcaaggccaaggtgaacagcgaggccccagctgccaatgctgtgaaggccggcggcacagaccacaggaagcccctcatcagcccccagaccagccacaagaccctgagcaaggctgtgtcccagaggctgcacgtggccgaccacgaggaccctgacaggaacaccacagctgcccccaggagcccccagtgtgtgctggagagcaagccacccctggccaccagcggccccctgaagcccagcgtgtctgacaccagcatccgcacctttgtgagccccctgaccagccccaagcctgtgcctgagcagggcatgtggagccgcttccacatggctgtgctgtctgagccagaccggggctgccccaccacccccaagagccccaagtgcagagctgagggccgggcccccagggctgacagcggccctgtgtccccagctgccagcagaaatggcatgtctgtggccggcaaccggcagagcgagccccggctggccagccacgtggccgctgacacagcccagccccggcccaccggggagaagggcggcaacatcatggccagtgaccggctggagaggaccaaccagctgaagatcgtggagatctctgctgaggccgtgtctgagaccgtgtgtggcaacaagccagctgagagtgacagaagaggaggctgcctggcccagggcaactgccaggagaagtctgagatccggctgtaccggcaggtggccgagagcagcaccagccaccccagcagcctgcccagccacgccagccaggccgagcaggagatgagccgctccttctccatggccaagctggccagcagcagcagcagcctgcagacagccatcaggaaggccgagtacagccagggcaagagcagcctgatgtctgacagcagaggagtgcccaggaacagcatccctgggggccccagcggggaggaccacctgtacttcacccccaggcctgccaccaggacctacagcatgcctgcccagttcagcagccacttcggccgggagggccaccccccccacagcctgggccgcagccgggacagccaggtgcctgtgaccagctctgtggtgcctgaggccaaggccagcagaggaggcctgcccagcctggccaacggccagggcatctacagcgtgaagcccctgctggacaccagcaggaacctgcctgccacagatgaaggagacatcatctctgtgcaggagaccagctgcctggtgacagacaagatcaaggtgaccaggaggcactactgctatgagcagaactggccccatgagagcaccagcttcttctctgtgaagcagaggatcaagagctttgagaacctggccaatgctgacaggcctgtggccaagagcggggccagccccttcctgtctgtgagcagcaagccacccatcggccgccgcagcagcggcagcatcgtgtctggcagcctgggccaccctggagatgctgctgcccggctgctgcggcgcagcctgagcagctgcagcgagaaccagagcgaggccggcaccctgctgccccagatggccaagagccccagcatcatgaccctgaccatcagccggcagaaccccccagagaccagcagcaaaggaagtgacagcgagctgaagaagagcctgggccccctgggcatccccacccccaccatgaccctggccagccctgtgaagaggaacaagagctctgtgcgccacacccagcccagccctgtgagccgcagcaagctgcaggagctgcgggccctgtccatgccagacctggacaagctgtgcagcgaggactacagcgctggccccagcgctgtgctcttcaagacagagctggagatcaccccccggcgcagccctggccccccagctggaggagtgtcctgcccagagaagggcggcaacagagcctgccctgggggcagcggccccaagaccagcgctgctgagacccccagcagcgccagtgacacaggagaggccgcccaggacctgcccttcagaagatcctggagcgtgaacctggaccagctgctggtgtctgctggggaccagcagaggctgcagagcgtgctgagctctgtgggcagcaagagcaccatcctgaccctcatccaggaggccaaggcccagagtgaaaatgaagaagatgtgtgcttcatcgtgctgaacaggaaggagggcagcggcctgggcttctctgtggccggcggcacagatgtggagcccaagagcatcaccgtgcacagggtcttcagccagggcgccgccagccaggagggcaccatgaacagaggagacttcctgctgtctgtgaatggagccagcctggccggcctggcccatggaaatgtgctgaaggtgctgcaccaggcccagctgcacaaggatgccctggtggtgatcaagaagggcatggaccagccccggcccagcgcccggcaggagcccccaacagccaacgggaagggcctgctgagcaggaagaccatccccctggagcccggcatcggccgctctgtggccgtgcatgatgccctgtgtgtggaggtgctgaagaccagcgctggcctgggcctgagcctggatggcggcaagagctctgtgactggagatggccccctggtgatcaagagggtgtacaagggcggcgctgctgagcaggccggcatcattgaagctggagatgagatcctggccatcaatggcaagcccctggtgggcctgatgcactttgatgcctggaacatcatgaagtctgtgcctgagggccctgtgcagctgctgatcaggaagcacaggaacagcagctag

SEQ ID NO: 163422 - DNA, 8520 bp, Artificial Sequence; identical to SEQ ID NO: 163420
  Description of Artificial Sequence: Synthetic coding sequence

SEQ ID NO: 163423 - DNA, 45 bp, Artificial Sequence
  Description of Artificial Sequence: Synthetic coding sequence
atgcccatcacccaggacaatgctgtgctgcacctgcccctgtag

SEQ ID NO: 163424 - DNA, 1476 bp, Artificial Sequence
  Description of Artificial Sequence: Synthetic coding sequence
atggagaaggctgctgacctgcaggacacagccagcctgaccctgaagttcaagttcaaccccaagctgggcatcgacaaccctgtgctgagcctggccgaggaccatgacccctatgacccctggagcctggagcggccccgcttctgcctgctgagcaaggaggagggcaagagctttggcttccacctgcagcaggagctgggccgggccggccacgtggtgtgccgggtggaccccggcaccagcgcccagaggcagggcctgcaggagggggaccgcatcctggccgtgaacaatgatgtggtggagcacgaggactatgctgtggtggtgcggcgcatccgggccagcagcccccgggtgctgctgactgtgctggcccggcatgcccatgatgtggcccgggcccagctgggagaagatgcccacctgtgccccaccctgggccctggggtgcggccccggctgtgccacatcgtgaaggatgaaggaggcttcggcttctctgtgacccacggcaaccagggccccttctggctggtgctgagcactggaggagctgctgagcgggccggcgtgcccccaggggcccggctgctggaggtgaatggcctgtggcagagcggccagcaggtgaccctgctggtggccggccctgaggtggaggagcagtgccggcagctgggcctgcccctggccgcccccctggccgagggctgggccctgcccaccaagccccgctgcctgcacctggagaagggcccccagggcttcggcttcctgctgcgggaggagaagggcctggatggccggcccggccagttcctgtgggaggtggaccccggcctgcctgccaagaaggccggcatgcaggccggggaccggctggtggccgtggccggggagagcgtggagggcctgggccacgaggagaccgtgagccgcatccagggccagggcagctgtgtgtccctgactgtggtggaccctgaggccgaccgcttcttctccatggtgcggctgagccccctgctcttcctggagaacacagaggccccagccagcccccggggcagcagcagcgccagcctggtggagacagaggaccccagcctggaggacacctctgtgcccagcgtgcccctgggcagccggcagtgcttcctgtacccaggccctgggggcagctatggcttccggctgagctgtgtggccagcggccccaggctcttcatcagccaggtgacccctgggggcagcgctgcccgggccggcctgcaggtgggagatgtgatcctggaggtgaatggctaccctgtgggcggccagaatgacctggagcggctgcagcagctgcctgaggccgagccccccctgtgcctgaagctggccgcccggagcctgcggggcctggaggcctggatccccccaggagctgctgaggactgggccctggccagtgacctgctgtag

SEQ ID NO: 163425 - DNA, 1518 bp, Artificial Sequence
  Description of Artificial Sequence: Synthetic coding sequence
atggagaaggctgctgacctgcaggacacagccagcctgaccctgaagttcaagttcaaccccaagctgggcatcgacaaccctgtgctgagcctggccgaggaccatgacccctatgacccctggagcctggagcggccccgcttctgcctgctgagcaaggaggagggcaagagctttggcttccacctgcagcaggagctgggccgggccggccacgtggtgtgccgggtggaccccggcaccagcgcccagaggcagggcctgcaggagggggaccgcatcctggccgtgaacaatgatgtggtggagcacgaggactatgctgtggtggtgcggcgcatccgggccagcagcccccgggtgctgctgactgtgctggcccggcatgcccatgatgtggcccgggcccagctgggagaagatgcccacctgtgccccaccctgggccctggggtgcggccccggctgtgccacatcgtgaaggatgaaggaggcttcggcttctctgtgacccacggcaaccagggccccttctggctggtgctgagcactggaggagctgctgagcgggccggcgtgcccccaggggcccggctgctggaggtgaatggagtgtctgtggagaagttcacccacaaccagctgaccaggaagctgtggcagagcggccagcaggtgaccctgctggtggccggccctgaggtggaggagcagtgccggcagctgggcctgcccctggccgcccccctggccgagggctgggccctgcccaccaagccccgctgcctgcacctggagaagggcccccagggcttcggcttcctgctgcgggaggagaagggcctggatggccggcccggccagttcctgtgggaggtggaccccggcctgcctgccaagaaggccggcatgcaggccggggaccggctggtggccgtggccggggagagcgtggagggcctgggccacgaggagaccgtgagccgcatccagggccagggcagctgtgtgtccctgactgtggtggaccctgaggccgaccgcttcttctccatggtgcggctgagccccctgctcttcctggagaacacagaggccccagccagcccccggggcagcagcagcgccagcctggtggagacagaggaccccagcctggaggacacctctgtgcccagcgtgcccctgggcagccggcagtgcttcctgtacccaggccctgggggcagctatggcttccggctgagctgtgtggccagcggccccaggctcttcatcagccaggtgacccctgggggcagcgctgcccgggccggcctgcaggtgggagatgtgatcctggaggtgaatggctaccctgtgggcggccagaatgacctggagcggctgcagcagctgcctgaggccgagccccccctgtgcctgaagctggccgcccggagcctgcggggcctggaggcctggatccccccaggagctgctgaggactgggccctggccagtgacctgctgtag

SEQ ID NO: 163426 - DNA, 1716 bp, Artificial Sequence
  Description of Artificial Sequence: Synthetic coding sequence
atggtgacccccagccccccaggcaaccacagcctgagcctggaggccccccggctgcacacagccagtgacctgctgggcaaccacagcctgggcctgcccctcatcacagccctggtgggcagccgggacagaagaggccgggtcttcagccctgtgcctgtgcccctgcccaccaaccccaccacccagcaccccacccggcagaagctgcccagcaccctgagcggccaccgggtgtgccaggcccacggggagcctgtgctgggcctgtgccccctgctgcccctcttctgctgccccccccaccccccagacccctggagcctggagcggccccgcttctgcctgctgagcaaggaggagggcaagagctttggcttccacctgcagcaggagctgggccgggccggccacgtggtgtgccgggtggaccccggcaccagcgcccagaggcagggcctgcaggagggggaccgcatcctggccgtgaacaatgatgtggtggagcacgaggactatgctgtggtggtgcggcgcatccgggccagcagcccccgggtgctgctgactgtgctggcccggcatgcccatgatgtggcccgggcccagctgggagaagatgcccacctgtgccccaccctgggccctggggtgcggccccggctgtgccacatcgtgaaggatgaaggaggcttcggcttctctgtgacccacggcaaccagggccccttctggctggtgctgagcactggaggagctgctgagcgggccggcgtgcccccaggggcccggctgctggaggtgaatggagtgtctgtggagaagttcacccacaaccagctgaccaggaagctgtggcagagcggccagcaggtgaccctgctggtggccggccctgaggtggaggagcagtgccggcagctgggcctgcccctggccgcccccctggccgagggctgggccctgcccaccaagccccgctgcctgcacctggagaagggcccccagggcttcggcttcctgctgcgggaggagaagggcctggatggccggcccggccagttcctgtgggaggtggaccccggcctgcctgccaagaaggccggcatgcaggccggggaccggctggtggccgtggccggggagagcgtggagggcctgggccacgaggagaccgtgagccgcatccagggccagggcagctgtgtgtccctgactgtggtggaccctgaggccgaccgcttcttctccatggtgcggctgagccccctgctcttcctggagaacacagaggccccagccagcccccggggcagcagcagcgccagcctggtggagacagaggaccccagcctggaggacacctctgtgcccagcgtgcccctgggcagccggcagtgcttcctgtacccaggccctgggggcagctatggcttccggctgagctgtgtggccagcggccccaggctcttcatcagccaggtgacccctgggggcagcgctgcccgggccggcctgcaggtgggagatgtgatcctggaggtgaatggctaccctgtgggcggccagaatgacctggagcggctgcagcagctgcctgaggccgagccccccctgtgcctgaagctggccgcccggagcctgcggggcctggaggcctggatccccccaggagctgctgaggactgggccctggccagtgacctgctgtag

SEQ ID NO: 163427 - DNA, 1518 bp, Artificial Sequence
  Description of Artificial Sequence: Synthetic coding sequence
atggaggaggccctggacctgcaggacacagccagcctgaccctgaagttcaagttcaaccccaagctgggcatcgacaaccctgtgctgagcctggccgaggaccatgacccctatgacccctggagcctggagcggccccgcttctgcctgctgagcaaggaggagggcaagagctttggcttccacctgcagcaggagctgggccgggccggccacgtggtgtgccgggtggaccccggcaccagcgcccagaggcagggcctgcaggagggggaccgcatcctggccgtgaacaatgatgtggtggagcacgaggactatgctgtggtggtgcggcgcatccgggccagcagcccccgggtgctgctgactgtgctggcccggcatgcccatgatgtggcccgggcccagctgggagaagatgcccacctgtgccccaccctgggccctggggtgcggccccggctgtgccacatcgtgaaggatgaaggaggcttcggcttctctgtgacccacggcaaccagggccccttctggctggtgctgagcactggaggagctgctgagcgggccggcgtgcccccaggggcccggctgctggaggtgaatggagtgtctgtggagaagttcacccacaaccagctgaccaggaagctgtggcagagcggccagcaggtgaccctgctggtggccggccctgaggtggaggagcagtgccggcagctgggcctgcccctggccgcccccctggccgagggctgggccctgcccaccaagccccgctgcctgcacctggagaagggcccccagggcttcggcttcctgctgcgggaggagaagggcctggatggccggcccggccagttcctgtgggaggtggaccccggcctgcctgccaagaaggccggcatgcaggccggggaccggctggtggccgtggccggggagagcgtggagggcctgggccacgaggagaccgtgagccgcatccagggccagggcagctgtgtgtccctgactgtggtggaccctgaggccgaccgcttcttctccatggtgcggctgagccccctgctcttcctggagaacacagaggccccagccagcccccggggcagcagcagcgccagcctggtggagacagaggaccccagcctggaggacacctctgtgcccagcgtgcccctgggcagccggcagtgcttcctgtacccaggccctgggggcagctatggcttccggctgagctgtgtggccagcggccccaggctcttcatcagccaggtgacccctgggggcagcgctgcccgggccggcctgcaggtgggagatgtgatcctggaggtgaatggctaccctgtgggcggccagaatgacctggagcggctgcagcagctgcctgaggccgagccccccctgtgcctgaagctggccgcccggagcctgcggggcctggaggcctggatccccccaggagctgctgaggactgggccctggccagtgacctgctgtag

SEQ ID NO: 163428 - DNA, 1716 bp, Artificial Sequence; identical to SEQ ID NO: 163426
  Description of Artificial Sequence: Synthetic coding sequence

SEQ ID NO: 163429 - DNA, 2310 bp, Artificial Sequence
  Description of Artificial Sequence: Synthetic coding sequence
atgggctgcaacatgtgtgtggtgcagaagccagaggagcagtacaaggtgatgctgcaggtgaatggcaaggagctgagcaagctgagccaggagcagaccctgcaggccctgcggagcagcaaggagcccctggtgatccaggtgctgcggcgcagcccccggctgcggggggacagcagctgccacgacctgcagctggtggacagcggcacccagacagacatcacctttgagcacatcatggccctgggcaagctgcggccccccaccccacccatggtgatcctggagcccccacccatcagccatgagtactatgaccctgctgagttcatggagggcggcccccaggaggccgaccggctggatgagctggagtatgaggaggtggagctgtacaagagcagccaccgggacaagctgggcctgatggtgtgctacagaacagatgatgaggaggacctgggcatctacgtgggggaggtgaaccccaacagcattgctgccaaggatggccgcatccgggagggggaccgcatcatccagatcaatggagtggatgtgcagaaccgggaggaggccgtggccatcctgagccaggaggagaacaccaacatcagcctgctggtggcccggcctgagagccagctggccaagcgctggaaggacagcgacagagatgacttcctggatgactttggaagtgaaaatgaaggagagctgcgggccaggaagctgaagagccccccagcccagcagcctggaaatgaggaggagaagggggccccagatgctggccctggcctgagcaacagccaggagctggacagcggcgtgggccgcacagatgagagcaccagaaatgaggagagcagcgagcatgacctgctgggagatgagccccccagcagcaccaacaccccaggcagcctgaggaagtttggcctgcagggagatgccctgcagagccgggacttccacttctccatggacagcctgctggccgagggcgccggcctgggcggcggagatgtgcccggcctgacagatgaggagtatgaaagataccgggagctgctggagatcaagtgccacctggagaatggaaaccagctgggcctgctcttcccccgggccagcggcggcaacagcgccctggatgtgaacagaaatgaaagcctgggccacgagatggccatgctggaggaggagctgcggcacctggagttcaagtgcaggaacatcctgcgggcccagaagatgcagcagctgcgggagcgctgcatgaaggcctggctgctggaggaggagagcctgtatgacctggccgccagcgagcccaagaagcatgagctgagtgacatcagcgagctgcctgagaagagtgacaaggacagcaccagcgcctacaacacaggagagagctgccgcagcacccccctgctggtggagcccctgcctgagagccccctgcggcgggccatggccggcaacagcaacctgaacagaacacctcctggccctgctgtggccaccccagccaaggccgcccctcctcctggcagccctgccaagttccgcagcctgagccgggaccctgaggccggccggcggcagcacgccgaggagcggggcagaagaaaccccaagacaggcctgaccctggagcgggtgggccctgagagcagcccctacctgagcagaagacaccggggccagggccaggagggggagcactaccacagctgtgtgcagctggcccccacccggggcctggaggagctgggccacggccccctgagcctggccggcggcccccgggtgggcggcgtggccgctgctgccacagaggcccccaggatggagtggaaggtgaaggtgcggagtgatggcaccaggtatgtggccaagaggcctgtgcgggaccggctgctgaaggcccgggccctgaagatccgggaggagaggagcggcatgaccacagatgatgatgctgtgtctgagatgaagatgggccgctactggagcaaggaggagaggaagcagcacctgatccgggcccgggagcagaggaagaggcgggagttcatgatgcagagccggctggagtgcctgcgggagcagcagaatggagacagcaagccagagctgaacatcatcgccctgagccacaggaagaccatgaagaagaggaacaagaagatcctggacaactggatcaccatccaggagatgctggcccatggagcccggtctgcagatggcaagagggtgtacaaccccctgctgtctgtgaccaccgtgtag

SEQ ID NO: 163430 - DNA, 2085 bp, Artificial Sequence
  Description of Artificial Sequence: Synthetic coding sequence
atggccctgggcaagctgcggccccccaccccacccatggtgatcctggagccctacgtgctgtctgagctgccccccatcagccatgagtactatgaccctgctgagttcatggagggcggcccccaggaggccgaccggctggatgagctggagtatgaggaggtggagctgtacaagagcagccaccgggacaagctgggcctgatggtgtgctacagaacagatgatgaggaggacctgggcatctacgtgggggaggtgaaccccaacagcattgctgccaaggatggccgcatccgggagggggaccgcatcatccagatcaacggggtggatgtgcagaaccgggaggaggccgtggccatcctgagccaggaggagaacaccaacatcagcctgctggtggcccggcctgagagccagctggccaagcgctggaaggacagcgacagagatgacttcctggatgactttggaagtgaaaatgaaggagagctgcgggccaggaagctgaagagccccccagcccagcagcctggaaatgaggaggagaagggggccccagatgctggccctggcctgagcaacagccaggagctggacagcggcgtgggccgcacagatgagagcaccagaaatgaggagagcagcgagcatgacctgctgggagatgagccccccagcagcaccaacaccccaggcagcctgaggaagtttggcctgcagggagatgccctgcagagccgggacttccacttctccatggacagcctgctggccgagggcgccggcctgggcggcggagatgtgcccggcctgacagatgaggagtatgagcgctaccgggagctgctggagatcaagtgccacctggagaatggaaaccagctgggcctgctcttcccccgggccagcggcggcaacagcgccctggatgtgaacagaaatgaaagcctgggccacgagatggccatgctggaggaggagctgcggcacctggagttcaagtgcaggaacatcctgcgggcccagaagatgcagcagctgcgggagcgctgcatgaaggcctggctgctggaggaggagagcctgtatgacctggccgccagcgagcccaagaagcatgagctgagtgacatcagcgagctgcctgagaagagtgacaaggacagcaccagcgcctacaacacaggagagagctgccgcagcacccccctgctggtggagcccctgcctgagagccccctgcggcgggccatggccggcaacagcaacctgaacagaacacctcctggccctgctgtggccaccccagccaaggccgcccctcctcctggcagccctgccaagttccgcagcctgagccgggaccctgaggccggccggcggcagcacgccgaggagcggggcagaagaaaccccaagacaggcctgaccctggagcgggtgggccctgagagcagcccctacctgagccgccgccaccggggccagggccaggagggggagcactaccacagctgtgtgcagctggcccccacccggggcctggaggagctgggccacggccccctgagcctggccggcggcccccgggtgggcggcgtggccgccgccgccacagaggcccccaggatggagtggaaggtgaaggtgcggagtgatggcacccgctacgtggccaagaggcctgtgcgggaccggctgctgaaggcccgggccctgaagatccgggaggagaggagcggcatgaccacagatgatgatgctgtgtctgagatgaagatgggccgctactggagcaaggaggagaggaagcagcacctgatccgggcccgggagcagaggaagagaagagagttcatgatgcagagccggctggagtgcctgcgggagcagcagaatggagacagcaagccagagctgaacatcatcgccctgagccacaggaagaccatgaagaagaggaacaagaagatcctggacaactggatcaccatccaggagatgctggcccacggggcccggtctgcagatggcaagagggtgtacaaccccctgctgtctgtgaccaccgtgtag

SEQ ID NO: 163431 - DNA, 2022 bp, Artificial Sequence
  Description of Artificial Sequence: Synthetic coding sequence
atgacagccccacccatcagccatgagtactatgaccctgctgagttcatggagggcggcccccaggaggccgaccggctggatgagctggagtatgaggaggtggagctgtacaagagcagccaccgggacaagctgggcctgatggtgtgctacagaacagatgatgaggaggacctgggcatctacgtgggggaggtgaaccccaacagcattgctgccaaggatggccgcatccgggagggggaccgcatcatccagatcaatggagtggatgtgcagaaccgggaggaggccgtggccatcctgagccaggaggagaacaccaacatcagcctgctggtggcccggcctgagagccagctggccaagcgctggaaggacagcgacagagatgacttcctggatgactttggaagtgaaaatgaaggagagctgcgggccaggaagctgaagagccccccagcccagcagcctggaaatgaggaggagaagggggccccagatgctggccctggcctgagcaacagccaggagctggacagcggcgtgggccgcacagatgagagcaccagaaatgaggagagcagcgagcatgacctgctgggagatgagccccccagcagcaccaacaccccaggcagcctgaggaagtttggcctgcagggagatgccctgcagagccgggacttccacttctccatggacagcctgctggccgagggcgccggcctgggcggcggagatgtgcccggcctgacagatgaggagtatgaaagataccgggagctgctggagatcaagtgccacctggagaatggaaaccagctgggcctgctcttcccccgggccagcggcggcaacagcgccctggatgtgaacagaaatgaaagcctgggccacgagatggccatgctggaggaggagctgcggcacctggagttcaagtgcaggaacatcctgcgggcccagaagatgcagcagctgcgggagcgctgcatgaaggcctggctgctggaggaggagagcctgtatgacctggccgccagcgagcccaagaagcatgagctgagtgacatcagcgagctgcctgagaagagtgacaaggacagcaccagcgcctacaacacaggagagagctgccgcagcacccccctgctggtggagcccctgcctgagagccccctgcggcgggccatggccggcaacagcaacctgaacagaacacctcctggccctgctgtggccaccccagccaaggccgcccctcctcctggcagccctgccaagttccgcagcctgagccgggaccctgaggccggccggcggcagcacgccgaggagcggggcagaagaaaccccaagacaggcctgaccctggagcgggtgggccctgagagcagcccctacctgagcagaagacaccggggccagggccaggagggggagcactaccacagctgtgtgcagctggcccccacccggggcctggaggagctgggccacggccccctgagcctggccggcggcccccgggtgggcggcgtggccgctgctgccacagaggcccccaggatggagtggaaggtgaaggtgcggagtgatggcaccaggtatgtggccaagaggcctgtgcgggaccggctgctgaaggcccgggccctgaagatccgggaggagaggagcggcatgaccacagatgatgatgctgtgtctgagatgaagatgggccgctactggagcaaggaggagaggaagcagcacctgatccgggcccgggagcagaggaagaggcgggagttcatgatgcagagccggctggagtgcctgcgggagcagcagaatggagacagcaagccagagctgaacatcatcgccctgagccacaggaagaccatgaagaagaggaacaagaagatcctggacaactggatcaccatccaggagatgctggcccatggagcccggtctgcagatggcaagagggtgtacaaccccctgctgtctgtgaccaccgtgtag

SEQ ID NO: 163432 - DNA, 1983 bp, Artificial Sequence
  Description of Artificial Sequence: Synthetic coding sequence
atgggctgcaacatgtgtgtggtgcagaagccagaggagcagtacaaggtgatgctgcaggaggtggagctgtacaagagcagccaccgggacaagctgggcctgatggtgtgctacagaacagatgatgaggaggacctgggcatctacgtgggggaggtgaaccccaacagcattgctgccaaggatggccgcatccgggagggggaccgcatcatccagatcaacggggtggatgtgcagaaccgggaggaggccgtggccatcctgagccaggaggagaacaccaacatcagcctgctggtggcccggcctgagagccagctggccaagcgctggaaggacagcgacagagatgacttcctggatgactttggaagtgaaaatgaaggagagctgcgggccaggaagctgaagagccccccagcccagcagcctggaaatgaggaggagaagggggccccagatgctggccctggcctgagcaacagccaggagctggacagcggcgtgggccgcacagatgagagcaccagaaatgaggagagcagcgagcatgacctgctgggagatgagccccccagcagcaccaacaccccaggcagcctgaggaagtttggcctgcagggagatgccctgcagagccgggacttccacttctccatggacagcctgctggccgagggcgccggcctgggcggcggagatgtgcccggcctgacagatgaggagtatgagcgctaccgggagctgctggagatcaagtgccacctggagaatggaaaccagctgggcctgctcttcccccgggccagcggcggcaacagcgccctggatgtgaacagaaatgaaagcctgggccacgagatggccatgctggaggaggagctgcggcacctggagttcaagtgcaggaacatcctgcgggcccagaagatgcagcagctgcgggagcgctgcatgaaggcctggctgctggaggaggagagcctgtatgacctggccgccagcgagcccaagaagcatgagctgagtgacatcagcgagctgcctgagaagagtgacaaggacagcaccagcgcctacaacacaggagagagctgccgcagcacccccctgctggtggagcccctgcctgagagccccctgcggcgggccatggccggcaacagcaacctgaacagaacacctcctggccctgctgtggccaccccagccaaggccgcccctcctcctggcagccctgccaagttccgcagcctgagccgggaccctgaggccggccggcggcagcacgccgaggagcggggcagaagaaaccccaagacaggcctgaccctggagcgggtgggccctgagagcagcccctacctgagccgccgccaccggggccagggccaggagggggagcactaccacagctgtgtgcagctggcccccacccggggcctggaggagctgggccacggccccctgagcctggccggcggcccccgggtgggcggcgtggccgccgccgccacagaggcccccaggatggagtggaaggtgaaggtgcggagtgatggcacccgctacgtggccaagaggcctgtgcgggaccggctgctgaaggcccgggccctgaagatccgggaggagaggagcggcatgaccacagatgatgatgctgtgtctgagatgaagatgggccgctactggagcaaggaggagaggaagcagcacctgatccgggcccgggagcagaggaagagaagagagttcatgatgcagagccggctggagtgcctgcgggagcagcagaatggagacagcaagccagagctgaacatcatcgccctgagccacaggaagaccatgaagaagaggaacaagaagatcctggacaactggatcaccatccaggagatgctggcccacggggcccggtctgcagatggcaagagggtgtacaaccccctgctgtctgtgaccaccgtgtag

SEQ ID NO: 163433 - DNA, 1554 bp, Artificial Sequence
  Description of Artificial Sequence: Synthetic coding sequence
atggcccagggctttgctgtgggctttgaccccctgggcctgggggacctgagcagcggcagcctgagcagcctgagcagccggggccacctgggcagtgacagcggcagcacagccacccgctacctgctgaggaagcagcagaggctgctgaatggccccccccggggcatccgggccagcagccccatgggccgggtcatcctgatcaacagccccatcgaggccaacagtgatgaaagtgacatcatccacagcgtgcgggtggagaagagccctgctggccgcctgggcttctctgtgcggggcggcagcgagcacggcctgggcatctttgtgtccaaggtggaggagggcagcagcgctgagagagctggcctgtgtgtgggggacaagatcacagaggtgaatggcctgagcctggagagcaccaccatgggcagcgctgtgaaggtgctgaccagcagcagccggctgcacatgatggtgcggaggatgggccgggtgcccggcatcaagttcagcaaggagaagaccacctgggtggatgtggtgaacagaaggctggtggtggagaagtgtggcagcacccccagcgacaccagcagtgaagatggagtgcggcgcatcgtgcacctgtacaccaccagtgatgacttctgcctgggcttcaacatccggggcggcaaggagtttggcctgggcatctacgtgtccaaggtggaccatggaggcctggccgaggagaatggcatcaaggtgggggaccaggtgctggccgccaacggggtgcgctttgatgacatcagccacagccaggccgtggaggtgctgaagggccagacccacatcatgctgaccatcaaggagaccggccgctacccagcctacaaggagatggtgtctgagtactgctggctggaccggctgagcaatggagtgctgcagcagctgagccctgccagcgagagcagcagctctgtgagcagctgtgccagcagcgccccctacagcagcggcagcctgcccagcgacaggatggacatctgcctgggccaggaggagcccggcagccggggccctggctggggccgggctgacacagccatgcagacagagccagatgctgggggccgggtggagacctggtgcagcgtgcggcccaccgtcatcctgcgggacacagccatccgcagtgatggcccccaccctggccggcggctggacagcgccctgtctgagagccccaagacagccctgctgctggccctgagccggcccaggcctcccatcaccaggagccagagctacctgaccctgtgggaggagaagcagcagaggaagaaggagaagagcggcagccctggagagaagggggccctgcagaggagcaagaccctgatgaacctcttcttcaagggcggccggcagggccgcctggccagagatggaagaagagaggcctggaccctggacagcggcagcctggccaagacctacccccggctggacatcgagaaggagatgggcgtgagcccctgctgccccggctag

SEQ ID NO: 163434 - DNA, 3102 bp, Artificial Sequence
  Description of Artificial Sequence: Synthetic coding sequence
atggcccagggctttgctgtgggctttgaccccctgggcctgggggacctgagcagcggcagcctgagcagcctgagcagccggggccacctgggcagtgacagcggcagcacagccacccgctacctgctgaggaagcagcagaggctgctgaatggccccccccggggcatccgggccagcagccccatgggccgggtcatcctgatcaacagccccatcgaggccaacagtgatgaaagtgacatcatccacagcgtgcgggtggagaagagccctgctggccgcctgggcttctctgtgcggggcggcagcgagcacggcctgggcatctttgtgtccaaggtggaggagggcagcagcgctgagagagctggcctgtgtgtgggggacaagatcacagaggtgaatggcctgagcctggagagcaccaccatgggcagcgctgtgaaggtgctgaccagcagcagccggctgcacatgatggtgcggaggatgggccgggtgcccggcatcaagttcagcaaggagaagaccacctgggtggatgtggtgaacagaaggctggtggtggagaagtgtggcagcacccccagcgacaccagcagtgaagatggagtgcggcgcatcgtgcacctgtacaccaccagtgatgacttctgcctgggcttcaacatccggggcggcaaggagtttggcctgggcatctacgtgtccaaggtggaccatggaggcctggccgaggagaatggcatcaaggtgggggaccaggtgctggccgccaacggggtgcgctttgatgacatcagccacagccaggccgtggaggtgctgaagggccagacccacatcatgctgaccatcaaggagaccggccgctacccagcctacaaggagatggtgtctgagtactgctggctggaccggctgagcaatggagtgctgcagcagctgagccctgccagcgagagcagcagctctgtgagcagctgtgccagcagcgccccctacagcagcggcagcctgcccagcgacaggatggacatctgcctgggccaggaggagcccggcagccggggccctggctggggccgggctgacacagccatgcagacagagccagatgctgggggccgggtggagacctggtgcagcgtgcggcccaccgtcatcctgcgggacacagccatccgcagtgatggcccccaccctggccggcggctggacagcgccctgtctgagagccccaagacagccctgctgctggccctgagccggcccaggcctcccatcaccaggagccagagctacctgaccctgtgggaggagaagcagcagaggaagaaggagaagagcggcagccctggagagaagggggccctgcagaggagcaagaccctgatgaacctcttcttcaagggcggccggcagggccgcctggccagagatggaagaagagaggcctggaccctggacagcggcagcctggccaagacctacccccggctggacatcgagaaggccggcggcgtgggccctgtgcagaagtttgtgacctggaggctgcggcgggaccaggagcggggccgggccctgctgagcgcccggagcggcagccccagcagccagctgcccaacgtggatgagcaggtgcaggcctgggagagcagaagacccctcatccaggacctggcccagaggctgctgacagatgatgaggtgctggccgtgaccaggcactgcagccgctacgtgcatgagggcggcatcgaggacctggtgcggcccctgctggccatcctggacaggcctgagaagctgctgctgctgcaggacatccgctctgtggtggcccccacagacctgggccgctttgacagcatggtgatgctggtggagctggaggcctttgaggccctgaagagcagagctgtgcggcccccagccctgcggcctgcccggcaggacaccccacccaagaggcacctgatcacccctgtgcctgacagccggggcggcttctacctgctgcctgtgaatggcttccctgaggaggaggacaacggggagctgcgggagcggctgggcgccctgaaggtgagccccagcgccagcgcccccaggcacccccacaagggcatcccccccctgcaggatgtgcctgtggatgccttcacccccctgcgcatcgcctgcaccccaccaccccagctgccccctgtggccccccggcccctgcggcccaactggctgctgacagagcccctgagccgggagcaccccccccagagccagatccggggccgggcccagagccgcagccgcagccgcagccgcagccgcagccgcagcagccggggccagggcaagagccctggccgccgcagccccagccctgtgcccaccccagcccccagcatgaccaacggccgctaccacaagcccaggaaggcccggccccccctgccccggcccctggatggagaggccgccaaggtgggcgccaagcagggccccagcgagagcggcacagagggcacagccaaggaggccgccatgaagaaccccagcggggagctgaagacagtgaccctgagcaagatgaagcagagcctgggcatcagcatcagcggcggcatcgagagcaaggtgcagcccatggtgaagattgagaagatcttccctggaggagctgccttcctgagcggggccctgcaggccggctttgagctggtggccgtggatggagagaacctggagcaggtgacccaccagagagctgtggacaccatccggcgggcctacagaaacaaggcccgggagcccatggagctggtggtgcgggtgcccggccccagcccccggcccagccccagcgacagcagcgccctgacagatggcggcctgcctgctgaccacctgcctgcccaccagcccctggatgctgcccctgtgcctgcccactggctgcctgagccccccaccaacccccagaccccacccacagatgcccggctgctgcagcccacccccagccctgcccccagccctgccctgcagaccccagacagcaagccagcccccagcccccgcatcccctag

SEQ ID NO: 163435 - DNA, 627 bp, Artificial Sequence
  Description of Artificial Sequence: Synthetic coding sequence
tgaccccggccccccatcaccaggagccagagctacctgaccctgtgggaggagaagcagcagaggaagaaggagaagagcggcagccctggagagaagggggccctgcagaggagcaagaccctgatgaacctcttcttcaagggcggccggcagggccgcctggccagagatggccggcgggaggcctggaccctggacagcggcagcctggccaagacctacccccggctggacatcgagaaggccggcggcgtgggccctgtgcagaagtttgtgacctggaggctgcggcgggaccaggagcggggccgggccctgctgagcgcccggagcggcagccccagcagccagctgcccaacgtggatgagcaggtgcaggcctgggagagccggcggcccctcatccaggacctggcccagaggctgctgacagatgatgaggtgctggccgtgaccaggcactgcagccgctacgtgcatgaaggaggcatcgaggacctggtgcggcccctgctggccatcctggacaggcctgagaagctgctgctgctgcaggacatccgctctgtggtggcccccacagacctgggccgctttgacagcatggtgatgctggtggagtag

SEQ ID NO: 163436 - DNA, 3465 bp, Artificial Sequence
  Description of Artificial Sequence: Synthetic coding sequence
atgggcctgctgctgatgatcctggccagcgctgtgctgggcagcttcctgaccctgctggcccagttcttcctgctgtaccgccggcagcctgagcccccagcagatgaggccgcccgggccggggagggcttccgctacatcaagcctgtgcccggcctgctgctgcgggagtacctgtatggaggcggcagagatgaggagcccagcggggccgcccctgagggcggggccacccccacagctgcccctgagaccccagccccacccacccgggagacctgctacttcctgaatgccaccatcctcttcctgttccgggagctgcgggacacagccctgacccggcgctgggtgaccaagaagatcaaggtggagtttgaggagctgctgcagaccaagacagctggccgcctgctggagggcctgagcctgagagatgtgttcctgggggagaccgtgcccttcatcaagaccatccggctggtgcggcctgtggtgcccagcgccactggagagccagatggccctgagggggaggccctgcctgctgcctgcccagaggagctggcctttgaggccgaggtggagtacaatggaggcttccacctggccattgatgtggacctggtgtttgggaagagcgcctacctgtttgtgaagctgagccgggtggtgggccgcctgcggctggtgttcaccagggtgcccttcacccactggttcttctcctttgtggaggaccccctgattgactttgaggtgcgcagccagtttgagggccggcccatgccccagctgaccagcatcatcgtgaaccagctgaagaagatcatcaagaggaagcacaccctgcccaactacaagatccgcttcaagcccttcttcccctaccagaccctgcagggctttgaggaggatgaggagcacatccacatccagcagtgggccctgacagagggccgcctgaaggtgaccctgctggagtgcagccggctgctgatcttcggcagctatgaccgggaggccaacgtgcactgcaccctggagctgagcagctctgtgtgggaggagaagcagaggagcagcatcaagacagtggagctgatcaagggcaacctgcagagcgtgggcctgaccctgcggctggtgcagagcacagatggctacgccggccacgtgatcatcgagaccgtggcccccaacagccctgctgccatcgctgacctgcagagaggagaccggctgattgccatcggcggcgtgaagatcaccagcaccctgcaggtgctgaagctgatcaagcaggccggggacagagtgctggtgtactatgaaagacctgtgggccagagcaaccagggcgctgtgctgcaggacaactttggccagctggaggagaacttcctgagcagcagctgccagagcggctatgaggaggaggccgccggcctgactgtggacacagagagccgggagctggacagcgagtttgaggacctggccagtgatgtgcgggcccagaatgagttcaaggatgaggcccagagcctgagccacagccccaagagggtgcccaccaccctgagcatcaagcccctgggcgccatcagccctgtgctgaacaggaagctggccgtgggcagccaccccctgccccccaagatccagagcaaggatggcaacaagcccccacccctgaagaccagcgagatcacagatcctgcccaggtgtccaagcccacccagggcagcgccttcaagccccctgtgcccccccggccccaggccaaggtgcccctgcccagcgcagatgcccccaaccaggccgagccagatgtgctggtggagaagccagagaaggtggtgcccccacccctggtggacaagtctgctgagaagcaggccaagaatgtggatgccattgatgatgctgctgcccccaagcagttcctggccaagcaggaggtggccaaggatgtgaccagcgagaccagctgccccaccaaggacagcagtgatgaccggcagacctgggagagcagcgagatcctgtacagaaacaagctgggcaagtggaccaggacccgggccagctgcctgtttgacatcgaggcctgccaccgctacctgaacatcgccctgtggtgccgggaccccttcaagctgggcggcctcatctgcctgggccacgtgtccctgaagctggaggatgtggccctgggctgcctggccaccagcaacacagagtacctgagcaagctgcggctggaggcccccagccccaaggccatcgtgaccaggacagccctgaggaacctgtccatgcagaagggcttcaatgacaagttctgctacggggacatcaccatccacttcaagtacctgaaggagggggagagtgaccaccacgtggtgaccaacgtggagaaggagaaggagccccacctggtggaggaggtgtctgtgctgcccaaggaggagcagtttgtgggccagatgggcctgacagagaacaagcacagcttccaggacacccagttccagaaccccacctggtgtgactactgcaagaagaaggtgtggaccaaggccgccagccagtgcatgttctgtgcctacgtgtgccacaagaagtgccaggagaagtgcctggccgagacctctgtgtgtggggccacagacagaagaattgacaggaccctgaagaacctgcggctggagggccaggagaccctgctgggcctgcccccccgggtggatgctgaggccagcaagtctgtgaacaagaccaccggcctgaccaggcacatcatcaacaccagcagccggctgctgaacctgcggcaggtgtccaagacccggctgtctgagcctggaacagacctggtggagcccagccccaagcacacccccaacaccagtgacaatgaaggaagtgacacagaggtgtgtggccccaacagccccagcaagaggggcaacagcacaggcatcaagctggtgaggaaggagggcggcctggatgattctgtgttcatcgctgtgaaggagatcggccgggacctgtaccggggcctgcccacagaggagcgcatccagaagctggagttcatgctggacaagctgcagaatgaaattgaccaggagctggagcacaacaacagcctggtgcgggaggagaaggagaccacagacaccaggaagaagagcctgctgtctgctgccctggccaagagcggggagcggctgcaggccctgaccctgctgatgatccactaccgggccggcattgaagatattgagaccctggagagcctgagcctggaccagcacagcaagaagatcagcaagtacacagatgacacagaggaggacctggacaatgagatcagccagctgattgacagccagcccttcagcagcatcagtgatgacctgtttggccccagcgagagcgtgtag

SEQ ID NO: 163437 - DNA, 3201 bp, Artificial Sequence
  Description of Artificial Sequence: Synthetic coding sequence
atgggctttgagctggacagatttgatggagatgtggaccctgacctgaagtgtgccctgtgccacaaggtgctggaggaccccctgaccaccccctgtggccacgtgttctgtgccggctgtgtgctgccctgggtggtgcaggagggcagctgcccagcccgctgccggggccgcctgagcgccaaggagctgaaccacgtgctgcccctgaagaggctcatcctgaagctggacatcaagtgtgcctatgccacccggggctgcggccgggtggtgaagctgcagcagctgcctgagcacctggagcgctgtgactttgccccagcccgctgcagacatgctggctgcggccaggtgctgctgcggagagatgtggaggcccacatgagagatgcctgtgatgcccggcctgtgggccgctgccaggagggctgcggcctgcccctgacccacggggagcagagagctgggggccactgctgtgcccgggccctgcgggcccacaacggggccctgcaggcccggctgggcgccctgcacaaggccctgaagaaggaggccctgcgggccggcaagcgggagaagagcctggtggcccagctggccgccgcccagctggagctgcagatgacagccctgcgctaccagaagaagttcacagagtacagcgcccggctggacagcctgagccgctgtgtggccgcccctcctgggggcaaaggagaggagaccaagagcctgaccctggtgctgcaccgggacagcggcagcctgggcttcaacatcatcggcggccggcccagcgtggacaaccatgatggcagcagcagcgagggcatctttgtgtccaagatcgtggacagcggccctgctgccaaggagggcggcctgcagatccatgaccgcatcatcgaggtgaatggccgggacctgagccgggccacccatgaccaggccgtggaggccttcaagacagccaaggagcccatcgtggtgcaggtgctgcggaggacccccaggaccaagatgttcaccccaccttctgagagccagctggtggacaccggcacccagacagacatcacctttgagcacatcatggccctgaccaagatgagcagccccagcccccctgtgctggacccctacctgctgcctgaggagcaccccagcgcccacgagtactatgaccccaatgactacatcggggacatccaccaggagatggaccgggaggagctggagctggaggaggtggacctgtacaggatgaacagccaggacaagctgggcctgactgtgtgctacagaacagatgatgaagatgacatcggcatctacatcagcgagattgaccccaacagcattgctgccaaggatggccgcatccgggagggggaccgcatcatccagatcaatggcatcgaggtgcagaaccgggaggaggccgtggccctgctgaccagcgaggagaacaagaacttcagcctgctgattgcccggcctgagctgcagctggatgagggctggatggatgatgacagaaatgacttcctggatgacctgcacatggacatgctggaggagcagcaccaccaggccatgcagttcaccgcctctgtgctgcagcagaagaagcatgatgaagatggcggcaccacagacacagccaccatcctgagcaaccagcacgagaaggacagcggcgtgggccgcacagatgagagcaccagaaatgatgagagcagcgagcaggagaacaatggagatgatgccacagccagcagcaaccccctggccggccagaggaagctgacctgcagccaggacaccctgggcagcggggacctgcccttcagcaatgaaagcttcatctctgctgactgcacagatgctgactacctgggcatccctgtggatgaatgtgagcgcttccgggagctgctggagctgaagtgccaggtgaagagcgccaccccctacggcctgtactaccccagcggccccctggatgctgggaagagtgaccctgagagcgtggacaaggagctggagctgctgaatgaggagctgcggagcattgagctggagtgcctgagcatcgtgcgggcccacaagatgcagcagctgaaggagcagtaccgggagagctggatgctgcacaacagcggcttcaggaactacaacaccagcattgatgtgagaagacatgagctgagtgacatcacagagctgcctgagaagagtgacaaggacagcagcagcgcctacaacacaggagagagctgccgcagcacccccctgaccctggagatcagcccagacaacagcctgcggcgggctgctgagggcatcagctgccccagcagcgagggcgctgtgggcaccacagaggcctacggccctgccagcaagaacctgctgagcatcacagaagatcctgaggtgggcacccccacctacagccccagcctgaaggagctggaccccaaccagcccctggagagcaaggagcggcgggccagtgatggcagccgcagccccacccccagccagaagctgggcagcgcctacctgcccagctaccaccacagcccctacaagcacgcccacatcccagcccacgcccagcactaccagagctacatgcagctgatccagcagaagtctgctgtggagtatgcccagagccagatgagcctggtgtccatgtgcaaggacctgagcagccccaccccatctgagcccaggatggagtggaaggtgaagatccgcagtgatggcacccgctacatcaccaagaggcctgtgcgggaccggctgctgcgggagcgggccctgaagatccgggaggagaggagcggcatgaccacagatgatgatgctgtgtctgagatgaagatgggccgctactggagcaaggaggagaggaagcagcacctggtgaaggccaaggagcagaggagaagaagagagttcatgatgcagagccggctggactgcctgaaggagcagcaggccgcagatgacaggaaggagatgaacatcctggagctgagccacaagaagatgatgaagaagaggaacaagaagatctttgacaactggatgaccatccaggagctgctgacccacggcaccaagagcccagatggcaccagggtgtacaacagcttcctgtctgtgaccaccgtgtag

SEQ ID NO: 163438 - DNA, 2190 bp, Artificial Sequence
  Description of Artificial Sequence: Synthetic coding sequence
atgggctttgagctggacagatttgatggagatgtggaccctgacctgaagtgtgccctgtgccacaaggtgctggaggaccccctgaccaccccctgtggccacgtgttctgtgccggctgtgtgctgccctgggtggtgcaggagggcagctgcccagcccgctgccggggccgcctgagcgccaaggagctgaaccacgtgctgcccctgaagaggctcatcctgaagctggacatcaagtgtgcctatgccacccggggctgcggccgggtggtgaagctgcagcagctgcctgagcacctggagcgctgtgactttgccccagcccgctgcagacatgctggctgcggccaggtgctgctgcggagagatgtggaggcccacatgagagatgcctgtgatgcccggcctgtgggccgctgccaggagggctgcggcctgcccctgacccacggggagcagagagctgggggccactgctgtgcccgggccctgcgggcccacaacggggccctgcaggcccggctgggcgccctgcacaaggccctgaagaaggaggccctgcgggccggcaagcgggagaagagcctggtggcccagctggccgccgcccagctggagctgcagatgacagccctgcgctaccagaagaagttcacagagtacagcgcccggctggacagcctgagccgctgtgtggccgcccctcctgggggcaaaggagaggagaccaagagcctgaccctggtgctgcaccgggacagcggcagcctgggcttcaacatcatcggcggccggcccagcgtggacaaccatgatggcagcagcagcgagggcatctttgtgtccaagatcgtggacagcggccctgctgccaaggagggcggcctgcagatccatgaccgcatcatcgaggtgaatggccgggacctgagccgggccacccatgaccaggccgtggaggccttcaagacagccaaggagcccatcgtggtgcaggtgctgcggaggacccccaggaccaagatgttcaccccaccttctgagagccagctggtggacaccggcacccagacagacatcacctttgagcacatcatggccctgaccaagatgagcagccccagcccccctgtgctggacccctacctgctgcctgaggagcaccccagcgcccacgagtactatgaccccaatgactacatcggggacatccaccaggagatggaccgggaggagctggagctggaggaggtggacctgtacaggatgaacagccaggacaagctgggcctgactgtgtgctacagaacagatgatgaagatgacatcggcatctacatcagcgagattgaccccaacagcattgctgccaaggatggccgcatccgggagggggaccgcatcatccagatcaatggcatcgaggtgcagaaccgggaggaggccgtggccctgctgaccagcgaggagaacaagaacttcagcctgctgattgcccggcctgagctgcagctggatgagggctggatggatgatgacagaaatgacttcctggatgacctgcacatggacatgctggaggagcagcaccaccaggccatgcagttcaccgcctctgtgctgcagcagaagaagcatgatgaagatggcggcaccacagacacagccaccatcctgagcaaccagcacgagaaggacagcggcgtgggccgcacagatgagagcaccagaaatgatgagagcagcgagcaggagaacaatggagatgatgccacagccagcagcaaccccctggccggccagaggaagctgacctgcagccaggacaccctgggcagcggggacctgcccttcagcaatgaaagcttcatctctgctgactgcacagatgctgactacctgggcatccctgtggagggggaggacccccagaggagagatgccctgcaccaccaggaggcccgggccggccccccagctgctggggcccggcctgaggaccccggccgggcccagagacatgaccacagaagaagaagaggagagagagatgaagatggagccctgctggagcagggcggggaggaggccgcccctggagagggccagggcgctgctgctgctgcccgggtgcatgatgctgagcaggtgggcctgagccagggcgccgccagcagcaggtag

SEQ ID NO: 163439 - DNA, 2352 bp, Artificial Sequence
  Description of Artificial Sequence: Synthetic coding sequence
atgggctgcagcctgtgcagcctgcagaagcaggaggagcagtacaagctgctgtatgaggtgtgccaggtgaatggccgggacctgagccgggccacccatgaccaggccgtggaggccttcaagacagccaaggagcccatcgtggtgcaggtgctgcggaggacccccaggaccaagatgttcaccccacccagcgagagccagctggtggacaccggcacccagacagacatcacctttgagcacatcatggccctgaccaagatgagcagccccagcccccctgtgctggacccctacctgctgcctgaggagcaccccagcgcccacgagtactatgaccccaatgactacatcggggacatccaccaggagatggaccgggaggagctggagctggaggaggtggacctgtacaggatgaacagccaggacaagctgggcctgactgtgtgctacagaacagatgatgaagatgacatcggcatctacatcagcgagattgaccccaacagcattgctgccaaggatggccgcatccgggagggggaccgcatcatccagatcaatggaattgaggtgcagaaccgggaggaggccgtggccctgctgaccagcgaggagaacaagaacttcagcctgctgattgcccggcctgagctgcagctggatgagggctggatggatgatgacagaaatgacttcctggatgacctgcacatggacatgctggaggagcagcaccaccaggccatgcagttcaccgcctctgtgctgcagcagaagaagcatgatgaagatggcggcaccacagacacagccaccatcctgagcaaccagcacgagaaggacagcggcgtgggccgcacagatgagagcaccagaaatgatgagagcagcgagcaggagaacaatggagatgatgccacagccagcagcaaccccctggccggccagaggaagctgacctgcagccaggacaccctgggcagcggggacctgcccttcagcaatgaaagcttcatctctgctgactgcacagatgctgactacctgggcatccctgtggatgaatgtgagcgcttccgggagctgctggagctgaagtgccaggtgaagagcgccaccccctacggcctgtactaccccagcggccccctggatgctgggaagagtgaccctgagagcgtggacaaggagctggagctgctgaatgaggagctgcggagcattgagctggagtgcctgagcatcgtgcgggcccacaagatgcagcagctgaaggagcagtaccgggagagctggatgctgcacaacagcggcttcaggaactacaacaccagcattgatgtgagaagacatgagctgagtgacatcacagagctgcctgagaagagtgacaaggacagcagcagcgcctacaacacaggagagagctgccgcagcacccccctgaccctggagatcagcccagacaacagcctgcggcgggctgctgagggcatcagctgccccagcagcgagggcgctgtgggcaccacagaggcctacggccctgccagcaagaacctgctgagcatcacagaggaccctgaggtgggcacccccacctacagccccagcctgaaggagctggaccccaaccagcccctggagagcaaggagcggcgggccagtgatggcagccgcagccccacccccagccagaagctgggcagcgcctacctgcccagctaccaccacagcccctacaagcacgcccacatcccagcccacgcccagcactaccagagctacatgcagctgatccagcagaagtctgctgtggagtatgcccagagccagatgagcctggtgtccatgtgcaaggacctgagcagccccacccccagcgagcccaggatggagtggaaggtgaagatccgcagtgatggcacccgctacatcaccaagaggcctgtgcgggaccggctgctgcgggagcgggccctgaagatccgggaggagaggagcggcatgaccacagatgatgatgctgtgtctgagatgaagatgggccgctactggagcaaggaggagaggaagcagcacctggtgaaggccaaggagcagaggagaagaagagagttcatgatgcagagccggctggactgcctgaaggagcagcaggccgcagatgacaggaaggagatgaacatcctggagctgagccacaagaagatgatgaagaagaggaacaagaagatctttgacaactggatgaccatccaggagctgctgacccacggcaccaagagcccagatggcaccagggtgtacaacagcttcctgtctgtgaccaccgtgtag

SEQ ID NO: 163440 - DNA, 2367 bp, Artificial Sequence
  Description of Artificial Sequence: Synthetic coding sequence
atgaagatggagcacaagaggatgatcctgctcttcagcaagttcaccctcatccacaagccccacggcggccgctggtacctggtgaatggccgggacctgagccgggccacccatgaccaggccgtggaggccttcaagacagccaaggagcccatcgtggtgcaggtgctgcggaggacccccaggaccaagatgttcaccccaccttctgagagccagctggtggacaccggcacccagacagacatcacctttgagcacatcatggccctgaccaagatgagcagccccagcccccctgtgctggacccctacctgctgcctgaggagcaccccagcgcccacgagtactatgaccccaatgactacatcggggacatccaccaggagatggaccgggaggagctggagctggaggaggtggacctgtacaggatgaacagccaggacaagctgggcctgactgtgtgctacagaacagatgatgaagatgacatcggcatctacatcagcgagattgaccccaacagcattgctgccaaggatggccgcatccgggagggggaccgcatcatccagatcaatggcatcgaggtgcagaaccgggaggaggccgtggccctgctgaccagcgaggagaacaagaacttcagcctgctgattgcccggcctgagctgcagctggatgagggctggatggatgatgacagaaatgacttcctggatgacctgcacatggacatgctggaggagcagcaccaccaggccatgcagttcaccgcctctgtgctgcagcagaagaagcatgatgaagatggcggcaccacagacacagccaccatcctgagcaaccagcacgagaaggacagcggcgtgggccgcacagatgagagcaccagaaatgatgagagcagcgagcaggagaacaatggagatgatgccacagccagcagcaaccccctggccggccagaggaagctgacctgcagccaggacaccctgggcagcggggacctgcccttcagcaatgaaagcttcatctctgctgactgcacagatgctgactacctgggcatccctgtggatgaatgtgagcgcttccgggagctgctggagctgaagtgccaggtgaagagcgccaccccctacggcctgtactaccccagcggccccctggatgctgggaagagtgaccctgagagcgtggacaaggagctggagctgctgaatgaggagctgcggagcattgagctggagtgcctgagcatcgtgcgggcccacaagatgcagcagctgaaggagcagtaccgggagagctggatgctgcacaacagcggcttcaggaactacaacaccagcattgatgtgagaagacatgagctgagtgacatcacagagctgcctgagaagagtgacaaggacagcagcagcgcctacaacacaggagagagctgccgcagcacccccctgaccctggagatcagcccagacaacagcctgcggcgggctgctgagggcatcagctgccccagcagcgagggcgctgtgggcaccacagaggcctacggccctgccagcaagaacctgctgagcatcacagaagatcctgaggtgggcacccccacctacagccccagcctgaaggagctggaccccaaccagcccctggagagcaaggagcggcgggccagtgatggcagccgcagccccacccccagccagaagctgggcagcgcctacctgcccagctaccaccacagcccctacaagcacgcccacatcccagcccacgcccagcactaccagagctacatgcagctgatccagcagaagtctgctgtggagtatgcccagagccagatgagcctggtgtccatgtgcaaggacctgagcagccccaccccatctgagcccaggatggagtggaaggtgaagatccgcagtgatggcacccgctacatcaccaagaggcctgtgcgggaccggctgctgcgggagcgggccctgaagatccgggaggagaggagcggcatgaccacagatgatgatgctgtgtctgagatgaagatgggccgctactggagcaaggaggagaggaagcagcacctggtgaaggccaaggagcagaggagaagaagagagttcatgatgcagagccggctggactgcctgaaggagcagcaggccgcagatgacaggaaggagatgaacatcctggagctgagccacaagaagatgatgaagaagaggaacaagaagatctttgacaactggatgaccatccaggagctgctgacccacggcaccaagagcccagatggcaccagggtgtacaacagcttcctgtctgtgaccaccgtgtag

SEQ ID NO: 163441 - DNA, 2331 bp, Artificial Sequence
  Description of Artificial Sequence: Synthetic coding sequence
atgtctgggaagaggcagttcttcctgaagcccctggccctgctgacctgctggcccagcacagtgaatggcaaggacctgagcaaggccacccatgaggaggccgtggaggccttcagaaatgccaaggagcccatcgtggtgcaggtgctgcggaggacccccctgagcaggcctgcctacggcatggccagcgaggtgcagctgatgaatgccagcacccagacagacatcacctttgagcacatcatggccctggccaagctgcggccccccaccccacctgtgcctgacatctgccccttcctgctgagtgacagctgccacagcctgcaccccatggagcacgagttctatgaggacaatgagtacatcagcagcctgcctgcagatgctgacagaacagaggactttgaatatgaggaggtggagctgtgccgggtgagcagccaggagaagctgggcctgactgtgtgctacagaacagatgatgaggaggacaccggcatctacgtgtctgaggtggaccccaacagcattgctgccaaggatggccgcatccgggagggggaccgcatcctgcagatcaatggagaagatgtgcagaaccgggaggaggccgtggccctgctgagcaatgatgagtgcaagagaattgtgctgctggtggcccggcctgagatccagctggatgagggctggctggaggatgaaagaaatgagttcctggaggagctgaacctggagatgctggaggaggagcacaatgaggccatgcagcccacagccaatgaggtggagcagcccaagaagcaggaggaggaggagggcaccacagacacagccaccagcagcagcaacaaccacgagaaggacagcggcgtgggccgcacagatgagagcctgagaaatgatgagagcagcgagcaggagaatgctgctgaggaccccaacagcaccagcctgaagagcaagagggacctgggccagagccaggacaccctgggctctgtggagctgcagtacaatgaaagcctggtgtctggagagtacatcgacagcgactgcatcggcaacccagatgaggactgtgagcgcttccggcagctgctggagctgaagtgcaagatccggaaccacggggagtatgacctgtactacagcagcagcaccatcgagtgcaaccagggcgagcaggagggcgtggagcacgagctgcagctgctgaatgaggagctgaggaacatcgagctggagtgccagaacatcatgcaggcccaccggctgcagaaggtgacagaccagtacggggacatctggaccctgcatgatggcggcttcaggaactacaacaccagcattgacatgcagaggggcaagctggatgacatcatggagcaccctgagaagagtgacaaggacagcagcagcgcctacaacacagctgagagctgccgcagcacccccctgactgtggacaggagcccagacagcagcctgcccagggtcatcaacctgaccaacaagaagaacctgcggagcaccatggccgccacccagagcagcagcggccagagcagcaaggagagcaccagcaccaaggccaagaccacagagcagggctgcagcgctgagagcaaggagaaggtgctggagggcagcaagctgcctgaccaggagaaggctgtgtctgagcacatcccctacctgagcccctaccacagcagcagctaccgctatgccaacatcccagcccacgcccggcactaccagagctacatgcagctgatccagcagaagtctgctgtggagtatgcccagagccagctgagcctggtgtccatgtgcaaggagagccagaagtgcagcgagcccaagatggagtggaaggtgaagatccgcagtgatggcacccgctacatcaccaagaggcctgtgcgggaccgcatcctgaaggagcgggccctgaagatcaaggaggagaggagcggcatgaccacagatgatgacaccatgtctgagatgaagatgggccgctactggagcaaggaggagaggaagcagcacctggtgcgggccaaggagcagaggagaagaagagagttcatgatgaggagccggctggagtgcctgaaggagagcccccagagcggcagcgagggcaagaaggagatcaacatcatcgagctgagccacaagaagatgatgaagaagaggaacaagaagatcctggacaactggatgaccatccaggagctgatgacccacggggccaagagcccagatggcaccagggtgcacaatgccttcctgtctgtgaccaccgtgtag

SEQ ID NO: 163442 - DNA, 3111 bp, Artificial Sequence
  Description of Artificial Sequence: Synthetic coding sequence
atgggctttgccctggagagatttgctgaggccgtggaccctgccctggagtgcaagctgtgtggccaggtgctggaggagcccctgtgcaccccctgtggccacgtgttctgtgccagctgcctgctgccctgggccgtgagaagaagacgctgccccctgcagtgccagcccctggcccctggagagctgtacagagtgctgcccctgcggagcctcatccagaagctgcgggtgcagtgtgactaccgggcccggggctgcggccacagcgtgcggctgcacgagctggaggcccacgtggagcactgtgactttggacctgcccggcggctgcggagccggggcggctgtgccagcggcctgggcggcggggaggtgcctgcccggggcggctgcggccccacccccagggctggccggggcggcggggcccggggcggccccccaggcggccgctggggccggggccggggccctggcccccgggtgctggcctggaggagaagagagaaggccctgctggcccagctgtgggccctgcagggcgaggtgcagctgacagcccggcgctaccaggagaagttcacccagtacatggcccacgtgaggaactttgtgggggacctgggcggcggccacagaagagatggagagcacaagcccttcaccatcgtgctggagcgggagaatgacaccctgggcttcaacatcattggaggccggcccaaccagaacaaccaggagggcaccagcacagagggcatctacgtgtccaagatcctggagaatggacctgctgacagagcagatggcctggagatccatgacaagatcatggaggtgaatggcaaggacctgagcaaggccacccatgaggaggccgtggaggccttcagaaatgccaaggagcccatcgtggtgcaggtgctgcggaggacccccctgagcaggcctgcctacggcatggccagcgaggtgcagctgatgaatgccagcacccagacagacatcacctttgagcacatcatggccctggccaagctgcggccccccaccccacctgtgcctgacatctgccccttcctgctgagtgacagctgccacagcctgcaccccatggagcacgagttctatgaggacaatgagtacatcagcagcctgcctgcagatgctgacagaacagaggactttgaatatgaggaggtggagctgtgccgggtgagcagccaggagaagctgggcctgactgtgtgctacagaacagatgatgaggaggacaccggcatctacgtgtctgaggtggaccccaacagcattgctgccaaggatggccgcatccgggagggggaccgcatcctgcagatcaatggagaagatgtgcagaaccgggaggaggccgtggccctgctgagcaatgatgagtgcaagagaattgtgctgctggtggcccggcctgagatccagctggatgagggctggctggaggatgaaagaaatgagttcctggaggagctgaacctggagatgctggaggaggagcacaatgaggccatgcagcccacagccaatgaggtggagcagcccaagaagcaggaggaggaggagggcaccacagacacagccaccagcagcagcaacaaccacgagaaggacagcggcgtgggccgcacagatgagagcctgagaaatgatgagagcagcgagcaggagaatgctgctgaggaccccaacagcaccagcctgaagagcaagagggacctgggccagagccaggacaccctgggctctgtggagctgcagtacaatgaaagcctggtgtctggagagtacatcgacagcgactgcatcggcaacccagatgaggactgtgagcgcttccggcagctgctggagctgaagtgcaagatccggaaccacggggagtatgacctgtactacagcagcagcaccatcgagtgcaaccagggcgagcaggagggcgtggagcacgagctgcagctgctgaatgaggagctgaggaacatcgagctggagtgccagaacatcatgcaggcccaccggctgcagaaggtgacagaccagtacggggacatctggaccctgcatgatggcggcttcaggaactacaacaccagcattgacatgcagaggggcaagctggatgacatcatggagcaccctgagaagagtgacaaggacagcagcagcgcctacaacacagctgagagctgccgcagcacccccctgactgtggacaggagcccagacagcagcctgcccagggtcatcaacctgaccaacaagaagaacctgcggagcaccatggccgccacccagagcagcagcggccagagcagcaaggagagcaccagcaccaaggccaagaccacagagcagggctgcagcgctgagagcaaggagaaggtgctggagggcagcaagctgcctgaccaggagaaggctgtgtctgagcacatcccctacctgagcccctaccacagcagcagctaccgctatgccaacatcccagcccacgcccggcactaccagagctacatgcagctgatccagcagaagtctgctgtggagtatgcccagagccagctgagcctggtgtccatgtgcaaggagagccagaagtgcagcgagcccaagatggagtggaaggtgaagatccgcagtgatggcacccgctacatcaccaagaggcctgtgcgggaccgcatcctgaaggagcgggccctgaagatcaaggaggagaggagcggcatgaccacagatgatgacaccatgtctgagatgaagatgggccgctactggagcaaggaggagaggaagcagcacctggtgcgggccaaggagcagaggagaagaagagagttcatgatgaggagccggctggagtgcctgaaggagagcccccagagcggcagcgagggcaagaaggagatcaacatcatcgagctgagccacaagaagatgatgaagaagaggaacaagaagatcctggacaactggatgaccatccaggagctgatgacccacggggccaagagcccagatggcaccagggtgcacaatgccttcctgtctgtgaccaccgtgtag

SEQ ID NO: 163443 - DNA, 2337 bp, Artificial Sequence
  Description of Artificial Sequence: Synthetic coding sequence
atgggctgcaacctgtgcaccttccagaagcgggaggagcactacaagctgctgtatgaggtgtcccaggtgaatggcaaggacctgagcaaggccacccatgaggaggccgtggaggccttcagaaatgccaaggagcccatcgtggtgcaggtgctgcggaggacccccctgagcaggcctgcctacggcatggccagcgaggtgcagctgatgaatgccagcacccagacagacatcacctttgagcacatcatggccctggccaagctgcggccccccaccccacctgtgcctgacatctgccccttcctgctgagtgacagctgccacagcctgcaccccatggagcacgagttctatgaggacaatgagtacatcagcagcctgcctgcagatgctgacagaacagaggactttgaatatgaggaggtggagctgtgccgggtgagcagccaggagaagctgggcctgactgtgtgctacagaacagatgatgaggaggacaccggcatctacgtgtctgaggtggaccccaacagcattgctgccaaggatggccgcatccgggagggggaccgcatcctgcagatcaatggagaagatgtgcagaaccgggaggaggccgtggccctgctgagcaatgatgagtgcaagagaattgtgctgctggtggcccggcctgagatccagctggatgagggctggctggaggatgaaagaaatgagttcctggaggagctgaacctggagatgctggaggaggagcacaatgaggccatgcagcccacagccaatgaggtggagcagcccaagaagcaggaggaggaggagggcaccacagacacagccaccagcagcagcaacaaccacgagaaggacagcggcgtgggccgcacagatgagagcctgagaaatgatgagagcagcgagcaggagaatgctgctgaggaccccaacagcaccagcctgaagagcaagagggacctgggccagagccaggacaccctgggctctgtggagctgcagtacaatgaaagcctggtgtctggagagtacatcgacagcgactgcatcggcaacccagatgaggactgtgagcgcttccggcagctgctggagctgaagtgcaagatccggaaccacggggagtatgacctgtactacagcagcagcaccatcgagtgcaaccagggcgagcaggagggcgtggagcacgagctgcagctgctgaatgaggagctgaggaacatcgagctggagtgccagaacatcatgcaggcccaccggctgcagaaggtgacagaccagtacggggacatctggaccctgcatgatggcggcttcaggaactacaacaccagcattgacatgcagaggggcaagctggatgacatcatggagcaccctgagaagagtgacaaggacagcagcagcgcctacaacacagctgagagctgccgcagcacccccctgactgtggacaggagcccagacagcagcctgcccagggtcatcaacctgaccaacaagaagaacctgcggagcaccatggccgccacccagagcagcagcggccagagcagcaaggagagcaccagcaccaaggccaagaccacagagcagggctgcagcgctgagagcaaggagaaggtgctggagggcagcaagctgcctgaccaggagaaggctgtgtctgagcacatcccctacctgagcccctaccacagcagcagctaccgctatgccaacatcccagcccacgcccggcactaccagagctacatgcagctgatccagcagaagtctgctgtggagtatgcccagagccagctgagcctggtgtccatgtgcaaggagagccagaagtgcagcgagcccaagatggagtggaaggtgaagatccgcagtgatggcacccgctacatcaccaagaggcctgtgcgggaccgcatcctgaaggagcgggccctgaagatcaaggaggagaggagcggcatgaccacagatgatgacaccatgtctgagatgaagatgggccgctactggagcaaggaggagaggaagcagcacctggtgcgggccaaggagcagaggagaagaagagagttcatgatgaggagccggctggagtgcctgaaggagagcccccagagcggcagcgagggcaagaaggagatcaacatcatcgagctgagccacaagaagatgatgaagaagaggaacaagaagatcctggacaactggatgaccatccaggagctgatgacccacggggccaagagcccagatggcaccagggtgcacaatgccttcctgtctgtgaccaccgtgtag

SEQ ID NO: 163444 - DNA, 1158 bp, Artificial Sequence
  Description of Artificial Sequence: Synthetic coding sequence
atgaagctggtgaggaagaacatcgagaaggacaatgccggccaggtgaccctggtgcctgaggagcctgaggacatgtggcacacctacaacctggtgcaggtgggggacagcctgcgggccagcaccatcaggaaggtgcagacagagagcagcactggatctgtgggcagcaacagagtgaggaccaccctgaccctgtgtgtggaggccatcgactttgacagccaggcctgccagctgcgggtgaagggcaccaacatccaggagaatgaatatgtgaagatgggcgcctaccacaccatcgagctggagcccaaccggcagttcaccctggccaagaagcagtgggacagcgtggtgctggagagaattgagcaggcctgtgaccctgcctggagcgcagatgtggccgctgtggtgatgcaggagggcctggcccacatctgcctggtgacccccagcatgaccctgacccgggccaaggtggaggtgaacatccccaggaagaggaagggcaactgcagccagcacgaccgggccctggagcgcttctatgagcaggtggtgcaggccatccagaggcacatccactttgatgtggtgaagtgcatcctggtggccagccctggctttgtgcgggagcagttctgtgactacctgttccagcaggccgtgaagacagacaacaagctgctgctggagaacagaagcaagttcctgcaggtgcacgccagcagcggccacaagtacagcctgaaggaggccctgtgtgaccccaccgtggccagccggctgagtgacaccaaggccgccggggaggtgaaggccctggatgacttctacaagatgctgcagcacgagccagaccgggccttctacggcctgaagcaggtggagaaggccaatgaggccatggccatcgacaccctgctgatcagtgatgagctgttccgccaccaggatgtggccaccaggagccgctacgtgcggctggtggacagcgtgaaggaaaatgccggcaccgtgcgcatcttcagcagcctgcacgtgtctggagagcagctgagccagctgactggagtggccgccatcctgcgcttccctgtgcctgagctgagtgaccaggagggggacagcagcagcgaggaggactag

SEQ ID NO: 163445 - DNA, 855 bp, Artificial Sequence
  Description of Artificial Sequence: Synthetic coding sequence
atggccagctacccctaccggcagggctgccctggagctgctggccaggcccctggggcccctcctggcagctactacccaggcccccccaacagcggcggccagtatggcagcggcctgcccccaggcggcggctacggcggccctgcccctgggggcccctacggccccccagctgggggcggcccctacggccaccccaaccctggcatgttccccagcggcaccccaggcggcccctatggaggagctgcccctgggggcccctacggccagcccccacccagcagctatggagcccagcagcccggcctgtatggccagggcggggccccacccaacgtggaccctgaggcctacagctggttccagagcgtggacagcgaccacagcggctacatctccatgaaggagctgaagcaggccctggtgaactgcaactggagcagcttcaatgatgagacctgcctgatgatgatcaacatgtttgacaagaccaagagcggcagaattgatgtgtatggcttcagcgccctgtggaagttcatccagcagtggaagaacctcttccagcagtatgaccgggacaggagcggcagcatctcctacacagagctgcagcaggccctgagccagatgggctacaacctgagcccccagttcacccagctgctggtgagccgctactgccccaggtctgccaacccagccatgcagctggaccgcttcatccaggtgtgcacccagctgcaggtgctgacagaggccttccgggagaaggacacagctgtgcagggcaacatccggctgagctttgaagattttgtgaccatgacagccagcaggatgctgtag

SEQ ID NO: 163446 - DNA, 423 bp, Artificial Sequence
  Description of Artificial Sequence: Synthetic coding sequence
atggccagctacccctaccggcagggctgccctggagctgctggccaggcccctggggcccctcctggcagctactacccaggcccccccaacagcggcggccagtatggcagcggcctgcccccaggcggcggctacggcggccctgcccctgggggcccctacggccccccagctgggggcggcccctacggccaccccaaccctggcatgttccccagcggcaccccaggcggcccctatggaggagctgcccctgggggcccctacggccagcccccacccagcagctatggagcccagcagcccggcctgtatggccagggcatccacgccgagggcgccgcccctgtgtgggacatgctgagcctgtggcagcgggagggcgctggggagctggccaggatgcacaatgccagctag

SEQ ID NO: 163447 - DNA, 1146 bp, Artificial Sequence
  Description of Artificial Sequence: Synthetic coding sequence
atgcacctgctggccatcctcttctgtgccctgtggagcgctgtgctggccgagaacagtgatgattatgacctgatgtatgtgaacctggacaatgaaattgacaatggcctgcaccccacagaggaccccaccccctgtgcctgtggccaggagcacagcgagtgggacaagctgttcatcatgctggagaacagccagatgagggagaggatgctgctgcaggccacagatgatgtgctgcggggggagctgcagaggctgcgggaggagctgggccgcctggccgagagcctggcccggccctgtgcccctggggccccagctgaggcccggctgaccagcgccctggatgagctgctgcaggccaccagagatgctggaagaaggctggccaggatggagggcgctgaggcccagaggcctgaggaggccggccgggccctggccgctgtgctggaggagctgcggcagaccagggctgacctgcatgctgtgcagggctgggccgcccgctcctggctgcctgctggctgtgaaacagccatcctcttccccatgaggagcaagaagatctttggatctgtgcaccctgtgcggcccatgaggctggagagcttcagcgcctgcatctgggtgaaggccacagatgtgctgaacaagaccatcctcttctcctatggcaccaagaggaacccctatgagatccagctgtacctgagctaccagagcatcgtgtttgtggtgggcggggaggagaacaagctggtggccgaggccatggtgtccctgggccgctggacccacctgtgtggcacctggaacagcgaggagggcctgaccagcctgtgggtgaatggagagctggccgccaccaccgtggagatggccaccggccacatcgtgcctgagggcggcatcctgcagatcggccaggagaagaatggctgctgcgtgggcggcggctttgatgagaccctggccttcagcggccgcctgaccggcttcaacatctgggacagcgtgctgagcaatgaggagatccgggagactggaggagctgagagctgccacatccggggcaacatcgtgggctggggcgtgacagagatccagccccacggcggggcccagtatgtgtcctag

SEQ ID NO: 163448 - DNA, 1422 bp, Artificial Sequence
  Description of Artificial Sequence: Synthetic coding sequence
atgggcagcggcaactgggaggtgactggaccaccctgtggcagccgctgtgagcggcccccaggcctgccccggggcgtgcacggccagttccgctctgctgtgggcctgagcggcctgcgctggttccgccgcttccaggaggtgacctggacccacctgcagaacatcgccagcaactacaacgtgtcctacaacgtggatgtgcgcttccgcagcctggccgaggagagccaggccgtggcccaggccgtgaacagaagccaggcctctgtgcagggcgagctggcccagctgaaggcctgggtgaggaagctgcagaggcggggcaggaaggtggacacccggctgcgggccctggacctgaccctgggggagaggagccagcagagggcccgggagaggaaggcccacaaggcccagagagatgccctgcaggacagcctggcccggctggagggcctggtgcacagccagggcgcccggctggccgccctggagggccgcctgcctgtggcccaccctggaacagctgccctgggccctgccctggtgcccacccccacccagcctgaggagctgggccccaccagcctgaagctgcagagggaccggcaggagctgcgggccgccagcgagcaccggggccccccccaggacagcagcgcccccctgcagggccggcgggagcccccagccagcggcagccaccgggtgctgtctggaacagcccccaaggacccccggcagcaggcctggagcccccaggtgcctggagagatctgtggggtgggccccaccctggtgttccccaatgccagcaccagaaatgtggtgttcctgagccctggctttgtgacagccctgcgggccctgtccttctgctcctgggtgaggacagccagcggccgcctgggcaccctgctgtcctatgccacagaggacaatgacaacaagctggtgctgcacggccgggacagcctgctgcccggcagcatccactttgtgattggagaccctgccttccgggagctgcccctgcagctgctgctggatggccagtggcaccacatctgtgtgatctggaccagcacccagggccgctactggctgcacgtggaccggcggctggtggccaccggcagccgcttccgggagggctatgagatccccccaggcggcagcctggtgctgggccaggagcaggacagcgtgggcggcggctttgacagcagcgaggcctttgtgggctccatgagcggcctggccatctgggaccgggccctggtgcctggagaggtggccaacctggccatcggcaaggagttccccactggagccatcctgaccctggccaatgctgccctggccggcggctttgtgcagggcgccaactgcacctgcctggagcgctgcccctag

SEQ ID NO: 163449 - DNA, 1437 bp, Artificial Sequence
  Description of Artificial Sequence: Synthetic coding sequence
atgggctgctcctggaggaagaccctgtccttcttcctggtgtttgtgcccatctacctgcatggagccagcagccaggaggccgcccctgtgggccccaggaagcccttctttgagcggctgcggcggctggaggagcagttccgccgcttccaggaggtgacctggacccacctgcagaacatcgccagcaactacaacgtgtcctacaacgtggatgtgcgcttccgcagcctggccgaggagagccaggccgtggcccaggccgtgaacagaagccaggcctctgtgcagggcgagctggcccagctgaaggcctgggtgaggaagctgcagaggcggggcaggaaggtggacacccggctgcgggccctggacctgaccctgggggagaggagccagcagagggcccgggagaggaaggcccacaaggcccagagagatgccctgcaggacagcctggcccggctggagggcctggtgcacagccagggcgcccggctggccgccctggagggccgcctgcctgtggcccaccctggaacagctgccctgggccctgccctggtgcccacccccacccagcctgaggagctgggccccaccagcctgaagctgcagagggaccggcaggagctgcgggccgccagcgagcaccggggccccccccaggacagcagcgcccccctgcagggcagaagagagcccccagccagcggcagccaccgggtgctgagcggcacagcccccaaggacccccggcagcaggcctggagcccccaggtgcctggagagatctgtggggtgggccccaccctggtgttccccaatgccagcaccagaaatgtggtgttcctgagccctggctttgtgacagccctgcgggccctgtccttctgctcctgggtgaggacagccagcggccgcctgggcaccctgctgtcctatgccacagaagataatgacaacaagctggtgctgcacggccgggacagcctgctgcccggcagcatccacttcgtcatcggggaccctgccttccgggagctgcccctgcagctgctgctggatggccagtggcaccacatctgtgtgatctggaccagcacccagggccgctactggctgcacgtggaccggcggctggtggccaccggcagccgcttccgggagggctatgagatccccccaggcggcagcctggtgctgggccaggagcaggacagcgtgggcggcggctttgacagcagcgaggcctttgtgggctccatgagcggcctggccatctgggaccgggccctggtgcctggagaggtggccaacctggccatcggcaaggagttccccaccggggccatcctgaccctggccaatgctgccctggccggcggctttgtgcagggcgccaactgcacctgcctggagcgctgcccctag

SEQ ID NO: 163450 - DNA, 1167 bp, Artificial Sequence
  Description of Artificial Sequence: Synthetic coding sequence
atgaagtggctgctgctgctgggcctggtggccctgtctgagtgcatcatgtacaaggtgcccctcatcaggaagaagagcctgcggaggaccctgtctgagcggggcctgctgaaggacttcctgaagaagcacaacctgaacccagccaggaagtacttcccccagtggaaggcccccaccctggtggatgagcagcccctggagaactacctggacatggagtacttcggcaccatcggcatcggcaccccagcccaggacttcaccgtggtgtttgacaccggcagcagcaacctgtgggtgcccagcgtgtactgcagcagcctggcctgcaccaaccacaaccgcttcaaccctgaggacagcagcacctaccagagcaccagcgagaccgtgtccatcacctatggaacaggctccatgacaggcatcctgggctatgacacagtgcaggtgggcggcatcagtgacaccaaccagatcttcggcctgtctgaaacagagcccggcagcttcctgtactatgccccctttgatggcatcctgggcctggcctaccccagcatcagcagcagcggggccacccctgtgtttgacaacatctggaaccagggcctggtgtcccaggacctcttctctgtgtacctgtctgcagatgaccagagcggctctgtggtgatctttggaggcatcgacagcagctactacacaggcagcctgaactgggtgcctgtgacagtggagggctactggcagatcaccgtggacagcatcaccatgaatggagaggccatcgcctgtgccgagggctgccaggccatcgtggacaccggcaccagcctgctgaccggccccaccagccccatcgccaacatccagagcgacattggagcctctgaaaattctgatggagacatggtggtgtcctgcagcgccatcagcagcctgcctgacatcgtgttcaccatcaatggagtgcagtaccctgtgccccccagcgcctacatcctgcagagcgagggcagctgcatcagcggcttccagggcatgaacctgcccacagaaagtggagagctgtggatcctgggagatgtgttcatccggcagtacttcaccgtgtttgaccgggccaacaaccaggtgggcctggcccctgtggcctag

SEQ ID NO: 163451 - DNA, 849 bp, Artificial Sequence
  Description of Artificial Sequence: Synthetic coding sequence
atgaagtggctgctgctgctgggcctggtggccctgtctgagtgcatcatgtacaaggtgcccctcatcaggaagaagagcctgcggaggaccctgtctgagcggggcctgctgaaggacttcctgaagaagcacaacctgaacccagccaggaagtacttcccccagtggaaggcccccaccctggtggatgagcagcccctggagaactacctggacatggagtacttcggcaccatcggcatcggcaccccagcccaggacttcaccgtggtgtttgacaccggcagcagcaacctgtgggtgcccagcgtgtactgcagcagcctggcctgcaccaaccacaaccgcttcaaccctgaggacagcagcacctaccagagcaccagcgagaccgtgtccatcacctatggaacaggctccatgacaggcatcctgggctatgacacagtgcagacagtggccatctggaggtctgctgccatgggcctggtgtcccaggacctcttctctgtgtacctgtctgcagatgaccagagcggctctgtggtgatctttggaggcatcgacagcagctactacacaggcagcctgaactgggtgcctgtgacagtggagggctactggcagatcaccgtggacagcatcaccatgaatggagaggccatcgcctgtgccgagggctgccaggccatcgtggacaccggcaccagcctgctgaccggccccaccagccccatcgccaacatccagagcgacatcggggccagcgagaacagtgatggagacatggtggtgtcctgcagcgccatcagcagcctgcctgacatcgtgttcaccatcaactag

SEQ ID NO: 163452 - DNA, 750 bp, Artificial Sequence
  Description of Artificial Sequence: Synthetic coding sequence
atgacaggcatcctgggctatgacacagtgcaggtgggcggcatcagtgacaccaaccagatcttcggcctgtctgaaacagagcccggcagcttcctgtactatgccccctttgatggcatcctgggcctggcctaccccagcatcagcagcagcggggccacccctgtgtttgacaacatctggaaccagggcctggtgtcccaggacctcttctctgtgtacctgtctgcagatgaccagagcggctctgtggtgatctttggaggcatcgacagcagctactacacaggcagcctgaactgggtgcctgtgacagtggagggctactggcagatcaccgtggacagcatcaccatgaatggagaggccatcgcctgtgccgagggctgccaggccatcgtggacaccggcaccagcctgctgaccggccccaccagccccatcgccaacatccagagcgacatcggggccagcgagaacagtgatggagacatggtggtgtcctgcagcgccatcagcagcctgcctgacatcgtgttcaccatcaacggggtgcagtaccctgtgcccccatctgcctacatcctgcagctgcccagcgagggcagctgcatcagcggcttccagggcatgaacctgcccacagagagcggggagctgtggatcctgggagatgtgttcatccggcagtacttcaccgtgtttgaccgggccaacaaccaggtgggcctggcccctgtggcctag

SEQ ID NO: 163453 - DNA, 1167 bp, Artificial Sequence
  Description of Artificial Sequence: Synthetic coding sequence
atgaagtggctgctgctgctgggcctggtggccctgtctgagtgcatcatgtacaaggtgcccctcatcaggaagaagagcctgcggaggaccctgtctgagcggggcctgctgaaggacttcctgaagaagcacaacctgaacccagccaggaagtacttcccccagtgggaggcccccaccctggtggatgagcagcccctggagaactacctggacatggagtacttcggcaccatcggcatcggcaccccagcccaggacttcaccgtggtgtttgacaccggcagcagcaacctgtgggtgcccagcgtgtactgcagcagcctggcctgcaccaaccacaaccgcttcaaccctgaggacagcagcacctaccagagcaccagcgagaccgtgtccatcacctatggaacaggctccatgacaggcatcctgggctatgacacagtgcaggtgggcggcatcagtgacaccaaccagatcttcggcctgtctgaaacagagcccggcagcttcctgtactatgccccctttgatggcatcctgggcctggcctaccccagcatcagcagcagcggggccacccctgtgtttgacaacatctggaaccagggcctggtgtcccaggacctcttctctgtgtacctgtctgcagatgaccagagcggctctgtggtgatctttggaggcatcgacagcagctactacacaggcagcctgaactgggtgcctgtgacagtggagggctactggcagatcaccgtggacagcatcaccatgaatggagaggccatcgcctgtgccgagggctgccaggccatcgtggacaccggcaccagcctgctgaccggccccaccagccccatcgccaacatccagagcgacattggagcctctgaaaattctgatggagacatggtggtgtcctgcagcgccatcagcagcctgcctgacatcgtgttcaccatcaatggagtgcagtaccctgtgccccccagcgcctacatcctgcagagcgagggcagctgcatcagcggcttccagggcatgaacctgcccacagaaagtggagagctgtggatcctgggagatgtgttcatccggcagtacttcaccgtgtttgaccgggccaacaaccaggtgggcctggcccctgtggcctag

SEQ ID NO: 163454 - DNA, 1167 bp, Artificial Sequence
  Description of Artificial Sequence: Synthetic coding sequence
atgaagtggctgctgctgctgggcctggtggccctgtctgagtgcatcatgtacaaggtgcccctcatcaggaagaagagcctgcggaggaccctgtctgagcggggcctgctgaaggacttcctgaagaagcacaacctgaacccagccaggaagtacttcccccagtgggaggcccccaccctggtggatgagcagcccctggagaactacctggacatggagtacttcggcaccatcggcatcggcaccccagcccaggacttcaccgtggtgtttgacaccggcagcagcaacctgtgggtgcccagcgtgtactgcagcagcctggcctgcaccaaccacaaccgcttcaaccctgaggacagcagcacctaccagagcaccagcgagaccgtgtccatcacctatggaacaggctccatgacaggcatcctgggctatgacacagtgcaggtgggcggcatcagtgacaccaaccagatcttcggcctgtctgaaacagagcccggcagcttcctgtactatgccccctttgatggcatcctgggcctggcctaccccagcatcagcagcagcggggccacccctgtgtttgacaacatctggaaccagggcctggtgtcccaggacctcttctctgtgtacctgtctgcagatgacaagagcggctctgtggtgatctttggaggcatcgacagcagctactacacaggcagcctgaactgggtgcctgtgacagtggagggctactggcagatcaccgtggacagcatcaccatgaatggagagaccatcgcctgtgccgagggctgccaggccatcgtggacaccggcaccagcctgctgaccggccccaccagccccatcgccaacatccagagcgacattggagcctctgaaaattctgatggagacatggtggtgtcctgcagcgccatcagcagcctgcctgacatcgtgttcaccatcaatggagtgcagtaccctgtgccccccagcgcctacatcctgcagagcgagggcagctgcatcagcggcttccagggcatgaatgtgcccacagaaagtggagagctgtggatcctgggagatgtgttcatccggcagtacttcaccgtgtttgaccgggccaacaaccaggtgggcctggcccctgtggcctag

SEQ ID NO: 163455 - DNA, 849 bp, Artificial Sequence
  Description of Artificial Sequence: Synthetic coding sequence
atgaagtggctgctgctgctgggcctggtggccctgtctgagtgcatcatgtacaaggtgcccctcatcaggaagaagagcctgcggaggaccctgtctgagcggggcctgctgaaggacttcctgaagaagcacaacctgaacccagccaggaagtacttcccccagtgggaggcccccaccctggtggatgagcagcccctggagaactacctggacatggagtacttcggcaccatcggcatcggcaccccagcccaggacttcaccgtggtgtttgacaccggcagcagcaacctgtgggtgcccagcgtgtactgcagcagcctggcctgcaccaaccacaaccgcttcaaccctgaggacagcagcacctaccagagcaccagcgagaccgtgtccatcacctatggaacaggctccatgacaggcatcctgggctatgacacagtgcagacagtggccatctggaggtctgctgccatgggcctggtgtcccaggacctcttctctgtgtacctgtctgcagatgaccagagcggctctgtggtgatctttggaggcatcgacagcagctactacacaggcagcctgaactgggtgcctgtgacagtggagggctactggcagatcaccgtggacagcatcaccatgaatggagaggccatcgcctgtgccgagggctgccaggccatcgtggacaccggcaccagcctgctgaccggccccaccagccccatcgccaacatccagagcgacatcggggccagcgagaacagtgatggagacatggtggtgtcctgcagcgccatcagcagcctgcctgacatcgtgttcaccatcaactag

SEQ ID NO: 163456 - DNA, 750 bp, Artificial Sequence; identical to SEQ ID NO: 163452
  Description of Artificial Sequence: Synthetic coding sequence

SEQ ID NO: 163457 - DNA, 1167 bp, Artificial Sequence; identical to SEQ ID NO: 163454
  Description of Artificial Sequence: Synthetic coding sequence

SEQ ID NO: 163458 - DNA, 849 bp, Artificial Sequence
  Description of Artificial Sequence: Synthetic coding sequence
atgaagtggctgctgctgctgggcctggtggccctgtctgagtgcatcatgtacaaggtgcccctcatcaggaagaagagcctgcggaggaccctgtctgagcggggcctgctgaaggacttcctgaagaagcacaacctgaacccagccaggaagtacttcccccagtgggaggcccccaccctggtggatgagcagcccctggagaactacctggacatggagtacttcggcaccatcggcatcggcaccccagcccaggacttcaccgtggtgtttgacaccggcagcagcaacctgtgggtgcccagcgtgtactgcagcagcctggcctgcaccaaccacaaccgcttcaaccctgaggacagcagcacctaccagagcaccagcgagaccgtgtccatcacctatggaacaggctccatgacaggcatcctgggctatgacacagtgcagacagtggccatctggaggtctgctgccatgggcctggtgtcccaggacctcttctctgtgtacctgtctgcagatgacaagagcggctctgtggtgatctttggaggcatcgacagcagctactacacaggcagcctgaactgggtgcctgtgacagtggagggctactggcagatcaccgtggacagcatcaccatgaatggagagaccatcgcctgtgccgagggctgccaggccatcgtggacaccggcaccagcctgctgaccggccccaccagccccatcgccaacatccagagcgacatcggggccagcgagaacagtgatggagacatggtggtgtcctgcagcgccatcagcagcctgcctgacatcgtgttcaccatcaactag

SEQ ID NO: 163459 - DNA, 750 bp, Artificial Sequence
  Description of Artificial Sequence: Synthetic coding sequence
atgacaggcatcctgggctatgacacagtgcaggtgggcggcatcagtgacaccaaccagatcttcggcctgtctgaaacagagcccggcagcttcctgtactatgccccctttgatggcatcctgggcctggcctaccccagcatcagcagcagcggggccacccctgtgtttgacaacatctggaaccagggcctggtgtcccaggacctcttctctgtgtacctgtctgcagatgacaagagcggctctgtggtgatctttggaggcatcgacagcagctactacacaggcagcctgaactgggtgcctgtgacagtggagggctactggcagatcaccgtggacagcatcaccatgaatggagagaccatcgcctgtgccgagggctgccaggccatcgtggacaccggcaccagcctgctgaccggccccaccagccccatcgccaacatccagagcgacatcggggccagcgagaacagtgatggagacatggtggtgtcctgcagcgccatcagcagcctgcctgacatcgtgttcaccatcaacggggtgcagtaccctgtgcccccatctgcctacatcctgcagctgcccagcgagggcagctgcatcagcggcttccagggcatgaatgtgcccacagagagcggggagctgtggatcctgggagatgtgttcatccggcagtacttcaccgtgtttgaccgggccaacaaccaggtgggcctggcccctgtggcctag

SEQ ID NO: 163460 - DNA, 1578 bp, Artificial Sequence
  Description of Artificial Sequence: Synthetic coding sequence
atggctgctgtggtgctggccgccacccggctgctgcggggcagcggctcctggggctgcagccggctgcgctttggacctccagcctaccgccgcttcagcagtggaggagcctaccccaacatccccctgagcagccccctgcccggggtgcccaagcctgtgtttgccaccgtggatggccaggagaagtttgagaccaaggtgaccaccctggacaatggcctgcgggtggccagccagaacaagtttggccagttctgcaccgtgggcatcctgatcaacagcggcagccgctatgaggccaagtacctgagcggcatcgcccacttcctggagaagctggccttcagcagcacagccaggtttgacagcaaggatgagatcctgctgaccctggagaagcacggcggcatctgtgactgccagaccagccgggacaccaccatgtatgctgtgtctgctgacagcaagggcctggacacagtggtggccctgctggctgatgtggtgctgcagccccggctgacagatgaggaggtggagatgaccaggatggctgtgcagtttgagctggaggacctgaacctgcggccagaccctgagcccctgctgacagagatgatccacgaggccgcctaccgggagaacacagtgggcctgcaccgcttctgccccacagaaaatgtggccaagatcaaccgggaggtgctgcacagctacctgaggaactactacaccccagacaggatggtgctggccggcgtgggcgtggagcacgagcacctggtggactgtgccaggaagtacctgctgggcgtgcagcctgcctggggcagcgctgaggccgtggacatcgacagatctgtggcccagtacacaggaggcatcgccaagctggagcgggacatgagcaatgtgtccctgggccccacccccatccctgagctgacccacatcatggtgggcctggagagctgcagcttcctggaggaggacttcatcccctttgctgtgctgaacatgatgatgggcggcggcggcagcttctctgctgggggccctgggaagggcatgttcagccggctgtacctgaatgtgctgaacagacaccactggatgtacaatgccaccagctaccaccacagctatgaggacaccggcctgctgtgcatccacgccagcgctgacccccggcaggtgcgggagatggtggagatcatcaccaaggagttcatcctgatgggcggcaccgtggacacagtggagctggagcgggccaagacccagctgacctccatgctgatgatgaacctggagagcaggcctgtgatctttgaagatgtgggccggcaggtgctggccaccaggagcaggaagctgccccatgagctgtgcaccctcatcagaaatgtgaagccagaagatgtgaagagggtggccagcaagatgctgcggggcaagccagctgtggccgccctgggggacctgacagacctgcccacctatgagcacatccagacagccctgagcagcaaggatggccgcctgcccaggacctaccgcctcttcagatag

SEQ ID NO: 163461 - DNA, 441 bp, Artificial Sequence
  Description of Artificial Sequence: Synthetic coding sequence
atggctgctgtggtgctggccgccacccggctgctgcggggcagcggctcctggggctgcagccggctgcgctttggacctccagcctaccgccgcttcagcagtggaggagcctaccccaacatccccctgagcagccccctgcccggggtgcccaagcctgtgtttgccaccgtggatggccaggagaagtttgagaccaaggtgaccaccctggacaatggcctgcgggtggccagccagaacaagtttggccagttctgcaccgtgggcatcctgatcaacagcggcagccgctatgaggccaagtacctgagcggcatcgcccacttcctggagaagctggccttcagcagcacagccaggtttgacagcaaggatgagatcctgctgaccctggagaagcacggcggcatctgtgactgccagaccagcaggtag

SEQ ID NO: 163462 - DNA, 1185 bp, Artificial Sequence
  Description of Artificial Sequence: Synthetic coding sequence
atgaagaggaacaccctggtggagctgctgaccttctggaagaactggcacttccggctgctgctggacctgacagccaagatgaagttctgcctgcgctggaagtccatgggcgtgtctgtgacagcccggcaccaggatgaggaggtggagatgaccaggatggctgtgcagtttgagctggaggacctgaacctgcggccagaccctgagcccctgctgacagagatgattcatgaagctgcctacagagaaaatacagtgggcctgcaccgcttctgccccacagaaaatgtggccaagatcaaccgggaggtgctgcacagctacctgaggaactactacaccccagacaggatggtgctggccggcgtgggcgtggagcacgagcacctggtggactgtgccaggaagtacctgctgggcgtgcagcctgcctggggcagcgctgaggccgtggacatcgacagatctgtggcccagtacacaggaggcatcgccaagctggagcgggacatgagcaatgtgtccctgggccccacccccatccctgagctgacccacatcatggtgggcctggagagctgcagcttcctggaggaggacttcatcccctttgctgtgctgaacatgatgatgggcggcggcggcagcttctctgctgggggccctgggaagggcatgttcagccggctgtacctgaatgtgctgaacagacaccactggatgtacaatgccaccagctaccaccacagctatgaggacaccggcctgctgtgcatccacgccagcgctgacccccggcaggtgcgggagatggtggagatcatcaccaaggagttcatcctgatgggcggcaccgtggacacagtggagctggagcgggccaagacccagctgacctccatgctgatgatgaacctggagagcaggcctgtgatctttgaagatgtgggccggcaggtgctggccaccaggagcaggaagctgccccatgagctgtgcaccctcatcagaaatgtgaagccagaagatgtgaagagggtggccagcaagatgctgcggggcaagccagctgtggccgccctgggggacctgacagacctgcccacctatgagcacatccagacagccctgagcagcaaggatggccgcctgcccaggacctaccgcctcttcagatag

SEQ ID NO: 163463 - DNA, 816 bp, Artificial Sequence
  Description of Artificial Sequence: Synthetic coding sequence
tacacaggaggcatcgccaagctggagcgggacatgagcaatgtgtccctgggccccacccccatccctgagctgacccacatcatggtgggcctggagagctgcagcttcctggaggaggacttcatcccctttgctgtgctgaacatgatgatgggcggcggcggcagcttctctgctgggggccctgggaagggcatgttcagccggctgtacctgaatgtgctgaacagacaccactggatgtacaatgccaccagctaccaccacagctatgaggacaccggcctgctgtgcatccacgccagcgctgacccccggcaggtgcgggagatggtggagatcatcaccaaggagttcatcctgatgggcggcaccgtggacacagtggagctggagcgggccaagacccagctgacctccatgctgatgatgaacctggagagcaggcctgtgatctttgaagatgtgggccggcaggtgctggccaccaggagcaggaagctgccccatgagctgtgcaccctcatccgggagtacagaagaggcagcgagggcctgccccaggccagcgcccggctgcggggcggccgcctggccctgccccaggccgtggtgggcctgtggtacgtgcaccacacccagaacctgggccccagccctgtggtgctgagcagaggaggccagggccagggccggggcgtggccgacctggtgtccctgcccggccccaccatgcacctgctgcccccctggcaggtgaccccacccagcgcccccctgggcggcgctgtgaccacagcccagagctgctag

SEQ ID NO: 163464 - DNA, 1482 bp, Artificial Sequence
  Description of Artificial Sequence: Synthetic coding sequence
atggctgctgccaccggccccagcttctggctgggcaatgagaccctgaaggtgcccctggccctgtttgccctgaaccggcagaggctgtgtgagcggctgaggaagaacccagctgtgcaggccggcagcatcgtggtgctgcagggcggggaggagacccagcgctactgcacagacacaggagtgctcttccggcaggagagcttcttccactgggcctttggagtgacagagcccggctgctatggagtgattgatgtggacaccgggaagagcaccctgtttgtgccccggctgcctgccagccacgccacctggatgggcaagatccacagcaaggagcacttcaaggagaagtatgctgtggatgatgtgcagtatgtggatgagatcgcctctgtgctgaccagccagaagcccagcgtgctgctgaccctgcggggcgtgaacacagacagcggctctgtgtgccgggaggccagctttgatggcatcagcaagtttgaggtgaacaacaccatcctgcaccctgagatcgtggagtgcagggtcttcaagacagacatggagctggaggtgctgcgctacaccaacaagatcagcagcgaggcccaccgggaggtgatgaaggctgtgaaggtgggcatgaaggagtatgagctggagagcctgtttgagcactactgctacagccggggcggcatgaggcacagcagctacacctgcatctgtggcagcggagaaaattctgctgtgctgcactacggccatgctggggccccaaatgacaggaccatccagaatggagacatgtgcctgtttgacatgggcggggagtactactgctttgccagtgacatcacctgcagcttccctgccaacgggaagttcaccgctgaccagaaggctgtgtatgaggccgtgctgcggagcagcagagctgtgatgggcgccatgaagccaggagtgtggtggccagacatgcaccggctggccgaccgcatccacctggaggagctggcccacatgggcatcctgagcggctctgtggatgccatggtgcaggcccacctgggcgctgtgttcatgccccacggcctgggccacttcctgggcattgatgtgcatgatgtgggcggctacccagagggcgtggagagaattgatgagcccggcctgcggagcctgaggacagcccggcacctgcagcccggcatggtgctgactgtggagcccggcatctacttcatcgaccacctgctggatgaggccctggccgaccctgcccgggccagcttcctgaaccgggaggtgctgcagcgcttccggggctttggaggagtgagaattgaagaagatgtggtggtgacagacagcggcatcgagctgctgacctgtgtgcccaggacagtggaggagattgaggcctgcatggccggctgtgacaaggccttcacccccttcagcggccccaagtag

SEQ ID NO: 163465 - DNA, 1359 bp, Artificial Sequence
  Description of Artificial Sequence: Synthetic coding sequence
atggctgctgccaccggccccagcttctggctgggcaatgagaccctgaaggtgcccctggccctgtttgccctgaaccggcagaggctgtgtgagcggctgaggaagaacccagctgtgcaggccggcagcatcgtggtgctgcagggcggggaggagacccagcgctactgcacagacacaggagtgctcttccggcaggagagcttcttccactgggcctttggagtgacagagcccggctgctatggagtgattgatgtggacaccgggaagagcaccctgtttgtgccccggctgcctgccagccacgccacctggatgggcaagatccacagcaaggagcacttcaaggagaagtatgctgtggatgatgtgcagtatgtggatgagatcgcctctgtgctgaccagccagaagcccagcgtgctgctgaccctgcggggcgtgaacacagacagcggctctgtgtgccgggaggccagctttgatggcatcagcaagtttgaggtgaacaacaccatcctgcaccctgagatcgtggagtgcctgtttgagcactactgctacagcagaggaggcatgaggcacagcagctacacctgcatctgtggcagcggggagaacagcgctgtgctgcactacggccacgccggggccccaaatgacaggaccatccagaatggagacatgtgcctgtttgacatgggcggggagtactactgctttgccagtgacatcacctgcagcttccctgccaacgggaagttcaccgctgaccagaaggctgtgtatgaagctgtgctgcggagcagcagagctgtgatgggcgccatgaagccaggagtgtggtggccagacatgcaccggctggccgaccgcatccacctggaggagctggcccacatgggcatcctgagcggctctgtggatgccatggtgcaggcccacctgggcgctgtgttcatgcctcatggcctgggccacttcctgggcattgatgtgcatgatgtgggcggctacccagagggcgtggagagaattgatgagcccggcctgcggagcctgaggacagcccggcacctgcagcccggcatggtgctgactgtggagcccggcatctacttcatcgaccacctgctggatgaggccctggccgaccctgcccgggccagcttcctgaaccgggaggtgctgcagcgcttccggggctttggaggagtgcgcatcgaggaggatgtggtggtgacagattctggaattgagctgctgacctgtgtgcccaggacagtggaggagattgaggcctgcatggccggctgtgacaaggccttcacccccttcagcggccccaagtag

SEQ ID NO: 163466 - DNA, 1290 bp, Artificial Sequence
  Description of Artificial Sequence: Synthetic coding sequence
atggctgctgccaccggccccagcttctggctgggcaatgagaccctgaaggtgcccctggccctgtttgccctgaaccggcagaggctgtgtgagcggctgaggaagaacccagctgtgcaggccggcagcatcgtggtgctgcagggcggggaggagacccagcgctactgcacagacacaggagtgctcttccggcagatcgcctctgtgctgaccagccagaagcccagcgtgctgctgaccctgcggggcgtgaacacagacagcggctctgtgtgccgggaggccagctttgatggcatcagcaagtttgaggtgaacaacaccatcctgcaccctgagatcgtggagtgcagggtcttcaagacagacatggagctggaggtgctgcgctacaccaacaagatcagcagcgaggcccaccgggaggtgatgaaggctgtgaaggtgggcatgaaggagtatgagctggagagcctgtttgagcactactgctacagccggggcggcatgaggcacagcagctacacctgcatctgtggcagcggagaaaattctgctgtgctgcactacggccatgctggggccccaaatgacaggaccatccagaatggagacatgtgcctgtttgacatgggcggggagtactactgctttgccagtgacatcacctgcagcttccctgccaacgggaagttcaccgctgaccagaaggctgtgtatgaggccgtgctgcggagcagcagagctgtgatgggcgccatgaagccaggagtgtggtggccagacatgcaccggctggccgaccgcatccacctggaggagctggcccacatgggcatcctgagcggctctgtggatgccatggtgcaggcccacctgggcgctgtgttcatgccccacggcctgggccacttcctgggcattgatgtgcatgatgtgggcggctacccagagggcgtggagagaattgatgagcccggcctgcggagcctgaggacagcccggcacctgcagcccggcatggtgctgactgtggagcccggcatctacttcatcgaccacctgctggatgaggccctggccgaccctgcccgggccagcttcctgaaccgggaggtgctgcagcgcttccggggctttggaggagtgagaattgaagaagatgtggtggtgacagacagcggcatcgagctgctgacctgtgtgcccaggacagtggaggagattgaggcctgcatggccggctgtgacaaggccttcacccccttcagcggccccaagtag

SEQ ID NO: 163467 - DNA, 354 bp, Artificial Sequence
  Description of Artificial Sequence: Synthetic coding sequence
atgagggccagcagcttcctgattgtggtggtgttcctgattgctggcaccctggtgctggaggccgctgtgactggagtgcctgtgaagggccaggacacagtgaagggccgggtgcccttcaacggccaggaccctgtgaagggccaggtgtctgtgaagggccaggacaaggtgaaggcccaggagcctgtgaagggccctgtgtccaccaagccaggcagctgccccatcatcctgatccgctgtgccatgctgaacccccccaaccgctgcctgaaggacacagactgccccggcatcaagaagtgctgtgagggcagctgtggcatggcctgctttgtgccccagtag

SEQ ID NO: 163468 - DNA, 732 bp, Artificial Sequence
  Description of Artificial Sequence: Synthetic coding sequence
atggcccggctgtggggcgccctgagcctgtggcccctgtgggccgctgtgccctggggcggcgctgctgctgtgggcgtgcgggcctgcagcagcacagctgccccagatggagtggagggccctgccctgcggcgcagctactggaggcacctgcggcggctggtgctgggccccccagagccccccttcagccacgtgtgccaggtgggggaccctgtgctgcggggcgtggccgcccctgtggagcgggcccagctgggcggccctgagctgcagaggctgacccagaggctggtgcaggtgatgagaagaagaagatgtgtgggcctgagcgccccccagctgggcgtgccccggcaggtgctggccctggagctgcctgaggccctgtgccgggagtgccccccccggcagagggccctgcggcagatggagcccttccccctgcgggtgtttgtgaaccccagcctgcgggtgctggacagccggctggtgaccttccctgagggctgtgagagcgtggccggcttcctggcctgtgtgccccgcttccaggccgtgcagatcagcggcctggaccccaacggggagcaggtggtgtggcaggccagcggctgggccgcccgcatcatccagcacgagatggaccacctgcagggctgcctcttcatcgacaagatggacagcaggaccttcaccaacgtgtactggatgaaggtgaatgactag

SEQ ID NO: 163469 - DNA, 294 bp, Artificial Sequence
  Description of Artificial Sequence: Synthetic coding sequence
atggtgtttgtgagaagaccctggccagccctgaccaccgtgctgctggccctgctggtgtgcctgggcgccctggtggatgcctaccccatcaagccagaggccccccgggaggatgccagccctgaggagctgaaccgctactatgccagcctgcggcactacctgaacctggtgacccggcagagatatggcaagagagatggccctgacaccctgctgagcaagaccttcttcccagatggagaagatagacctgtgcgcagccgctctgagggccctgacctgtggtag

SEQ ID NO: 163470 - DNA, 1992 bp, Artificial Sequence
  Description of Artificial Sequence: Synthetic coding sequence
atggcccccaagagggtggtgcagctgagcctgaagatgcccacccatgctgtgtgtgtggtgggcgtggaggcccacgtggacatccacagtgatgtgcccaagggggccaacagcttccgggtgtctggcagcagcggcgtggaggtgttcatggtgtacaacagaaccagggtgaaggagcccatcggcaaggcccgctggcccctggacacagatgctgacatggtggtgtctgtgggcacagccagcaaggagctgaaggacttcaaggtgcgggtgtcctactttggagagcaggaggaccaggccctgggccgctctgtgctgtacctgactggagtggacatcagcctggaggtggacaccggccgcacaggcaaggtgaagaggagccagggcgacaagaagacctggcgctggggccctgagggctacggggccatcctgctggtgaactgtgaccgggacaaccacaggtctgctgagccagacctgacccacagctggctgatgagcctggccgacctgcaggacatgagccccatgctgctgagctgcaatggaccagacaagctgtttgacagccacaagctggtgctgaatgtgcccttcagtgacagcaagagggtgcgggtcttctgtgcccggggcggcaacagcctgagtgactacaagcaggtgctgggcccccagtgcctgtcctatgaggtggagcggcagcccggggagcaggagatcaagttctacgtggagggcctgaccttcccagatgctgacttcctgggcctggtgtccctgtctgtgtccctggtggaccccggcaccctgcctgaggtgaccctcttcacagacacagtgggcttcaggatggccccctggatcatgacccccaacacccagcccccagaggagctgtatgtgtgccgggtgatggacacccacggcagcaatgagaagttcctggaggacatgagctacctgaccctgaaggccaactgcaagctgaccatctgcccccaggtggagaacagaaatgaccgctggatccaggatgagatggagtttggctacatcgaggccccccacaagagcttccctgtggtgtttgacagccccaggaacagaggcctgaaggacttcccctacaagaggatcctgggccctgactttggctacgtgacccgggagatccccctgcccggccccagcagcctggacagctttggaaacctggatgtgagcccccctgtgacagtgggcggcacagagtaccccctgggccgcatcctgattggcagcagcttccccaagagcggcggccggcagatggcccgggctgtgaggaacttcctgaaggcccagcaggtgcaggcccctgtggagctgtacagcgactggctgtctgtgggccacgtggatgagttcctgacctttgtgcccaccagtgaccagaagggcttccggctgctgctggccagccccagcgcctgcctgaagctgttccaggagaagaaggaggagggctacggggaggccgcccagtttgatggcctgaagcaccaggccaagaggagcatcaatgagatgctggccgacagacacctgcagagggacaacctgcacgcccagaagtgcatcgactggaacagaaatgtgctgaagcgggagctgggcctggccgagagtgacatcgtggacatcccccagctgttcttcctgaagaacttctatgcagaggccttcttcccagacatggtgaacatggtggtgctgggcaagtacctgggcatccccaagccctacggccccatcatcaatggccgctgctgcctggaggagaaggtgcagagcctgctggagcccctgggcctgcactgcatcttcattgatgactacctgagctaccacgagctgcagggcgagatccactgcggcaccaacgtgcggaggaagcccttccccttcaagtggtggaacatggtgccctag

SEQ ID NO: 163471 - DNA, 537 bp, Artificial Sequence
  Description of Artificial Sequence: Synthetic coding sequence
atggcccgggctgtgaggaacttcctgaaggcccagcaggtgcaggcccctgtggagctgtacagcgactggctgtctgtgggccacgtggatgagttcctgacctttgtgcccaccagtgaccagaagggcttccggctgctgctggccagccccagcgcctgcctgaagctgttccaggagaagaaggaggagggctatggagaggccgcccagtttgatggcctgaagcaccaggccaagaggagcatcaatgagatgctggccgacagacacctgcagagggacaacctgcacgcccaggtgaacatggtggtgctgggcaagtacctgggcatccccaagccctacggccccatcatcaatggccgctgctgcctggaggagaaggtgcagagcctgctggagcccctgggcctgcactgcatcttcattgatgactacctgagctaccacgagctgcagggcgagatccactgcggcaccaacgtgcggaggaagcccttccccttcaagtggtggaacatggtgccctag

SEQ ID NO: 163472 - DNA, 405 bp, Artificial Sequence
  Description of Artificial Sequence: Synthetic coding sequence
atgctggccgacagacacctgcagagggacaacctgcacgcccagaagtgcatcgactggaacagaaatgtgctgaagcgggagctgggcctggccgagagtgacatcgtggacatcccccagctgttcttcctgaagaacttctacgccgaggccttcttcccagacatggtgaacatggtggtgctgggcaagtacctgggcatccccaagccctacggccccatcatcaatggccgctgctgcctggaggagaaggtgcagagcctgctggagcccctgggcctgcactgcatcttcattgatgactacctgagctaccacgagctgcagggcgagatccactgcggcaccaacgtgcggaggaagcccttccccttcaagtggtggaacatggtgccctag

SEQ ID NO: 163473 - DNA, 663 bp, Artificial Sequence
  Description of Artificial Sequence: Synthetic coding sequence
atggcccgggctgtgaggaacttcctgaaggcccagcaggtgcaggcccctgtggagctgtacagcgactggctgtctgtgggccacgtggatgagttcctgacctttgtgcccaccagtgaccagaagggcttccggctgctgctggccagccccagcgcctgcctgaagctgttccaggagaagaaggaggagggctatggagaggccgcccagtttgatggcctgaagcaccaggccaagaggagcatcaatgagatgctggccgacagacacctgcagagggacaacctgcacgcccagaagtgcatcgactggaacagaaatgtgctgaagcgggagctgggcctggccgagagtgacatcgtggacatcccccagctgttcttcctgaagaacttctacgccgaggccttcttcccagacatggtgaacatggtggtgctgggcaagtacctgggcatccccaagccctacggccccatcatcaatggccgctgctgcctggaggagaaggtgcagagcctgctggagcccctgggcctgcactgcatcttcattgatgactacctgagctaccacgagctgcagggcgagatccactgcggcaccaacgtgcggaggaagcccttccccttcaagtggtggaacatggtgccctag

SEQ ID NO: 163474 - DNA, 1314 bp, Artificial Sequence
  Description of Artificial Sequence: Synthetic coding sequence
atgctgcgggagaggacagtgcggctgcagtatggcagccgggtggaggccgtgtatgtgctgggcacctacctgtggacagatgtgtacagcgctgccccagctggggcccagaccttcagcctgaagcacagcgagcacgtgtgggtggaggtggtgagagatggagaggccgaggaggtggccaccaacgggaagcagcgctggctgctgagccccagcaccaccctgcgggtgaccatgagccaggccagcacagaggccagcagtgacaaggtgacagtgaactactatgatgaggagggcagcatccccatcgaccaggccggcctcttcctgacagccatcgagatcagcctggatgtggatgctgacagagatggagtggtggagaagaacaaccccaagaaggcctcctggacctggggccctgagggccagggcgccatcctgctggtgaactgtgaccgggagaccccctggctgcccaaggaggactgcagagatgagaaggtgtacagcaaggaggacctgaaggacatgagccagatgatcctgcggaccaagggccctgaccggctgcctgctggctatgagatcgtgctgtacatctccatgtctgacagcgacaaggtgggcgtcttctacgtggagaaccccttcttcggccagcgctacatccacatcctgggccgcaggaagctgtaccacgtggtgaagtacacaggaggcagcgctgagctgctcttctttgtggagggcctgtgcttcccagatgagggcttcagcggcctggtgtccatccacgtgtccctgctggagtacatggcccaggacatccccctgacccccatcttcacagacaccgtcatcttccgcatcgccccctggatcatgacccccaacatcctgccccctgtgtctgtgtttgtgtgctgcatgaaggacaactacctgttcctgaaggaggtgaagaacctggtggagaagaccaactgtgagctgaaggtgtgcttccagtacctgaacagaggagaccgctggatccaggatgaaattgaatttggctacatcgaggccccccacaagggcttccctgtggtgctggacagccccagagatggcaacctgaaggacttccctgtgaaggagctgctgggccctgactttggctacgtgacccgggagcccctgtttgaatctgtgaccagcctggacagctttggaaacctggaggtgtccccacctgtgacagtgaatggcaagacctaccccctgggccgcatcctgattggcagcagcttccccctgtag

SEQ ID NO: 163475 - DNA, 1998 bp, Artificial Sequence
  Description of Artificial Sequence: Synthetic coding sequence
atgctgcgggagaggacagtgcggctgcagtatggcagccgggtggaggccgtgtatgtgctgggcacctacctgtggacagatgtgtacagcgctgccccagctggggcccagaccttcagcctgaagcacagcgagcacgtgtgggtggaggtggtgagagatggagaggccgaggaggtggccaccaacgggaagcagcgctggctgctgagccccagcaccaccctgcgggtgaccatgagccaggccagcacagaggccagcagtgacaaggtgacagtgaactactatgatgaggagggcagcatccccatcgaccaggccggcctcttcctgacagccatcgagatcagcctggatgtggatgctgacagagatggagtggtggagaagaacaaccccaagaaggcctcctggacctggggccctgagggccagggcgccatcctgctggtgaactgtgaccgggagaccccctggctgcccaaggaggactgcagagatgagaaggtgtacagcaaggaggacctgaaggacatgagccagatgatcctgcggaccaagggccctgaccggctgcctgctggctatgagatcgtgctgtacatctccatgtctgacagcgacaaggtgggcgtcttctacgtggagaaccccttcttcggccagcgctacatccacatcctgggccgcaggaagctgtaccacgtggtgaagtacacaggaggcagcgctgagctgctcttctttgtggagggcctgtgcttcccagatgagggcttcagcggcctggtgtccatccacgtgtccctgctggagtacatggcccaggacatccccctgacccccatcttcacagacaccgtcatcttccgcatcgccccctggatcatgacccccaacatcctgccccctgtgtctgtgtttgtgtgctgcatgaaggacaactacctgttcctgaaggaggtgaagaacctggtggagaagaccaactgtgagctgaaggtgtgcttccagtacctgaacagaggagaccgctggatccaggatgaaattgaatttggctacatcgaggccccccacaagggcttccctgtggtgctggacagccccagagatggcaacctgaaggacttccctgtgaaggagctgctgggccctgactttggctacgtgacccgggagcccctgtttgaatctgtgaccagcctggacagctttggaaacctggaggtgtccccacctgtgacagtgaatggcaagacctaccccctgggccgcatcctgattggcagcagcttccccctgagcggcggccgcaggatgaccaaggtggtgcgggacttcctgaaggcccagcaggtgcaggcccctgtggagctgtacagcgactggctgactgtgggccacgtggatgagttcatgagctttgtgcccatccctggcaccaagaagttcctgctgctgatggccagcaccagcgcctgctacaagctgttccgggagaagcagaaggatggccatggagaggccatcatgttcaagggcctgggcggcatgagcagcaagaggatcaccatcaacaagatcctgagcaatgaaagcctggtgcaggagaacctgtacttccagcgctgcctggactggaacagagacatcctgaagaaggagctgggcctgacagagcaggacatcatcgacctgcctgccctcttcaagatggatgaggaccaccgggcccgggccttcttccccaacatggtgaacatgattgtgctggacaaggacctgggcatccccaagcccttcggcccccaggtggaggaggagtgctgcctggagatgcacgtgcggggcctgctggagcccctgggcctggagtgcaccttcattgatgacatcagcgcctaccacaagttcctgggggaggtgcactgcggcaccaacgtgcggaggaagcccttcaccttcaagtggtggcacatggtgccctag

SEQ ID NO: 163476 - DNA, 1650 bp, Artificial Sequence
  Description of Artificial Sequence: Synthetic coding sequence
atgctgcgggagaggacagtgcggctgcagtatggcagccgggtggaggccgtgtatgtgctgggcacctacctgtggacagatgtgtacagcgctgccccagctggggcccagaccttcagcctgaagcacagcgagcacgtgtgggtggaggtggtgagagatggagaggccgaggaggtggccaccaacgggaagcagcgctggctgctgagccccagcaccaccctgcgggtgaccatgagccaggccagcacagaggccagcagtgacaaggtgacagtgaactactatgatgaggagggcagcatccccatcgaccaggccggcctcttcctgacagccatcgagatcagcctggatgtggatgctgacagagatggagtggtggagaagaacaaccccaagaagaccaggagcagcgccaatgccatcagcacctcctgggccggcggcagcagcaccatgtggagcagcaccagggtggcccccaggagctgctgcagctcctggaaggcctctgtgagccccacccgggccagccaggcctggagccccagcatgtctgcctgctggagcacctggcccagcatgaaggacaactacctgttcctgaaggaggtgaagaacctggtggagaagaccaactgtgagctgaaggtgtgcttccagtacctgaacagaggagaccgctggatccaggatgaaattgaatttggctacatcgaggccccccacaagggcttccctgtggtgctggacagccccagagatggcaacctgaaggacttccctgtgaaggagctgctgggccctgactttggctacgtgacccgggagcccctgtttgaatctgtgaccagcctggacagctttggaaacctggaggtgtccccacctgtgacagtgaatggcaagacctaccccctgggccgcatcctgattggcagcagcttccccctgagcggcggccgcaggatgaccaaggtggtgcgggacttcctgaaggcccagcaggtgcaggcccctgtggagctgtacagcgactggctgactgtgggccacgtggatgagttcatgagctttgtgcccatccctggcaccaagaagttcctgctgctgatggccagcaccagcgcctgctacaagctgttccgggagaagcagaaggatggccatggagaggccatcatgttcaagggcctgggcggcatgagcagcaagaggatcaccatcaacaagatcctgagcaatgaaagcctggtgcaggagaacctgtacttccagcgctgcctggactggaacagagacatcctgaagaaggagctgggcctgacagagcaggacatcatcgacctgcctgccctcttcaagatggatgaggaccaccgggcccgggccttcttccccaacatggtgaacatgattgtgctggacaaggacctgggcatccccaagcccttcggcccccaggtggaggaggagtgctgcctggagatgcacgtgcggggcctgctggagcccctgggcctggagtgcaccttcattgatgacatcagcgcctaccacaagttcctgggggaggtgcactgcggcaccaacgtgcggaggaagcccttcaccttcaagtggtggcacatggtgccctag

SEQ ID NO: 163477 - DNA, 1995 bp, Artificial Sequence
  Description of Artificial Sequence: Synthetic coding sequence
atgagcctgcagagaattgtgcgggtgtccctggagcaccccaccagcgctgtgtgtgtggccggcgtggagaccctggtggacatctacggctctgtgcctgagggcacagagatgtttgaggtgtatggcaccccaggagtggacatctacatcagccccaacatggagcggggccgggagagagctgacacccggcgctggaggtttgatgccaccctggagatcatcgtggtgatgaacagccccagcaatgacctgaatgacagccacgtgcagatctcctaccacagcagccatgagcccctgcccctggcctatgctgtgctgtacctgacctgtgtggacatcagcctggactgtgacctgaactgtgagggccggcaggacaggaactttgtggacaagaggcagtgggtgtggggccccagcggctacggcggcatcctgctggtgaactgtgacagagatgaccccagctgtgatgtgcaggacaactgtgaccagcacgtgcactgcctgcaggacctggaggacatgtctgtgatggtgctgcggacccagggccctgctgccctgtttgatgaccacaagctggtgctgcacaccagcagctatgatgccaagagggcccaggtgttccacatctgtggcccagaagatgtgtgtgaggcctaccgccacgtgctgggccaggacaaggtgtcctatgaggtgccccggctgcatggagatgaggagcgcttctttgtggagggcctgtccttcccagatgctggcttcaccggcctcatctccttccacgtgaccctgctggatgacagcaatgaagacttcagcgccagccccatcttcacagacacagtggtgttccgggtggccccctggatcatgacccccagcaccctgccccccctggaggtgtatgtgtgccgggtgaggaacaacacctgctttgtggatgctgtggccgagctggccaggaaggccggctgcaagctgaccatctgcccccaggctgaaaatagaaatgaccgctggatccaggatgagatggagctgggctacgtgcaggccccccacaagaccctgcctgtggtgtttgacagccccagaaatggagagctgcaggacttcccctacaagaggatcctgggccctgactttggctacgtgacccgggagccccgggacagatctgtgtctggcctggacagctttggaaacctggaggtgagcccccctgtggtggccaacgggaaggagtaccccctgggccgcatcctgattggaggcaacctgcccggcagcagcggccggcgggtgacccaggtggtgcgggacttcctgcacgcccagaaggtgcagccccctgtggagctgtttgtggactggctggccgtgggccacgtggatgagttcctgagctttgtgcctgccccagatggcaagggcttcaggatgctgctggccagccctggggcctgcttcaagctgttccaggagaagcagaagtgtggccacggccgggccctgctcttccagggcgtggtggatgatgagcaggtgaagaccatcagcatcaaccaggtgctgagcaacaaggacctgatcaactacaacaagtttgtgcagagctgcatcgactggaaccgggaggtgctgaagcgggagctgggcctggctgaatgtgacatcatcgacatcccccagctgttcaagacagagaggaagaaggccacagccttcttcccagacctggtgaacatgctggtgctgggcaagcacctgggcatccccaagcccttcggccccatcatcaatggctgctgctgcctggaggagaaggtgcgcagcctgctggagcccctgggcctgcactgcaccttcattgatgacttcaccccctaccacatgctgcatggagaggtgcactgcggcaccaacgtgtgcaggaagcccttctccttcaagtggtggaacatggtgccctag

SEQ ID NO: 163478 - DNA, 645 bp, Artificial Sequence
  Description of Artificial Sequence: Synthetic coding sequence
atggcccagggcaccctcatccgggtgaccccagagcagcccacccatgctgtgtgtgtgctgggcaccctgacccagctggacatctgcagcagcgcccctgaggactgcaccagcttcagcatcaatgccagccctggggtggtggtggacatcgcccacggccccccagccaagaagaagagcacaggcagcagcacctggcccctggaccccggggtggaggtgaccctgaccatgaaggtggccagcggcagcactggagaccagaaggtgcagatctcctactacggccccaagaccccacctgtgaaggccctgctgtacctgactggagtggatggagtgagcccctgccaccctggctggagcgccatgcatgacctggcccactgcaacctgcggctgcaggtgcaggccatcctgtgcttctctgtgcccagctcctggaccaccggggcctgccaccacgcctggctgatctttgtgttcctggtggagatggagttccaccacgtgggccaggccggcctggagctgctgaccagcggggacctgcctgccagcggcagccagagcgcccgcatcaccggcatgaaccactgtgcccggcccagcatcttcctgatcctgaagtacctgtag

SEQ ID NO: 163479 - DNA, 1992 bp, Artificial Sequence
  Description of Artificial Sequence: Synthetic coding sequence
atggcccagggcaccctcatccgggtgaccccagagcagcccacccatgctgtgtgtgtgctgggcaccctgacccagctggacatctgcagcagcgcccctgaggactgcaccagcttcagcatcaatgccagccctggggtggtggtggacatcgcccacggccccccagccaagaagaagagcacaggcagcagcacctggcccctggaccccggggtggaggtgaccctgaccatgaaggtggccagcggcagcactggagaccagaaggtgcagatctcctactacggccccaagaccccacctgtgaaggccctgctgtacctgactggagtggagatcagcctgtgtgccgacatcaccaggacaggcaaggtgaagcccaccagggctgtgaaggaccagaggacctggacctggggcccctgtggccagggcgccatcctgctggtgaactgtgaccgggacaacctggagagcagcgccatggactgtgaagatgatgaggtgctggacagcgaggacctgcaggacatgagcctgatgaccctgagcaccaagacccccaaggacttcttcaccaaccacaccctggtgctgcacgtggcccggtctgagatggacaaggtgcgggtcttccaggccacccggggcaagctgagcagcaagtgcagcgtggtgctgggccccaagtggcccagccactacctgatggtgcctgggggcaagcacaacatggacttctacgtggaggccctggccttcccagacacagacttccctggcctcatcaccctgaccatcagcctgctggacaccagcaacctggagctgcctgaggccgtggtgttccaggacagcgtggtgttccgggtggccccctggatcatgacccccaacacccagcccccccaggaggtgtatgcctgcagcatctttgaaaatgaagacttcctgaagtctgtgaccaccctggccatgaaggccaagtgcaagctgaccatctgcccagaggaggagaacatggatgaccagtggatgcaggatgagatggagatcggctacatccaggccccccacaagaccctgcctgtggtgtttgacagccccaggaacagaggcctgaaggagttccccatcaagagggtgatgggccctgactttggctacgtgacccggggcccccagacaggaggcatcagcggcctggacagctttggaaacctggaggtgagcccccctgtgacagtgcggggcaaggagtaccccctgggccgcatcctgtttggagacagctgctaccccagcaatgacagccggcagatgcaccaggccctgcaggacttcctgagcgcccagcaggtgcaggcccctgtgaagctgtacagcgactggctgtctgtgggccacgtggatgagttcctgagctttgtgcctgccccagacaggaagggcttccggctgctgctggccagccccaggagctgctacaagctgttccaggagcagcagaatgaaggacatggagaggccctgctgtttgagggcatcaagaagaagaagcagcagaagatcaagaacatcctgagcaacaagaccctgcgggagcacaacagctttgtggagcgctgcatcgactggaaccgggagctgctgaagcgggagctgggcctggccgagagtgacatcatcgacatcccccagctgttcaagctgaaggagttcagcaaggccgaggccttcttccccaacatggtgaacatgctggtgctgggcaagcacctgggcatccccaagcccttcggccctgtgatcaatggccgctgctgcctggaggagaaggtgtgcagcctgctggagcccctgggcctgcagtgcaccttcatcaatgacttcttcacctaccacatccgccacggggaggtgcactgcggcaccaacgtgcggaggaagcccttctccttcaagtggtggaacatggtgccctag

SEQ ID NO: 163480 - DNA, 384 bp, Artificial Sequence
  Description of Artificial Sequence: Synthetic coding sequence
atggcccagggcaccctcatccgggtgaccccagagcagcccacccatgctgtgtgtgtgctgggcaccctgacccagctggacatctgcagcagcgcccctgaggactgcaccagcttcagcatcaatgccagccctggggtggtggtggacatcgcccacggccccccagccaagaagaagagcacaggcagcagcacctggcccctggaccccggggtggaggtgaccctgaccatgaaggtggccagcggcagcactggagaccagaaggtgcagatctcctactacggccccaagaccccacctgtgaaggccctgctgtacctgactggagtggatggagtgagcccctgccaccctggctggagcgccatggcctag

SEQ ID NO: 163481 - DNA, 2628 bp, Artificial Sequence
  Description of Artificial Sequence: Synthetic coding sequence
atggacacagtgcaccacatgctgctgtttggctgcaacatgcccagcagcacaggcagctactggttctgtgatgagggcacctgcacagacaaggccaacatcctgtatgcctgggccagaaatgccccacccacccggctgcccaagggcgtgggcttccgggtgggcggggagaccggcagcaagtactttgtgctgcaggtgcactatggagacatcagcgccttccgggacaacaacaaggactgcagcggcgtgtccctgcacctgacccggctgccccagcccctgattgctggcatgtacctgatgatgtctgtggacaccgtcatcccagctggggagaaggtggtgaacagcgacatcagctgccactacaagaactaccccatgcacgtgtttgcctacagagtgcacacccaccacctgggcaaggtggtgtctggctacagagtgagaaatggccagtggaccctgattggccggcagagcccccagctgccccaggccttctaccctgtgggccaccctgtggatgtgtcctttggagacctgctggccgcccgctgtgtgttcaccggggagggccgcacagaggccacccacatcggcggcaccagcagtgatgagatgtgcaacctgtacatcatgtactacatggaggccaagcatgctgtgtccttcatgacctgcacccagaatgtggccccagacatgttccgcaccatccccccagaggccaacatccccatccctgtgaagagtgacatggtgatgatgcatgagcaccacaaggagacagagtacaaggacaagatccccctgctgcagcagcccaagcgggaggaggaggaggtgctggaccagggcgacttctacagcctgctgagcaagctgctgggggagagagaagatgtggtgcacgtgcacaagtacaaccccacagagaaggccgagagcgagagtgacctggtggccgagatcgccaacgtggtgcagaagaaggacctgggccgcagtgatgcccgggagggcgctgagcacgagagaggaaatgccatcctggtgcgggaccgcatccacaagttccaccggctggtgtccaccctgcggcccccagagagcagggtcttcagcctgcagcagcccccacctggagagggcacctgggagcctgagcacactggagacttccacatggaggaggccctggactggccaggagtgtacctgctgcccggccaggtgtctggagtggccctggaccccaagaacaacctggtgatcttccacagaggagaccacgtgtgggatggcaacagctttgacagcaagtttgtgtaccagcagatcggcctgggccccatcgaggaggacaccatcctggtgattgaccccaacaatgctgctgtgctgcagagcagcggcaagaacctcttctacctgccccacggcctgagcattgacaaggatggcaactactgggtgacagatgtggccctgcaccaggtgttcaagctggaccccaacaacaaggagggccctgtgctgatcctgggccgctccatgcagcccggcagtgaccagaaccacttctgccagcccacagatgtggccgtggaccccggcactggagccatctacgtgtctgatggctactgcaacagcagaattgtgcagttcagccccagcggcaagttcatcacccagtggggcgaggagagcagcggcagcagccccctgcccggccagttcaccgtgccccacagcctggccctggtgcccctgctgggccagctgtgtgtggccgacagagaaaatggccgcatccagtgcttcaagacagacaccaaggagtttgtgcgggagatcaagcacagcagctttggaagaaatgtgtttgccatctcctacatccctggcctgctgtttgctgtgaatggcaagccccactttggagaccaggagcctgtgcagggctttgtgatgaacttcagcaatggagagatcatcgacatcttcaagcctgtgaggaagcactttgacatgcctcatgacatcgtggcctctgaagatggcaccgtgtacatcggagatgcccacaccaacacagtgtggaagttcaccctgacagagaagctggagcacaggtctgtgaagaaggccggcatcgaggtgcaggagatcaaggccgaggccgtggtggagaccaagatggagaacaagcccaccagcagcgagctgcagaagatgcaggagaagcagaagctgatcaaggagcccggcagcggcgtgcctgtggtgctgatcaccaccctgctggtgattcctgtggtggtgctgctggccatcgccatcttcatccgctggaagaagagccgggcctttggagacagcgagcacaagctggagaccagcagcggccgggtgctgggccgcttccggggcaagggcagcggcggcctgaacctgggcaacttctttgccagcaggaagggctacagcaggaagggctttgaccggctgagcacagagggcagtgaccaggagaaggaggatgatggcagcgagagcgaggaggagtacagcgcccccctgcctgccctggcccccagcagcagctag
